(12) United States Patent
Emmanuel et al.

(10) Patent No.: US 9,328,353 B2
(45) Date of Patent: May 3, 2016

(54) ISOLATED POLYNUCLEOTIDES AND POLYPEPTIDES FOR INCREASING PLANT YIELD AND/OR AGRICULTURAL CHARACTERISTICS

(75) Inventors: Eyal Emmanuel, Rechovot (IL); Hagai Karchi, Moshav Sitriya (IL)

(73) Assignee: Evogene Ltd., Rehovot (IL)

(*) Notice: Subject to any disclaimer, the term of this patent is extended or adjusted under 35 U.S.C. 154(b) by 419 days.

(21) Appl. No.: 13/695,094

(22) PCT Filed: Apr. 27, 2011

(86) PCT No.: PCT/IB2011/051843
§ 371 (c)(1),
(2), (4) Date: Oct. 29, 2012

(87) PCT Pub. No.: WO2011/135527
PCT Pub. Date: Nov. 3, 2011

(65) Prior Publication Data
US 2013/0125258 A1  May 16, 2013

Related U.S. Application Data

(60) Provisional application No. 61/328,692, filed on Apr. 28, 2010, provisional application No. 61/378,003, filed on Aug. 30, 2010, provisional application No. 61/405,260, filed on Oct. 21, 2010, provisional application No. 61/437,715, filed on Jan. 31, 2011.

(51) Int. Cl.
*C12N 15/82* (2006.01)
*C07K 14/415* (2006.01)

(52) U.S. Cl.
CPC .......... *C12N 15/8271* (2013.01); *C07K 14/415* (2013.01); *C12N 15/8261* (2013.01)

(58) Field of Classification Search
None
See application file for complete search history.

(56) References Cited

U.S. PATENT DOCUMENTS

| | | |
|---|---|---|
| 3,791,932 A | 2/1974 | Schuurs et al. |
| 3,839,153 A | 10/1974 | Schuurs et al. |
| 3,850,578 A | 11/1974 | McConnell |
| 3,850,752 A | 11/1974 | Schuurs et al. |
| 3,853,987 A | 12/1974 | Dreyer |
| 3,867,517 A | 2/1975 | Ling |
| 3,879,262 A | 4/1975 | Schuurs et al. |
| 3,901,654 A | 8/1975 | Gross |
| 3,935,074 A | 1/1976 | Rubenstein et al. |
| 3,984,533 A | 10/1976 | Uzgiris |
| 3,996,345 A | 12/1976 | Ullman et al. |
| 4,034,074 A | 7/1977 | Miles |
| 4,098,876 A | 7/1978 | Piasio et al. |
| 4,666,828 A | 5/1987 | Gusella |
| 4,683,202 A | 7/1987 | Mullis |
| 4,801,531 A | 1/1989 | Frossard |
| 4,879,219 A | 11/1989 | Wands et al. |
| 4,943,674 A | 7/1990 | Houck et al. |
| 4,945,050 A | 7/1990 | Sanford et al. |
| 5,011,771 A | 4/1991 | Bellet et al. |
| 5,187,267 A | 2/1993 | Comai et al. |
| 5,192,659 A | 3/1993 | Simons |
| 5,268,463 A | 12/1993 | Jefferson |
| 5,272,057 A | 12/1993 | Smulson et al. |
| 5,281,521 A | 1/1994 | Trojanowski et al. |
| 5,296,462 A | 3/1994 | Thomashow |
| 5,316,931 A | 5/1994 | Donson et al. |
| 5,356,816 A | 10/1994 | Thomashow |
| 5,399,680 A | 3/1995 | Zhu et al. |
| 5,464,765 A | 11/1995 | Coffee et al. |
| 5,466,785 A | 11/1995 | De Framond |
| 5,495,070 A | 2/1996 | John |
| 5,504,200 A | 4/1996 | Hall et al. |
| 5,521,708 A | 5/1996 | Beretta |
| 5,569,597 A | 10/1996 | Grimsley et al. |
| 5,597,718 A | 1/1997 | John et al. |
| 5,604,121 A | 2/1997 | Hilder et al. |
| 5,608,142 A | 3/1997 | Barton et al. |
| 5,608,144 A | 3/1997 | Baden et al. |
| 5,608,149 A | 3/1997 | Barry et al. |
| 5,608,152 A | 3/1997 | Kridl et al. |
| 5,620,882 A | 4/1997 | John |
| 5,659,026 A | 8/1997 | Baszczynski et al. |
| 5,693,507 A | 12/1997 | Daniell et al. |
| 5,859,330 A | 1/1999 | Bestwick et al. |

(Continued)

FOREIGN PATENT DOCUMENTS

| | | |
|---|---|---|
| AU | 2005229157 | 10/2005 |
| AU | 2005234725 | 12/2005 |

(Continued)

OTHER PUBLICATIONS

Guo et al., 2004, Proceedings of the National Academy of Sciences USA 101: 9205-9210.*
Paterson et al., 2009, Nature 547: 551-556.*
GenBank Accession No. XP_002444756.1.*
Official Action Dated Jul. 26, 2013 From the US Patent and Trademark Office Re. U.S. Appl. No. 13/254,183.
Matsumoto et al. "Os11g0162200 [Oryza Sativa Japonica Group]", Direct GenBank Sequence Submission, GenBank: BAF27672.1, GenBank Accession No. BAF27672, Aug. 11, 2012.
Communication Pursuant to Article 94(3) EPC Dated Aug. 2, 2013 From the European Patent Office Re. Application No. 10194223.3.

(Continued)

*Primary Examiner* — David T Fox
*Assistant Examiner* — Bratislav Stankovic

(57) ABSTRACT

Provided are isolated polynucleotides which comprise a nucleic acid sequence at least 80% identical to SEQ ID NO: 321, 1-320, 322-480, 793-2945 or 2946; isolated polypeptides which comprise an amino acid sequence at least 80% homologous to SEQ ID NO: 517, 481-516, 518-792, 2947-4662 or 4663, nucleic acid constructs comprising same, transgenic cells and plants expressing same and methods of using same for increasing yield, biomass, growth rate, vigor, oil content, fiber yield, fiber quality, abiotic stress tolerance, and/or nitrogen use efficiency of a plant.

4 Claims, 8 Drawing Sheets

(56) References Cited

U.S. PATENT DOCUMENTS

| | | |
|---|---|---|
| 5,880,100 A | 3/1999 | Ogiso et al. |
| 5,981,834 A | 11/1999 | John et al. |
| 6,080,914 A | 6/2000 | Conner |
| 6,084,153 A | 7/2000 | Good et al. |
| 6,313,375 B1 | 11/2001 | Jung et al. |
| 6,313,376 B1 | 11/2001 | Jung et al. |
| 6,359,196 B1 | 3/2002 | Lok et al. |
| 6,392,122 B1 | 5/2002 | Clendennen et al. |
| 6,403,862 B1 | 6/2002 | Jiao et al. |
| 6,472,588 B1 | 10/2002 | Haigler et al. |
| 6,670,528 B1 | 12/2003 | Shinozaki et al. |
| 6,720,477 B2 | 4/2004 | Da Costa e Silva et al. |
| 7,214,786 B2 | 5/2007 | Kovalic et al. |
| 7,554,007 B2 | 6/2009 | Ronen et al. |
| 7,812,218 B2 | 10/2010 | Ronen et al. |
| 7,910,800 B2 | 3/2011 | Karchi et al. |
| 8,049,069 B2 | 11/2011 | Wu et al. |
| 8,168,857 B2 | 5/2012 | Ayal et al. |
| 8,426,682 B2 | 4/2013 | Ronen et al. |
| 2002/0046419 A1 | 4/2002 | Choo et al. |
| 2002/0049999 A1 | 4/2002 | Allen et al. |
| 2002/0148007 A1 | 10/2002 | Jiao et al. |
| 2002/0160378 A1 | 10/2002 | Harper et al. |
| 2002/0170088 A1 | 11/2002 | Wilkins |
| 2003/0005485 A1 | 1/2003 | Ohlrogge et al. |
| 2003/0074697 A1 | 4/2003 | Allen et al. |
| 2003/0084485 A1 | 5/2003 | Zhu et al. |
| 2003/0162294 A1 | 8/2003 | Verbruggen |
| 2003/0163839 A1 | 8/2003 | Helentjaris et al. |
| 2003/0233670 A1 | 12/2003 | Edgerton et al. |
| 2004/0006794 A1 | 1/2004 | Wilkins |
| 2004/0019927 A1 | 1/2004 | Sherman et al. |
| 2004/0031072 A1 | 2/2004 | La Rosa et al. |
| 2004/0034888 A1* | 2/2004 | Liu et al. ............... 800/289 |
| 2004/0123343 A1 | 6/2004 | La Rosa et al. |
| 2004/0172684 A1 | 9/2004 | Kovalic et al. |
| 2004/0181830 A1 | 9/2004 | Kovalic et al. |
| 2005/0108791 A1 | 5/2005 | Edgerton |
| 2006/0048240 A1 | 3/2006 | Alexandrov et al. |
| 2006/0101543 A1 | 5/2006 | Somerville et al. |
| 2006/0107345 A1 | 5/2006 | Alexandrov et al. |
| 2006/0123505 A1 | 6/2006 | Kikuchi et al. |
| 2006/0123516 A1 | 6/2006 | Ronen et al. |
| 2006/0137043 A1 | 6/2006 | Puzio et al. |
| 2006/0143729 A1 | 6/2006 | Alexandrov et al. |
| 2006/0150283 A1* | 7/2006 | Alexandrov et al. ...... 800/288 |
| 2006/0168684 A1 | 7/2006 | Renz et al. |
| 2006/0174373 A1 | 8/2006 | Gipmans et al. |
| 2006/0179511 A1 | 8/2006 | Chomet et al. |
| 2006/0183137 A1 | 8/2006 | Harper et al. |
| 2006/0195943 A1 | 8/2006 | Feldmann et al. |
| 2006/0206961 A1 | 9/2006 | Cirpus et al. |
| 2006/0260002 A1 | 11/2006 | Ronen et al. |
| 2006/0288451 A1 | 12/2006 | Val et al. |
| 2007/0006345 A1 | 1/2007 | Alexandrov et al. |
| 2007/0006346 A1 | 1/2007 | Alexandrov et al. |
| 2007/0044171 A1* | 2/2007 | Kovalic et al. ............ 800/278 |
| 2007/0044172 A1 | 2/2007 | Schneeberger et al. |
| 2007/0061916 A1 | 3/2007 | Kovalic et al. |
| 2007/0124833 A1 | 5/2007 | Abad et al. |
| 2007/0169219 A1 | 7/2007 | Nadzan et al. |
| 2007/0214517 A1 | 9/2007 | Alexandrov et al. |
| 2007/0261130 A1 | 11/2007 | Lightner et al. |
| 2007/0283460 A9* | 12/2007 | Liu et al. ............... 800/289 |
| 2008/0072340 A1 | 3/2008 | Troukhan et al. |
| 2008/0076179 A1 | 3/2008 | Hartel et al. |
| 2008/0148432 A1 | 6/2008 | Abad |
| 2008/0197120 A1 | 8/2008 | Beck et al. |
| 2008/0301839 A1 | 12/2008 | Ravanello |
| 2009/0087878 A9* | 4/2009 | La Rosa et al. ........... 435/69.1 |
| 2009/0089898 A1 | 4/2009 | Karchi et al. |
| 2009/0093620 A1 | 4/2009 | Kovalic et al. |
| 2009/0094717 A1 | 4/2009 | Troukhan et al. |
| 2009/0126042 A1 | 5/2009 | Ronen et al. |
| 2009/0144848 A1 | 6/2009 | Kovalic et al. |
| 2009/0260109 A1 | 10/2009 | Ronen et al. |
| 2009/0293154 A1 | 11/2009 | Yelin et al. |
| 2010/0037352 A1 | 2/2010 | Alexandrov et al. |
| 2010/0154077 A1 | 6/2010 | Emmanuel et al. |
| 2010/0319088 A1 | 12/2010 | Ronen et al. |
| 2011/0080674 A1 | 4/2011 | Durand |
| 2011/0214206 A1 | 9/2011 | La Rosa et al. |
| 2012/0060234 A1 | 3/2012 | Emmanuel et al. |
| 2012/0084885 A1 | 4/2012 | Alexandrov et al. |
| 2012/0096587 A1 | 4/2012 | Vinocur et al. |
| 2012/0180164 A1 | 7/2012 | Ayal et al. |
| 2012/0222169 A1 | 8/2012 | Ronen et al. |
| 2012/0297504 A1 | 11/2012 | Granevitze et al. |
| 2013/0167265 A1 | 6/2013 | Panik et al. |
| 2013/0219562 A1 | 8/2013 | Ronen et al. |
| 2013/0239255 A1 | 9/2013 | Ronen et al. |
| 2013/0276169 A1 | 10/2013 | Poraty et al. |
| 2013/0291223 A1 | 10/2013 | Emmanuel et al. |

FOREIGN PATENT DOCUMENTS

| | | |
|---|---|---|
| CN | 1823168 | 8/2006 |
| EP | 0834566 | 4/1998 |
| EP | 0905242 | 3/1999 |
| EP | 1033405 | 9/2000 |
| EP | 1225231 | 7/2002 |
| EP | 1945021 | 7/2008 |
| EP | 2154946 | 2/2010 |
| JP | 2005-052114 | 3/2005 |
| JP | 2005-185101 | 7/2005 |
| RU | 2350653 | 3/2009 |
| WO | WO 93/06710 | 4/1993 |
| WO | WO 93/07278 | 4/1993 |
| WO | WO 94/17194 | 8/1994 |
| WO | WO 95/08914 | 4/1995 |
| WO | WO 96/26639 | 9/1996 |
| WO | WO 96/40924 | 12/1996 |
| WO | WO 01/17333 | 3/2001 |
| WO | WO 01/40250 | 6/2001 |
| WO | WO 02/16655 | 2/2002 |
| WO | WO 02/45485 | 6/2002 |
| WO | WO 02/079403 | 10/2002 |
| WO | WO 02/090557 | 11/2002 |
| WO | WO 03/020025 | 3/2003 |
| WO | WO 03/087313 | 10/2003 |
| WO | WO 03/098186 | 11/2003 |
| WO | WO 2004/035798 | 4/2004 |
| WO | WO 2004/053055 | 6/2004 |
| WO | WO 2004/058963 | 7/2004 |
| WO | WO 2004/081173 | 9/2004 |
| WO | WO 2004/092367 | 10/2004 |
| WO | WO 2004/104162 | 12/2004 |
| WO | WO 2004/111183 | 12/2004 |
| WO | WO 2005/0121364 | 12/2004 |
| WO | WO 2005/084331 | 9/2005 |
| WO | WO 2005/095614 | 10/2005 |
| WO | WO 2005/108422 | 11/2005 |
| WO | WO 2005/121364 | 12/2005 |
| WO | WO 2006/138012 | 12/2006 |
| WO | WO 2007/020638 | 2/2007 |
| WO | WO 2007/049275 | 5/2007 |
| WO | WO 2007/110314 | 10/2007 |
| WO | WO 2007/113237 | 10/2007 |
| WO | WO 2008/069878 | 6/2008 |
| WO | WO 2008/075364 | 6/2008 |
| WO | WO 2008/122980 | 10/2008 |
| WO | WO 2009/009142 | 1/2009 |
| WO | WO 2009/013750 | 1/2009 |
| WO | WO 2009/083958 | 7/2009 |
| WO | WO 2009/105492 | 8/2009 |
| WO | WO 2009/134339 | 11/2009 |
| WO | WO 2009/141824 | 11/2009 |
| WO | WO 2009/144311 | 12/2009 |
| WO | WO 2010/020941 | 2/2010 |
| WO | WO 2010/049897 | 5/2010 |
| WO | WO 2010/076756 | 7/2010 |
| WO | WO 2010/100595 | 9/2010 |
| WO | WO 2010/143138 | 12/2010 |
| WO | WO 2011/015985 | 2/2011 |

(56) References Cited

FOREIGN PATENT DOCUMENTS

| WO | WO 2011/080674 | 7/2011 |
|----|----------------|--------|
| WO | WO 2011/135527 | 11/2011 |
| WO | WO 2012/028993 | 3/2012 |
| WO | WO 2012/085862 | 6/2012 |
| WO | WO 2012/150598 | 11/2012 |
| WO | WO 2013/027223 | 2/2013 |
| WO | WO 2013/128448 | 9/2013 |
| WO | WO 2013/179211 | 12/2013 |

OTHER PUBLICATIONS

Examination Report Dated Jul. 9, 2013 From the Instituto Mexicano de la Propiedad Industrial Re. Application No. MX/a/2010/007169 and Its Translation Into English.
Examination Report Dated Jun. 26, 2013 From the Instituto Mexicano de la Propiedad Industrial Re. Application No. MX/a/2010/000975 and Its Translation Into English.
Official Action Dated Aug. 12, 2013 From the US Patent and Trademark Office Re. U.S. Appl. No. 12/834,106.
Substantive Examination Report Dated Jul. 31, 2013 From the Intellectual Property Office of The Philippines, Bureau of Patents Re. Application No. 1/2009/501930.
Examination Report Dated Jun. 7, 2013 From the Instituto Mexicano de la Propiedad Industrial Re. Application No. MX/a/2011/003575 and Its Translation Into English.
Examination Report Dated Jun. 20, 2013 From the Instituto Mexicano de la Propiedad Industrial Re. Application No. MX/a/2011/007294 and Its Translation Into English.
International Search Report and the Written Opinion Dated Sep. 1, 2013 From the International Searching Authority Re. Application No. PCT/IB2013/054374.
Bennetzen et al. "Setaria Italica Strain Yugul SETITScaffold_2_Cont751, Whole Genome Shotgun Sequence", Database NCBI [Online], GenBank Accession No. AGNK01000751, May 11, 2012.
Briggs et al. "Poly(ADP-Ribosyl)ation in Plants", Trends in Plant Science, 16(7): 372-380, Jul. 31, 2011. p. 378.
NCBI "PREDICTED: Nudix Hydrolase 16, Mitochondrial-Like [Setaria Italica]", Database NCBI [Online], NCBI Reference Sequence: XP_004955808, Jun. 26, 2013.
Communication Pursuant to Article 94(3) EPC Dated Aug. 20, 2013 From the European Patent Office Re. Application No. 11172514.9.
Official Action Dated Sep. 16, 2013 From the US Patent and Trademark Office Re. U.S. Appl. No. 13/125,047.
Translation of Office Action Dated Aug. 28, 2013 From the State Intellectual Property Office of the People's Republic of China Re. Application No. 200880109464.9.
Clontech "Genome Walker™ Universal Kit User Manual", Clontech Laboratories Inc., Cat. No. 638904, PT3042-1 (PR742239), p. 1-30, Apr. 25, 2007.
Zhou et al. "Global Genome Expression Analysis of Rice in Response to Drought and High-Salinity Stresses in Shoot, Flag Leaf, and Panicle", Plant Molecular Biology, 63(5): 591-608, Mar. 2007.
Communication Pursuant to Article 94(3) EPC Dated Dec. 8, 2008 From the European Patent Office Re.: Application No. 04734072.4.
International Preliminary Report on Patentability Dated Dec. 8, 2005 From the International Bureau of WIPO Re.: Application No. PCT/IL2004/000431.
International Preliminary Report on Patentability Dated Jan. 22, 2009 From the International Bureau of WIPO Re.: Application No. PCT/IL2006/001223.
Invitation to Pay Additional Fees Dated Feb. 7, 2008 From the International Searching Authority Re.: Application No. PCT/IL06/001223.
Invitation to Pay Additional Fees Dated Dec. 18, 2008 From the International Searching Authority Re.: Application No. PCT/IL08/01024.
Advisory Action Before the Filing of an Appeal Brief Dated Aug. 5, 2011 From the US Patent and Trademark Office Re. U.S. Appl. No. 12/083,978.

Advisory Action Before the Filing of an Appeal Brief Dated Aug. 29, 2012 From the US Patent and Trademark Office Re. U.S. Appl. No. 12/457,199.
Applicant-Initiated Interview Summary Dated Aug. 6, 2012 From the US Patent and Trademark Office Re. U.S. Appl. No. 12/669,975.
Communication Pursuant to Article 93(3) EPC Dated Jun. 15, 2012 From the European Patent Office Re. Application No. 11154193.4.
Communication Pursuant to Article 94(3) EPC Dated Apr. 3, 2012 From the European Patent Office Re.: Application No. 06766224.7.
Communication Pursuant to Article 94(3) EPC Dated Jul. 4, 2012 From the European Patent Office Re. Application No. 10194223.3.
Communication Pursuant to Article 94(3) EPC Dated Mar. 8, 2011 From the European Patent Office Re.: Application No. 06809784.9.
Communication Pursuant to Article 94(3) EPC Dated Nov. 8, 2010 From the European Patent Office Re.: Application No. 04734072.4.
Communication Pursuant to Article 94(3) EPC Dated Sep. 9, 2009 From the European Patent Office Re.: Application No. 04734072.4.
Communication Pursuant to Article 94(3) EPC Dated May 12, 2010 From the European Patent Office Re.: Application No. 06766224.7.
Communication Pursuant to Article 94(3) EPC Dated Feb. 13, 2009 From the European Patent Office Re.: Application No. 05750089.4.
Communication Pursuant to Article 94(3) EPC DAted Jul. 13, 2012 From the European Patent Office Re. Application No. 11172514.9.
Communication Pursuant to Article 94(3) EPC Dated Feb. 14, 2012 From the European Patent Office Re.: Application No. 04734072.4.
Communication Pursuant to Article 94(3) EPC Dated Mar. 14, 2011 From the European Patent Office Re. Application No. 07849616.3.
Communication Pursuant to Article 94(3) EPC Dated Nov. 19, 2010 From the European Patent Office Re.: Application No. 06809784.9.
Communication Pursuant to Article 94(3) EPC Dated Jun. 21, 2012 From the European Patent Office Re. Application No. 11154213.0.
Communication Pursuant to Article 94(3) EPC Dated Nov. 27, 2009 From the European Patent Office Re.: Application No. 06809784.9.
Communication Pursuant to Article 94(3) EPC Dated Jun. 29, 2011 From the European Patent Office Re. Application No. 08738191.9.
Communication Pursuant to Rule 55 EPC Dated Mar. 16, 2012 From the European Patent Office Re. Application No. 11190921.4.
Communication Pursuant to Rule 58 EPC or Rule 159 EPC, Invitation to Remedy Deficiencies in the Application Documents Dated Jan. 19, 2012 From the European Patent Office Re. Application No. 11190922.2.
Communication Pursuant to Rule 69 EPC—Reminder Concerning Payment of the Designation Fee (Art. 79(2) EPC) and of the Examination Fee (Art. 94(1) EPC)—and Invitation Pursuant to Rule 70a(1) EPC Dated Jul. 18, 2011 From the European Patent Office Re. Application No. 11154193.4.
Communication Pursuant to Rule 69 EPC—Reminder Concerning Payment of the Designation Fee (Art. 79(2) EPC) and of the Examination Fee (Art. 94(1) EPC)—and Invitation Pursuant to Rule 70a(1) EPC Dated Jul. 25, 2011 From the European Patent Office Re. Application No. 11154213.0.
Communication Pursuant to Rule 70(2) EPC and Reference to Rule 39(1) EPC Dated Sep. 13, 2010 From the European Patent Office Re.: Application No. 09163033.5.
Communication Pursuant to Rules 70(2) and 70a(2) EPC and Reference to Rule 39(1) EPC Dated Dec. 5, 2011 From the European Patent Office Re. Application No. 10194223.3.
Communication Pursuant to Rules 70(2) and 70a(2) EPC and Reference to Rule 39(1) EPC Dated Nov. 7, 2011 From the European Patent Office Re. Application No. 11172514.9.
Communication Pursuant to Rules 70(2) and 70a(2) EPC Dated May 7, 2012 From the European Patent Office Re. Application No. 09823171.5.
Communication Pursuant to Rules 70(2) and 70a(2) EPC Dated Jan. 19, 2012 From the European Patent Office Re. Application No. 09807983.3.
Communication Pursuant to Rules 70(2) and 70a(2) EPC Dated Jul. 24, 2012 From the European Patent Office Re. Application No. 10748403.2.
Communication Pursuant to Rules 70(2) and 70a(2) EPC Dated May 24, 2011 From the European Patent Office Re. Application No. 09750276.9.

(56) References Cited

OTHER PUBLICATIONS

Communication Relating to the Results of the Partial International Search Dated Jul. 8, 2009 From the International Searching Authority Re.: Application No. PCT/IL2008/001657.
Communication Under Rule 71(3) EPC Dated Jun. 5, 2012 From the European Patent Office Re.: Application No. 06809784.9.
Communiciation Pursuant to Rules 70(2) and 70a(2) EPC Dated Aug. 30, 2010 From the European Patent Office Re. Application No. 08738191.9.
Decision on Granting a Patent for Invention Dated Dec. 7, 2010 From the Rospatent, Federal State Institution, Federal Institute for Industrial Property of the Federal Service for Intellectual Property, Patents and Trademarks of the Russian Federation Re. Application No. 2008120395 and Its Translation Into English.
European Search Report and the European Search Opinion Dated Nov. 2, 2011 From the European Patent Office Re. Application No. 10194223.3.
European Search Report and the European Search Opinion Dated Oct. 6, 2011 From the European Patent Office Re. Application No. 11172514.9.
European Search Report and the European Search Opinion Dated Aug. 9, 2010 From the European Patent Office Re.: Application No. 09163033.5.
European Search Report and the European Search Opinion Dated Jun. 14, 2011 From the European Patent Office Re. Application No. 11154193.4.
European Search Report and the European Search Opinion Dated Jun. 21, 2011 From the European Patent Office Re. Application No. 11154213.0.
Examination Report Dated Aug. 1, 2011 From the Government of India, Patent Office Re.: Application No. 158/CHENP/2007.
Examination Report Dated Nov. 3, 2010 From the Government of India, Patent Office Re.: Application No. 158/CHENP/2007.
Examination Report Dated Jun. 6, 2012 From the Federal Service of Intellectual Property, Federal State Budget Institute, Federal Institute of Industrial Property of the Russian Federation Re. Application No. 2011113420 and Its Translation Into English.
Examination Report Dated Jun. 11, 2012 From the Instituto Mexicano de la Propiedad Industrial Re. Application No. MX/a/2011/007294 and Its Translation Into English.
Examination Report Dated Nov. 13, 2007 From the Government of India, Patent Office Re.: Application No. 3482/CHENP/2005.
Examination Report Dated Sep. 14, 2012 From the Australian Government IP Australia Re. Application No. 2007335706.
Examination Report Dated Aug. 16, 2012 From the Instituto Mexicano de la Propiedad Industrial Re. Application No. MX/a/2010/014097 and Its Translation Into English.
Examination Report Dated Feb. 17, 2010 From the Instituto Mexicano de la Propricdad Industrial Re. Application No. PA/a/2005/012565 and Its Summary in English.
Examination Report Dated Apr. 19, 2011 From the Instituto Mexicano de la Propriedad Industrial Re. Application No. MX/a/2008/002262 and Its Summary Into English.
Examination Report Dated Dec. 19, 2011 From the Federal Service of Intellectual Property, Federal State Budget Institute, Federal Institute of Industrial Property of the Russian Federation Re. Application No. 2011113420 and Its Translation Into English.
Examination Report Dated Sep. 22, 2010 From the Instituto Mexicano de la Propriedad Industrial Re. Application No. MX/a/2008/005280 and its Summary Into English.
Examination Report Dated Jun. 25, 2012 From the Instituto Mexicano de la Propiedad Industrial Re. Application No. MX/a/2011/003575 and Its Translation Into English.
Examination Report Dated May 25, 2011 From the Government of India, Patent Office Re.: Application No. 158/CHENP/2007.
Examiner's Report Dated Aug. 1, 2011 From the Australian Government, IP Australia Re. Application No. 2005234725.
Examiner's Report Dated Jan. 10, 2012 From the Australian Government, IP Australia Re. Application No. 2005234725.
Examiner's Report Dated Jan. 13, 2011 From the Australian Government, IP Australia Re.: Application No. 2005252469.
Examiner's Report Dated Jan. 13, 2013 From the Australian Government, IP Australia Re. Application No. 2011239323.
Examiner's Report Dated Mar. 15, 2012 From the Australian Government, IP Australia Re. Application No. 2011239323.
Examiner's Report Dated Dec. 17, 2009 From the Australian Government, IP Australian Re.: Application No. 20052469.
Examiner's Report Dated Oct. 19, 2011 From the Australian Government, IP Australia Re. Application No. 2006281018.
Examiner's Report Dated Dec. 20, 2010 From the Australian Government, IP Australia Re. Application No. 2005234725.
Examiner's Report Dated Jul. 21, 2011 From the Australian Government, IP Australia Re. Application No. 2005234725.
Examiner's Report Dated Jun. 24, 2011 From the Australian Government, IP Australia Re. Application No. 2006281018.
Examiner's Report Dated Oct. 28, 2011 From the Australian Government, IP Australia Re. Application No. 2006307457.
Examiner's Report Dated Jun. 30, 2011 From the Australian Government, IP Australia Re. Application No. 2006307457.
Examiner's Report Dated Jan. 31, 2012 From the Australian Government, IP Australia Re. Application No. 2006281018.
Examiner's Report Dated Mar. 31, 2011 From the Australian Government, IP Australia Re.: Application No. 2005252469.
International Preliminary Report on Patentability Dated Dec. 1, 2011 From the International Bureau of WIPO Re. Application No. PCT/IL2008/000489.
International Preliminary Report on Patentability Dated Dec. 2, 2010 From the International Bureau of WIPO Re. Application No. PCT/IL2009/000508.
International Preliminary Report on Patentability Dated Mar. 3, 2011 From the International Bureau of WIPO Re.: Application No. PCT/IB2009/053633.
International Preliminary Report on Patentability Dated Feb. 4, 2010 From the International Bureau of WIPO Re.: Application No. PCT/IL2008/001024.
International Preliminary Report on Patentability Dated Jul. 8, 2010 From the International Bureau of WIPO Re.: Application No. PCT/IL2008/001657.
International Preliminary Report on Patentability Dated Apr. 12, 2012 From the Interantional Bureau of WIPO Re. Application No. PCT/IB2010/052545.
International Preliminary Report on Patentability Dated Jul. 12, 2012 From the International Bureau of WIPO Re. Application No. PCT/IB2010/056023.
International Preliminary Report on Patentability Dated May 12, 2011 From the International Bureau of WIPO Re. Application No. PCT/IB2009/054774.
International Preliminary Report on Patentability Dated Jan. 14, 2010 From the International Bureau of WIPO Re.: Application No. PCT/IL2008/000489.
International Preliminary Report on Patentability Dated Sep. 15, 2011 From the International Bureau of WIPO Re. Application No. PCT/IB2010/050871.
International Preliminary Report on Patentability Dated Jan. 21, 2010 From the International Bureau of WIPO Re.: Application No. PCT/IL2007/001590.
International Preliminary Report on Patentability Dated Jan. 22, 2009 From the International Bureau of WIPO Re.: Application No. PCT/IL2006/000947.
International Preliminary Report on Patentability Dated Mar. 29, 2007 From the International Bureau of WIPO Re.: Application No. PCT/IL2005/000627.
International Preliminary Report on Patentability Dated Jan. 30, 2007 From the International Bureau of WIPO Re.: Application No. PCT/IL05/00627.
International Search Report and the Written Opinion Dated Jun. 2, 2010 From the International Searching Authority Re. Application No. PCT/IB09/53633.
International Search Report and the Written Opinion Dated Jun. 2, 2010 From the International Searching Authority Re.: Application No. PCT/IB09/54774.

(56) References Cited

OTHER PUBLICATIONS

International Search Report and the Written Opinion Dated Aug. 6, 2012 From the International Searching Authority Re. Application No. PCT/IB11/53697.
International Search Report and the Written Opinion Dated Dec. 6, 2011 From the International Searching Authority Re. Application No. PCT/IB2011/051843.
International Search Report and the Written Opinion Dated Sep. 6, 2012 From the International Searching Authority Re. Application No. PCT/IB2011/055854.
International Search Report and the Written Opinion Dated Sep. 7, 2010 From the International Searching Authority Re. Application No. PCT/IB10/50871.
International Search Report and the Written Opinion Dated Mar. 16, 2012 From the International Searching Authority Re. Application No. PCT/IB2010/052545.
International Search Report and the Written Opinion Dated Feb. 17, 2010 From the International Searching Authority Re.: Application No. PCT/IL09/00508.
International Search Report and the Written Opinion Dated Aug. 22, 2011 From the International Searching Authority Re. Application No. PCT/IB2010/056023.
International Search Report and the Written Opinion Dated Nov. 24, 2008 From the International Searching Authority Re.: Application No. PCT/IL08/00489.
International Search Report and the Written Opinion Dated Jul. 29, 2008 From the International Searching Authority Re.: Application No. PCT/IL06/001223.
International Search Report and the Written Opinion Dated Oct. 30, 2009 From the International Searching Authority Re.: Application No. PCT/IL2008/001657.
International Search Report and the Written Opinion Dated Oct. 31, 2011 From the International Searching Authority Re.: Application No. PCT/IL08/00489.
International Search Report Dated Jul. 2, 2009 From the International Searching Authority Re.: Application No. PCT/IL07/01590.
International Search Report Dated Jan. 3, 2007 From the International Searching Authority Re.: Application No. PCT/IL2005/000627.
International Search Report Dated Mar. 4, 2009 From the International Searching Authority Re.: Application No. PCT/IL08/01024.
International Search Report Dated Nov. 4, 2005 From the International Searching Authority Re.: Application No. PCT/IL04/00431.
International Search Report Dated Aug. 27, 2008 From the International Searching Authority Re.: Application No. PCT/IL06/00947.
Invitation to Pay Additional Fees Dated Mar. 2, 2010 From the International Searching Authority Re.: Application No. PCT/IB09/53633.
Invitation to Pay Additional Fees Dated May 8, 2012 From the International Searching Authority Re. Application No. PCT/IB11/53697.
Invitation to Pay Additional Fees Dated Sep. 8, 2006 From the International Searching Authority Re.: Application No. PCT/IL05/00627.
Invitation to Pay Additional Fees Dated Jun. 9, 2011 From the International Searching Authority Re. Application No. PCT/IB2010/056023.
Invitation to Pay Additional Fees Dated Jun. 15, 2012 From the International Searching Authority Re. Application No. PCT/IB2011/055854.
Invitation to Pay Additional Fees Dated Oct. 17, 2012 From the International Searching Authority Re. Application No. PCT/IL2012/050154.
Invitation to Pay Additional Fees Dated Aug. 18, 2011 From the International Searching Authority Re.: Application No. PCT/IL08/00489.
Invitation to Pay Additional Fees Dated Nov. 19, 2009 From the International Searching Authority Re.: Application No. PCT/IL09/00508.
Invitation to Pay Additional Fees Dated Aug. 23, 2005 From the International Search Authority Re. Application No. PCT/IL2004/000431.
Invitation to Pay Additional Fees Dated Dec. 27, 2011 From the International Searching Authority Re. Application No. PCT/IB2010/052545.
Notice of Allowance Dated Dec. 5, 2011 From the US Patent and Trademark Office Re. U.S. Appl. No. 12/448,359.
Notice of Allowance Dated Aug. 11, 2010 From the Instituto Mexicano de la Propriedad Industrial Re. Application No. PA/a/2005/012565.
Notice of Allowance Dated Apr. 16, 2010 From the US Patent and Trademark Office Re.: U.S. Appl. No. 11/629,411.
Notice of Allowance Dated Oct. 18, 2010 From the US Patent and Trademark Office Re.: U.S. Appl. No. 11/990,386.
Notice of Grant Dated Jan. 14, 2011 From the Instituto Mexicano de la Propriedad Industrial Re. Application No. MX/a/2008/005280.
Office Action Dated Jan. 2, 2012 From the Israel Patent Office Re. Application No. 206118 and Its Translation Into English.
Office Action Dated Feb. 3, 2011 From the Israel Patent Office Re.: Application No. 172135 and Its Translation Into English.
Office Action Dated Aug. 4, 2010 From the Israel Patent Office Re.: Application No. 172135 and Its Translation Into English.
Office Action Dated Jan. 9, 2009 From the State Intellectual Property Office of the People's Republic of China Re.: Application No. 200480020597.0.
Office Action Dated Nov. 11, 2010 From the Israel Patent Office Re. Application No. 206118 and Its Translation Into English.
Office Action Dated May 13, 2010 From the Israel Patent Office Re. Application No. 180022 and Its Translation Into English.
Office Action Dated Jun. 17, 2010 From the Israel Patent Office Re. Application No. 190918 and Its Translation Into English.
Office Action Dated Oct. 18, 2010 From the Israel Patent Office Re. Application No. 180022 and Its Translation Into English.
Office Action Dated Jun. 19, 2011 From the Israel Patent Office Re. Application No. 199391 and Its Translation Into English.
Office Action Dated Jun. 20, 2011 From the Israel Patent Office Re. Application No. 190918 and Its Translation Into English.
Office Action Dated Jan. 22, 2010 From the State Intellectual Property Office of the People's Republic of China Re.: Application No. 200580027481.4 and Its Translation Into English.
Office Action Dated Sep. 22, 2011 From the Israeli Patent Office Re. Application No. 201242 and Its Translation Into English.
Office Action Dated Jun. 25, 2012 From the State Intellectual Property Office of the People's Republic of China Re.: Application No. 200880109464.9 and Its Translation Into English.
Office Action Dated Apr. 27, 2009 From the Israeli Patent Office Re.: Application No. 172135 and Its Translation Into English.
Office Action Dated Jan. 31, 2010 From the Israel Patent Office Re.: Application No. 172135 and Its Translation Into English.
Office Letter Dated Jul. 7, 2008 From the Government of India, Patent Office Re.: Application No. 3482/CHENP/2005.
Official Action Dated May 1, 2009 From the US Patent and Trademark Office Re.: U.S. Appl. No. 11/629,411.
Official Action Dated Sep. 2, 2009 From the US Patent and Trademark Office Re.: U.S. Appl. No. 11/629,411.
Official Action Dated Jul. 8, 2011 From the US Patent and Trademark Office Re. U.S. Appl. No. 12/083,978.
Official Action Dated Jun. 8, 2010 From the US Patent and Trademark Office Re.: U.S. Appl. No. 11/629,411.
Official Action Dated Apr. 10, 2012 From the US Patent and Trademark Office Re. U.S. Appl. No. 12/669,975.
Official Action Dated May 10, 2011 From the US Patent and Trademark Office Re. U.S. Appl. No. 12/457,199.
Official Action Dated Jun. 13, 2012 From the US Patent and Trademark Office Re. U.S. Appl. No. 12/594,853.
Official Action Dated May 14, 2012 From the US Patent and Trademark Office Re. U.S. Appl. No. 12/457,199.
Official Action Dated Feb. 15, 2011 From the US Patent and Trademark Office Re. U.S. Appl. No. 12/448,359.
Official Action Dated May 15, 2009 From the US Patent and Trademark Office Re.: U.S. Appl. No. 11/990,386.
Official Action Dated Jul. 17, 2012 From the US Patent and Trademark Office Re. U.S. Appl. No. 12/834,106.

(56) References Cited

OTHER PUBLICATIONS

Official Action Dated Aug. 18, 2010 From the US Patent and Trademark Office Re. U.S. Appl. No. 12/083,978.
Official Action Dated Oct. 18, 2007 From the US Patent and Trademark Office Re.: U.S. Appl. No. 11/284,236.
Official Action Dated Jun. 19, 2012 From the US Patent and Trademark Office Re. U.S. Appl. No. 13/450,547.
Official Action Dated Sep. 19, 2011 From the US Patent and Trademark Office Re. U.S. Appl. No. 12/810,855.
Official Action Dated Dec. 21, 2011 From the US Patent and Trademark Office Re. U.S. Appl. No. 12/810,855.
Official Action Dated Aug. 22, 2011 From the US Patent and Trademark Office Re. U.S. Appl. No. 12/457,199.
Official Action Dated Oct. 22, 2009 From the US Patent and Trademark Office Re.: U.S. Appl. No. 11/990,386.
Official Action Dated Nov. 23, 2010 From the US Patent and Trademark Office Re. U.S. Appl. No. 12/083,978.
Official Action Dated Jul. 28, 2008 From the US Patent and Trademark Office Re.: U.S. Appl. No. 11/284,236.
Official Action Dated Apr. 29, 2011 From the US Patent and Trademark Office Re. U.S. Appl. No. 12/448,359.
Partial European Search Report Dated Jul. 12, 2011 From the European Patent Office Re. Application No. 10194223.3.
Partial European Search Report Dated Apr. 19, 2010 From the European Patent Office Re.: Application No. 09163033.5.
Requisition by the Examiner Dated Feb. 2, 2012 From the Canadian Intellectual Property Office Re. Application No. 2,570,195.
Requisition by the Examiner Dated Jun. 15, 2011 From the Canadian Intellectual Property Office Re. Application No. 2,526,440.
Response Dated Jun. 2, 2011 to Office Action of Feb. 3, 2011 From the Israel Patent Office Re.: Application No. 172135.
Response Dated Jul. 3, 2011 to Examination Report of Apr. 19, 2011 From the Instituto Mexicano de la Propriedad Industrial Re. Application No. MX/a/2008/002262 and Its Summary Into English.
Response Dated Oct. 3, 2011 to Examiner's Report of Jun. 24, 2011 From the Australian Government, IP Australia Re. Application No. 2006281018.
Response Dated Jan. 4, 2010 to Official Action of Sep. 2, 2009 From the US Patent and Trademark Office Re.: U.S. Appl. No. 11/629,411.
Response Dated Oct. 4, 2011 to Official Action of Jul. 8, 2011 From the US Patent and Trademark Office Re. U.S. Appl. No. 12/083,978.
Response Dated Dec. 5, 2010 to Office Action of Aug. 4, 2010 From the Israel Patent Office Re.: Application No. 172135.
Response Dated Jul. 6, 2011 to Examiner's Report of Dec. 20, 2010 From the Australian Government, IP Australia Re. Application No. 2005234725.
Response Dated Jun. 6, 2011 to Official Action of May 10, 2011 From the US Patent and Trademark Office Re. U.S. Appl. No. 12/457,199.
Response Dated Jan. 7, 2010 to Communication Pursuant to Article 94(3) EPC of Sep. 9, 2009 From the European Patent Office Re.: Application No. 04734072.4.
Response Dated Mar. 8, 2011 to Examiner's Report of Jan. 13, 2011 From the Australian Government, IP Australia Re.: Application No. 2005252469.
Response Dated Feb. 9, 2011 to Communication Pursuant to Article 94(3) EPC of Nov. 19, 2010 From the European Patent Office Re.: Application No. 06809784.9.
Response Dated Jun. 9, 2011 to Examiner's Report of Dec. 20, 2011 From the Australian Government, IP Australia Re. Application No. 2005234725.
Response Dated Mar. 9, 2011 to Office Action of Nov. 11, 2010 From the Israel Patent Office Re. Application No. 206118.
Response Dated Jan. 10, 2012 to European Search Report and the European Search Opinion of Jun. 14, 2011 From the European Patent Office Re. Application No. 11154193.4.
Response Dated Aug. 11, 2011 to Examination Report of Aug. 1, 2011 From the Government of India, Patent Office Re.: Application No. 158/CHENP/2007.
Response Dated Dec. 12, 2010 to Examiner's Report of Dec. 17, 2009 From the Australian Government, IP Australia Re.: Application No. 2005252469.
Response Dated Oct. 12, 2010 to Communication Pursuant to Article 94(3) EPC of May 12, 2010 From the European Patent Office Re.: Application No. 06766224.7.
Response Dated Sep. 13, 2010 to Office Action Dated May 13, 2010 From the Israel Patent Office Re. Application No. 180022.
Response Dated Dec. 14, 2010 to Examination Report of Sep. 22, 2010 From the Instituto Mexicano de la Propriedad Industrial Re. Application No. MX/a/2008/005280.
Response Dated Feb. 14, 2011 to Supplementary European Search Report and the European Search Opinion of Jul. 29, 2010 From the European Patent Office Re. Application No. 08776651.5.
Response Dated Mar. 14, 2011 to Official Action of Feb. 15, 2011 From the US Patent and Trademark Office Re. U.S. Appl. No. 12/448,359.
Response Dated Oct. 14, 2010 to Office Action of Jun. 17, 2010 From the Israel Patent Office Re. Application No. 190918.
Response Dated Sep. 14, 2010 to Official Action of Aug. 18, 2010 From the US Patent and Trademark Office Re. U.S. Appl. No. 12/083,978.
Response Dated Dec. 15, 2011 to Examiner's Report of Aug. 1, 2011 From the Australian Government, IP Australia Re. Application No. 2005234725.
Response Dated Jun. 15, 2011 to Examiner's Report of Mar. 31, 2011 From the Australian Government, IP Australia Re.: Application No. 2005252469.
Response Dated Jun. 17, 2011 to Examiner's Report of Mar. 31, 2011 From the Australian Government, IP Australia Re.: Application No. 2005252469.
Response Dated May 17, 2010 to Office Action of Jan. 22, 2010 From the State Intellectual Property Office of the People's Republic of China Re.: Application No. 200580027481.4.
Response Dated Oct. 17, 2011 to Requisition by the Examiner of Jun. 15, 2011 From the Canadian Intellectual Property Office Re. Application No. 2,526,440.
Response Dated Oct. 18, 2011 to Official Action of Sep. 19, 2011 From the US Patent and Trademark Office Re. U.S. Appl. No. 12/810,855.
Response Dated Dec. 19, 2011 to Examiner's Report of Oct. 19, 2011 From the Australian Government, IP Australia Re. Application No. 2006281018.
Response Dated Jan. 19, 2011 to Supplementary European Search Report and the European Search Opinion of Jul. 1, 2010 From the European Patent Office Re. Application No. 07849616.3.
Response Dated Oct. 19, 2011 to Official Action of Apr. 29, 2011 From the US Patent and Trademark Office Re. U.S. Appl. No. 12/448,359.
Response Dated Jul. 20, 2011 to Examination Report of May 25, 2011 From the Government of India, Patent Office Re.: Application No. 158/CHENP/2007.
Response Dated Apr. 21, 2011 to Communication Pursuant to Article 94(3) EPC of Nov. 8, 2010 From the European Patent Office Re.: Application No. 04734072.4.
Response Dated Sep. 21, 2010 to Notice of Allowance of Apr. 16, 2010 From the US Patent and Trademark Office Re.: U.S. Appl. No. 11/629,411.
Response Dated Dec. 22, 2011 to Official Action of Aug. 22, 2011 From the US Patent and Trademark Office Re. U.S. Appl. No. 12/457,199.
Response Dated Feb. 22, 2010 to Official Action of Oct. 22, 2009 From the US Patent and Trademark Office Re.: U.S. Appl. No. 11/990,386.
Response Dated Feb. 23, 2011 to Communication Pursuant to Rule 70(2) EPC and Reference to Rule 39(1) EPC of Sep. 13, 2010 From the European Patent Office Re.: Application No. 09163033.5.
Response Dated Mar. 23, 2011 to Official Action of Nov. 23, 2010 From the US Patent and Trademark Office Re. U.S. Appl. No. 12/083,978.
Response Dated Feb. 24, 2011 to Communciation Pursuant to Rules 70(2) and 70a(2) EPC of Aug. 30, 2010 From the European Patent Office Re. Application No. 08738191.9.

(56) References Cited

OTHER PUBLICATIONS

Response Dated Mar. 24, 2011 to Examination Report of Nov. 3, 2010 From the Government of India, Patent Office Re.: Application No. 158/CHENP/2007.
Response Dated Oct. 24, 2010 to Office Action of Sep. 2, 2010 From the ROSPATENT, Federal State Institution, Federal Institute for Industrial Property of the Federal Service for Intellectual Property, Patents and Trademarks of the Russian Federation Re. Application No. 2008120395.
Response Dated Jul. 25, 2011 to Examiner's Report of Jul. 21, 2011 From the Australian Government, IP Australia Re. Application No. 2005234725.
Response Dated Sep. 25, 2011 to Examiner's Report of Jun. 30, 2011 From the Australian Government, IP Australia Re. Application No. 2006307457.
Response Dated Oct. 27, 2011 to Communication Pursuant to Article 94(3) EPC of Jun. 29, 2011 From the European Patent Office Re. Application No. 08738191.9.
Response Dated Oct. 27, 2011 to Office Action of Jul. 1, 2011 From the State Intellectual Property Office of the People's Republic of China Re. Application No. 200880017707.6.
Response Dated Oct. 27, 2011 to Supplementary European Search Report and the European Search Opinion of May 6, 2011 From the European Patent Office Re. Application No. 09750276.9.
Response Dated Jun. 29, 2010 to Examination Report of Feb. 17, 2010 From the Instituto Mexicano de la Propriedad Industrial Re. Application No. PA/a/2005/012565.
Response Dated Jun. 29, 2011 to Communication Pursuant to Article 94(3) EPC of Mar. 8, 2011 From the European Patent Office Re.: Application No. 06809784.9.
Response Dated May 31, 2010 to Office Action of Jan. 31, 2010 From the Israel Patent Office Re.: Application No. 172135.
Response Dated Oct. 31, 2011 to Notification of the First Office Action of Jun. 30, 2011 From the State intellectual Property Office of the People's Republic of China Re. Application No. 200680047610.0.
Restriction Official Action Dated Feb. 1, 2012 From the US Patent and Trademark Office Re. U.S. Appl. No. 12/669,975.
Restriction Official Action Dated Apr. 11, 2012 From the US Patent and Trademark Office Re. U.S. Appl. No. 12/834,106.
Restriction Official Action Dated Feb. 13, 2012 From the US Patent and Trademark Office Re. U.S. Appl. No. 12/594,853.
Summary of Office Action Dated Sep. 2, 2010 From the ROSPATENT, Federal State Institution, Federal Institute for Industrial Property of the Federal Service for Intellectual Property, Patents and Trademarks of the Russian Federation Re. Application No. 2008120395.
Supplementary European Search Report and the European Search Opinion Dated Feb. 1, 2010 From the European Patent Office Re.: Application No. 06766224.7.
Supplementary European Search Report and the European Search Opinion Dated Jul. 1, 2010 From the European Patent Office Re. Application No. 07849616.3.
Supplementary European Search Report and the European Search Opinion Dated Jan. 2, 2012 From the European Patent Office Re. Application No. 09807983.3.
Supplementary European Search Report and the European Search Opinion Dated Jul. 6, 2012 From the European Patent Office Re. Application No. 10748403.2.
Supplementary European Search Report and the European Search Opinion Dated May 6, 2011 From the European Patent Office Re. Application No. 09750276.9.
Supplementary European Search Report and the European Search Opinion Dated Aug. 11, 2010 From the European Patent Office Re. Application No. 08738191.9.
Supplementary European Search Report and the European Search Opinion Dated Sep. 14, 2009 From the European Patent Office Re.: Application No. 06809784.9.
Supplementary European Search Report and the European Search Opinion Dated Apr. 18, 2012 From the European Patent Office Re. Application No. 09823171.5.
Supplementary European Search Report and the European Search Opinion Dated Jul. 29, 2010 From the European Patent Office Re. Application No. 08776651.5.
Supplementary European Search Report Dated Apr. 23, 2008 From the European Patent Office Re.: Application No. 05750089.4.
Supplementary European Search Report Dated Oct. 31, 2007 From the European Patent Office Re.: Application No. 04734072.4.
Supplementary Partial European Search Report Dated Aug. 30, 2007 From the European Patent Office Re.: Application No. 04734072.4.
Translation of Decision of Rejection Dated Dec. 9, 2011 From the State Intellectual Property Office of the People's Republic of China Re.: Application No. 200580027481.4.
Translation of Examination Report Dated Sep. 6, 2010 From the Government of the People's Republic of Bangladesh, Department of Patents, Designs and Trademarks, Ministry of Industries Re. Application No. 275/2009.
Translation of Notice of Payment of the Restoration Fee for Unity of Invention Dated Mar. 20, 2009 From the State Intellectual Property Office of the People's Republic of China Re.: Application No. 200580027481.4.
Translation of Notification of the Office Action Dated Dec. 1, 2011 From the State Intellectual Property Office of the People's Republic of China Re. Application No. 200680047610.0.
Translation of Notification of the Office Action Dated Jun. 30, 2011 From the State Intellectual Property Office of the People's Republic of China Re. Application No. 200680047610.0.
Translation of Office Action Dated Jul. 1, 2011 From the State Intellectual Property Office of the People's Republic of China Re. Application No. 200880017707.6.
Translation of Office Action Dated Jan. 4, 2012 From the State Intellectual Property Office of the People's Republic of China Re. Application No. 200880109464.9.
Translation of Office Action Dated Apr. 9, 2012 From the State Intellectual Property Office of the People's Republic of China Re. Application No. 200880017707.6.
Translation of Office Action Dated Sep. 13, 2012 From the State Intellectual Property Office of the People's Republic of China Re. Application No. 200910217137.1.
Translation of Office Action Dated Jan. 17, 2012 From the State Intellectual Property Office of the People's Republic of China Re. Application No. 201110104274.1.
Translation of Office Action Dated Oct. 19, 2010 From the State Intellectual Property Office of the People's Republic of China Re. Application No. 200680038391.X.
Translation of Office Action Dated Jun. 22, 2011 From the State Intellectual Property Office of the People's Republic of China Re. Application No. 200880127685.9.
Translation of Office Action Dated Dec. 31, 2011 From the State Intellectual Property Office of the People's Republic of China Re. Application No. 200910217137.1.
Translation of the Office Action Dated Jan. 9, 2009 From the State Intellectual Property Office Re.: Application No. 2004800200597.0.
Written Opinion Dated Jul. 2, 2009 From the International Searching Authority Re.: Application No. PCT/IL07/01590.
Written Opinion Dated Jan. 3, 2007 From the International Searching Authority Re.: Application No. PCT/IL2005/000627.
Written Opinion Dated Mar. 4, 2009 From the International Searching Authority Re.: Application No. PCT/IL08/01024.
Written Opinion Dated Nov. 4, 2005 From the International Searching Authority Re.: Application No. PCT/I104/00431.
Written Opinion Dated Aug. 27, 2008 From the International Searching Authority Re.: Application No. PCT/IL06/00947.
Adachi et al. "Oryza Saliva Japonica Group cDNA Clone:J023021L06, Full Insert Sequence", Database EMBASE [Online], XP002665608, Retrieved From EBI, Database Accession No. AK099270, Jul. 19, 2003.
Aharon et al. "Overexpression of a Plasma Membrane Aquaporin in Transgenic Tobacco Improves Plant Vigor Under Favorable Growth Conditions But Not Under Drought or Salt Stress", The Plant Cell, 15: 439-447, Feb. 2003.

(56) References Cited

OTHER PUBLICATIONS

Alcala et al. "Generation of ESTs From Tomato Fruit Tissue", Database GenBank on STIC, National Center for Biotechnology Information, Accession No. AW932839, 2001.
Apse et al. "Engineering Salt Tolerance in Plants", Current Opinion in Biotechnology, 13: 146-150, 2002.
Apse et al. "Engineering Salt Tolerance in Plants", Current Opinion in Biotechnology, XP003018468, 13(2): 146-150, Apr. 1, 2002.
Bautista et al. "Arabidopsis Thaliana At5g06690 mRNA, Complete Cds", Unpublished, The Salk Institute for Biological Studies, La Jolla, CA, USA, GenBank: BT029447, Nov. 15, 2006.
Bernhardt et al. "The bHLH Genes GLARRA3 (GL3) and Enhancer of GLABRA3 (EGL3) Specify Epidermal Cell Fate in the Arabidopsis Root", Development, 130(26): 6431-6439, 2003.
Blast "BLAST Results", 1 P.
Blewitt et al. "BNLGHi10083 Six-Day Cotton Fiber Gossypium Hirsutum cDNA 5' Similar to (AC004521) Unknown Protein [Arabidopsis Thaliana], mRNA Sequence", XP002576188, Retrieved Fron EBI Accession No. EMBL:AI728187, Database Accession No. AI728187, Jun. 12, 1999. Sequence.
Blewitt et al. "BNLGHi8081 Six-Day Cotton Fiber Gossypium Hirsutum cDNA 5' Similar to (AC004521) Unknown Protein [Arabidopsis Thalian], mRNA Sequence", XP002576189, Retrieved From EBI Accesion No. EMBL:AI730835, Database Accession No. AI730835, Jun. 12, 1999. Sequence.
Blewitt et al. "BNLGHi8396 Six-Day Cotton Fiber Gossypium Hirsutum cDNA 5' Similar to (AC004521) Unknown Protein [Arabidopsis Thaliana], mRNA Sequence", XP002576190, Retrieved From EBI Accession No. EMBL:AI27553, Database Accession No. AI27553, Jun. 12, 1999. Sequence.
Blewitt et al. "Gossypium Hirsutum Strain Acala Maxxa BURP Domain-Containing Protein (BNL 1924) mRNA, Complete CDS", GenBank Nucleotide, GenBank Accession No. AY343972, Aug. 16, 2003.
Bowie et al. "Deciphering the Message in Protein Sequences: Tolerance to Amino Acid Substitutions", Science, 247(4948): 1306-1310, Mar. 16, 1990.
Brandle et al. "Perspectives on the Production of Recombinant Proteins in Plants", AgBiotechNet, 3(ABN 070): 1-4, 2001. Abstract.
Castelli et al. "Arabidopsis Thaliana Full-Length cDNA Complete Sequence From Clone GSLTFB52ZA10 of Flowers and Buds of Strain Col-0 of Arabidopsis Thaliana (Thale Cress)", GeneBank Direct Submission BX829993, Accession No. BX829993, Feb. 6, 2004.
Cheuk et al. "Arabidopsis Thaliana At2g40550 Gene, Complete CDS", Database EMBL [Online], XP002673499, Retrieved From EBI Accession No. EM_PL: BT022032.1, Database Accession No. BT022032, May 4, 2005.
Cheuk et al. "Arabidopsis Thaliana At2g46960/F14M4.21 mRNA, Complete CDS", Database EMBL [Online], XP002593835, Retrieved From EBI Accession No. EMBL:AY091688, Database Accession No. AY091688, Apr. 14, 2002.
Daniell et al. "Solanum Bulbocastanum Chloroplast, Complete Genome", GenBank NCBI, Accession No. NC_007943, Mar. 26, 2010. p. 1, Source, p. 10-11, Nucleotides 46590-47195, Gene 'RPS4'.
Davletova et al. "The Zinc-Finger Protein Zat12 Plays a Central Role in Reactive Oxygen and Abiotic Stress Signaling in Arabidopsis", Plant. Physiology, 139: 847-856, Oct. 2005.
Feng et al. "Probable Cinnamyl Alcohol Dehydrogenase 6", Database UniProt [Online], XP002665609, Retrieved From EBI, Database Accession No. Q7XWU3, Mar. 1, 2004.
Francois et al. "Overexpression of the VvLTP1 Gene Interferes With Somatic Embryo Development in Grapevine", Functional Plant Biology, 35(5): 394-402, 2008.
Fray et al. "Nucleotide Sequence and Expression of a Ripening and Water Stress-Related cDNA From Tomato With Homology to the MIP Class of Membrane Channel Proteins", Plant Molecular Biology, XP009117320, 24(3): 539-543, 1994. Figs.1, 2. & Database UniProt, REcName: Full=Probable Aquaporin PIP-Type pTOM75; AltName: Full=Ripening-Associated Membrane Protein; Short=RAMP, Oct. 1, 1994.
Friedberg "Automated Protein Function Prediction—The Genomic Challenge", Briefings in Bioinformatics, 7(3): 225-242, 2006.
Gardiner et al. "*Zea mays* PCO131392 mRNA Sequence", Database EMBL/GenBank/DDBJ, EBI Database Accession No. AY107021, XP002542347, May 28, 2002. 96,5% Identity in 1118 nt Overlap of AY107021 (1118 nt) With SEQ ID No. 68 (1348 nt) of the Present Application, Abstract.
Gaxiola et al. "Drought- and Salt-Tolerant Plants Result From Overexpression of the AVP1 H+-Pump", Proc. Natl. Acad. Sci. USA, PNAS, 98(20): 11444-11449, Sep. 25, 2001.
Good et al. "Can Less Yield More? Is Reducing Nutrient Input Into the Environment Compatible With Maintaining Crop Production?", Trends in Plant Science, 9(12): 597-605, Dec. 2004.
Good et al. "Engineering Nitrogen Use Efficiency With Alanine Aminotransferase", Canadian Journal of Botany, 85: 252-262, 2007.
Gowik et al. "cis-Regulatory Elements for Mesophyll-Specific Gene Expression in the C4 Plant Flaveria Trinervia, the Promoter of the C4 Phosphoenolpyruvate Carboxylase Gene", The Plant Cell, 16: 1077-1090, 2004.
Grover et al. "Understanding Molecular Alphabets of the Plant Abiotic Stress Responses", Current Science, 80(2): 206-216, Jan. 25, 2001.
Guo et al. "Protein Tolerance to Random Amino Acid Change", Proc. Natl. Acad. Sci. USA, PNAS, 101(25): 9205-9210, 2004.
Hachez et al. "Modulating the Expression of Aquaporin Genes in Planta: A Key to Understand Their Physiological Functions?", Biochimica et Biophysica Acta, XP005655605, 1758(8): 1142-1156, Aug. 1, 2006. p. 1151, col.1, § 2—p. 1153, col. 1, § 1, Table 1.
Hattori et al. "An Acetohydroxy Acid Synthase Mutant Reveals a Single Site Involved in Multiple Herbicide Resistance", Molecular and General Genetics, 246: 419-425, 1995. Abstract!
Hill et al. "Functional Analysis of Conserved Histidines in ADP-Glucose Pyrophosphorylase From *Escherichia coli*", Biochemical and Biophysical Research Communications, 244(2): 573-577, 1998.
Holmstroem et al. "Drought Tolerance in Tobacco", Nature, 379: 683-684, 1996. Abstract.
In et al. "Panax Gingseng mRNA for Cytoplasmic Ribosomal Protein S13, Complete Cds", Database EMBL [Online], Retrieved From EBI Accession No. EMBL, Database Accession No. AB043974, 2000.
Invitrogen "SuperScript® Plasmid System With Gateway® Technology for cDNA Synthesis and Cloning", Invitrogen by Life Technologies, User Manual, Catalog No. 18248-013, Manual Part No. 11108, 44 P., Dec. 22, 2010.
Ishikawa et al. JP 2005-185101: Full Length cDNA of Plant and the Use Thereof, Database EMBL [Online], XP002678022, Retrieved From EBI Accession No. EM_PAT:HV067703, Database Accession No. HV067703, Jul. 15, 2011. Sequence.
Ji et al. "Gossypium Hirsutum Expansin mRNA, Complete CDs", Database EMBL [Online], XP002474936, Retrieved From EBI Accession No. EMBL:AY189969, Database Accession No. AY189969, May 20, 2003.
Ji et al. "Isolation and Analyses of Genes Preferentially Expressed During Early Cotton Fiber Development by Subtractive PCR and cDNA Array", Nucleic Acids Research, XP002474935, 31(10): 2534-2543, May 15, 2003.
Johansson et al. "The Role of Aquaporins in Cellular and Whole Plant Water Balance," Biochimica et Biophysica Acta 1465: 324-342, 2000.
Kandel et al. "Cloning, Functional Expression, and Characterization of CYP709C1, the First Sub-Terminal Hydroxylase of Long Chain Fatty Acid in Plants", Journal of Biological Chemistry, JBC, 280(43): 35881-35889, Oct. 28, 2005. p. 35887, col. 1, Para 2.
Kano-Murakami et al. "A Rice Homeotic Gene, OSH1, Causes Unusual Phenotypes in Transgenic Tobacco", FEBS Letters, 334(3): 365-368, Nov. 1993.
Katavic et al. "Utility of the Arabidopsis FAE1 and Yeast SLC1-1 Genes for Improvement in Erucic Acid and Oil Content in Rapeseed", Biochemical Society Transactions, 28(6): 935-937, Dec. 2000.

(56) References Cited

OTHER PUBLICATIONS

Katavic et al. "Utility of the Arabidopsis FAE1 and Yeast SLC1-1 Genes for Improvements in Erucic Acid and Oil Content in Rapeseed", Biochemical Society Transactions, 28: 935-7, 2000. ABSTRACT!
Keskin et al. "A New, Structurally Nonredundant, Diverse Data Set of Protein-Protein Interfaces and Its Implications", Protein Science, 13: 1043-1055, 2004.
Kikuchi et al. "Rice cDNA-Encoded Protein SEQ ID No. 31047", Database Geneseq [Online], XP002678021, Retrieved From EBI Accession No. GSP:AQD37188, Database Accession No. AGD37188, Jun. 12, 2008. Shows 100% Identity to Present SEG ID No. 246 (Protein) and Corresponding Polynucleotide Shows 100 % Identity to SEQ ID No. 7 Over 458 Nucleotides. Abstract.
Kim et al. "Arabidopsis Thaliana At2g46960/F14M4.21 mRNA, Complete CDS", Database EMBL [Online], XP002593834, Retrieved From EBI Accession No. EMBL:AF367329, Database Accession No. AF367329, Apr. 12, 2001.
Kim et al. "Molecular Cloning of Low-Temperature-Inducible Ribosomal Proteins From Soybean", Journal of Experimental Botany, 55(399): 1153-1155, 2004.
Kirkness et al. "Lycopersicon Esculentum Clone 133453R, mRNA Sequence", Database EMBL [Online], XP002529190, Retrieved From EBI Accession No. EMBL:BT014251, Database Accession No. BT014251, May 12, 2004.
Kirubakaran et al. "Characterization of a New Antifungal Lipid Transfer Protein From Wheat", Plant Physiology and Biochemistry, 46: 918-927, 2008.
La Rosa et al. "Oryza Sativa Amino Acid Sequence SEQ ID No. 133688", Database Geneseq [Online], XP002678023, Retrieved From EBI Accession No. GSP:ANM19687, Database Accession No. ANM19687, Dec. 28, 2007. 100% Identity to Present SEQ IFD No. 246, Corresponding Polynucleotide Has 99,6% Identity to Present SEQ ID No. 7 Over 488 Nucleotides. Abstract, Sequence.
La Rosa et al. "Oryza Sativa Nucleotide Sequence SEQ ID No. 31205", Database Geneseq [Online], XP002678024, Retrieved From EBI Accession No. GSN:ANL17203, Database Accession No. ANL17203, Dec. 28, 2007. Sequence.
Li et al. "Gossypium Hirsutum Dehydration-Induced Protein RD22-Like Protein (RDL) mRNA, Complete CDS", EBI Accession No. EMBL:AY072821, XP002639385, Database Accession No. AY072821, Dec. 4, 2002. Compound.
Li et al. "Isolation of Genes Preferntially Expressed in Cotton Fibers by cDNA Filter Arrays and RT-PCR", Plant Science, XP002639386, 163(6): 1113-1120, 2002.
Lin et al. "Arabidopsis Thaliana Chromosome III BAC F7O18 Genomic Sequence, Complete Sequence", GenBank Accession No. AC011437, Oct. 30, 2002.
Liu et al. "Root-Specific Expression of a Western White Pine PR10 Gene is Mediated by Different Promoter Regions in Transgenic Tobacco", Plant Molecular Biology, 52: 103-120, 2003.
Matsumoto et al. "*Hordeum vulgare* Subsp. *vulgare*, Full-Length cDNA", UniProtKB/TrEMBL, ID: F2DLE8-HORVD, UniProt Accession No. F2DLE8, May 31, 2011.
Maurel "Plant Aquaporins: Novel Functions and Regulation Properties", FEBS Letters, XP022078418, 581(12): 2227-2236, May 25, 2007. p. 2230, col. 2, Last §—p. 2231, col. 1, § 2, Fig.1.
McConnell et al. "Role of PHABULOSA and PHAVOLUTA in Determining Radial Patterning in Shoots", Nature, 411(6338): 709-713, Jun. 7, 2001.
Merriam-Webster "Exogenous Definition", Merrian-Webster On-Line Dictionary, 2010.
NCBI "Protein Sequence (588 Letters)", NCBI BLAST Basic Local Alignment Search Tool, 3 P., Retrieved From the Internet on Nov. 24, 2009.
Ngo et al. "Computational Complexity, Protein Structure Prediction, and the Levinthal Paradox", The Protein Folding Problem and Tertiary Structure Prediction, p. 433, 492-495, 1994.

Nuccio et al. "Metabolic Engineering of Plants for Osmotic Stress Resistance", Current Opinion in Plant Biology, XP002216348, 2(2): 128-134, Apr. 1, 1999.
Orford et al. "Specific Expression of an Expansin Gene During Elongation of Cotton Fibres", Biochimica et Biophysica Acta, XP000866032, 1398(3): 342-346, Jul. 9, 1998. Abstract, p. 343, Fig.1.
Orzaez et al. "Agroinjection of Tomato Fruits. A Tool for Rapid Functional Analysis of Transgenes Directly in Fruit", Plant Physiology, 140: 3-11, 2006.
Park et al. "Glycine Max Ribosomal Protein S13 (RPS13) mRNA, Complete Cds", Database EMBL [Online], Retreieved From EBI Accession No. EMBL, Database Accession No. AY453393, 2004.
Payne et al. "GL3 Encodes a bHLH Protein That Regulates Trichome Development in Arabidopsis Through Interaction With GL1 and TTG1", Genetics, 156: 1349-1362, Nov. 2000.
Payne et al. "Heterologous MYB Genes Distinct From GL1 Enhance Trichome Production When Overexpressed in Nicotiana Tabacum", Development, 126: 671-682, 1999.
Pilon-Smits et al. "Improved Performance of Transgenic Fructan-Accumulating Tobacco under Drought Stress", Plant Physiology, 107: 125-130, 1995.
Purnelle et al. "Arabidopsis Thaliana DNA Chromosome 3, BAC Clone F3C22", Database EMBL [Online], XP002640829, Retrieved From EBI Accession No. EMBL:AL353912, Database Accession No. AL 353912, Apr. 27, 2000. Compound.
Quesada et al. "Genetic Architecture of NaC1 Tolerance in Arabidopsis", Plant Physiology, 130: 951-963, 2002. ABSTRACT!
Rounsley et al. "Arabidopsis Thaliana Chromosome 2 Clone T2P4 Map CIC10A06, Complete Sequence", Database EMBL [Online], XP002673500, Retrieved From EBI Accession No. EMBL:AC002336, Database Accession No. AC002336, Jul. 18, 1997. Sequence.
Saez-Vasquez et al. "Accumulation and Nuclear Targeting of BnC24, A Brassica Napus Ribosomal Protein Corresponding to a mRNA Accumulating in Response to Cold Treatment", Plant Science, 156(1): 35-46, 2000.
Saijo et al. "Over-Expression of a Single Ca 2+-Dependent Protein Kinase Confers Both Cold and Salt/Drought Tolerance on Rice Plants", The Plant Journal 23(3): 319-327, 2000.
Skriver et al. "Cis-Acting DNA Elements Responsive to Gibberellin and Its Antagonist Abscisic Acid", Proceedings of the National Academy of Sciences USA 88: 7266-7270, 1991.
Smart et al. "MIP Genes Are Down-Regulated Under Drought Stress in Nicotiana Glauca", Plant and Cell Physiology, XP002455682, 42(7): 686-693, 2001. p. 686, Reference to Database Entry AF290618, p. 692, 1-h col., § 2.
Smart et al. "Nicotiana Glauca Putative Delta TIP (MIP2) mRNA, Complete Cds", Database EMBL [Online], Retrieved From EBI Accession No. EMBL: AF290618, XP002455682, Database Accession No. AF290618, Jan. 2, 2001.
Sunkar et al. "Small RNAs as Big Players in Plant Abiotic Stress Responses and Nutrient Deprivation", Trends in Plant Science, XP022148764, 12(7): 301-309, Jul. 1, 2007.
Takahashi et al. "The DNA Replication Checkpoint Aids Survival of Plants Deficient in the Novel Replisome Factor ETG1", The EMBO Journal, XP002537888, 27(13): 1840-1851, Jul. 9, 2008 & Supplementary Materials and Methods. Suppl. Fig.S6, p. 1844-1845.
Talicrcio et al. "GH_TMIRS_129_G10_F Cooton Normalized Library dT Primed Gossypium Hirsutum cDNA, mRNA Sequence", EMBL-Bank, XP002659970, Retrieved From EBI Accession No. EM_EST:DW508992, Database Accession No. DW508992.
Taliercio et al. "GH_TMIRS_129_G10_R Cotton Normalized Library dT Primed Gossypium Hirsutum cDNA, mRNA Sequence", EMBL-Bank, XP002659971, Retrieved From EBI Accession No. EM_EST:DW508993, Database Accession No. DW508993.
Tamura et al. "Osmotic Stress Tolerance of Transgenic Tobacco Expressing a Gene Encoding a Membrane-Located Receptor-Like Protein From Tobacco Plants", Plant Physiology, 131(2): 454-462, 2003.
Tanaka et al. "Enhanced Tolerance Against Salt-Stress and Freezing-Stress of *Escherichia coli* Cells Expressing Algal BBC1 Gene", Current Microbiology, 42(3): 173-177, 2001.

(56) References Cited

OTHER PUBLICATIONS

Tarczynski et al. "Stress Protection of Transgenic Tobacco by Production of the Osmolyte Mannitol", Science, 259: 508-510, 1993. ABSTRACT!

Thornton et al. "From Structure to Function: Approaches and Limitations", Nature Structural Biology. Structural Genomic Supplement, Nov. 2000, p. 991-994.

Udall et al. "A Global Assembly of Cotton ESTs", Genome Research, 16(3): 441-450, 2006.

Van der Hoeven et al. "EST301294 Tomato Root During/After Fruit Set, Cornell University Lycopersicon Esculentum cDNA Clone cLEX1K11 Similar to Vernicia Fordii Aquaporin, mRNA Sequence", Database EMBL [Online], Retrieved From EBI Accession No. EMBL: AW218814, XP002455680, Database Accession No. AW218814, Dec. 14, 1999. Abstract.

Van der Hoeven et al. "EST301295 Tomato Root During/After Fruit Set, Cornell University Lycopersicon Esculentum cDNA Clone cLEX1K11 Similar to Vernicia Fordii Aquaporin, mRNA Sequence", Database EMBL [Online], Retrieved From EBI Accession No. EMBL: AW218815, XP002455681, Database Accession No. AW218815, Dec. 14, 1999. Abstract.

Van der Hoeven et al. "EST312975 Tomato Root During/After Fruit Set, Cornell University Solanum Lycopersicum cDNA Clone cLEX14O20 5-, mRNA Sequence", GenBank, GenBank Accession No. AW622177.1.

Van der Hoeven et al. "EST428934 Tomato Nutrient Deficient Roots Lycopersicon Esculentum cDNA Clone cLEW26B2 5' Sequence, mRNA Sequence", Database EMBL, Retrieved From EBI Accession No. EMBL, Database Accession No. BF098413, 2000.

Van Haaren et al. "A Functional Map of the Fruit-Specific Promoter of the Tomato 2A11 Gene", Plant Molecular Biology, 21: 625-640, 1993. ABSTRACT!

Vigeolas et al. "Increasing Seed Oil Content in Oil-Seed Rape (*Brassica napus* L.) by Over-Expression of a Yeast Glycerol-3-Phosphate Dehydrogenase Under the Control of a Seed-Specific Promoter", Plant Biotechnology Journal, 5 Issue: 431-441, 2007. ABSTRACT!

Wallace et al. "Oligonucleotide Probes for the Screening of Recombinant DNA Libraries", Methods in Enzymology, XP002957829, 152: 432-442, Jan. 1, 1987.

Wang et al. "Control of Plant Trichome Development by a Cotton Fiber MYB Gene", The Plant Cell, 16: 2323-2334, Sep. 2004.

Wang et al. "Control of Plant Trichome Development by a Cotton Fiber MYB Gene", The Plant Cell, 16: 2323-2334, Sep. 2004. GenEmbl Database, Accession No. AY641990.

Wang et al. "The Soybean Dof-Type Transcription Factor Genes, GmDof4 and GmDof11, Enhance Lipid Content in the Seeds of Transgenic Arabidopsis Plants", The Plant Journal, 52: 716-729, 2007. ABSTRACT!

Wells "Additivity of Mutational Effects in Proteins", Biochemistry, 29 (37): 8509-8517, 1990.

Whisstock et al. "Prediction of Protein Function from Protein Sequence and Structure," Quarterly Reviews of Biophysics 36 (3): 307-340, Aug. 2003.

Wing et al. "An Integrated Analysis of the Genetics, Devlopment, and Evolution of Cotton Fiber", NBCI GenBank Accession No. BE052336, 2000.

Wing et al. "GA_Eb0023F09f Gossypium Arborcum 7-10 Dpa Fiber Library Gossypium Arboreum cDNA Clone GA_Eb0023F09f, mRNA Sequence", XP002576191, Retrieved From EBI Accession No. EMBL:BF275177, Database Accession No. BF275177, Nov. 20, 2000. Sequence.

Wing et al. "GA_Eb0026P18f Gossypium Arboreum 7-10 Dpa Fiber Library Gossypium Arboreum cDNA Clone GA_Eb0026P18f, mRNA Sequence", Database EMBL [Online], XP002640830, Retrieved From EBI Accession No. EMBL:BF277249, Database Accession No. BF277249, Nov. 20, 2000.

Wu et al. "SubName: Full=Major Intrinsic Protein", Database UniProt [Online], XP002529191, Retrieved From EBI Accession No. UNIPROT:AOFI89, Database Accession No. AOFI89, Nov. 28, 2006.

Xu et al. "Expression of a Late Embryogenesis Abundant Protein Gene, HVA1, From Barley Confers Tolerance to Water Deficit and Salt Stress in Transgenic Rice", Plant Physiology, 110: 249-257, 1996.

Yamada et al. "Arabidopsis Thaliana Clone RAFL14-87-A16 (R20399) Unknown Protein (Atlg60770) mRNA, Complete Cds", GenBank Accession No. BT002876, Retrieved From the Internet, Jan. 21, 2010.

Yamada et al. "Arabidopsis Thaliana Unknown Proein (At3g51610) mRNA, Complete CDS", Database EMBL[Online], XP002640828, Retrieved Fom EBI Accession No. EMBL:AY034915, Database Accession No. AY034915, Jun. 13, 2001. Compound.

Yanagisawa et al. "Diversity and Similarity Among Recognition Sequences of Dof Transcription Factors", The Plant Journal, 17(2): 209-214, 1999.

Yanagisawa et al. "Metabolic Engineering With Dof1 Transcription Factor in Plants: Improved Nitrogen Assimilation and Growth Under Low-Nitrogen Conditions", Proc. Natl. Acad. Sci USA, PNAS, 101(20): 7833-7838, May 18, 2004.

Yanagisawa et al. "Metabolic Engineering With Dof1 Transcription Factor in Plants: Improved Nitrogen Assimilation and Growth Under Low-Nitrogen Conditions", Proc. Natl. Acad. Sci. USA, PNAS, 101(20): 7833-7838, May 18, 2004.

Zabrouskov et al. "Oxidative Metabolism and the Physiological Age of Seed Potatoes Are Affected by Increased Alpha-Linolenate Content", Physiologia Plantarum, 116: 172-185, 2002.

International Search Report and the Written Opinion Dated Apr. 10, 2013 From the International Searching Authority Re. Application No. PCT/IL2012/050327.

Invitation to Pay Additional Fees Dated Apr. 8, 2013 From the International Searching Authority Re. Application No. PCT/IL2013/050172.

Requisition by the Examiner Dated Apr. 11, 2013 From the Canadian Intellectual Property Office Re. Application No. 2,626,592.

Translation of Office Action Dated Mar. 22, 2013 From the State Intellectual Property Office of the People's Republic of China Re. Application No. 200880109464.9.

Soderlund et al. "Sequencing, Mapping, and Analysis of 27,455 Maize Full-Length cDNAs", PLoS Genetics, 5(11): e1000740-1-e1000740-13, Nov. 2009.

Supplementary European Search Report and the European Search Opinion Dated Feb. 4, 2014 From the European Patent Office Re. Application No. 11774517.4.

Kovalic et al. "Sorghum Bicolor Protein Sequence SEQ ID No. 43065", Database Geneseq [Online], XP002718666, Retrieved From EBI Accession No. GSP:AXD18519, Database Accession No. AXD18519, Nov. 12, 2009.

La Rosa et al. "Oryza Sativa Amino Acid Sequence SEQ ID No. 113405", Database Geneseq [Online], XP002718667, Retrieved From EBI Accession No. GSP:ANL99403, Database Accession No. ANL99403, Dec. 28, 2007.

Office Action Dated Apr. 1, 2013 From the State Intellectual Property Office of the People's Republic of China Re. Application No. 200880127757.X and Its Translation Into English.

Communication Pursuant to Article 94(3) EPC Dated May 8, 2013 From the European Patent Office Re. Application No. 08776651.5.

Requisition—Sequence Listing Dated May 8, 2013 From the Canadian Intellectual Property Office Re. Application No. 2,753,616.

Communication Pursuant to Article 94(3) EPC Dated May 29, 2013 From the European Patent Office Re. Application No. 09823171.5.

Official Action Dated Jun. 24, 2013 From the US Patent and Trademark Office Re. U.S. Appl. No. 12/992,902.

Patent Examination Report Dated Jun. 21, 2013 From the Australian Government, IP Australia Re. Application No. 2012241091.

Arabidopsis Genome Initiative "Analysis of the Genome Sequence of the Flowering Plant Arabicopsis Thaliana" Nature, 408: 796-815, Dec. 14, 2000.

Ciddi et al. "Elicitation of *Taxus* SP. Cell Cultures for Production of Taxol", Biotechnology Letters, 17(12): 1343-1346, Dec. 1995.

Kikuchi et al. "Oryza Sativa Japonica Group cDNA Clone:J023131O04, Full Insert Sequence", GenRank Database Accession No. AK072531, Jul. 2, 2013.

(56) References Cited

OTHER PUBLICATIONS

Lurin et al. "Genome-Wide Analysis of Arabidopsis Pentatricopeptide Repeat Proteins Reveals Their Essential Role in Organelle Biogenesis", The plant Cell, 16: 2089-2103, Aug. 2004.
Terminology "Frequently Asked Questions", Bioinformatics Website, Frequently Asked Questions, 2001.
Theologis et al. "Sequence and Analysis off Chromosome 1 of the Plant Arabidopsis Thaliana", Nature, 408: 816-820, Dec. 14, 2000.
Patent Examination Report Dated Jun. 27, 2013 From the Australian Government, IP Australia Re. Application No. 2012216482.
Matz et al. "Gossypium Hirsutum GHDEL65 (ghdel65) mRNA, Complete CDS", GenBank Nucleotide, GenBank Accession No. AF336280, Mar. 15, 2001.
Examination Report Dated Mar. 23, 2013 From the Government of India, Patent Office, Intellectual Property Building Re. Application No. 2570/CHENP/2008.
International Search Report and the Written Opinion Dated May 12, 2013 From the International Searching Authority Re. Application No. PCT/IL2013/050172.
Official Action Dated May 8, 2013 From the US Patent and Trademark Office Re. U.S. Appl. No. 13/125,047.
Desveaux et al. "Whirly Transcription Factors: Defense Gene Regulation and Beyond", Trends in Plant Science, TiPS, 10(2): 95-102, Feb. 2005.
Young et al. "Hypothetical Protein MTR_7g116270 [Medicago Truncatula]", Database NCBI [Online], GenBank: AES82688.1, Database Accession No. AES82688, Nov. 21, 2011.
Zhang et al. "Phosphatidic Acid Regulates Microtubule Organization by Interaction With MAP65-1 in Response to Salt Stress in Arabidopsis", The Plant Cell, 24: 4555-4576, Nov. 2012.
Official Action Dated May 20, 2013 From the US Patent and Trademark Office Re. U.S. Appl. No. 13/059,231.
Patent Examination Report Dated May 31, 2013 From the Australian Government, IP Australia Re. Application No. 2008278654.
Hirner et al. "Arabidopsis LHT1 is a High-Affinity Transporter for Cellular Amino Acid Uptake in Both Root Epidermis and Leaf Mesophyll", The Plant Cell, 18: 1931-1946, Aug. 2006.
Plant Energy Biology "Protein_Coding: Cationic Amino Acid Transporter 2 (TAIR10)", Plant Energy Biology: SUBA3 Flatfile for AT1G58030.1, Database, 1 P., 2007.
Rolletschek et al. "Ectopic Expression of an Amino Acid Transporter (VfAAP1) in Seeds of Vica Narbonensis and Pea Increases Storage Proteins", Plant Physiology, 137: 1236-1249, Apr. 2005.
Su et al. "Molecular and Functional Characterization of a Family of Amino Acid Transporter From Arabidopsis", Plant Physiology, 136: 3104-3113, Oct. 2004.
TAIR "Encodes a Member of the Cationic Amino Acid Transporter (CAT) Subfamily of Amino Acid Polyamine Choline Transporters. Localized to the Tonoplast", TAIR, Locus: AT1G58030, TAIR Accession No. Locus:2196245, 4 P., 2013.
TAIR "Protein Kinase Superfamily Protein. Functions in: Protein Serine/Threonine Kinase Activity, Protein Kinase activity, Kinase Activity, ATP Binding ff.", TAIR, Locus: AT5G15080, TAIR Accession No. Locus:2147805, 4 P., 2013.
Examination Report Dated Oct. 1, 2013 From the Instituto Mexicano de la Propiedad Industrial Re. Application No. MX/a/2010/000975 and Its Translation Into English.
International Preliminary Report on Patentability Dated Nov. 14, 2013 From the International Bureau of WIPO Re. Application No. PCT/IL2012/050154.
Patent Examination Report Dated Dec. 12, 2012 From the Australian Government, IP Australia Re. Application No. 2008236316.
Advisory Action Before the Filing of an Appeal Brief Dated Dec. 20, 2013 From the US Patent and Trademark Office Re. U.S. Appl. No. 12/834,106.
Applicant-Initiated Interview Summary Dated Dec. 18, 2013 From the US Patent and Trademark Office Re. U.S. Appl. No. 12/834,106.

Communication Pursuant to Rule 58 EPC or Rule 159 EPC, Invitation to Remedy Deficiencies in the Application Documents Dated Dec. 6, 2013 From the European Patent Office Re. Application No. 11190921.4.
Patent Examination Report Dated Jan. 3, 2014 From the Australian Government IP Australia Re. Application No. 2008278654.
Examination Report Dated Mar. 13, 2013 From the Instituto Mexicano de la Propiedad Industrial Re. Application No. PA/a/2005/009380 and Its Summary in English.
International Preliminary Report on Patentability Dated Jul. 4, 2013 From the International Bureau of WIPO Re. Application No. PCT/IB2011/055854.
Examination Report Dated Jul. 29, 2013 From the Instituto Mexicano de la Propiedad Industrial Re. Application No. MX/a/2010/012697 and Its Translation Into English.
Official Action Dated Sep. 20, 2013 From the US Patent and Trademark Office Re. U.S. Appl. No. 12/669,975.
Communication Pursuant to Article 94(3) EPC Dated Dec. 19, 2012 From the European Patent Office Re.: Application No. 04734072.4.
Official Action Dated Dec. 18, 2012 From the US Patent and Trademark Office Re. U.S. Appl. No. 12/834,106.
Benfey et al. "The CaMV 35S Enhancer Contains at Least Two Domains Which Can Confer Different Development and Tissue-Specific Expression Patterns", The EMBO Journal, 8(8): 2195-2202, 1989.
Benfey et al. "The Cauliflower Mosaic Virus 35S Promoter: Combinatorial Regulation of Transcription in Plants", Science, 250(4983): 959-966, Nov. 16, 1990.
Communication Pursuant to Article 94(3) EPC Dated Jan. 3, 2013 From the European Patent Office Re. Application No. 09807983.3.
English Summary of Examination Results Dated Dec. 28, 2012 From the National Office of Intellectual Property (NOIP) of Vietnam Re. Application No. 1-2009-02358.
International Search Report and the Written Opinion Dated Jan. 7, 2013 From the International Searching Authority Re. Application No. PCT/IL2012/050154.
Invitation to Pay Additional Fees Dated Dec. 31, 2012 From the International Searching Authority Re. Application No. PCT/IL2012/050327.
Examination Report Dated Dec. 7, 2012 From the Instituto Mexicano de la Propiedad Industrial Re. Application No. MX/a/2011/003575 and Its Translation Into English.
Patent Examination Report Dated Jan. 4, 2013 From the Australian Government, IP Australia Re. Application No. 2008344935.
Official Action Dated Jan. 9, 2014 From the US Patent and Trademark Office Re. U.S. Appl. No. 12/992,902.
Bork et al. "Go Hunting in Sequence Databases But Watch Out for the Traps", Trends in Genetics, TIG, 12(10): 425-427, Oct. 1996.
Doerks et al. "Protein Annotation: Detective Work for Function Prediction", Trends in Genetics, TIG, 14(6): 248-250, Jun. 1998.
Smith et al. "The Challenges of Genome Sequence Annotation or 'The Devil is in the Details'", Nature Biotechnology, 15: 1222-1223, Nov. 1997.
Applicant-Initiated Interview Summary Dated Dec. 20, 2013 From the US Patent and Trademark Office Re. U.S. Appl. No. 13/125,047.
Notice of Allowance Dated Jan. 7, 2013 From the US Patent and Trademark Office Re. U.S. Appl. No. 12/457,199.
Official Action Dated Jan. 18, 2013 From the US Patent and Trademark Office Re. U.S. Appl. No. 12/669,975.
Translation of Notice to Amendment Dated Aug. 31, 2012 From the Thai Patent Office, Department of Intellectual Property Office Re. Application No. 0901000235.
Examination Report Dated Jun. 11, 2012 From the Instituto Mexicano de la Propiedad Industrial Re. Application No. MX/a/2011/007294 and Summary in English.
Translation of Office Action Dated Jan. 17, 2013 From the State Intellectual Property Office of the People's Republic of China Re. Application No. 201110104274.1.
Translation of Search Report Dated Jan. 17, 2013 From the State Intellectual Property Office of the People's Republic of China Re. Application No. 201110104274.1.

(56) References Cited

OTHER PUBLICATIONS

International Preliminary Report on Patentability Dated Feb. 21, 2013 From the International Bureau of WIPO Re. Application No. PCT/IB2011/051843.
Official Action Dated Feb. 8, 2013 From the US Patent and Trademark Office Re. U.S. Appl. No. 12/594,853.
Supplementary European Search Report and the European Search Opinion Dated Feb. 14, 2013 From the European Patent Office Re. Application No. 10785834.2.
Translation of Office Action Dated Feb. 25, 2013 From the State Intellectual Property Office of the People's Republic of China Re. Application No. 200910217137.1.
Communication Pursuant to Rules 70(2) and 70a(2) EPC Dated Mar. 5, 2013 From the European Patent Office Re. Application No. 10785834.2.
Requisition by the Examiner Dated Feb. 12, 2013 From the Canadian Intellectual Property Office Re. Application No. 2,570,195.
Restriction Official Action Dated Mar. 1, 2013 From the US Patent and Trademark Office Re. U.S. Appl. No. 13/254,183.
International Preliminary Report on Patentability Dated Mar. 14, 2013 From the International Bureau of WIPO Re. Application No. PCT/IB2011/053697.
Restriction Official Action Dated Apr. 4, 2013 From the US Patent and Trademark Office Re. U.S. Appl. No. 13/125,047.
Notice of Allowance Dated Apr. 8, 2013 From the US Patent and Trademark Office Re. U.S. Appl. No. 12/594,853.
Requisition by the Examiner Dated Mar. 25, 2013 From the Canadian Intellectual Property Office Re. Application No. 2,619,114.
Communication Pursuant to Article 94(3) EPC Dated Oct. 9, 2013 From the European Patent Office Re. Application No. 08869158.9.
Invitation to Pay Additional Fees Dated Oct. 16, 2013 From the International Searching Authority Re. Application No. PCT/IL2013/050725.
Office Action Dated Sep. 9, 2013 From the State Intellectual Property Office of the People's Republic of China Re. Application No. 200910217137.1 and Its Translation Into English.
Supplementary European Search Report and the European Search Opinion Dated Oct. 15, 2013 From the European Patent Office Re. Application No. 10840687.7.
Liu et al. "Plant Full Length Insert Polypeptide Seqid 64542", Database Geneseq [Online], XP002713973, Retrieved From EBI Accession No. GSP:ADY08727, Database Accession No. ADY08727, Apr. 21, 2005. Polypeptide Has 96.4% Identity to SEQ ID No. 653 and Is Used for the Same Purpose, Abstract, Sequence.
Paterson et al. "Sorghum Bicolor Chromosome 2, Whole Genome Shotgun Sequence", NCBI Database [Online], Retrieved From EBI Accession No. EMBL:CM000761, Database Accession No. CM000761, Jun. 24, 2009. Sequence.
Paterson et al. "SubName: Full=Putative Uncharacterized Protein Sb02g004350", Database UniProt [Online], XP002713972, Retrieved From EBI Accession No. UNIPROT:C5XB01, Database Accession No. C5XB01, Sep. 1, 2009. Polynucleotide and Polypeptide Molecules Fully Comprising the Present Molecules According to SEQ ID No:166, 653, Abstract, Sequence.
Office Action Dated Oct. 28, 2013 From the State Intellectual Property Office of the People's Republic of China Re. Application No. 201110104274.1 and Its Translation Into English.
Communication Pursuant to Article 94(3) EPC Dated Nov. 7, 2013 From the European Patent Office Re. Application No. 10748403.2.
Communication Pursuant to Rules 70(2) and 70a(2) EPC Dated Nov. 4, 2013 From the European Patent Office Re. Application No. 10840687.7.
Examination Report Dated Aug. 22, 2013 From the Instituto Mexicano de la Propiedad Industrial Re. Application No. MX/a/2011/009044 and Its Translation Into English.
Official Action Dated Oct. 29, 2013 From the US Patent and Trademark Office Re. U.S. Appl. No. 13/059,231.
Seki et al. "Monitoring the Expression Profiles of 7000 Arabidopsis Genes Under Drought, Cold and High-Salinity Stresses Using a Full-Length cDNA Microarray", The Plant Journal, 31(3): 279-292, 2002.
Tobias et al. "Structure of the Cinnamyl-Alcohol Dehydrogenase Gene Family in Rice and Promoter Activity of a Member Associated With Lignification", Planta, 220: 678-688, 2005.
Communication Pursuant to Article 94(3) EPC Dated Oct. 23, 2012 From the European Patent Office Re. Application No. 11154193.4.
Requisition by the Examiner Dated Oct. 3, 2012 From the Canadian Intellectual Property Office Re. Application No. 2,526,440.
Translation of Notice of Paying Restoration Fee for Unity of Invention Dated Oct. 29, 2012 From the State Intellectual Property Office of the People's Republic of China Re. Application No. 200880127757.X.
Alcala et al. "EST543159 Tomato Callus Solanum Lycopersicum cDNA Clone cLEC80A19 5-end, mRNA Sequence", GenBank: BI923254.1, GenBank Accession No. BI923254, Oct. 17, 2001.
Requisition by the Examiner Dated Aug. 27, 2013 From the Canadian Intellectual Property Office Re. Application No. 2,526,440.
Notice of Allowance Dated Nov. 15, 2013 From the US Patent and Trademark Office Re. U.S. Appl. No. 12/669,975.
Restriction Official Action Dated Nov. 13, 2012 From the US Patent and Trademark Office Re. U.S. Appl. No. 12/992,902.
Backhaus et al. "Nucleotide Sequence of a cDNA for a P2 60S Acidic Ribosomal Protein From Parthenium Argentatum", Plant Physiology, 106: 395, 1994.
Del Pozo et al. "F-Box Proteins and Protein Degradation: An Emerging Theme in Cellular Regulation", Plant Molecular Biology, 44(2): 123-128, Sep. 2000.
Harwood "Plant Fatty Acid Synthesis", The AOCS Lipid Library, 11 P., Apr. 12, 2010.
Notice of Allowance Dated Nov. 19, 2012 From the US Patent and Trademark Office Re. U.S. Appl. No. 13/450,547.
Advisory Action Before the Filing of an Appeal Brief Dated Nov. 19, 2013 From the US Patent and Trademark Office Re. U.S. Appl. No. 12/834,106.
International Search Report and the Written Opinion Dated Nov. 19, 2013 From the International Searching Authority Re. Application No. PCT/IL2013/050725.
Yu et al. "Cell Cycle Checkpoint Protein MAD2 Homolog [*Zea mays*]", Database NCBI [Online], GenBank: AAD30555.1, GenBank Accession No. AAD30555, May 17, 1999.
Communication Under Rule 71(3) EPC Dated Nov. 19, 2012 From the European Patent Office Re. Application No. 08738191.9.
Applicant-Initiated Interview Summary Dated Nov. 20, 2013 From the US Patent and Trademark Office Re. U.S. Appl. No. 13/125,047.
Requisition by the Examiner Dated Oct. 28, 2013 From the Canadian Intellectual Property Office Re. Application No. 2,570,195.
Lazar et al. "Transforming Growth Factor Alpha: Mutation of Aspartic Acid 47 and Leucine 48 Results in Different Biological Activities", Molecular and Cell Biology, 8(3): 1247-1252, Mar. 1988.
Communication Pursuant to Article 94(3) EPC Dated Oct. 23, 2012 From the European Patent Office Re. Application No. 11154213.0.
Examination Report Dated Oct. 15, 2012 From the Instituto Mexicano de la Propiedad Industrial Re. Application No. MX/a/2009/006660 and Its Translation Into English.
Examination Report Dated Dec. 16, 2013 From the Government of India, Patent Office, Intellectual Property Building Re. Application No. 2570/CHENP/2008.
Li et al. "Dehydration-Induced Protein RD22-Like Protein [Gossypium Hirsutum]", NCBI Database [Online], GenBank: AAL67991.1, GenBank Accession No. AAL67991, Dec. 4, 2002.
Examination Report Dated May 23, 2013 From the Instituto Mexican de la Propiedad Industrial Re. Application No. MX/a/2011/001741 and Its Translation Into English.
Invitation to Pay Additional Fees Dated Jul. 17, 2013 From the International Searching Authority Re. Application No. PCT/IB2013/054374.
Communication Pursuant to Article 94(3) EPC Dated Apr. 30, 2015 From the European Patent Office Re. Application No. 11774517.4.
Patent Examination Report Dated Jun. 25, 2015 From the Australian Government, IP Australia Re. Application No. 2011246876.

\* cited by examiner

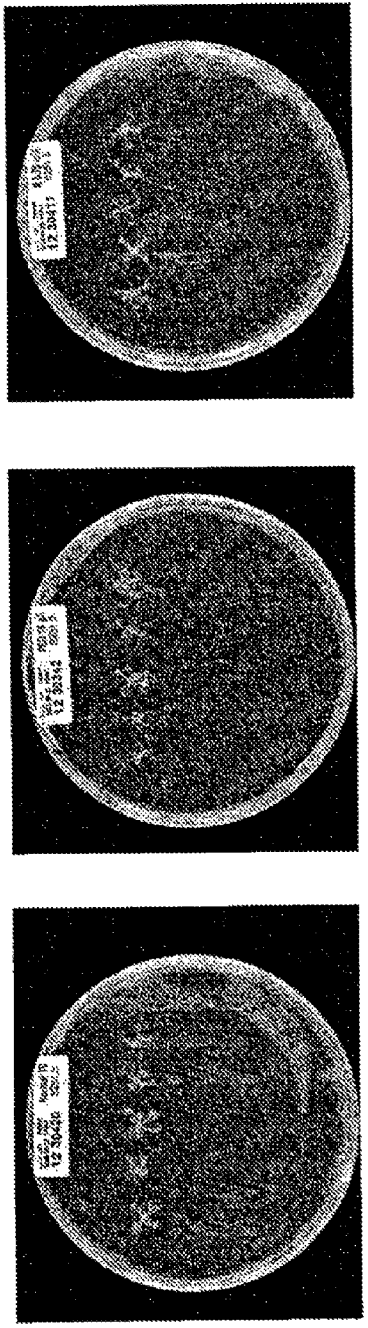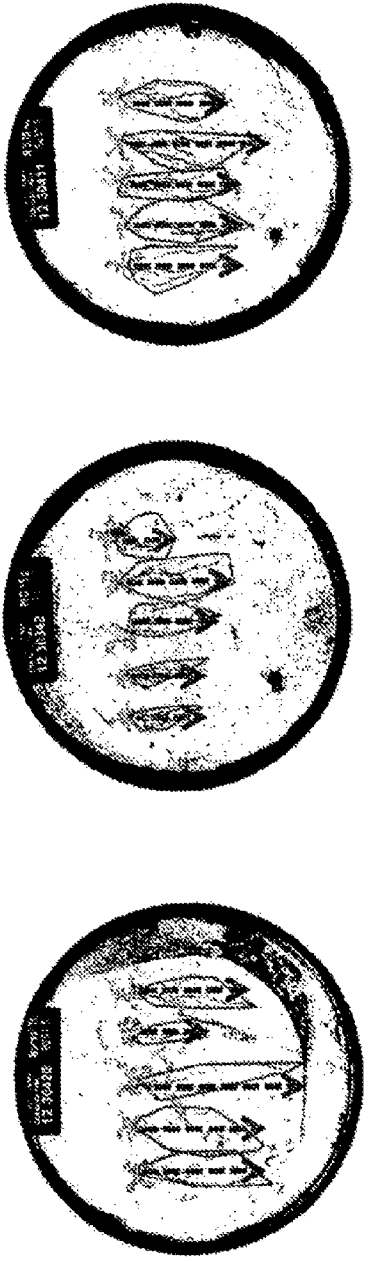
FIG. 3E  FIG. 3F
FIG. 3C  FIG. 3D
FIG. 3A  FIG. 3B

ISOLATED POLYNUCLEOTIDES AND POLYPEPTIDES FOR INCREASING PLANT YIELD AND/OR AGRICULTURAL CHARACTERISTICS

FIELD AND BACKGROUND OF THE INVENTION

The present invention, in some embodiments thereof, relates to isolated polynucleotides and polypeptides which can increase the yield (e.g., biomass, grain quantity and/or quality), growth rate, vigor, abiotic stress tolerance (ABST), water use efficiency (WUE), nitrogen use efficiency (NUE) and/or fertilizer use efficiency (FUE) of a plant.

The ever-increasing world population and the decreasing availability in arable land for agriculture affect the yield of plants and plant-related products. The global shortage of water supply, desertification, abiotic stress (ABS) conditions (e.g., salinity, drought, flood, suboptimal temperature and toxic chemical pollution), and/or limited nitrogen and fertilizer sources cause substantial damage to agricultural plants such as major alterations in the plant metabolism, cell death, and decreases in plant growth and crop productivity.

Drought is a gradual phenomenon, which involves periods of abnormally dry weather that persists long enough to produce serious hydrologic imbalances such as crop damage, water supply shortage and increased susceptibility to various diseases.

Salinity, high salt levels, affects one in five hectares of irrigated land. None of the top five food crops, i.e., wheat, corn, rice, potatoes, and soybean, can tolerate excessive salt. Detrimental effects of salt on plants result from both water deficit, which leads to osmotic stress (similar to drought stress), and the effect of excess sodium ions on critical biochemical processes. As with freezing and drought, high salt causes water deficit; and the presence of high salt makes it difficult for plant roots to extract water from their environment. Thus, salination of soils that are used for agricultural production is a significant and increasing problem in regions that rely heavily on agriculture, and is worsen by over-utilization, over-fertilization and water shortage, typically caused by climatic change and the demands of increasing population.

Suboptimal temperatures affect plant growth and development through the whole plant life cycle. Thus, low temperatures reduce germination rate and high temperatures result in leaf necrosis. In addition, mature plants that are exposed to excess heat may experience heat shock, which may arise in various organs, including leaves and particularly fruit, when transpiration is insufficient to overcome heat stress. Heat also damages cellular structures, including organelles and cytoskeleton, and impairs membrane function. Heat shock may produce a decrease in overall protein synthesis, accompanied by expression of heat shock proteins, e.g., chaperones, which are involved in refolding proteins denatured by heat. High-temperature damage to pollen almost always occurs in conjunction with drought stress, and rarely occurs under well-watered conditions. Combined stress can alter plant metabolism in novel ways. Excessive chilling conditions, e.g., low, but above freezing, temperatures affect crops of tropical origins, such as soybean, rice, maize, and cotton. Typical chilling damage includes wilting, necrosis, chlorosis or leakage of ions from cell membranes. Excessive light conditions, which occur under clear atmospheric conditions subsequent to cold late summer/autumn nights, can lead to photoinhibition of photosynthesis (disruption of photosynthesis). In addition, chilling may lead to yield losses and lower product quality through the delayed ripening of maize.

Nutrient deficiencies cause adaptations of the root architecture, particularly notably for example is the root proliferation within nutrient rich patches to increase nutrient uptake. Nutrient deficiencies cause also the activation of plant metabolic pathways which maximize the absorption, assimilation and distribution processes such as by activating architectural changes. Engineering the expression of the triggered genes may cause the plant to exhibit the architectural changes and enhanced metabolism also under other conditions.

In addition, it is widely known that the plants usually respond to water deficiency by creating a deeper root system that allows access to moisture located in deeper soil layers. Triggering this effect will allow the plants to access nutrients and water located in deeper soil horizons particularly those readily dissolved in water like nitrates.

Suboptimal nutrient (macro and micro nutrient) affect plant growth and development through the whole plant life cycle. A common approach to promote plant growth has been, and continues to be, the use of natural as well as synthetic nutrients (fertilizers). Thus, fertilizers are the fuel behind the "green revolution", directly responsible for the exceptional increase in crop yields during the last 40 years, and are considered the number one overhead expense in agriculture. Of the three macronutrients provided as main fertilizers [Nitrogen (N), Phosphate (P) and Potassium (K)], nitrogen is often the rate-limiting element in plant growth and all field crops have a fundamental dependence on inorganic nitrogenous fertilizer. Nitrogen is responsible for biosynthesis of amino acids and nucleic acids, prosthetic groups, plant hormones, plant chemical defenses, and the like; it is translocated to the shoot, where it is stored in the leaves and stalk during the rapid step of plant development and up until flowering. In corn for example, plants accumulate the bulk of their organic nitrogen during the period of grain germination, and until flowering. Once fertilization of the plant has occurred, grains begin to form and become the main sink of plant nitrogen. The stored nitrogen can be then redistributed from the leaves and stalk that served as storage compartments until grain formation. Phosphorous (P) and Potassium (K) have a direct correlation to yield and general plant tolerance.

Since fertilizer is rapidly depleted from most soil types, it must be supplied to growing crops two or three times during the growing season, particularly for cereals, which comprise more than half of the cultivated areas worldwide. For example, inorganic nitrogenous fertilizers such as ammonium nitrate, potassium nitrate, or urea, typically accounts for 40% of the costs associated with crops such as corn and wheat. In addition, the low nitrogen use efficiency (NUE) of the main crops (e.g., in the range of only 30-70%) negatively affects the input expenses for the farmer, due to the excess fertilizer applied. Moreover, the over and inefficient use of fertilizers are major factors responsible for environmental problems such as eutrophication of groundwater, lakes, rivers and seas, nitrate pollution in drinking water which can cause methemoglobinemia, phosphate pollution, atmospheric pollution and the like. However, in spite of the negative impact of fertilizers on the environment, and the limits on fertilizer use, which have been legislated in several countries, the use of fertilizers is expected to increase in order support food and fiber production for rapid population growth on limited land resources. For example, it has been estimated that by 2050, more than 150 million tons of nitrogenous fertilizer will be used worldwide annually.

Increased use efficiency of nitrogen by plants should enable crops to be cultivated with lower fertilizer input, or alternatively to be cultivated on soils of poorer quality and would therefore have significant economic impact in both developed and developing agricultural systems.

Yield is affected by various factors, such as, the number and size of the plant organs, plant architecture (for example, the number of branches), grains set length, number of filled grains, vigor (e.g. seedling), growth rate, root development, utilization of water, nutrients (e.g., nitrogen) and fertilizers, and stress tolerance.

Crops such as, corn, rice, wheat, canola and soybean account for over half of total human caloric intake, whether through direct consumption of the seeds themselves or through consumption of meat products raised on processed seeds or forage. Seeds are also a source of sugars, oils and metabolites used in industrial processes. The ability to increase plant yield, whether through increase dry matter accumulation rate, modifying cellulose or lignin composition, increase stalk strength, enlarge meristem size, change of plant branching pattern, erectness of levees, increase in fertilization efficiency, enhanced seed dry matter accumulation rate, modification of seed development, enhanced seed filling or by increasing the content of oil, starch or protein in the seeds would have many applications in agricultural and non-agricultural uses such as in the biotechnological production of pharmaceuticals, antibodies or vaccines.

Studies have shown that plant adaptations to adverse environmental conditions are complex genetic traits with polygenic nature. Conventional means for crop and horticultural improvements utilize selective breeding techniques to identify plants having desirable characteristics. However, selective breeding is tedious, time consuming and has an unpredictable outcome. Furthermore, limited germplasm resources for yield improvement and incompatibility in crosses between distantly related plant species represent significant problems encountered in conventional breeding. Advances in genetic engineering have allowed mankind to modify the germplasm of plants by expression of genes-of-interest in plants. Such a technology has the capacity to generate crops or plants with improved economic, agronomic or horticultural traits.

Genetic improvement of fertilizer use efficiency (FUE) in plants can be generated either via traditional breeding or via genetic engineering. Attempts to generate plants with increased FUE have been described in U.S. Pat. Appl. No. 20020046419 to Choo, et al.; U.S. Pat. Appl. No. 2005010879 to Edgerton et al.; U.S. Pat. Appl. No. 20060179511 to Chomet et al.; Good, A, et al. 2007 (Engineering nitrogen use efficiency with alanine aminotransferase. Canadian Journal of Botany 85: 252-262); and Good A G et al. 2004 (Trends Plant Sci. 9:597-605).

Yanagisawa et al. (Proc. Natl. Acad. Sci. U.S.A. 2004 101:7833-8) describe Dof1 transgenic plants which exhibit improved growth under low-nitrogen conditions.

U.S. Pat. No. 6,084,153 to Good et al. discloses the use of a stress responsive promoter to control the expression of Alanine Amine Transferase (AlaAT) and transgenic canola plants with improved drought and nitrogen deficiency tolerance when compared to control plants.

WO publication No. 2009/013750 discloses genes, constructs and methods of increasing abiotic stress tolerance, biomass and/or yield in plants generated thereby.

WO publication No. 2008/122980 discloses genes constructs and methods for increasing oil content, growth rate and biomass of plants.

WO publication No. 2008/075364 discloses polynucleotides involved in plant fiber development and methods of using same.

WO publication No. 2007/049275 discloses isolated polypeptides, polynucleotides encoding same, transgenic plants expressing same and methods of using same for increasing plant abiotic stress tolerance and biomass.

WO publication No. 2004/104162 discloses methods of increasing abiotic stress tolerance and/or biomass in plants and plants generated thereby.

WO publication No. 2005/121364 discloses polynucleotides and polypeptides involved in plant fiber development and methods of using same for improving fiber quality, yield and/or biomass of a fiber producing plant.

WO publication No. 2007/020638 discloses methods of increasing abiotic stress tolerance and/or biomass in plants and plants generated thereby.

WO publication No. 2009/083958 discloses methods of increasing water use efficiency, fertilizer use efficiency, biotic/abiotic stress tolerance, yield and biomass in plant and plants generated thereby.

WO publication No. 2010/020941 discloses methods of increasing nitrogen use efficiency, abiotic stress tolerance, yield and biomass in plants and plants generated thereby.

WO publication No. 2009/141824 discloses isolated polynucleotides and methods using same for increasing plant utility.

SUMMARY OF THE INVENTION

According to an aspect of some embodiments of the present invention there is provided a method of increasing yield, biomass, growth rate, vigor, oil content, fiber yield, fiber quality, abiotic stress tolerance, and/or nitrogen use efficiency of a plant, comprising expressing within the plant an exogenous polynucleotide comprising a nucleic acid sequence encoding a polypeptide at least 80% identical to SEQ ID NO: 481-792, 2947-4662 or 4663, thereby increasing the yield, biomass, growth rate, vigor, oil content, fiber yield, fiber quality, abiotic stress tolerance, and/or nitrogen use efficiency of the plant.

According to an aspect of some embodiments of the present invention there is provided a method of increasing yield, biomass, growth rate, vigor, oil content, fiber yield, fiber quality, abiotic stress tolerance, and/or nitrogen use efficiency of a plant, comprising expressing within the plant an exogenous polynucleotide comprising a nucleic acid sequence encoding a polypeptide selected from the group consisting of SEQ ID NOs:481-792, and 2947-4663, thereby increasing the yield, biomass, growth rate, vigor, oil content, fiber yield, fiber quality, abiotic stress tolerance, and/or nitrogen use efficiency of the plant.

According to an aspect of some embodiments of the present invention there is provided a method of increasing yield, biomass, growth rate, vigor, oil content, fiber yield, fiber quality, abiotic stress tolerance, and/or nitrogen use efficiency of a plant, comprising expressing within the plant an exogenous polynucleotide comprising a nucleic acid sequence at least 80% identical to SEQ ID NO: 1-480, 793-2945, or 2946, thereby increasing the yield, biomass, growth rate, vigor, oil content, fiber yield, fiber quality, abiotic stress tolerance, and/or nitrogen use efficiency of the plant.

According to an aspect of some embodiments of the present invention there is provided a method of increasing yield, biomass, growth rate, vigor, oil content, fiber yield, fiber quality, abiotic stress tolerance, and/or nitrogen use efficiency of a plant, comprising expressing within the plant an exogenous polynucleotide comprising the nucleic acid sequence selected from the group consisting of SEQ ID NOs: 1-480, and 793-2946, thereby increasing the yield, biomass, growth rate, vigor, oil content, fiber yield, fiber quality, abiotic stress tolerance, and/or nitrogen use efficiency of the plant.

According to an aspect of some embodiments of the present invention there is provided an isolated polynucleotide comprising a nucleic acid sequence encoding a polypeptide which comprises an amino acid sequence at least 80% homologous to the amino acid sequence set forth in SEQ ID NO:481-792, 2947-4662 or 4663, wherein the amino acid sequence is capable of increasing yield, biomass, growth rate, vigor, oil content, fiber yield, fiber quality, abiotic stress tolerance, and/or nitrogen use efficiency of a plant.

According to an aspect of some embodiments of the present invention there is provided an isolated polynucleotide comprising a nucleic acid sequence encoding a polypeptide which comprises the amino acid sequence selected from the group consisting of SEQ ID NOs:481-792, and 2947-4663.

According to an aspect of some embodiments of the present invention there is provided an isolated polynucleotide comprising a nucleic acid sequence at least 80% identical to SEQ ID NO:1-480, 793-2945 or 2946, wherein the nucleic acid sequence is capable of increasing yield, biomass, growth rate, vigor, oil content, fiber yield, fiber quality, abiotic stress tolerance, and/or nitrogen use efficiency of a plant.

According to an aspect of some embodiments of the present invention there is provided an isolated polynucleotide comprising the nucleic acid sequence selected from the group consisting of SEQ ID NOs: 1-480, and 793-2946.

According to an aspect of some embodiments of the present invention there is provided a nucleic acid construct comprising the isolated polynucleotide of some embodiments of the invention, and a promoter for directing transcription of the nucleic acid sequence in a host cell.

According to an aspect of some embodiments of the present invention there is provided an isolated polypeptide comprising an amino acid sequence at least 80% homologous to SEQ ID NO: 481-792, 2947-4662 or 4663, wherein the amino acid sequence is capable of increasing yield, biomass, growth rate, vigor, oil content, fiber yield, fiber quality, abiotic stress tolerance, and/or nitrogen use efficiency of a plant.

According to an aspect of some embodiments of the present invention there is provided an isolated polypeptide comprising the amino acid sequence selected from the group consisting of SEQ ID NOs: 481-792, and 2947-4663.

According to an aspect of some embodiments of the present invention there is provided a plant cell exogenously expressing the polynucleotide of some embodiments of the invention, or the nucleic acid construct of some embodiments of the invention.

According to an aspect of some embodiments of the present invention there is provided a plant cell exogenously expressing the polypeptide of some embodiments of the invention.

According to an aspect of some embodiments of the present invention there is provided a transgenic plant comprising the nucleic acid construct of some embodiments of the invention.

According to some embodiments of the invention, the nucleic acid sequence encodes an amino acid sequence selected from the group consisting of SEQ ID NOs: 481-792, and 2947-4663.

According to some embodiments of the invention, the nucleic acid sequence is selected from the group consisting of SEQ ID NOs: 1-480, and 793-2946.

According to some embodiments of the invention, the polynucleotide consists of the nucleic acid sequence selected from the group consisting of SEQ ID NOs: 1-480, and 793-2946.

According to some embodiments of the invention, the nucleic acid sequence encodes the amino acid sequence selected from the group consisting of SEQ ID NOs:481-792, and 2947-4663.

According to some embodiments of the invention, the plant cell forms part of a plant.

According to some embodiments of the invention, the method further comprising growing the plant expressing the exogenous polynucleotide under the abiotic stress.

According to some embodiments of the invention, the abiotic stress is selected from the group consisting of salinity, drought, water deprivation, flood, etiolation, low temperature, high temperature, heavy metal toxicity, anaerobiosis, nutrient deficiency, nutrient excess, atmospheric pollution and UV irradiation.

According to some embodiments of the invention, the yield comprises seed yield or oil yield.

According to some embodiments of the invention, the method further comprising growing the plant expressing the exogenous polynucleotide under nitrogen-limiting conditions.

According to some embodiments of the invention, the promoter is heterologous to the isolated polynucleotide and/or to the host cell.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE DRAWINGS

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

FIGS. 3A-F are images depicting visualization of root development of transgenic plants exogenously expressing the polynucleotide of some embodiments of the invention when grown in transparent agar plates under normal (FIGS. 3A-B), osmotic stress (15% PEG; FIGS. 3C-D) or nitrogen-limiting (FIGS. 3E-F) conditions. The different transgenes were grown in transparent agar plates for 17 days (7 days nursery and 10 days after transplanting). The plates were photographed every 3-4 days starting at day 1 after transplanting. FIG. 3A—An image of a photograph of plants taken following 10 after transplanting days on agar plates when grown under normal (standard) conditions. FIG. 3B—An image of root analysis of the plants shown in FIG. 3A in which the lengths of the roots measured are represented by arrows. FIG. 3C—An image of a photograph of plants taken following 10 days after transplanting on agar plates, grown under high osmotic (PEG 15%) conditions. FIG. 3D—An image of root analysis of the plants shown in FIG. 3C in which the lengths of the roots measured are represented by arrows. FIG. 3E—An image of a photograph of plants taken following 10 days after transplanting on agar plates, grown under low nitrogen conditions. FIG. 3F—An image of root analysis of the plants shown in FIG. 3E in which the lengths of the roots measured are represented by arrows.

DESCRIPTION OF SPECIFIC EMBODIMENTS OF THE INVENTION

Figure 1:
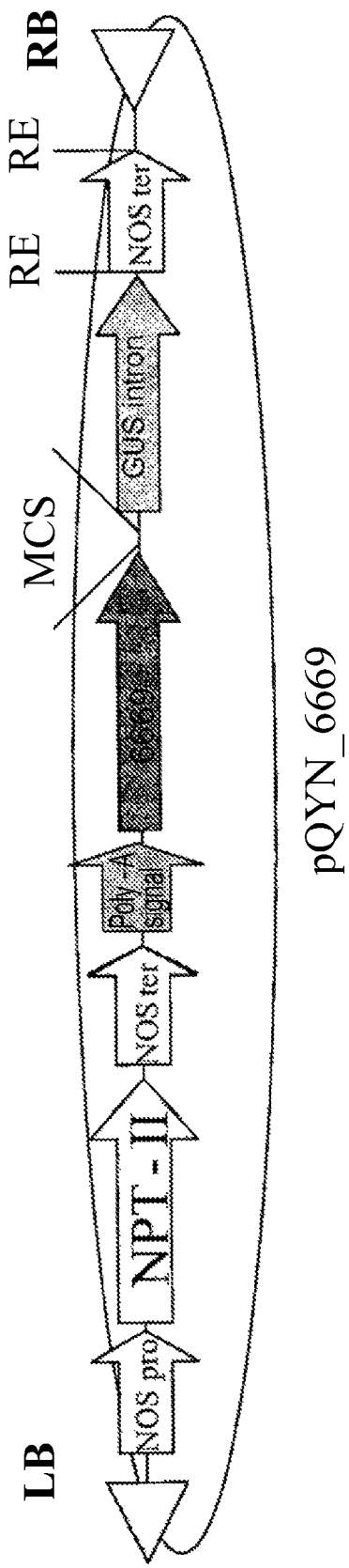
FIG. 1 is a schematic illustration of the modified pGI binary plasmid containing the new At6669 promoter (SEQ ID NO:4668) and the GUSintron (pQYN_6669) used for expressing the isolated polynucleotide sequences of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); GUSintron—the GUS reporter gene (coding sequence and intron). The isolated polynucleotide sequences of the invention were cloned into the vector while replacing the GUSintron reporter gene.

The present invention, in some embodiments thereof, relates to isolated polynucleotides and polypeptides, nucleic acid constructs, transgenic cells and transgenic plants comprising same and methods of generating and using same, and, more particularly, but not exclusively, to methods of increasing yield, biomass, growth rate, vigor, oil content, fiber yield, fiber quality abiotic stress tolerance, and/or fertilizer use efficiency (e.g., nitrogen use efficiency) of a plant.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

The present inventors have identified novel polypeptides and polynucleotides which can be used to increase yield, growth rate, biomass, oil content, vigor and/or abiotic stress tolerance of a plant.

Thus, as shown in the Examples section which follows, the present inventors have utilized bioinformatics tools to identify polynucleotides which enhance yield (e.g., seed yield, oil yield, oil content), growth rate, biomass, vigor, abiotic stress tolerance and/or fertilizer (e.g., nitrogen) use efficiency of a plant. Genes which affect the trait-of-interest were identified [Example 1, Table 1, SEQ ID NOs: 1-288 (polynucleotides) and 481-727 (polypeptides)] based on expression profiles in specific tissues and conditions of several Barley accessions (Example 3, Tables 3-8), Arabidopsis ecotypes/accessions (Examples 4-5, Tables 9-16), Sorghum varieties (Example 6, Tables 17-25) and Maize hybrids (Example 7, Tables 26-31). Homologous polypeptides and polynucleotides having the same function were also identified [Example 2, Table 2, SEQ ID NOs: 793-2946 (polynucleotides) and 2947-4663 (polypeptides)]. Agrobacterium tumefaciens cells were transformed with binary vectors harboring the identified genes (Example 9) and transgenic plants expressing same were generated (Example 10). Transgenic plants over-expressing the identified polynucleotides were found to exhibit increased biomass, yield, oil yield, dry matter, harvest index, growth rate, rosette area, seed yield and weight of 1000 seeds (Tables 33-48; Examples 11 and 12). Altogether, these results suggest the use of the novel polynucleotides and polypeptides of the invention for increasing yield (including oil yield, seed yield and oil content), growth rate, biomass, vigor, abiotic stress tolerance and/or fertilizer (e.g., nitrogen) use efficiency of a plant.

Thus, according to an aspect of some embodiments of the invention, there is provided method of increasing yield, biomass, growth rate, vigor, oil content, fiber yield, fiber quality, abiotic stress tolerance, and/or nitrogen use efficiency of a plant, comprising expressing within the plant an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 481-792, and 2947-4663, thereby increasing the yield, biomass, growth rate, vigor, oil content, fiber yield, fiber quality, abiotic stress tolerance, and/or nitrogen use efficiency of the plant.

As used herein the phrase "plant yield" refers to the amount (e.g., as determined by weight or size) or quantity (numbers) of tissues or organs produced per plant or per growing season. Hence increased yield could affect the economic benefit one can obtain from the plant in a certain growing area and/or growing time.

It should be noted that a plant yield can be affected by various parameters including, but not limited to, plant biomass; plant vigor; growth rate; seed yield; seed or grain quantity; seed or grain quality; oil yield; content of oil, starch and/or protein in harvested organs (e.g., seeds or vegetative parts of the plant); number of flowers (florets) per panicle (expressed as a ratio of number of filled seeds over number of primary panicles); harvest index; number of plants grown per area; number and size of harvested organs per plant and per area; number of plants per growing area (density); number of harvested organs in field; total leaf area; carbon assimilation and carbon partitioning (the distribution/allocation of carbon within the plant); resistance to shade; number of harvestable organs (e.g. seeds), seeds per pod, weight per seed; and modified architecture [such as increase stalk diameter, thickness or improvement of physical properties (e.g. elasticity)].

As used herein the phrase "seed yield" refers to the number or weight of the seeds per plant, seeds per pod, or per growing area or to the weight of a single seed, or to the oil extracted per seed. Hence seed yield can be affected by seed dimensions (e.g., length, width, perimeter, area and/or volume), number of (filled) seeds and seed filling rate and by seed oil content. Hence increase seed yield per plant could affect the economic benefit one can obtain from the plant in a certain growing area and/or growing time; and increase seed yield per growing area could be achieved by increasing seed yield per plant, and/or by increasing number of plants grown on the same given area.

The term "seed" (also referred to as "grain" or "kernel") as used herein refers to a small embryonic plant enclosed in a covering called the seed coat (usually with some stored food), the product of the ripened ovule of gymnosperm and angiosperm plants which occurs after fertilization and some growth within the mother plant.

The phrase "oil content" as used herein refers to the amount of lipids in a given plant organ, either the seeds (seed oil content) or the vegetative portion of the plant (vegetative oil content) and is typically expressed as percentage of dry weight (10% humidity of seeds) or wet weight (for vegetative portion).

It should be noted that oil content is affected by intrinsic oil production of a tissue (e.g., seed, vegetative portion), as well as the mass or size of the oil-producing tissue per plant or per growth period.

In one embodiment, increase in oil content of the plant can be achieved by increasing the size/mass of a plant's tissue(s) which comprise oil per growth period. Thus, increased oil content of a plant can be achieved by increasing the yield, growth rate, biomass and vigor of the plant.

As used herein the phrase "plant biomass" refers to the amount (e.g., measured in grams of air-dry tissue) of a tissue produced from the plant in a growing season, which could also determine or affect the plant yield or the yield per growing area. An increase in plant biomass can be in the whole plant or in parts thereof such as aboveground (harvestable) parts, vegetative biomass, roots and seeds.

As used herein the phrase "growth rate" refers to the increase in plant organ/tissue size per time (can be measured in $cm^2$ per day).

As used herein the phrase "plant vigor" refers to the amount (measured by weight) of tissue produced by the plant in a given time. Hence increased vigor could determine or affect the plant yield or the yield per growing time or growing area. In addition, early vigor (seed and/or seedling) results in improved field stand.

Improving early vigor is an important objective of modern rice breeding programs in both temperate and tropical rice cultivars. Long roots are important for proper soil anchorage in water-seeded rice. Where rice is sown directly into flooded fields, and where plants must emerge rapidly through water, longer shoots are associated with vigour. Where drill-seeding is practiced, longer mesocotyls and coleoptiles are important for good seedling emergence. The ability to engineer early vigor into plants would be of great importance in agriculture. For example, poor early vigor has been a limitation to the introduction of maize (Zea mays L.) hybrids based on Corn Belt germplasm in the European Atlantic.

It should be noted that a plant yield can be determined under stress (e.g., abiotic stress, nitrogen-limiting conditions) and/or non-stress (normal) conditions.

As used herein, the phrase "non-stress conditions" refers to the growth conditions (e.g., water, temperature, light-dark cycles, humidity, salt concentration, fertilizer concentration in soil, nutrient supply such as nitrogen, phosphorous and/or potassium), that do not significantly go beyond the everyday climatic and other abiotic conditions that plants may encounter, and which allow optimal growth, metabolism, reproduction and/or viability of a plant at any stage in its life cycle (e.g., in a crop plant from seed to a mature plant and back to seed again). Persons skilled in the art are aware of normal soil conditions and climatic conditions for a given plant in a given geographic location. It should be noted that while the non-stress conditions may include some mild variations from the optimal conditions (which vary from one type/species of a plant to another), such variations do not cause the plant to cease growing without the capacity to resume growth.

The phrase "abiotic stress" as used herein refers to any adverse effect on metabolism, growth, reproduction and/or viability of a plant. Accordingly, abiotic stress can be induced by suboptimal environmental growth conditions such as, for example, salinity, water deprivation, flooding, freezing, low or high temperature, heavy metal toxicity, anaerobiosis, nutrient deficiency, atmospheric pollution or UV irradiation. The implications of abiotic stress are discussed in the Background section.

The phrase "abiotic stress tolerance" as used herein refers to the ability of a plant to endure an abiotic stress without suffering a substantial alteration in metabolism, growth, productivity and/or viability.

Plants are subject to a range of environmental challenges. Several of these, including salt stress, general osmotic stress, drought stress and freezing stress, have the ability to impact whole plant and cellular water availability. Not surprisingly, then, plant responses to this collection of stresses are related. Zhu (2002) Ann Rev. Plant Biol. 53: 247-273 et al. note that "most studies on water stress signaling have focused on salt stress primarily because plant responses to salt and drought are closely related and the mechanisms overlap". Many examples of similar responses and pathways to this set of stresses have been documented. For example, the CBF transcription factors have been shown to condition resistance to salt, freezing and drought (Kasuga et al. (1999) Nature Biotech. 17: 287-291). The Arabidopsis rd29B gene is induced in response to both salt and dehydration stress, a process that is mediated largely through an ABA signal transduction process (Uno et al. (2000) Proc. Natl. Acad. Sci. USA 97: 11632-11637), resulting in altered activity of transcription factors that bind to an upstream element within the rd29B promoter. In Mesembryanthemum crystallinum (ice plant), Patharker and Cushman have shown that a calcium-dependent protein kinase (McCDPK1) is induced by exposure to both drought and salt stresses (Patharker and Cushman (2000) Plant J. 24: 679-691). The stress-induced kinase was also shown to phosphorylate a transcription factor, presumably altering its activity, although transcript levels of the target transcription factor are not altered in response to salt or drought stress. Similarly, Saijo et al. demonstrated that a rice salt/drought-induced calmodulin-dependent protein kinase (OsCDPK7) conferred increased salt and drought tolerance to rice when overexpressed (Saijo et al. (2000) Plant J. 23: 319-327).

Exposure to dehydration invokes similar survival strategies in plants as does freezing stress (see, for example, Yelenosky (1989) Plant Physiol 89: 444-451) and drought stress induces freezing tolerance (see, for example, Siminovitch et al. (1982) Plant Physiol 69: 250-255; and Guy et al. (1992) Planta 188: 265-270). In addition to the induction of cold-acclimation proteins, strategies that allow plants to survive in low water conditions may include, for example, reduced surface area, or surface oil or wax production. In another example increased solute content of the plant prevents evaporation and water loss due to heat, drought, salinity, osmoticum, and the like therefore providing a better plant tolerance to the above stresses.

It will be appreciated that some pathways involved in resistance to one stress (as described above), will also be involved in resistance to other stresses, regulated by the same or homologous genes. Of course, the overall resistance pathways are related, not identical, and therefore not all genes controlling resistance to one stress will control resistance to the other stresses. Nonetheless, if a gene conditions resistance to one of these stresses, it would be apparent to one skilled in the art to test for resistance to these related stresses. Methods of assessing stress resistance are further provided in the Examples section which follows.

As used herein the phrase "water use efficiency (WUE)" refers to the level of organic matter produced per unit of water consumed by the plant, i.e., the dry weight of a plant in relation to the plant's water use, e.g., the biomass produced per unit transpiration.

As used herein the phrase "fertilizer use efficiency" refers to the metabolic process(es) which lead to an increase in the plant's yield, biomass, vigor, and growth rate per fertilizer unit applied. The metabolic process can be the uptake, spread, absorbent, accumulation, relocation (within the plant) and use of one or more of the minerals and organic moieties absorbed by the plant, such as nitrogen, phosphates and/or potassium.

As used herein the phrase "fertilizer-limiting conditions" refers to growth conditions which include a level (e.g., concentration) of a fertilizer applied which is below the level needed for normal plant metabolism, growth, reproduction and/or viability.

As used herein the phrase "nitrogen use efficiency (NUE)" refers to the metabolic process(es) which lead to an increase in the plant's yield, biomass, vigor, and growth rate per nitrogen unit applied. The metabolic process can be the uptake, spread, absorbent, accumulation, relocation (within the plant) and use of nitrogen absorbed by the plant.

As used herein the phrase "nitrogen-limiting conditions" refers to growth conditions which include a level (e.g., concentration) of nitrogen (e.g., ammonium or nitrate) applied which is below the level needed for normal plant metabolism, growth, reproduction and/or viability.

Improved plant NUE and FUE is translated in the field into either harvesting similar quantities of yield, while implementing less fertilizers, or increased yields gained by implementing the same levels of fertilizers. Thus, improved NUE or FUE has a direct effect on plant yield in the field. Thus, the polynucleotides and polypeptides of some embodiments of the invention positively affect plant yield, seed yield, and plant biomass. In addition, the benefit of improved plant NUE will certainly improve crop quality and biochemical constituents of the seed such as protein yield and oil yield.

It should be noted that improved ABST will confer plants with improved vigor also under non-stress conditions, resulting in crops having improved biomass and/or yield e.g., elongated fibers for the cotton industry, higher oil content.

The term "fiber" is usually inclusive of thick-walled conducting cells such as vessels and tracheids and to fibrillar aggregates of many individual fiber cells. Hence, the term "fiber" refers to (a) thick-walled conducting and non-conducting cells of the xylem; (b) fibers of extraxylary origin, including those from phloem, bark, ground tissue, and epidermis; and (c) fibers from stems, leaves, roots, seeds, and flowers or inflorescences (such as those of *Sorghum vulgare* used in the manufacture of brushes and brooms).

Example of fiber producing plants, include, but are not limited to, agricultural crops such as cotton, silk cotton tree (Kapok, *Ceiba pentandra*), desert willow, creosote bush, winterfat, balsa, kenaf, roselle, jute, sisal abaca, flax, corn, sugar cane, hemp, ramie, kapok, coir, bamboo, spanish moss and *Agave* spp. (e.g. sisal).

As used herein the phrase "fiber quality" refers to at least one fiber parameter which is agriculturally desired, or required in the fiber industry (further described hereinbelow). Examples of such parameters, include but are not limited to, fiber length, fiber strength, fiber fitness, fiber weight per unit length, maturity ratio and uniformity (further described hereinbelow).

Cotton fiber (lint) quality is typically measured according to fiber length, strength and fineness. Accordingly, the lint quality is considered higher when the fiber is longer, stronger and finer.

As used herein the phrase "fiber yield" refers to the amount or quantity of fibers produced from the fiber producing plant.

As used herein the term "increasing" refers to at least about 2%, at least about 3%, at least about 4%, at least about 5%, at least about 10%, at least about 15%, at least about 20%, at least about 30%, at least about 40%, at least about 50%, at least about 60%, at least about 70%, at least about 80%, increase in yield, biomass, growth rate, vigor, oil content, fiber yield, fiber quality, abiotic stress tolerance, and/or nitrogen use efficiency of a plant as compared to a native plant [i.e., a plant not modified with the biomolecules (polynucleotide or polypeptides) of the invention, e.g., a non-transformed plant of the same species which is grown under the same (e.g., identical) growth conditions].

The phrase "expressing within the plant an exogenous polynucleotide" as used herein refers to upregulating the expression level of an exogenous polynucleotide within the plant by introducing the exogenous polynucleotide into a plant cell or plant and expressing by recombinant means, as further described herein below.

As used herein "expressing" refers to expression at the mRNA and optionally polypeptide level.

As used herein, the phrase "exogenous polynucleotide" refers to a heterologous nucleic acid sequence which may not be naturally expressed within the plant or which overexpression in the plant is desired. The exogenous polynucleotide may be introduced into the plant in a stable or transient manner, so as to produce a ribonucleic acid (RNA) molecule and/or a polypeptide molecule. It should be noted that the exogenous polynucleotide may comprise a nucleic acid sequence which is identical or partially homologous to an endogenous nucleic acid sequence of the plant.

The term "endogenous" as used herein refers to any polynucleotide or polypeptide which is present and/or naturally expressed within a plant or a cell thereof.

According to some embodiments of the invention, the exogenous polynucleotide of the invention comprises a nucleic acid sequence encoding a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 481-792, and 2947-4663.

Homology (e.g., percent homology, identity+similarity) can be determined using any homology comparison software, including for example, the Basic Local Alignment Search Tool BlastP® or Basic Local Alignment Search Tool TBLASTN® software (National Library of Medicine) of the National Center of Biotechnology Information (NCBI) such as by using default parameters, when starting from a polypeptide sequence; or the Basic Local Alignment Search Tool tBLASTX® (National Library of Medicine) algorithm (available via the NCBI) such as by using default parameters, which compares the six-frame conceptual translation products of a nucleotide query sequence (both strands) against a protein sequence database.

According to some embodiments of the invention, the term "homology" or "homologous" refers to identity of two or more nucleic acid sequences; or identity of two or more amino acid sequences.

Homologous sequences include both orthologous and paralogous sequences. The term "paralogous" relates to gene-duplications within the genome of a species leading to paralogous genes. The term "orthologous" relates to homologous genes in different organisms due to ancestral relationship.

One option to identify orthologues in monocot plant species is by performing a reciprocal blast search. This may be done by a first blast involving blasting the sequence-of-interest against any sequence database, such as the publicly available NCBI database which may be found at: Hypertext Transfer Protocol://World Wide Web (dot) ncbi (dot) nlm (dot) nih (dot) gov. If orthologues in rice were sought, the sequence-of-interest would be blasted against, for example, the 28,469 full-length cDNA clones from Oryza sativa Nipponbare available at NCBI. The blast results may be filtered. The full-length sequences of either the filtered results or the non-filtered results are then blasted back (second blast) against the sequences of the organism from which the sequence-of-interest is derived. The results of the first and second blasts are then compared. An orthologue is identified when the sequence resulting in the highest score (best hit) in the first blast identifies in the second blast the query sequence (the original sequence-of-interest) as the best hit. Using the same rational a paralogue (homolog to a gene in the same organism) is found. In case of large sequence families, the ClustalW program may be used [Hypertext Transfer Protocol://World Wide Web (dot) ebi (dot) ac (dot) uk/Tools/clustalw2/index (dot) html], followed by a neighbor-joining tree (Hypertext Transfer Protocol://en (dot) wikipedia (dot) org/wiki/Neighbor-joining) which helps visualizing the clustering.

According to some embodiments of the invention, the exogenous polynucleotide of the invention encodes a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the amino acid sequence selected from the group consisting of SEQ ID NOs:481-792, and 2947-4663.

According to some embodiments of the invention, the method of increasing yield, biomass, growth rate, vigor, oil content, fiber yield, fiber quality, abiotic stress tolerance, and/or nitrogen use efficiency of a plant, is effected by expressing within the plant an exogenous polynucleotide comprising a nucleic acid sequence encoding a polypeptide at least at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the amino acid sequence selected from the group consisting of SEQ ID NOs:481-792, and 2947-4663, thereby increasing the yield, biomass, growth rate, vigor, oil content, fiber yield, fiber quality, abiotic stress tolerance, and/or nitrogen use efficiency of the plant.

According to some embodiments of the invention, the exogenous polynucleotide encodes a polypeptide consisting of the amino acid sequence set forth by SEQ ID NO:481-792, 2947-4662 or 4663.

According to an aspect of some embodiments of the invention, the method of increasing yield, biomass, growth rate, vigor, oil content, fiber yield, fiber quality, abiotic stress tolerance, and/or nitrogen use efficiency of a plant, is effected by expressing within the plant an exogenous polynucleotide comprising a nucleic acid sequence encoding a polypeptide comprising an amino acid sequence selected from the group consisting of SEQ ID NOs:481-792, and 2947-4663, thereby increasing the yield, biomass, growth rate, vigor, oil content, fiber yield, fiber quality, abiotic stress tolerance, and/or nitrogen use efficiency of the plant.

According to an aspect of some embodiments of the invention, there is provided a method of increasing yield, biomass, growth rate, vigor, oil content, fiber yield, fiber quality, abiotic stress tolerance, and/or nitrogen use efficiency of a plant, comprising expressing within the plant an exogenous polynucleotide comprising a nucleic acid sequence encoding a polypeptide selected from the group consisting of SEQ ID NOs: 481-792, and 2947-4663, thereby increasing the yield, biomass, growth rate, vigor, oil content, fiber yield, fiber quality, abiotic stress tolerance, and/or nitrogen use efficiency of the plant.

According to some embodiments of the invention, the exogenous polynucleotide encodes a polypeptide consisting of the amino acid sequence set forth by SEQ ID NO: 481-792, 2947-4662 or 4663.

According to some embodiments of the invention the exogenous polynucleotide comprises a nucleic acid sequence which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs:1-480, and 793-2946.

According to an aspect of some embodiments of the invention, there is provided a method of increasing yield, biomass, growth rate, vigor, oil content, fiber yield, fiber quality, abiotic stress tolerance, and/or nitrogen use efficiency of a plant, comprising expressing within the plant an exogenous polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs:1-480, and 793-2946, thereby increasing the yield, biomass, growth rate, vigor, oil content, fiber yield, fiber quality, abiotic stress tolerance, and/or nitrogen use efficiency of the plant.

According to some embodiments of the invention, the homology is a global homology, i.e., an homology over the entire amino acid or nucleic acid sequences of the invention and not over portions thereof.

According to some embodiments of the invention, the identity is a global identity, i.e., an identity over the entire amino acid or nucleic acid sequences of the invention and not over portions thereof.

Identity (e.g., percent homology) can be determined using any homology comparison software, including for example, the BlastN software of the National Center of Biotechnology Information (NCBI) such as by using default parameters.

According to some embodiments of the invention the exogenous polynucleotide is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs:1-480, and 793-2946.

According to some embodiments of the invention the exogenous polynucleotide is set forth by SEQ ID NO:1-480, 793-2945 or 2946.

According to some embodiments of the invention the exogenous polynucleotide is set forth by the nucleic acid sequence selected from the group consisting of SEQ ID NOs: 1-480, and 793-2946.

As used herein the term "polynucleotide" refers to a single or double stranded nucleic acid sequence which is isolated and provided in the form of an RNA sequence, a complementary polynucleotide sequence (cDNA), a genomic polynucleotide sequence and/or a composite polynucleotide sequences (e.g., a combination of the above).

The term "isolated" refers to at least partially separated from the natural environment e.g., from a plant cell.

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is at least partially complementary and at least partially genomic. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

Nucleic acid sequences encoding the polypeptides of the present invention may be optimized for expression. Examples of such sequence modifications include, but are not limited to, an altered G/C content to more closely approach that typically found in the plant species of interest, and the removal of codons atypically found in the plant species commonly referred to as codon optimization.

The phrase "codon optimization" refers to the selection of appropriate DNA nucleotides for use within a structural gene or fragment thereof that approaches codon usage within the plant of interest. Therefore, an optimized gene or nucleic acid sequence refers to a gene in which the nucleotide sequence of a native or naturally occurring gene has been modified in order to utilize statistically-preferred or statistically-favored codons within the plant. The nucleotide sequence typically is examined at the DNA level and the coding region optimized for expression in the plant species determined using any suitable procedure, for example as described in Sardana et al. (1996, Plant Cell Reports 15:677-681). In this method, the standard deviation of codon usage, a measure of codon usage bias, may be calculated by first finding the squared proportional deviation of usage of each codon of the native gene relative to that of highly expressed plant genes, followed by a calculation of the average squared deviation. The formula used is: 1 SDCU=n=1 N [(Xn−Yn)/Yn]2/N, where Xn refers to the frequency of usage of codon n in highly expressed plant genes, where Yn to the frequency of usage of codon n in the gene of interest and N refers to the total number of codons in the gene of interest. A Table of codon usage from highly expressed genes of dicotyledonous plants is compiled using the data of Murray et al. (1989, Nuc Acids Res. 17:477-498).

One method of optimizing the nucleic acid sequence in accordance with the preferred codon usage for a particular plant cell type is based on the direct use, without performing any extra statistical calculations, of codon optimization Tables such as those provided on-line at the Codon Usage Database through the NIAS (National Institute of Agrobiological Sciences) DNA bank in Japan (Hypertext Transfer Protocol://World Wide Web (dot) kazusa (dot) or (dot) jp/codon/). The Codon Usage Database contains codon usage tables for a number of different species, with each codon usage Table having been statistically determined based on the data present in Genbank.

By using the above Tables to determine the most preferred or most favored codons for each amino acid in a particular species (for example, rice), a naturally-occurring nucleotide sequence encoding a protein of interest can be codon optimized for that particular plant species. This is effected by replacing codons that may have a low statistical incidence in the particular species genome with corresponding codons, in regard to an amino acid, that are statistically more favored. However, one or more less-favored codons may be selected to delete existing restriction sites, to create new ones at potentially useful junctions (5' and 3' ends to add signal peptide or termination cassettes, internal sites that might be used to cut and splice segments together to produce a correct full-length sequence), or to eliminate nucleotide sequences that may negatively effect mRNA stability or expression.

The naturally-occurring encoding nucleotide sequence may already, in advance of any modification, contain a number of codons that correspond to a statistically-favored codon in a particular plant species. Therefore, codon optimization of the native nucleotide sequence may comprise determining which codons, within the native nucleotide sequence, are not statistically-favored with regards to a particular plant, and modifying these codons in accordance with a codon usage table of the particular plant to produce a codon optimized derivative. A modified nucleotide sequence may be fully or partially optimized for plant codon usage provided that the protein encoded by the modified nucleotide sequence is produced at a level higher than the protein encoded by the corresponding naturally occurring or native gene. Construction of synthetic genes by altering the codon usage is described in for example PCT Patent Application 93/07278.

According to some embodiments of the invention, the exogenous polynucleotide is a non-coding RNA.

As used herein the phrase 'non-coding RNA" refers to an RNA molecule which does not encode an amino acid sequence (a polypeptide). Examples of such non-coding RNA molecules include, but are not limited to, an antisense RNA, a pre-miRNA (precursor of a microRNA), or a precursor of a Piwi-interacting RNA (piRNA).

Non-limiting examples of non-coding RNA polynucleotides are provided in SEQ ID NOs: 201-213, 280-288, and 476-480.

Thus, the invention encompasses nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or man induced, either randomly or in a targeted fashion.

The invention provides an isolated polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs:1-480, and 793-2946.

According to some embodiments of the invention the nucleic acid sequence is capable of increasing yield, biomass, growth rate, vigor, oil content, fiber yield, fiber quality, abiotic stress tolerance, fertilizer use efficiency, water use efficiency and/or nitrogen use efficiency of a plant.

According to some embodiments of the invention the isolated polynucleotide comprising the nucleic acid sequence selected from the group consisting of SEQ ID NOs:1-480, and 793-2946.

According to some embodiments of the invention the isolated polynucleotide is set forth by SEQ ID NO:1-480, 793-2945 or 2946.

The invention provides an isolated polynucleotide comprising a nucleic acid sequence encoding a polypeptide which comprises an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to the amino acid sequence selected from the group consisting of SEQ ID NO: 481-792, and 2947-4663.

According to some embodiments of the invention the amino acid sequence is capable of increasing yield, biomass, growth rate, vigor, oil content, fiber yield, fiber quality, abiotic stress tolerance, fertilizer use efficiency, water use efficiency and/or nitrogen use efficiency of a plant.

The invention provides an isolated polynucleotide comprising a nucleic acid sequence encoding a polypeptide which comprises the amino acid sequence selected from the group consisting of SEQ ID NOs:481-792, and 2947-4663.

The invention provides an isolated polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to an amino acid sequence selected from the group consisting of SEQ ID NO: 481-792, and 2947-4663.

According to some embodiments of the invention the amino acid sequence is capable of increasing yield, biomass, growth rate, vigor, oil content, fiber yield, fiber quality, abiotic stress tolerance, fertilizer use efficiency, water use efficiency and/or nitrogen use efficiency of a plant.

According to some embodiments of the invention, the polypeptide comprising an amino acid sequence selected from the group consisting of SEQ ID NOs:481-792, and 2947-4663.

According to some embodiments of the invention, the polypeptide is set forth by SEQ ID NO: 481-792, 2947-4662 or 4663.

According to an aspect of some embodiments of the invention, there is provided a nucleic acid construct comprising the isolated polynucleotide of the invention, and a promoter for directing transcription of the nucleic acid sequence in a host cell.

The invention also encompasses fragments of the above described polypeptides and polypeptides having mutations, such as deletions, insertions or substitutions of one or more amino acids, either naturally occurring or man induced, either randomly or in a targeted fashion.

The term "plant" as used herein encompasses whole plants, ancestors and progeny of the plants and plant parts, including seeds, shoots, stems, roots (including tubers), and plant cells, tissues and organs. The plant may be in any form including suspension cultures, embryos, meristematic regions, callus tissue, leaves, gametophytes, sporophytes, pollen, and microspores. Plants that are particularly useful in the methods of the invention include all plants which belong to the superfamily Viridiplantae, in particular monocotyledonous and dicotyledonous plants including a fodder or forage legume, ornamental plant, food crop, tree, or shrub selected from the list comprising *Acacia* spp., *Acer* spp., *Actinidia* spp., *Aesculus* spp., *Agathis australis, Albizia amara, Alsophila tricolor, Andropogon* spp., *Arachis* spp, *Areca catechu, Astelia fragrans, Astragalus cicer, Baikiaea plurijuga, Betula* spp., *Brassica* spp., *Bruguiera gymnorrhiza, Burkea africana, Butea frondosa, Cadaba farinosa, Calliandra* spp, *Camellia sinensis, Canna indica, Capsicum* spp., *Cassia* spp., *Centroema pubescens, Chacoomeles* spp., *Cinnamomum cassia, Coffea arabica, Colophospermum mopane, Coronillia varia, Cotoneaster serotina, Crataegus* spp., *Cucumis* spp., *Cupressus* spp., *Cyathea dealbata, Cydonia oblonga, Cryptomeria japonica, Cymbopogon* spp., *Cynthea dealbata, Cydonia oblonga, Dalbergia monetaria, Davallia divaricata, Desmodium* spp., *Dicksonia squarosa, Dibeteropogon amplectens,*

*Dioclea* spp, *Dolichos* spp., *Dorycnium rectum*, *Echinochloa pyramidalis*, *Ehraffia* spp., *Eleusine coracana*, *Eragrestis* spp., *Erythrina* spp., *Eucalypfus* spp., *Euclea schimperi*, *Eulalia vi/losa*, *Pagopyrum* spp., *Feijoa sellowlana*, *Fragaria* spp., *Flemingia* spp, *Freycinetia banksli*, *Geranium thunbergii*, *GinAgo biloba*, *Glycine javanica*, *Gliricidia* spp, *Gossypium hirsutum*, *Grevillea* spp., *Guibourtia coleosperma*, *Hedysarum* spp., *Hemaffhia altissima*, *Heteropogon contoffus*, *Hordeum vulgare*, *Hyparrhenia rufa*, *Hypericum erectum*, *Hypeffhelia dissolute*, *Indigo incamata*, *Iris* spp., *Leptarrhena pyrolifolia*, *Lespediza* spp., *Lettuca* spp., *Leucaena leucocephala*, *Loudetia simplex*, *Lotonus bainesli*, *Lotus* spp., *Macrotyloma axillare*, *Malus* spp., *Manihot esculenta*, *Medicago saliva*, *Metasequoia glyptostroboides*, *Musa sapientum*, *Nicotianum* spp., *Onobrychis* spp., *Ornithopus* spp., *Oryza* spp., *Peltophorum africanum*, *Pennisetum* spp., *Persea gratissima*, *Petunia* spp., *Phaseolus* spp., *Phoenix canariensis*, *Phormium cookianum*, *Photinia* spp., *Picea glauca*, *Pinus* spp., *Pisum sativam*, *Podocarpus totara*, *Pogonarthria fleckii*, *Pogonaffhria squarrosa*, *Populus* spp., *Prosopis cineraria*, *Pseudotsuga menziesii*, *Pterolobium stellatum*, *Pyrus communis*, *Quercus* spp., *Rhaphiolepsis umbellata*, *Rhopalostylis sapida*, *Rhus natalensis*, *Ribes grossularia*, *Ribes* spp., *Robinia pseudoacacia*, *Rosa* spp., *Rubus* spp., *Salix* spp., *Schyzachyrium sanguineum*, *Sciadopitys vefficillata*, *Sequoia sempervirens*, *Sequoiadendron giganteum*, *Sorghum bicolor*, *Spinacia* spp., *Sporobolus fimbriatus*, *Stiburus alopecuroides*, *Stylosanthos humilis*, *Tadehagi* spp, *Taxodium distichum*, *Themeda triandra*, *Trifolium* spp., *Triticum* spp., *Tsuga heterophylla*, *Vaccinium* spp., *Vicia* spp., *Vitis vinifera*, *Watsonia pyramidata*, *Zantedeschia aethiopica*, *Zea mays*, amaranth, artichoke, asparagus, broccoli, Brussels sprouts, cabbage, canola, carrot, cauliflower, celery, collard greens, flax, kale, lentil, oilseed rape, okra, onion, potato, rice, soybean, straw, sugar beet, sugar cane, sunflower, tomato, squash tea, maize, wheat, barely, rye, oat, peanut, pea, lentil and alfalfa, cotton, rapeseed, canola, pepper, sunflower, tobacco, eggplant, eucalyptus, a tree, an ornamental plant, a perennial grass and a forage crop. Alternatively algae and other non-Viridiplantae can be used for the methods of the present invention.

According to some embodiments of the invention, the plant used by the method of the invention is a crop plant such as rice, maize, wheat, barley, peanut, potato, sesame, olive tree, palm oil, banana, soybean, sunflower, canola, sugarcane, alfalfa, millet, leguminosae (bean, pea), flax, lupinus, rapeseed, tobacco, poplar and cotton.

According to some embodiments of the invention, there is provided a plant cell exogenously expressing the polynucleotide of some embodiments of the invention, the nucleic acid construct of some embodiments of the invention and/or the polypeptide of some embodiments of the invention.

According to some embodiments of the invention, expressing the exogenous polynucleotide of the invention within the plant is effected by transforming one or more cells of the plant with the exogenous polynucleotide, followed by generating a mature plant from the transformed cells and cultivating the mature plant under conditions suitable for expressing the exogenous polynucleotide within the mature plant.

According to some embodiments of the invention, the transformation is effected by introducing to the plant cell a nucleic acid construct which includes the exogenous polynucleotide of some embodiments of the invention and at least one promoter for directing transcription of the exogenous polynucleotide in a host cell (a plant cell). Further details of suitable transformation approaches are provided hereinbelow.

As mentioned, the nucleic acid construct according to some embodiments of the invention comprises a promoter sequence and the isolated polynucleotide of the invention.

According to some embodiments of the invention, the isolated polynucleotide is operably linked to the promoter sequence.

A coding nucleic acid sequence is "operably linked" to a regulatory sequence (e.g., promoter) if the regulatory sequence is capable of exerting a regulatory effect on the coding sequence linked thereto.

As used herein, the term "promoter" refers to a region of DNA which lies upstream of the transcriptional initiation site of a gene to which RNA polymerase binds to initiate transcription of RNA. The promoter controls where (e.g., which portion of a plant) and/or when (e.g., at which stage or condition in the lifetime of an organism) the gene is expressed.

According to some embodiments of the invention, the promoter is heterologous to the isolated polynucleotide and/or to the host cell.

Any suitable promoter sequence can be used by the nucleic acid construct of the present invention. Preferably the promoter is a constitutive promoter, a tissue-specific, or an abiotic stress-inducible promoter.

According to some embodiments of the invention, the promoter is a plant promoter, which is suitable for expression of the exogenous polynucleotide in a plant cell.

Suitable constitutive promoters include, for example, CaMV 35S promoter [SEQ ID NO:4666 (pQFNC); SEQ ID NO:5158 (PJJ 35S from Brachypodium); SEQ ID NO:5159 (Odell et al., Nature 313:810-812, 1985)], Arabidopsis At6669 promoter (SEQ ID NO:4665; see PCT Publication No. WO04081173A2 or the new At6669 promoter (SEQ ID NO:4668); maize Ubi 1 (Christensen et al., Plant Sol. Biol. 18:675-689, 1992); rice actin (McElroy et al., Plant Cell 2:163-171, 1990); pEMU (Last et al., Theor. Appl. Genet. 81:581-588, 1991); CaMV 19S (Nilsson et al., Physiol. Plant 100:456-462, 1997); GOS2 (de Pater et al, Plant J November; 2(6):837-44, 1992); ubiquitin (Christensen et al, Plant Mol. Biol. 18: 675-689, 1992); Ubi 1 promoter (SEQ ID NO:5157); RBCS promoter (SEQ ID NO:5156); Rice cyclophilin (Bucholz et al, Plant Mol Biol. 25(5):837-43, 1994); Maize H3 histone (Lepetit et al, Mol. Gen. Genet. 231: 276-285, 1992); Actin 2 (An et al, Plant J. 10(1); 107-121, 1996) and Synthetic Super MAS (Ni et al., The Plant Journal 7: 661-76, 1995). Other constitutive promoters include those in U.S. Pat. Nos. 5,659,026, 5,608,149; 5,608,144; 5,604,121; 5,569,597: 5,466,785; 5,399,680; 5,268,463; and 5,608,142.

Suitable tissue-specific promoters include, but not limited to, leaf-specific promoters [such as described, for example, by Yamamoto et al., Plant J. 12:255-265, 1997; Kwon et al., Plant Physiol. 105:357-67, 1994; Yamamoto et al., Plant Cell Physiol. 35:773-778, 1994; Gotor et al., Plant J. 3:509-18, 1993; Orozco et al., Plant Mol. Biol. 23:1129-1138, 1993; and Matsuoka et al., Proc. Natl. Acad. Sci. USA 90:9586-9590, 1993], seed-preferred promoters [e.g., Napin (originated from *Brassica napus* which is characterized by a seed specific promoter activity; Stuitje A. R. et. al. Plant Biotechnology Journal 1 (4): 301-309; SEQ ID NO:4667), from seed specific genes (Simon, et al., Plant Mol. Biol. 5. 191, 1985; Scofield, et al., J. Biol. Chem. 262: 12202, 1987; Baszczynski, et al., Plant Mol. Biol. 14: 633, 1990), Brazil Nut albumin (Pearson' et al., Plant Mol. Biol. 18: 235-245, 1992), legumin (Ellis, et al. Plant Mol. Biol. 10: 203-214, 1988), Glutelin (rice) (Takaiwa, et al., Mol. Gen. Genet. 208: 15-22, 1986; Takaiwa, et al., FEBS Letts. 221: 43-47, 1987), Zein (Matzke et al Plant Mol Biol, 143). 323-32 1990), napA (Stalberg, et al, Planta 199: 515-519, 1996), Wheat SPA (Albanietal, Plant Cell, 9: 171-184, 1997), sunflower oleosin (Cummins, et al., Plant Mol. Biol. 19: 873-876, 1992)], endosperm specific promoters [e.g., wheat LMW and HMW, glutenin-1 (Mol Gen Genet 216:81-90, 1989; NAR 17:461-2), wheat a, b and g gliadins (EMBO3:1409-15, 1984), Barley ltrl promoter, barley B1, C, D hordein (Theor Appl Gen 98:1253-62, 1999; Plant J 4:343-55, 1993; Mol Gen Genet 250:750-60, 1996), Barley DOF (Mena et al, The Plant Journal, 116(1): 53-62, 1998), Biz2 (EP99106056.7), Synthetic promoter (Vicente-Carbajosa et al., Plant J. 13: 629-640, 1998), rice prolamin NRP33, rice-globulin Glb-1 (Wu et al, Plant Cell Physiology 39(8) 885-889, 1998), rice alpha-globulin REB/OHP-1 (Nakase et al. Plant Mol. Biol. 33: 513-S22, 1997), rice ADP-glucose PP (Trans Res 6:157-68, 1997), maize ESR gene family (Plant J 12:235-46, 1997), sorgum gamma-kafirin (PMB 32:1029-35, 1996)], embryo specific promoters [e.g., rice OSH1 (Sato et al, Proc. Natl. Acad. Sci. USA, 93: 8117-8122), KNOX (Postma-Haarsma of al, Plant Mol. Biol. 39:257-71, 1999), rice oleosin (Wu et at, J. Biochem., 123: 386, 1998)], and flower-specific promoters [e.g., AtPRP4, chalene synthase (chsA) (Van der Meer, et al., Plant Mol. Biol. 15, 95-109, 1990), LAT52 (Twell et al Mol. Gen Genet. 217:240-245; 1989), apetala-3], and root promoters such as the ROOTP promoter [SEQ ID NO: 4669].

Suitable abiotic stress-inducible promoters include, but not limited to, salt-inducible promoters such as RD29A (Yamaguchi-Shinozalei et al., Mol. Gen. Genet. 236:331-340, 1993); drought-inducible promoters such as maize rab17 gene promoter (Pla et. al., Plant Mol. Biol. 21:259-266, 1993), maize rab28 gene promoter (Busk et. al., Plant J. 11:1285-1295, 1997) and maize Ivr2 gene promoter (Pelleschi et. al., Plant Mol. Biol. 39:373-380, 1999); heat-inducible promoters such as heat tomato hsp80-promoter from tomato (U.S. Pat. No. 5,187,267).

The nucleic acid construct of some embodiments of the invention can further include an appropriate selectable marker and/or an origin of replication. According to some embodiments of the invention, the nucleic acid construct utilized is a shuttle vector, which can propagate both in E. coli (wherein the construct comprises an appropriate selectable marker and origin of replication) and be compatible with propagation in cells. The construct according to the present invention can be, for example, a plasmid, a bacmid, a phagemid, a cosmid, a phage, a virus or an artificial chromosome.

The nucleic acid construct of some embodiments of the invention can be utilized to stably or transiently transform plant cells. In stable transformation, the exogenous polynucleotide is integrated into the plant genome and as such it represents a stable and inherited trait. In transient transformation, the exogenous polynucleotide is expressed by the cell transformed but it is not integrated into the genome and as such it represents a transient trait.

There are various methods of introducing foreign genes into both monocotyledonous and dicotyledonous plants (Potrykus, I., Annu. Rev. Plant. Physiol., Plant. Mol. Biol. (1991) 42:205-225; Shimamoto et al., Nature (1989) 338:274-276).

The principle methods of causing stable integration of exogenous DNA into plant genomic DNA include two main approaches:

(i) Agrobacterium-mediated gene transfer: Klee et al. (1987) Annu. Rev. Plant Physiol. 38:467-486; Klee and Rogers in Cell Culture and Somatic Cell Genetics of Plants, Vol. 6, Molecular Biology of Plant Nuclear Genes, eds. Schell, J., and Vasil, L. K., Academic Publishers, San Diego, Calif. (1989) p. 2-25; Gatenby, in Plant Biotechnology, eds. Kung, S. and Arntzen, C. J., Butterworth Publishers, Boston, Mass. (1989) p. 93-112.

(ii) Direct DNA uptake: Paszkowski et al., in Cell Culture and Somatic Cell Genetics of Plants, Vol. 6, Molecular Biology of Plant Nuclear Genes eds. Schell, J., and Vasil, L. K., Academic Publishers, San Diego, Calif. (1989) p. 52-68; including methods for direct uptake of DNA into protoplasts, Toriyama, K. et al. (1988) Bio/Technology 6:1072-1074. DNA uptake induced by brief electric shock of plant cells: Zhang et al. Plant Cell Rep. (1988) 7:379-384. Fromm et al. Nature (1986) 319:791-793. DNA injection into plant cells or tissues by particle bombardment, Klein et al. Bio/Technology (1988) 6:559-563; McCabe et al. Bio/Technology (1988) 6:923-926; Sanford, Physiol. Plant. (1990) 79:206-209; by the use of micropipette systems: Neuhaus et al., Theor. Appl. Genet. (1987) 75:30-36; Neuhaus and Spangenberg, Physiol. Plant. (1990) 79:213-217; glass fibers or silicon carbide whisker transformation of cell cultures, embryos or callus tissue, U.S. Pat. No. 5,464,765 or by the direct incubation of DNA with germinating pollen, DeWet et al. in Experimental Manipulation of Ovule Tissue, eds. Chapman, G. P. and Mantell, S. H. and Daniels, W. Longman, London, (1985) p. 197-209; and Ohta, Proc. Natl. Acad. Sci. USA (1986) 83:715-719.

The Agrobacterium system includes the use of plasmid vectors that contain defined DNA segments that integrate into the plant genomic DNA. Methods of inoculation of the plant tissue vary depending upon the plant species and the Agrobacterium delivery system. A widely used approach is the leaf disc procedure which can be performed with any tissue explant that provides a good source for initiation of whole plant differentiation. See, e.g., Horsch et al. in Plant Molecular Biology Manual A5, Kluwer Academic Publishers, Dordrecht (1988) p. 1-9. A supplementary approach employs the Agrobacterium delivery system in combination with vacuum infiltration. The Agrobacterium system is especially viable in the creation of transgenic dicotyledonous plants.

There are various methods of direct DNA transfer into plant cells. In electroporation, the protoplasts are briefly exposed to a strong electric field. In microinjection, the DNA is mechanically injected directly into the cells using very small micropipettes. In microparticle bombardment, the DNA is adsorbed on microprojectiles such as magnesium sulfate crystals or tungsten particles, and the microprojectiles are physically accelerated into cells or plant tissues.

Following stable transformation plant propagation is exercised. The most common method of plant propagation is by seed. Regeneration by seed propagation, however, has the deficiency that due to heterozygosity there is a lack of uniformity in the crop, since seeds are produced by plants according to the genetic variances governed by Mendelian rules. Basically, each seed is genetically different and each will grow with its own specific traits. Therefore, it is preferred that the transformed plant be produced such that the regenerated plant has the identical traits and characteristics of the parent transgenic plant. Therefore, it is preferred that the transformed plant be regenerated by micropropagation which provides a rapid, consistent reproduction of the transformed plants.

Micropropagation is a process of growing new generation plants from a single piece of tissue that has been excised from a selected parent plant or cultivar. This process permits the mass reproduction of plants having the preferred tissue expressing the fusion protein. The new generation plants which are produced are genetically identical to, and have all of the characteristics of, the original plant. Micropropagation allows mass production of quality plant material in a short period of time and offers a rapid multiplication of selected cultivars in the preservation of the characteristics of the original transgenic or transformed plant. The advantages of cloning plants are the speed of plant multiplication and the quality and uniformity of plants produced.

Micropropagation is a multi-stage procedure that requires alteration of culture medium or growth conditions between stages. Thus, the micropropagation process involves four basic stages: Stage one, initial tissue culturing; stage two, tissue culture multiplication; stage three, differentiation and plant formation; and stage four, greenhouse culturing and hardening. During stage one, initial tissue culturing, the tissue culture is established and certified contaminant-free. During stage two, the initial tissue culture is multiplied until a sufficient number of tissue samples are produced to meet production goals. During stage three, the tissue samples grown in stage two are divided and grown into individual plantlets. At stage four, the transformed plantlets are transferred to a greenhouse for hardening where the plants' tolerance to light is gradually increased so that it can be grown in the natural environment.

According to some embodiments of the invention, the transgenic plants are generated by transient transformation of leaf cells, meristematic cells or the whole plant.

Transient transformation can be effected by any of the direct DNA transfer methods described above or by viral infection using modified plant viruses.

Viruses that have been shown to be useful for the transformation of plant hosts include CaMV, Tobacco mosaic virus (TMV), brome mosaic virus (BMV) and Bean Common Mosaic Virus (BV or BCMV). Transformation of plants using plant viruses is described in U.S. Pat. No. 4,855,237 (bean golden mosaic virus; BGV), EP-A 67,553 (TMV), Japanese Published Application No. 63-14693 (TMV), EPA 194,809 (BV), EPA 278,667 (BV); and Gluzman, Y. et al., Communications in Molecular Biology: Viral Vectors, Cold Spring Harbor Laboratory, New York, pp. 172-189 (1988). Pseudovirus particles for use in expressing foreign DNA in many hosts, including plants are described in WO 87/06261.

According to some embodiments of the invention, the virus used for transient transformations is avirulent and thus is incapable of causing severe symptoms such as reduced growth rate, mosaic, ring spots, leaf roll, yellowing, streaking, pox formation, tumor formation and pitting. A suitable avirulent virus may be a naturally occurring avirulent virus or an artificially attenuated virus. Virus attenuation may be effected by using methods well known in the art including, but not limited to, sub-lethal heating, chemical treatment or by directed mutagenesis techniques such as described, for example, by Kurihara and Watanabe (Molecular Plant Pathology 4:259-269, 2003), Gal-on et al. (1992), Atreya et al. (1992) and Huet et al. (1994).

Suitable virus strains can be obtained from available sources such as, for example, the American Type culture Collection (ATCC) or by isolation from infected plants. Isolation of viruses from infected plant tissues can be effected by techniques well known in the art such as described, for example by Foster and Tatlor, Eds. "Plant Virology Protocols: From Virus Isolation to Transgenic Resistance (Methods in Molecular Biology (Humana Pr), Vol 81)", Humana Press, 1998. Briefly, tissues of an infected plant believed to contain a high concentration of a suitable virus, preferably young leaves and flower petals, are ground in a buffer solution (e.g., phosphate buffer solution) to produce a virus infected sap which can be used in subsequent inoculations.

Construction of plant RNA viruses for the introduction and expression of non-viral exogenous polynucleotide sequences in plants is demonstrated by the above references as well as by Dawson, W. O. et al., Virology (1989) 172:285-292; Takamatsu et al. EMBO J. (1987) 6:307-311; French et al. Science (1986) 231:1294-1297; Takamatsu et al. FEBS Letters (1990) 269:73-76; and U.S. Pat. No. 5,316,931.

When the virus is a DNA virus, suitable modifications can be made to the virus itself. Alternatively, the virus can first be cloned into a bacterial plasmid for ease of constructing the desired viral vector with the foreign DNA. The virus can then be excised from the plasmid. If the virus is a DNA virus, a bacterial origin of replication can be attached to the viral DNA, which is then replicated by the bacteria. Transcription and translation of this DNA will produce the coat protein which will encapsidate the viral DNA. If the virus is an RNA virus, the virus is generally cloned as a cDNA and inserted into a plasmid. The plasmid is then used to make all of the constructions. The RNA virus is then produced by transcribing the viral sequence of the plasmid and translation of the viral genes to produce the coat protein(s) which encapsidate the viral RNA.

In one embodiment, a plant viral polynucleotide is provided in which the native coat protein coding sequence has been deleted from a viral polynucleotide, a non-native plant viral coat protein coding sequence and a non-native promoter, preferably the subgenomic promoter of the non-native coat protein coding sequence, capable of expression in the plant host, packaging of the recombinant plant viral polynucleotide, and ensuring a systemic infection of the host by the recombinant plant viral polynucleotide, has been inserted. Alternatively, the coat protein gene may be inactivated by insertion of the non-native polynucleotide sequence within it, such that a protein is produced. The recombinant plant viral polynucleotide may contain one or more additional non-native subgenomic promoters. Each non-native subgenomic promoter is capable of transcribing or expressing adjacent genes or polynucleotide sequences in the plant host and incapable of recombination with each other and with native subgenomic promoters. Non-native (foreign) polynucleotide sequences may be inserted adjacent the native plant viral subgenomic promoter or the native and a non-native plant viral subgenomic promoters if more than one polynucleotide sequence is included. The non-native polynucleotide sequences are transcribed or expressed in the host plant under control of the subgenomic promoter to produce the desired products.

In a second embodiment, a recombinant plant viral polynucleotide is provided as in the first embodiment except that the native coat protein coding sequence is placed adjacent one of the non-native coat protein subgenomic promoters instead of a non-native coat protein coding sequence.

In a third embodiment, a recombinant plant viral polynucleotide is provided in which the native coat protein gene is adjacent its subgenomic promoter and one or more non-native subgenomic promoters have been inserted into the viral polynucleotide. The inserted non-native subgenomic promoters are capable of transcribing or expressing adjacent genes in a plant host and are incapable of recombination with each other and with native subgenomic promoters. Non-native polynucleotide sequences may be inserted adjacent the non-native subgenomic plant viral promoters such that the sequences are transcribed or expressed in the host plant under control of the subgenomic promoters to produce the desired product.

In a fourth embodiment, a recombinant plant viral polynucleotide is provided as in the third embodiment except that the native coat protein coding sequence is replaced by a non-native coat protein coding sequence.

The viral vectors are encapsidated by the coat proteins encoded by the recombinant plant viral polynucleotide to produce a recombinant plant virus. The recombinant plant viral polynucleotide or recombinant plant virus is used to infect appropriate host plants. The recombinant plant viral polynucleotide is capable of replication in the host, systemic spread in the host, and transcription or expression of foreign gene(s) (exogenous polynucleotide) in the host to produce the desired protein.

Techniques for inoculation of viruses to plants may be found in Foster and Taylor, eds. "Plant Virology Protocols: From Virus Isolation to Transgenic Resistance (Methods in Molecular Biology (Humana Pr), Vol 81)", Humana Press, 1998; Maramorosh and Koprowski, eds. "Methods in Virology" 7 vols, Academic Press, New York 1967-1984; Hill, S. A. "Methods in Plant Virology", Blackwell, Oxford, 1984; Walkey, D. G. A. "Applied Plant Virology", Wiley, New York, 1985; and Kado and Agrawa, eds. "Principles and Techniques in Plant Virology", Van Nostrand-Reinhold, New York.

In addition to the above, the polynucleotide of the present invention can also be introduced into a chloroplast genome thereby enabling chloroplast expression.

A technique for introducing exogenous polynucleotide sequences to the genome of the chloroplasts is known. This technique involves the following procedures. First, plant cells are chemically treated so as to reduce the number of chloroplasts per cell to about one. Then, the exogenous polynucleotide is introduced via particle bombardment into the cells with the aim of introducing at least one exogenous polynucleotide molecule into the chloroplasts. The exogenous polynucleotides selected such that it is integratable into the chloroplast's genome via homologous recombination which is readily effected by enzymes inherent to the chloroplast. To this end, the exogenous polynucleotide includes, in addition to a gene of interest, at least one polynucleotide stretch which is derived from the chloroplast's genome. In addition, the exogenous polynucleotide includes a selectable marker, which serves by sequential selection procedures to ascertain that all or substantially all of the copies of the chloroplast genomes following such selection will include the exogenous polynucleotide. Further details relating to this technique are found in U.S. Pat. Nos. 4,945,050; and 5,693,507 which are incorporated herein by reference. A polypeptide can thus be produced by the protein expression system of the chloroplast and become integrated into the chloroplast's inner membrane.

Since processes which increase yield, biomass, growth rate, vigor, oil content, fiber yield, fiber quality, abiotic stress tolerance, and/or nitrogen use efficiency of a plant can involve multiple genes acting additively or in synergy (see, for example, in Quesda et al., Plant Physiol. 130:951-063, 2002), the present invention also envisages expressing a plurality of exogenous polynucleotides in a single host plant to thereby achieve superior effect on oil content, yield, growth rate, biomass, vigor and/or abiotic stress tolerance.

Expressing a plurality of exogenous polynucleotides in a single host plant can be effected by co-introducing multiple nucleic acid constructs, each including a different exogenous polynucleotide, into a single plant cell. The transformed cell can than be regenerated into a mature plant using the methods described hereinabove.

Alternatively, expressing a plurality of exogenous polynucleotides in a single host plant can be effected by co-introducing into a single plant-cell a single nucleic-acid construct including a plurality of different exogenous polynucleotides. Such a construct can be designed with a single promoter sequence which can transcribe a polycistronic messenger RNA including all the different exogenous polynucleotide sequences. To enable co-translation of the different polypeptides encoded by the polycistronic messenger RNA, the polynucleotide sequences can be inter-linked via an internal ribosome entry site (IRES) sequence which facilitates translation of polynucleotide sequences positioned downstream of the IRES sequence. In this case, a transcribed polycistronic RNA molecule encoding the different polypeptides described above will be translated from both the capped 5' end and the two internal IRES sequences of the polycistronic RNA molecule to thereby produce in the cell all different polypeptides. Alternatively, the construct can include several promoter sequences each linked to a different exogenous polynucleotide sequence.

The plant cell transformed with the construct including a plurality of different exogenous polynucleotides, can be regenerated into a mature plant, using the methods described hereinabove.

Alternatively, expressing a plurality of exogenous polynucleotides in a single host plant can be effected by introducing different nucleic acid constructs, including different exogenous polynucleotides, into a plurality of plants. The regenerated transformed plants can then be cross-bred and resultant progeny selected for superior abiotic stress tolerance, water use efficiency, fertilizer use efficiency, growth, biomass, yield and/or vigor traits, using conventional plant breeding techniques.

According to some embodiments of the invention, the method further comprising growing the plant expressing the exogenous polynucleotide under the abiotic stress.

Non-limiting examples of abiotic stress conditions include, salinity, drought, water deprivation, excess of water (e.g., flood, waterlogging), etiolation, low temperature, high temperature, heavy metal toxicity, anaerobiosis, nutrient deficiency, nutrient excess, atmospheric pollution and UV irradiation.

Thus, the invention encompasses plants exogenously expressing the polynucleotide(s), the nucleic acid constructs and/or polypeptide(s) of the invention.

Once expressed within the plant cell or the entire plant, the level of the polypeptide encoded by the exogenous polynucleotide can be determined by methods well known in the art such as, activity assays, Western blots using antibodies capable of specifically binding the polypeptide, Enzyme-Linked Immuno Sorbent Assay (ELISA), radio-immuno-assays (RIA), immunohistochemistry, immunocytochemistry, immunofluorescence and the like.

Methods of determining the level in the plant of the RNA transcribed from the exogenous polynucleotide are well known in the art and include, for example, Northern blot analysis, reverse transcription polymerase chain reaction (RT-PCR) analysis (including quantitative, semi-quantitative or real-time RT-PCR) and RNA-in situ hybridization.

The sequence information and annotations uncovered by the present teachings can be harnessed in favor of classical breeding. Thus, sub-sequence data of those polynucleotides described above, can be used as markers for marker assisted selection (MAS), in which a marker is used for indirect selection of a genetic determinant or determinants of a trait of interest (e.g., biomass, growth rate, oil content, yield, abiotic stress tolerance, water use efficiency, nitrogen use efficiency and/or fertilizer use efficiency). Nucleic acid data of the present teachings (DNA or RNA sequence) may contain or be linked to polymorphic sites or genetic markers on the genome such as restriction fragment length polymorphism (RFLP), microsatellites and single nucleotide polymorphism (SNP), DNA fingerprinting (DFP), amplified fragment length polymorphism (AFLP), expression level polymorphism, polymorphism of the encoded polypeptide and any other polymorphism at the DNA or RNA sequence.

Examples of marker assisted selections include, but are not limited to, selection for a morphological trait (e.g., a gene that affects form, coloration, male sterility or resistance such as the presence or absence of awn, leaf sheath coloration, height, grain color, aroma of rice); selection for a biochemical trait (e.g., a gene that encodes a protein that can be extracted and observed; for example, isozymes and storage proteins); selection for a biological trait (e.g., pathogen races or insect biotypes based on host pathogen or host parasite interaction can be used as a marker since the genetic constitution of an organism can affect its susceptibility to pathogens or parasites).

The polynucleotides and polypeptides described hereinabove can be used in a wide range of economical plants, in a safe and cost effective manner.

Plant lines exogenously expressing the polynucleotide or the polypeptide of the invention are screened to identify those that show the greatest increase of the desired plant trait.

The effect of the transgene (the exogenous polynucleotide encoding the polypeptide) on abiotic stress tolerance can be determined using known methods such as detailed below and in the Examples section which follows.

Abiotic stress tolerance—Transformed (i.e., expressing the transgene) and non-transformed (wild type) plants are exposed to an abiotic stress condition, such as water deprivation, suboptimal temperature (low temperature, high temperature), nutrient deficiency, nutrient excess, a salt stress condition, osmotic stress, heavy metal toxicity, anaerobiosis, atmospheric pollution and UV irradiation.

Salinity tolerance assay—Transgenic plants with tolerance to high salt concentrations are expected to exhibit better germination, seedling vigor or growth in high salt. Salt stress can be effected in many ways such as, for example, by irrigating the plants with a hyperosmotic solution, by cultivating the plants hydroponically in a hyperosmotic growth solution (e.g., Hoagland solution), or by culturing the plants in a hyperosmotic growth medium [e.g., 50% Murashige-Skoog medium (MS medium)]. Since different plants vary considerably in their tolerance to salinity, the salt concentration in the irrigation water, growth solution, or growth medium can be adjusted according to the specific characteristics of the specific plant cultivar or variety, so as to inflict a mild or moderate effect on the physiology and/or morphology of the plants (for guidelines as to appropriate concentration see, Bernstein and Kafkafi, Root Growth Under Salinity Stress In: Plant Roots, The Hidden Half 3rd ed. Waisel Y, Eshel A and Kafkafi U. (editors) Marcel Dekker Inc., New York, 2002, and reference therein).

For example, a salinity tolerance test can be performed by irrigating plants at different developmental stages with increasing concentrations of sodium chloride (for example 50 mM, 100 mM, 200 mM, 400 mM NaCl) applied from the bottom and from above to ensure even dispersal of salt. Following exposure to the stress condition the plants are frequently monitored until substantial physiological and/or morphological effects appear in wild type plants. Thus, the external phenotypic appearance, degree of wilting and overall success to reach maturity and yield progeny are compared between control and transgenic plants.

Quantitative parameters of tolerance measured include, but are not limited to, the average wet and dry weight, growth rate, leaf size, leaf coverage (overall leaf area), the weight of the seeds yielded, the average seed size and the number of seeds produced per plant. Transformed plants not exhibiting substantial physiological and/or morphological effects, or exhibiting higher biomass than wild-type plants, are identified as abiotic stress tolerant plants.

Osmotic tolerance test—Osmotic stress assays (including sodium chloride and mannitol assays) are conducted to determine if an osmotic stress phenotype was sodium chloride-specific or if it was a general osmotic stress related phenotype. Plants which are tolerant to osmotic stress may have more tolerance to drought and/or freezing. For salt and osmotic stress germination experiments, the medium is supplemented for example with 50 mM, 100 mM, 200 mM NaCl or 100 mM, 200 mM NaCl, 400 mM mannitol.

Drought tolerance assay/Osmoticum assay—Tolerance to drought is performed to identify the genes conferring better plant survival after acute water deprivation. To analyze whether the transgenic plants are more tolerant to drought, an osmotic stress produced by the non-ionic osmolyte sorbitol in the medium can be performed. Control and transgenic plants are germinated and grown in plant-agar plates for 4 days, after which they are transferred to plates containing 500 mM sorbitol. The treatment causes growth retardation, then both control and transgenic plants are compared, by measuring plant weight (wet and dry), yield, and by growth rates measured as time to flowering.

Conversely, soil-based drought screens are performed with plants overexpressing the polynucleotides detailed above. Seeds from control *Arabidopsis* plants, or other transgenic plants overexpressing the polypeptide of the invention are germinated and transferred to pots. Drought stress is obtained after irrigation is ceased accompanied by placing the pots on absorbent paper to enhance the soil-drying rate. Transgenic and control plants are compared to each other when the majority of the control plants develop severe wilting. Plants are re-watered after obtaining a significant fraction of the control plants displaying a severe wilting. Plants are ranked comparing to controls for each of two criteria: tolerance to the drought conditions and recovery (survival) following re-watering.

Cold stress tolerance—To analyze cold stress, mature (25 day old) plants are transferred to 4° C. chambers for 1 or 2 weeks, with constitutive light. Later on plants are moved back to greenhouse. Two weeks later damages from chilling period, resulting in growth retardation and other phenotypes, are compared between both control and transgenic plants, by measuring plant weight (wet and dry), and by comparing growth rates measured as time to flowering, plant size, yield, and the like.

Heat stress tolerance—Heat stress tolerance is achieved by exposing the plants to temperatures above 34° C. for a certain period. Plant tolerance is examined after transferring the plants back to 22° C. for recovery and evaluation after 5 days relative to internal controls (non-transgenic plants) or plants not exposed to neither cold or heat stress.

Water use efficiency—can be determined as the biomass produced per unit transpiration. To analyze WUE, leaf relative water content can be measured in control and transgenic plants. Fresh weight (FW) is immediately recorded; then leaves are soaked for 8 hours in distilled water at room temperature in the dark, and the turgid weight (TW) is recorded. Total dry weight (DW) is recorded after drying the leaves at 60° C. to a constant weight. Relative water content (RWC) is calculated according to the following Formula I:

$$RWC=[(FW-DW)/(TW-DW)]\times 100 \qquad \text{Formula I}$$

Fertilizer use efficiency—To analyze whether the transgenic plants are more responsive to fertilizers, plants are grown in agar plates or pots with a limited amount of fertilizer, as described, for example, in Yanagisawa et al (Proc Natl Acad Sci USA. 2004; 101:7833-8). The plants are analyzed for their overall size, time to flowering, yield, protein content of shoot and/or grain. The parameters checked are the overall size of the mature plant, its wet and dry weight, the weight of the seeds yielded, the average seed size and the number of seeds produced per plant. Other parameters that may be tested are: the chlorophyll content of leaves (as nitrogen plant status and the degree of leaf verdure is highly correlated), amino acid and the total protein content of the seeds or other plant parts such as leaves or shoots, oil content, etc. Similarly, instead of providing nitrogen at limiting amounts, phosphate or potassium can be added at increasing concentrations. Again, the same parameters measured are the same as listed above. In this way, nitrogen use efficiency (NUE), phosphate use efficiency (PUE) and potassium use efficiency (KUE) are assessed, checking the ability of the transgenic plants to thrive under nutrient restraining conditions.

Nitrogen use efficiency—To analyze whether the transgenic plants (e.g., *Arabidopsis* plants) are more responsive to nitrogen, plant are grown in 0.75-3 mM (nitrogen deficient conditions) or 6-10 mM (optimal nitrogen concentration). Plants are allowed to grow for additional 25 days or until seed production. The plants are then analyzed for their overall size, time to flowering, yield, protein content of shoot and/or grain/ seed production. The parameters checked can be the overall size of the plant, wet and dry weight, the weight of the seeds yielded, the average seed size and the number of seeds produced per plant. Other parameters that may be tested are: the chlorophyll content of leaves (as nitrogen plant status and the degree of leaf greenness is highly correlated), amino acid and the total protein content of the seeds or other plant parts such as leaves or shoots and oil content. Transformed plants not exhibiting substantial physiological and/or morphological effects, or exhibiting higher measured parameters levels than wild-type plants, are identified as nitrogen use efficient plants.

Nitrogen Use efficiency assay using plantlets—The assay is done according to Yanagisawa-S. et al. with minor modifications ("Metabolic engineering with Dof1 transcription factor in plants: Improved nitrogen assimilation and growth under low-nitrogen conditions" *Proc. Natl. Acad. Sci. USA* 101, 7833-7838). Briefly, transgenic plants which are grown for 7-10 days in 0.5×MS [Murashige-Skoog] supplemented with a selection agent are transferred to two nitrogen-limiting conditions: MS media in which the combined nitrogen concentration ($NH_4NO_3$ and $KNO_3$) was 0.75 mM (nitrogen deficient conditions) or 6-15 mM (optimal nitrogen concentration). Plants are allowed to grow for additional 30-40 days and then photographed, individually removed from the Agar (the shoot without the roots) and immediately weighed (fresh weight) for later statistical analysis. Constructs for which only T1 seeds are available are sown on selective media and at least 20 seedlings (each one representing an independent transformation event) are carefully transferred to the nitrogen-limiting media. For constructs for which T2 seeds are available, different transformation events are analyzed. Usually, 20 randomly selected plants from each event are transferred to the nitrogen-limiting media allowed to grow for 3-4 additional weeks and individually weighed at the end of that period. Transgenic plants are compared to control plants grown in parallel under the same conditions. Mock-transgenic plants expressing the uidA reporter gene (GUS) under the same promoter or transgenic plants carrying the same promoter but lacking a reporter gene are used as control.

Nitrogen determination—The procedure for N (nitrogen) concentration determination in the structural parts of the plants involves the potassium persulfate digestion method to convert organic N to $NO_3^-$ (Purcell and King 1996 Argon. J. 88:111-113, the modified $Cd^-$ mediated reduction of $NO_3^-$ to $NO_2^-$ (Vodovotz 1996 Biotechniques 20:390-394) and the measurement of nitrite by the Griess assay (Vodovotz 1996, supra). The absorbance values are measured at 550 nm against a standard curve of $NaNO_2$. The procedure is described in details in Samonte et al. 2006 Agron. J. 98:168-176.

Germination tests—Germination tests compare the percentage of seeds from transgenic plants that could complete the germination process to the percentage of seeds from control plants that are treated in the same manner. Normal conditions are considered for example, incubations at 22° C. under 22-hour light 2-hour dark daily cycles. Evaluation of germination and seedling vigor is conducted between 4 and 14 days after planting. The basal media is 50% MS medium (Murashige and Skoog, 1962 Plant Physiology 15, 473-497).

Germination is checked also at unfavorable conditions such as cold (incubating at temperatures lower than 10° C. instead of 22° C.) or using seed inhibition solutions that contain high concentrations of an osmolyte such as sorbitol (at concentrations of 50 mM, 100 mM, 200 mM, 300 mM, 500 mM, and up to 1000 mM) or applying increasing concentrations of salt (of 50 mM, 100 mM, 200 mM, 300 mM, 500 mM NaCl).

The effect of the transgene on plant's vigor, growth rate, biomass, yield and/or oil content can be determined using known methods.

Plant vigor—The plant vigor can be calculated by the increase in growth parameters such as leaf area, fiber length, rosette diameter, plant fresh weight and the like per time.

Growth rate—The growth rate can be measured using digital analysis of growing plants. For example, images of plants growing in greenhouse on plot basis can be captured every 3 days and the rosette area can be calculated by digital analysis. Rosette area growth is calculated using the difference of rosette area between days of sampling divided by the difference in days between samples.

Evaluation of growth rate can be done by measuring plant biomass produced, rosette area, leaf size or root length per time (can be measured in $cm^2$ per day of leaf area).

Relative growth rate area can be calculated using Formula II.

Relative growth rate area=Regression coefficient of area along time course.   Formula II:

Thus, the relative growth area rate is in units of 1/day and length growth rate is in units of 1/day.

Seed yield—Evaluation of the seed yield per plant can be done by measuring the amount (weight or size) or quantity (i.e., number) of dry seeds produced and harvested from 8-16 plants and divided by the number of plants.

For example, the total seeds from 8-16 plants can be collected, weighted using e.g., an analytical balance and the total weight can be divided by the number of plants. Seed yield per growing area can be calculated in the same manner while taking into account the growing area given to a single plant. Increase seed yield per growing area could be achieved by increasing seed yield per plant, and/or by increasing number of plants capable of growing in a given area.

In addition, seed yield can be determined via the weight of 1000 seeds. The weight of 1000 seeds can be determined as follows: seeds are scattered on a glass tray and a picture is taken. Each sample is weighted and then using the digital analysis, the number of seeds in each sample is calculated.

The 1000 seeds weight can be calculated using formula III:

1000 Seed Weight=number of seed in sample/sample weight×1000    Formula III:

The Harvest Index can be calculated using Formula IV

Harvest Index=Average seed yield per plant/Average dry weight    Formula IV:

Grain protein concentration—Grain protein content (g grain protein $m^{-2}$) is estimated as the product of the mass of grain N (g grain N $m^{-2}$) multiplied by the N/protein conversion ratio of k-5.13 (Mosse 1990, supra). The grain protein concentration is estimated as the ratio of grain protein content per unit mass of the grain (g grain protein $kg^{-1}$ grain).

Fiber length—Fiber length can be measured using fibrograph. The fibrograph system was used to compute length in terms of "Upper Half Mean" length. The upper half mean (UHM) is the average length of longer half of the fiber distribution. The fibrograph measures length in span lengths at a given percentage point (Hypertext Transfer Protocol://World Wide Web (dot) cottoninc (dot) com/ClassificationofCotton/?Pg=4#Length).

According to some embodiments of the invention, increased yield of corn may be manifested as one or more of the following: increase in the number of plants per growing area, increase in the number of ears per plant, increase in the number of rows per ear, number of kernels per ear row, kernel weight, thousand kernel weight (1000-weight), ear length/diameter, increase oil content per kernel and increase starch content per kernel.

As mentioned, the increase of plant yield can be determined by various parameters. For example, increased yield of rice may be manifested by an increase in one or more of the following: number of plants per growing area, number of panicles per plant, number of spikelets per panicle, number of flowers per panicle, increase in the seed filling rate, increase in thousand kernel weight (1000-weight), increase oil content per seed, increase starch content per seed, among others. An increase in yield may also result in modified architecture, or may occur because of modified architecture.

Similarly, increased yield of soybean may be manifested by an increase in one or more of the following: number of plants per growing area, number of pods per plant, number of seeds per pod, increase in the seed filling rate, increase in thousand seed weight (1000-weight), reduce pod shattering, increase oil content per seed, increase protein content per seed, among others. An increase in yield may also result in modified architecture, or may occur because of modified architecture.

Increased yield of canola may be manifested by an increase in one or more of the following: number of plants per growing area, number of pods per plant, number of seeds per pod, increase in the seed filling rate, increase in thousand seed weight (1000-weight), reduce pod shattering, increase oil content per seed, among others. An increase in yield may also result in modified architecture, or may occur because of modified architecture.

Increased yield of cotton may be manifested by an increase in one or more of the following: number of plants per growing area, number of bolls per plant, number of seeds per boll, increase in the seed filling rate, increase in thousand seed weight (1000-weight), increase oil content per seed, improve fiber length, fiber strength, among others. An increase in yield may also result in modified architecture, or may occur because of modified architecture.

Oil content—The oil content of a plant can be determined by extraction of the oil from the seed or the vegetative portion of the plant. Briefly, lipids (oil) can be removed from the plant (e.g., seed) by grinding the plant tissue in the presence of specific solvents (e.g., hexane or petroleum ether) and extracting the oil in a continuous extractor. Indirect oil content analysis can be carried out using various known methods such as Nuclear Magnetic Resonance (NMR) Spectroscopy, which measures the resonance energy absorbed by hydrogen atoms in the liquid state of the sample [See for example, Conway T F. and Earle F R., 1963, Journal of the American Oil Chemists' Society; Springer Berlin/Heidelberg, ISSN: 0003-021X (Print) 1558-9331 (Online)]; the Near Infrared (NI) Spectroscopy, which utilizes the absorption of near infrared energy (1100-2500 nm) by the sample; and a method described in WO/2001/023884, which is based on extracting oil a solvent, evaporating the solvent in a gas stream which forms oil particles, and directing a light into the gas stream and oil particles which forms a detectable reflected light.

Thus, the present invention is of high agricultural value for promoting the yield of commercially desired crops (e.g., biomass of vegetative organ such as poplar wood, or reproductive organ such as number of seeds or seed biomass).

Any of the transgenic plants described hereinabove or parts thereof may be processed to produce a feed, meal, protein or oil preparation, such as for ruminant animals.

The transgenic plants described hereinabove, which exhibit an increased oil content can be used to produce plant oil (by extracting the oil from the plant).

The plant oil (including the seed oil and/or the vegetative portion oil) produced according to the method of the invention may be combined with a variety of other ingredients. The specific ingredients included in a product are determined according to the intended use. Exemplary products include animal feed, raw material for chemical modification, biodegradable plastic, blended food product, edible oil, biofuel, cooking oil, lubricant, biodiesel, snack food, cosmetics, and fermentation process raw material. Exemplary products to be incorporated to the plant oil include animal feeds, human food products such as extruded snack foods, breads, as a food binding agent, aquaculture feeds, fermentable mixtures, food supplements, sport drinks, nutritional food bars, multi-vitamin supplements, diet drinks, and cereal foods.

According to some embodiments of the invention, the oil comprises a seed oil.

According to some embodiments of the invention, the oil comprises a vegetative portion oil.

According to some embodiments of the invention, the plant cell forms a part of a plant.

As used herein the term "about" refers to ±10%

The terms "comprises", "comprising", "includes", "including", "having" and their conjugates mean "including but not limited to".

The term "consisting of means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

General Experimental and Bioinformatics Methods

RNA extraction—Tissues growing at various growth conditions (as described below) were sampled and RNA was extracted using TRIzol Reagent from Invitrogen [Hypertext Transfer Protocol://World Wide Web (dot) invitrogen (dot) com/content (dot)cfm?pageid=469]. Approximately 30-50 mg of tissue was taken from samples. The weighed tissues were ground using pestle and mortar in liquid nitrogen and resuspended in 500 µl of TRIzol Reagent. To the homogenized lysate, 100 µl of chloroform was added followed by precipitation using isopropanol and two washes with 75% ethanol. The RNA was eluted in 30 µl of RNase-free water. RNA samples were cleaned up using Qiagen's RNeasy® minikit clean-up protocol as per the manufacturer's protocol (QIAGEN Inc, CA USA). For convenience, each micro-array expression information tissue type has received an expression Set ID.

Correlation analysis—was performed for selected genes according to some embodiments of the invention, in which the characterized parameters (measured parameters according to the correlation IDs) were used as "x axis" for correlation with the tissue transcriptome which was used as the "Y axis". For each gene and measured parameter a correlation coefficient "R" was calculated (using Pearson correlation) along with a p-value for the significance of the correlation. When the correlation coefficient (R) between the levels of a gene's expression in a certain tissue and a phenotypic performance across ecotypes/variety/hybrid is high in absolute value (between 0.5-1), there is an association between the gene (specifically the expression level of this gene) the phenotypic characteristic (e.g., improved yield, growth rate, nitrogen use efficiency, abiotic stress tolerance and the like).

Example 1

Identifying Genes which Improve Yield and Agronomical Important Traits in Plants The present inventors have identified polynucleotides which expression thereof in plants can increase yield, fiber yield, fiber quality, growth rate, vigor, biomass, growth rate, oil content, abiotic stress tolerance (ABST), fertilizer use efficiency (FUE) such as nitrogen use efficiency (NUE), and water use efficiency (WUE) of a plant, as follows.

All nucleotide sequence datasets used here were originated from publicly available databases or from performing sequencing using the Solexa technology (e.g. Barley and *Sorghum*). Sequence data from 100 different plant species was introduced into a single, comprehensive database. Other information on gene expression, protein annotation, enzymes and pathways were also incorporated.

Major databases used include:

Genomes

*Arabidopsis* genome [TAIR genome version 6 (Hypertext Transfer Protocol://World Wide Web (dot) *arabidopsis* (dot) org/)]

Rice genome [IRGSP build 4.0 (Hypertext Transfer Protocol://rgp (dot) dna (dot) affrc (dot) go (dot) jp/IRGSP/)].

Poplar [*Populus trichocarpa* release 1.1 from JGI (assembly release v1.0) (Hypertext Transfer Protocol://World Wide Web (dot) genome (dot) jgi-psf (dot) org/)]

Brachypodium [JGI 4× assembly, Hypertext Transfer Protocol://World Wide Web (dot) brachpodium (dot) org)]

Soybean [DOE-JGI SCP, version Glyma0 (Hypertext Transfer Protocol://World Wide Web (dot) phytozome (dot) net/)]

Grape [French-Italian Public Consortium for Grapevine Genome Characterization grapevine genome (Hypertext Transfer Protocol://World Wide Web (dot) genoscope (dot) cns (dot) fr/)]

Castobean [TIGR/J Craig Venter Institute 4× assembly [(Hypertext Transfer Protocol://msc (dot) jcvi (dot) org/r communis]

*Sorghum* [DOE-JGI SCP, version Sbi1 [Hypertext Transfer Protocol://World Wide Web (dot) phytozome (dot) net/)].

Partially assembled genome of Maize [Hypertext Transfer Protocol://maizesequence (dot) org/]

Expressed EST and mRNA sequences were extracted from the following databases:

GenBank Hypertext Transfer Protocol://World Wide Web (dot) ncbi (dot) nlm (dot) nih (dot) gov/dbEST RefSeq (Hypertext Transfer Protocol://World Wide Web (dot) ncbi (dot) nlm (dot) nih (dot) gov/RefSeq/).

TAIR (Hypertext Transfer Protocol://World Wide Web (dot) *arabidopsis* (dot) org/).

Protein and pathway databases

Uniprot [Hypertext Transfer Protocol://World Wide Web (dot) uniprot (dot) org/].

AraCyc [Hypertext Transfer Protocol://World Wide Web (dot) *arabidopsis* (dot) org/biocyc/index (dot) jsp].

ENZYME [Hypertext Transfer Protocol://expasy (dot) org/enzyme/].

Microarray datasets were downloaded from:

GEO (Hypertext Transfer Protocol://World Wide Web.ncbi.nlm.nih.gov/geo/)

TAIR (Hypertext Transfer Protocol://World Wide Web.*arabidopsis*.org/).

Proprietary microarray data (WO2008/122980).

QTL and SNPs information

Gramene [Hypertext Transfer Protocol://World Wide Web (dot) gramene (dot) org/qtl/].

Panzea [Hypertext Transfer Protocol://World Wide Web (dot) panzea (dot) org/index (dot) html].

Database Assembly—was performed to build a wide, rich, reliable annotated and easy to analyze database comprised of publicly available genomic mRNA, ESTs DNA sequences, data from various crops as well as gene expression, protein annotation and pathway data QTLs, and other relevant information.

Database assembly is comprised of a toolbox of gene refining, structuring, annotation and analysis tools enabling to construct a tailored database for each gene discovery project. Gene refining and structuring tools enable to reliably detect splice variants and antisense transcripts, generating understanding of various potential phenotypic outcomes of a single gene. The capabilities of the "LEADS" platform of Compugen LTD for analyzing human genome have been confirmed and accepted by the scientific community [see e.g., "Widespread Antisense Transcription", Yelin, et al. (2003) Nature Biotechnology 21, 379-85; "Splicing of Alu Sequences", Lev-Maor, et al. (2003) Science 300 (5623), 1288-91; "Computational analysis of alternative splicing using EST tissue information", Xie H et al. Genomics 2002], and have been proven most efficient in plant genomics as well.

EST clustering and gene assembly—For gene clustering and assembly of organisms with available genome sequence data (*arabidopsis*, rice, castorbean, grape, brachypodium, poplar, soybean, *sorghum*) the genomic LEADS version (GANG) was employed. This tool allows most accurate clustering of ESTs and mRNA sequences on genome, and predicts gene structure as well as alternative splicing events and anti-sense transcription.

For organisms with no available full genome sequence data, "expressed LEADS" clustering software was applied.

Gene annotation—Predicted genes and proteins were annotated as follows:

Blast search [Hypertext Transfer Protocol://blast (dot) ncbi (dot) nlm (dot) nih (dot) gov/Blast (dot) cgi] against all plant UniProt [Hypertext Transfer Protocol://World Wide Web (dot) uniprot (dot) org/] sequences was performed. Open reading frames of each putative transcript were analyzed and longest ORF with higher number of homologues was selected as predicted protein of the transcript. The predicted proteins were analyzed by InterPro [Hypertext Transfer Protocol://World Wide Web (dot) ebi (dot) ac (dot) uk/interpro/].

Blast against proteins from AraCyc and ENZYME databases was used to map the predicted transcripts to AraCyc pathways.

Predicted proteins from different species were compared using blast algorithm [Hypertext Transfer Protocol://World Wide Web (dot) ncbi (dot) nlm (dot) nih (dot) gov/Blast (dot) cgi] to validate the accuracy of the predicted protein sequence, and for efficient detection of orthologs.

Gene expression profiling—Several data sources were exploited for gene expression profiling, namely microarray data and digital expression profile (see below). According to gene expression profile, a correlation analysis was performed to identify genes which are co-regulated under different development stages and environmental conditions and associated with different phenotypes.

Publicly available microarray datasets were downloaded from TAIR and NCBI GEO sites, renormalized, and integrated into the database. Expression profiling is one of the most important resource data for identifying genes important for yield.

A digital expression profile summary was compiled for each cluster according to all keywords included in the sequence records comprising the cluster. Digital expression, also known as electronic Northern Blot, is a tool that displays virtual expression profile based on the EST sequences forming the gene cluster. The tool provides the expression profile of a cluster in terms of plant anatomy (e.g., the tissue/organ in which the gene is expressed), developmental stage (the developmental stages at which a gene can be found) and profile of treatment (provides the physiological conditions under which a gene is expressed such as drought, cold, pathogen infection, etc). Given a random distribution of ESTs in the different clusters, the digital expression provides a probability value that describes the probability of a cluster having a total of N ESTs to contain X ESTs from a certain collection of libraries. For the probability calculations, the following is taken into consideration: a) the number of ESTs in the cluster, b) the number of ESTs of the implicated and related libraries, c) the overall number of ESTs available representing the species. Thereby clusters with low probability values are highly enriched with ESTs from the group of libraries of interest indicating a specialized expression.

Recently, the accuracy of this system was demonstrated by Portnoy et al., 2009 (Analysis Of The Melon Fruit Transcriptome Based On 454 Pyrosequencing) in: Plant & Animal Genomes XVII Conference, San Diego, Calif. Transcriptomic analysis, based on relative EST abundance in data was performed by 454 pyrosequencing of cDNA representing mRNA of the melon fruit. Fourteen double strand cDNA samples obtained from two genotypes, two fruit tissues (flesh and rind) and four developmental stages were sequenced. GS FLX pyrosequencing (Roche/454 Life Sciences) of non-normalized and purified cDNA samples yielded 1,150,657 expressed sequence tags, that assembled into 67,477 unigenes (32,357 singletons and 35,120 contigs). Analysis of the data obtained against the Cucurbit Genomics Database [Hypertext Transfer Protocol://World Wide Web (dot) icugi (dot) org/] confirmed the accuracy of the sequencing and assembly. Expression patterns of selected genes fitted well their qRT-PCR data.

Overall, 213 genes (SEQ ID NOs: 1-288 and 289-480 for polynucleotides and SEQ ID NOs: 481-727 and 728-792 for polypeptides) were identified to have a major impact on plant yield, growth rate, vigor, biomass, growth rate, oil content, abiotic stress tolerance, nitrogen use efficiency, water use efficiency and fertilizer use efficiency when expression thereof is increased in plants. The identified genes, their curated polynucleotide and polypeptide sequences, as well as their updated sequences according to Genbank database are summarized in Table 1, hereinbelow.

TABLE 1

Identified genes for increasing yield, growth rate, vigor, biomass, growth rate, oil content, abiotic stress tolerance, nitrogen use efficiency, water use efficiency and fertilizer use efficiency of a plant

| Gene Name | Cluster Name | Organism | Polyn. SEQ ID NO: | Polyp. SEQ ID NO: |
|---|---|---|---|---|
| LYM46 | barley\|gb157SOLEXA\|AV914235 | barley | 1 | 481 |
| LYM297 | arabidopsis\|gb165\|AT2G36560 | arabidopsis | 2 | 482 |
| LYM298 | arabidopsis\|gb165\|AT3G04550 | arabidopsis | 3 | 483 |
| LYM299 | arabidopsis\|gb165\|AT5G45360 | arabidopsis | 4 | 484 |
| LYM300 | barley\|gb157SOLEXA\|AF039024 | barley | 5 | 485 |
| LYM301 | barley\|gb157SOLEXA\|AJ471689 | barley | 6 | 486 |
| LYM302 | barley\|gb157SOLEXA\|AJ478368 | barley | 7 | 487 |
| LYM303 | barley\|gb157SOLEXA\|AL450771 | barley | 8 | 488 |
| LYM304 | barley\|gb157SOLEXA\|AL500954 | barley | 9 | 489 |
| LYM305 | barley\|gb157SOLEXA\|AL501188 | barley | 10 | 490 |
| LYM306 | barley\|gb157SOLEXA\|AL507201 | barley | 11 | 491 |
| LYM307 | barley\|gb157SOLEXA\|AV832846 | barley | 12 | 492 |
| LYM308 | barley\|gb157SOLEXA\|AV833964 | barley | 13 | 493 |
| LYM309 | barley\|gb157SOLEXA\|AV834630 | barley | 14 | 494 |
| LYM310 | barley\|gb157SOLEXA\|AV836092 | barley | 15 | 495 |
| LYM312 | barley\|gb157SOLEXA\|AV932936 | barley | 16 | 496 |
| LYM313 | barley\|gb157SOLEXA\|BE060106 | barley | 17 | 497 |
| LYM314 | barley\|gb157SOLEXA\|BE412725 | barley | 18 | 498 |
| LYM315 | barley\|gb157SOLEXA\|BE412988 | barley | 19 | 499 |
| LYM316 | barley\|gb157SOLEXA\|BE412990 | barley | 20 | 500 |
| LYM317 | barley\|gb157SOLEXA\|BE413214 | barley | 21 | 501 |
| LYM318 | barley\|gb157SOLEXA\|BE413493 | barley | 22 | 502 |
| LYM319 | barley\|gb157SOLEXA\|BE421137 | barley | 23 | 503 |
| LYM320 | barley\|gb157SOLEXA\|BE421502 | barley | 24 | 504 |
| LYM321 | barley\|gb157SOLEXA\|BE437947 | barley | 25 | 505 |
| LYM322 | barley\|gb157SOLEXA\|BE438129 | barley | 26 | 506 |
| LYM323 | barley\|gb157SOLEXA\|BF263342 | barley | 27 | 507 |
| LYM324 | barley\|gb157SOLEXA\|BF264152 | barley | 28 | 508 |
| LYM326 | barley\|gb157SOLEXA\|BF623943 | barley | 29 | 509 |
| LYM327 | barley\|gb157SOLEXA\|BF628395 | barley | 30 | 510 |
| LYM328 | barley\|gb157SOLEXA\|BG299354 | barley | 31 | 511 |
| LYM329 | barley\|gb157SOLEXA\|BG300782 | barley | 32 | 512 |
| LYM330 | barley\|gb157SOLEXA\|BG366539 | barley | 33 | 513 |
| LYM331 | barley\|gb157SOLEXA\|BG415251 | barley | 34 | 514 |
| LYM332 | barley\|gb157SOLEXA\|BI947101 | barley | 35 | 515 |
| LYM333 | barley\|gb157SOLEXA\|BI951290 | barley | 36 | 516 |
| LYM334 | barley\|gb157SOLEXA\|BI953288 | barley | 37 | 517 |
| LYM335 | barley\|gb157SOLEXA\|BJ447518 | barley | 38 | 518 |
| LYM336 | barley\|gb157SOLEXA\|BQ665724 | barley | 39 | 519 |
| LYM338 | barley\|gb157SOLEXA\|BU977002 | barley | 40 | 520 |
| LYM339 | barley\|gb157SOLEXA\|CB875456 | barley | 41 | 521 |
| LYM340 | brachypodium\|09v1\|GT776162 | brachypodium | 42 | 522 |
| LYM341 | brachypodium\|09v1\|SRR031795S0011089 | brachypodium | 43 | 523 |
| LYM342 | brachypodium\|09v1\|SRR031795S0018843 | brachypodium | 44 | 524 |
| LYM343 | cotton\|gb164\|AW186747 | cotton | 45 | 525 |

TABLE 1-continued

Identified genes for increasing yield, growth rate, vigor, biomass, growth rate, oil content, abiotic stress tolerance, nitrogen use efficiency, water use efficiency and fertilizer use efficiency of a plant

| Gene Name | Cluster Name | Organism | Polyn. SEQ ID NO: | Polyp. SEQ ID NO: |
|---|---|---|---|---|
| LYM344 | cotton\|gb164\|AW187142 | cotton | 46 | 526 |
| LYM345 | cotton\|gb164\|CO128772 | cotton | 47 | 527 |
| LYM346 | maize\|gb170\|AA979954 | maize | 48 | 528 |
| LYM348 | maize\|gb170\|AI491658 | maize | 49 | 529 |
| LYM349 | maize\|gb170\|AI586701 | maize | 50 | 530 |
| LYM350 | maize\|gb170\|AI612450 | maize | 51 | 531 |
| LYM351 | maize\|gb170\|AI629497 | maize | 52 | 532 |
| LYM352 | maize\|gb170\|AI649898 | maize | 53 | 533 |
| LYM353 | maize\|gb170\|AI714592 | maize | 54 | 534 |
| LYM354 | maize\|gb170\|AI734481 | maize | 55 | 535 |
| LYM355 | maize\|gb170\|AI734524 | maize | 56 | 536 |
| LYM356 | maize\|gb170\|AI820388 | maize | 57 | 537 |
| LYM357 | maize\|gb170\|AI834390 | maize | 58 | 538 |
| LYM359 | maize\|gb170\|AI939790 | maize | 59 | 539 |
| LYM360 | maize\|gb170\|AI964644 | maize | 60 | 540 |
| LYM361 | maize\|gb170\|AI978097 | maize | 61 | 541 |
| LYM362 | maize\|gb170\|AW053081 | maize | 62 | 542 |
| LYM363 | maize\|gb170\|AW053216 | maize | 63 | 543 |
| LYM364 | maize\|gb170\|AW066128 | maize | 64 | 544 |
| LYM365 | maize\|gb170\|AW066984 | maize | 65 | 545 |
| LYM366 | maize\|gb170\|AW119986 | maize | 66 | 546 |
| LYM367 | maize\|gb170\|AW163846 | maize | 67 | 547 |
| LYM368 | maize\|gb170\|AW267659 | maize | 68 | 548 |
| LYM369 | maize\|gb170\|AW400051 | maize | 69 | 549 |
| LYM370 | maize\|gb170\|AW455701 | maize | 70 | 550 |
| LYM371 | maize\|gb170\|AW461159 | maize | 71 | 551 |
| LYM372 | maize\|gb170\|AW499159 | maize | 72 | 552 |
| LYM373 | maize\|gb170\|AW573473 | maize | 73 | 553 |
| LYM374 | maize\|gb170\|BE238502 | maize | 74 | 554 |
| LYM375 | maize\|gb170\|BE512179 | maize | 75 | 555 |
| LYM376 | maize\|gb170\|BG842270 | maize | 76 | 556 |
| LYM377 | maize\|gb170\|BI398419 | maize | 77 | 557 |
| LYM378 | maize\|gb170\|BM075597 | maize | 78 | 558 |
| LYM379 | maize\|gb170\|BM953346 | maize | 79 | 559 |
| LYM380 | maize\|gb170\|BQ294380 | maize | 80 | 560 |
| LYM381 | maize\|gb170\|BU197916 | maize | 81 | 561 |
| LYM382 | maize\|gb170\|CF005206 | maize | 82 | 562 |
| LYM383 | maize\|gb170\|CK145349 | maize | 83 | 563 |
| LYM384 | maize\|gb170\|DR786060 | maize | 84 | 564 |
| LYM385 | maize\|gb170\|DT942887 | maize | 85 | 565 |
| LYM386 | maize\|gb170\|DW783146 | maize | 86 | 566 |
| LYM387 | maize\|gb170\|T18700 | maize | 87 | 567 |
| LYM388 | maize\|gb170\|W49854 | maize | 88 | 568 |
| LYM389 | rice\|gb170\|GFXAP002539X8 | rice | 89 | 569 |
| LYM390 | rice\|gb170\|OS01G10070 | rice | 90 | 570 |
| LYM391 | rice\|gb170\|OS01G13930 | rice | 91 | 571 |
| LYM392 | rice\|gb170\|OS01G42870 | rice | 92 | 572 |
| LYM393 | rice\|gb170\|OS01G45470 | rice | 93 | 573 |
| LYM394 | rice\|gb170\|OS01G72670 | rice | 94 | 574 |
| LYM395 | rice\|gb170\|OS02G03230 | rice | 95 | 575 |
| LYM396 | rice\|gb170\|OS02G12310 | rice | 96 | 576 |
| LYM397 | rice\|gb170\|OS02G44510 | rice | 97 | 577 |
| LYM398 | rice\|gb170\|OS02G58150 | rice | 98 | 578 |
| LYM399 | rice\|gb170\|OS03G04470 | rice | 99 | 579 |
| LYM400 | rice\|gb170\|OS03G14690 | rice | 100 | 580 |
| LYM401 | rice\|gb170\|OS03G17490 | rice | 101 | 581 |
| LYM402 | rice\|gb170\|OS03G53660 | rice | 102 | 582 |
| LYM403 | rice\|gb170\|OS04G53300 | rice | 103 | 583 |
| LYM404 | rice\|gb170\|OS04G54240 | rice | 104 | 584 |
| LYM405 | rice\|gb170\|OS04G58890 | rice | 105 | 585 |
| LYM406 | rice\|gb170\|OS04G59050 | rice | 106 | 586 |
| LYM407 | rice\|gb170\|OS05G05680 | rice | 107 | 587 |
| LYM408 | rice\|gb170\|OS05G35340 | rice | 108 | 588 |
| LYM409 | rice\|gb170\|OS05G42270 | rice | 109 | 589 |
| LYM410 | rice\|gb170\|OS06G43760 | rice | 110 | 590 |
| LYM411 | rice\|gb170\|OS07G10350 | rice | 111 | 591 |
| LYM412 | rice\|gb170\|OS07G42220 | rice | 112 | 592 |
| LYM413 | rice\|gb170\|OS07G42390 | rice | 113 | 593 |
| LYM414 | rice\|gb170\|OS09G12150 | rice | 114 | 594 |
| LYM415 | rice\|gb170\|OS09G31120 | rice | 115 | 595 |
| LYM416 | rice\|gb170\|OS10G27450 | rice | 116 | 596 |
| LYM417 | rice\|gb170\|OS10G34920 | rice | 117 | 597 |

TABLE 1-continued

Identified genes for increasing yield, growth rate, vigor, biomass, growth rate, oil content, abiotic stress tolerance, nitrogen use efficiency, water use efficiency and fertilizer use efficiency of a plant

| Gene Name | Cluster Name | Organism | Polyn. SEQ ID NO: | Polyp. SEQ ID NO: |
|---|---|---|---|---|
| LYM418 | rice\|gb170\|OS11G08940 | rice | 118 | 598 |
| LYM419 | sorghum\|09v1\|AW285700 | sorghum | 119 | 599 |
| LYM421 | sorghum\|09v1\|AW565098 | sorghum | 120 | 600 |
| LYM423 | sorghum\|09v1\|BE367258 | sorghum | 121 | 601 |
| LYM424 | sorghum\|09v1\|BF507223 | sorghum | 122 | 602 |
| LYM427 | sorghum\|09v1\|BG463613 | sorghum | 123 | 603 |
| LYM433 | sorghum\|09v1\|CF481648 | sorghum | 124 | 604 |
| LYM435 | sorghum\|09v1\|SB01G001570 | sorghum | 125 | 605 |
| LYM436 | sorghum\|09v1\|SB01G001880 | sorghum | 126 | 606 |
| LYM437 | sorghum\|09v1\|SB01G005600 | sorghum | 127 | 607 |
| LYM438 | sorghum\|09v1\|SB01G009590 | sorghum | 128 | 608 |
| LYM439 | sorghum\|09v1\|SB01G012100 | sorghum | 129 | 609 |
| LYM440 | sorghum\|09v1\|SB01G022260 | sorghum | 130 | 610 |
| LYM441 | sorghum\|09v1\|SB01G028160 | sorghum | 131 | 611 |
| LYM442 | sorghum\|09v1\|SB01G036980 | sorghum | 132 | 612 |
| LYM443 | sorghum\|09v1\|SB01G038030 | sorghum | 133 | 613 |
| LYM444 | sorghum\|09v1\|SB01G041100 | sorghum | 134 | 614 |
| LYM445 | sorghum\|09v1\|SB01G045170 | sorghum | 135 | 615 |
| LYM446 | sorghum\|09v1\|SB01G045830 | sorghum | 136 | 616 |
| LYM447 | sorghum\|09v1\|SB01G045970 | sorghum | 137 | 617 |
| LYM448 | sorghum\|09v1\|SB01G047790 | sorghum | 138 | 618 |
| LYM449 | sorghum\|09v1\|SB01G049680 | sorghum | 139 | 619 |
| LYM450 | sorghum\|09v1\|SB02G002380 | sorghum | 140 | 620 |
| LYM451 | sorghum\|09v1\|SB02G003540 | sorghum | 141 | 621 |
| LYM452 | sorghum\|09v1\|SB02G005600 | sorghum | 142 | 622 |
| LYM453 | sorghum\|09v1\|SB02G024770 | sorghum | 143 | 623 |
| LYM454 | sorghum\|09v1\|SB02G036860 | sorghum | 144 | 624 |
| LYM455 | sorghum\|09v1\|SB02G042460 | sorghum | 145 | 625 |
| LYM456 | sorghum\|09v1\|SB03G000620 | sorghum | 146 | 626 |
| LYM457 | sorghum\|09v1\|SB03G002840 | sorghum | 147 | 627 |
| LYM458 | sorghum\|09v1\|SB03G005490 | sorghum | 148 | 628 |
| LYM460 | sorghum\|09v1\|SB03G010610 | sorghum | 149 | 629 |
| LYM461 | sorghum\|09v1\|SB03G028800 | sorghum | 150 | 630 |
| LYM463 | sorghum\|09v1\|SB03G036240 | sorghum | 151 | 631 |
| LYM464 | sorghum\|09v1\|SB03G037450 | sorghum | 152 | 632 |
| LYM465 | sorghum\|09v1\|SB03G042320 | sorghum | 153 | 633 |
| LYM466 | sorghum\|09v1\|SB03G042690 | sorghum | 154 | 634 |
| LYM467 | sorghum\|09v1\|SB03G044230 | sorghum | 155 | 635 |
| LYM468 | sorghum\|09v1\|SB03G046070 | sorghum | 156 | 636 |
| LYM471 | sorghum\|09v1\|SB04G009670 | sorghum | 157 | 637 |
| LYM472 | sorghum\|09v1\|SB04G017800 | sorghum | 158 | 638 |
| LYM473 | sorghum\|09v1\|SB04G020170 | sorghum | 159 | 639 |
| LYM474 | sorghum\|09v1\|SB04G022570 | sorghum | 160 | 640 |
| LYM475 | sorghum\|09v1\|SB04G023155 | sorghum | 161 | 641 |
| LYM476 | sorghum\|09v1\|SB04G028950 | sorghum | 162 | 642 |
| LYM477 | sorghum\|09v1\|SB04G030560 | sorghum | 163 | 643 |
| LYM478 | sorghum\|09v1\|SB05G000940 | sorghum | 164 | 644 |
| LYM479 | sorghum\|09v1\|SB05G000980 | sorghum | 165 | 645 |
| LYM480 | sorghum\|09v1\|SB05G001550 | sorghum | 166 | 646 |
| LYM481 | sorghum\|09v1\|SB05G005450 | sorghum | 167 | 647 |
| LYM483 | sorghum\|09v1\|SB05G018376 | sorghum | 168 | 648 |
| LYM484 | sorghum\|09v1\|SB05G019020 | sorghum | 169 | 649 |
| LYM485 | sorghum\|09v1\|SB06G021970 | sorghum | 170 | 650 |
| LYM486 | sorghum\|09v1\|SB06G024300 | sorghum | 171 | 651 |
| LYM487 | sorghum\|09v1\|SB06G027830 | sorghum | 172 | 652 |
| LYM488 | sorghum\|09v1\|SB06G029440 | sorghum | 173 | 653 |
| LYM489 | sorghum\|09v1\|SB06G030740 | sorghum | 174 | 654 |
| LYM490 | sorghum\|09v1\|SB06G032170 | sorghum | 175 | 655 |
| LYM491 | sorghum\|09v1\|SB06G033090 | sorghum | 176 | 656 |
| LYM492 | sorghum\|09v1\|SB07G001470 | sorghum | 177 | 657 |
| LYM493 | sorghum\|09v1\|SB07G003070 | sorghum | 178 | 658 |
| LYM494 | sorghum\|09v1\|SB07G005420 | sorghum | 179 | 659 |
| LYM495 | sorghum\|09v1\|SB07G027350 | sorghum | 180 | 660 |
| LYM496 | sorghum\|09v1\|SB07G027880 | sorghum | 181 | 661 |
| LYM497 | sorghum\|09v1\|SB08G000390 | sorghum | 182 | 662 |
| LYM498 | sorghum\|09v1\|SB08G000930 | sorghum | 183 | 663 |
| LYM499 | sorghum\|09v1\|SB08G002960 | sorghum | 184 | 664 |
| LYM500 | sorghum\|09v1\|SB08G007640 | sorghum | 185 | 665 |
| LYM501 | sorghum\|09v1\|SB08G009120 | sorghum | 186 | 666 |
| LYM502 | sorghum\|09v1\|SB08G019150 | sorghum | 187 | 667 |
| LYM503 | sorghum\|09v1\|SB08G019960 | sorghum | 188 | 668 |
| LYM504 | sorghum\|09v1\|SB08G022310 | sorghum | 189 | 669 |

TABLE 1-continued

Identified genes for increasing yield, growth rate, vigor, biomass, growth rate, oil content, abiotic stress tolerance, nitrogen use efficiency, water use efficiency and fertilizer use efficiency of a plant

| Gene Name | Cluster Name | Organism | Polyn. SEQ ID NO: | Polyp. SEQ ID NO: |
|---|---|---|---|---|
| LYM505 | sorghum\|09v1\|SB09G004700 | sorghum | 190 | 670 |
| LYM506 | sorghum\|09v1\|SB10G023650 | sorghum | 191 | 671 |
| LYM507 | sorghum\|09v1\|SB10G023690 | sorghum | 192 | 672 |
| LYM508 | sorghum\|09v1\|SB10G026350 | sorghum | 193 | 673 |
| LYM509 | sorghum\|09v1\|SB10G029550 | sorghum | 194 | 674 |
| LYM510 | wheat\|gb164\|CA745761 | wheat | 195 | 675 |
| LYM304_H3 | brachypodium\|09v1\|DV468923 | brachypodium | 196 | 676 |
| LYM307_H7 | sorghum\|09v1\|SB01G033760 | sorghum | 197 | 677 |
| LYM326_H4 | brachypodium\|09v1\|GT790559 | brachypodium | 198 | 678 |
| LYM368_H4 | sorghum\|09v1\|SB04G022750 | sorghum | 199 | 679 |
| LYM397_H2 | sorghum\|09v1\|SB04G036540 | sorghum | 200 | 680 |
| LYM311 | barley\|gb157SOLEXA\|AV909117 | barley | 201 | — |
| LYM325 | barley\|gb157SOLEXA\|BF623560 | barley | 202 | — |
| LYM337 | barley\|gb157SOLEXA\|BQ756072 | barley | 203 | — |
| LYM420 | sorghum\|09v1\|AW287430 | sorghum | 204 | — |
| LYM422 | sorghum\|09v1\|AW745990 | sorghum | 205 | — |
| LYM425 | sorghum\|09v1\|BF655529 | sorghum | 206 | — |
| LYM426 | sorghum\|09v1\|BG050685 | sorghum | 207 | — |
| LYM428 | sorghum\|09v1\|BG947594 | sorghum | 208 | — |
| LYM429 | sorghum\|09v1\|BI140081 | sorghum | 209 | — |
| LYM430 | sorghum\|09v1\|CD208778 | sorghum | 210 | — |
| LYM431 | sorghum\|09v1\|CD210000 | sorghum | 211 | — |
| LYM432 | sorghum\|09v1\|CF073969 | sorghum | 212 | — |
| LYM434 | sorghum\|09v1\|CF758775 | sorghum | 213 | — |
| LYM298 | arabidopsis\|gb165\|AT3G04550 | arabidopsis | 3 | 683 |
| LYM396 | rice\|gb170\|OS02G12310 | rice | 96 | 708 |
| LYM409 | rice\|gb170\|OS05G42270 | rice | 109 | 710 |
| LYM440 | sorghum\|09v1\|SB01G022260 | sorghum | 130 | 718 |
| LYM46 | barley\|gb157SOLEXA\|AV914235 | barley | 214 | 681 |
| LYM297 | arabidopsis\|gb165\|AT2G36560 | arabidopsis | 215 | 682 |
| LYM305 | barley\|gb157SOLEXA\|AL501188 | barley | 216 | 684 |
| LYM308 | barley\|gb157SOLEXA\|AV833964 | barley | 217 | 493 |
| LYM309 | barley\|gb157SOLEXA\|AV834630 | barley | 218 | 685 |
| LYM312 | barley\|gb157SOLEXA\|AV932936 | barley | 219 | 686 |
| LYM315 | barley\|gb157SOLEXA\|BE412988 | barley | 220 | 687 |
| LYM316 | barley\|gb157SOLEXA\|BE412990 | barley | 221 | 688 |
| LYM323 | barley\|gb157SOLEXA\|BF263342 | barley | 222 | 689 |
| LYM331 | barley\|gb157SOLEXA\|BG415251 | barley | 223 | 690 |
| LYM336 | barley\|gb157SOLEXA\|BQ665724 | barley | 224 | 691 |
| LYM337 | barley\|gb157SOLEXA\|BQ756072 | barley | 225 | 692 |
| LYM338 | barley\|gb157SOLEXA\|BU977002 | barley | 226 | 693 |
| LYM339 | barley\|gb157SOLEXA\|CB875456 | barley | 227 | 694 |
| LYM340 | brachypodium\|09v1\|GT776162 | brachypodium | 228 | 522 |
| LYM341 | brachypodium\|09v1\|SRR031795S0011089 | brachypodium | 229 | 523 |
| LYM342 | brachypodium\|09v1\|SRR031795S0018843 | brachypodium | 230 | 695 |
| LYM345 | cotton\|gb164\|CO128772 | cotton | 231 | 696 |
| LYM353 | maize\|gb170\|AI714592 | maize | 232 | 697 |
| LYM356 | maize\|gb170\|AI820388 | maize | 233 | 698 |
| LYM357 | maize\|gb170\|AI834390 | maize | 234 | 699 |
| LYM360 | maize\|gb170\|AI964644 | maize | 235 | 700 |
| LYM362 | maize\|gb170\|AW053081 | maize | 236 | 701 |
| LYM364 | maize\|gb170\|AW066128 | maize | 237 | 544 |
| LYM365 | maize\|gb170\|AW066984 | maize | 238 | 545 |
| LYM370 | maize\|gb170\|AW455701 | maize | 239 | 702 |
| LYM371 | maize\|gb170\|AW461159 | maize | 240 | 703 |
| LYM374 | maize\|gb170\|BE238502 | maize | 241 | 704 |
| LYM378 | maize\|gb170\|BM075597 | maize | 242 | 558 |
| LYM381 | maize\|gb170\|BU197916 | maize | 243 | 705 |
| LYM384 | maize\|gb170\|DR786060 | maize | 244 | 706 |
| LYM386 | maize\|gb170\|DW783146 | maize | 245 | 707 |
| LYM401 | rice\|gb170\|OS03G17490 | rice | 246 | 581 |
| LYM402 | rice\|gb170\|OS03G53660 | rice | 247 | 582 |
| LYM408 | rice\|gb170\|OS05G35340 | rice | 248 | 709 |
| LYM411 | rice\|gb170\|OS07G10350 | rice | 249 | 711 |
| LYM414 | rice\|gb170\|OS09G12150 | rice | 250 | 594 |
| LYM417 | rice\|gb170\|OS10G34920 | rice | 251 | 712 |
| LYM421 | sorghum\|09v1\|AW565098 | sorghum | 252 | 713 |
| LYM424 | sorghum\|09v1\|BF507223 | sorghum | 253 | 714 |
| LYM427 | sorghum\|09v1\|BG463613 | sorghum | 254 | 715 |
| LYM428 | sorghum\|09v1\|BG947594 | sorghum | 255 | 716 |
| LYM433 | sorghum\|09v1\|CF481648 | sorghum | 256 | 717 |
| LYM443 | sorghum\|09v1\|SB01G038030 | sorghum | 257 | 613 |

TABLE 1-continued

Identified genes for increasing yield, growth rate, vigor, biomass, growth rate, oil content, abiotic stress tolerance, nitrogen use efficiency, water use efficiency and fertilizer use efficiency of a plant

| Gene Name | Cluster Name | Organism | Polyn. SEQ ID NO: | Polyp. SEQ ID NO: |
|---|---|---|---|---|
| LYM445 | sorghum|09v1|SB01G045170 | sorghum | 258 | 719 |
| LYM446 | sorghum|09v1|SB01G045830 | sorghum | 259 | 616 |
| LYM447 | sorghum|09v1|SB01G045970 | sorghum | 260 | 617 |
| LYM451 | sorghum|09v1|SB02G003540 | sorghum | 261 | 621 |
| LYM455 | sorghum|09v1|SB02G042460 | sorghum | 262 | 625 |
| LYM457 | sorghum|09v1|SB03G002840 | sorghum | 263 | 627 |
| LYM460 | sorghum|09v1|SB03G010610 | sorghum | 264 | 720 |
| LYM465 | sorghum|09v1|SB03G042320 | sorghum | 265 | 721 |
| LYM467 | sorghum|09v1|SB03G044230 | sorghum | 266 | 722 |
| LYM468 | sorghum|09v1|SB03G046070 | sorghum | 267 | 636 |
| LYM472 | sorghum|09v1|SB04G017800 | sorghum | 268 | 723 |
| LYM475 | sorghum|09v1|SB04G023155 | sorghum | 269 | 724 |
| LYM479 | sorghum|09v1|SB05G000980 | sorghum | 270 | 725 |
| LYM483 | sorghum|09v1|SB05G018376 | sorghum | 271 | 726 |
| LYM484 | sorghum|09v1|SB05G019020 | sorghum | 272 | 727 |
| LYM488 | sorghum|09v1|SB06G029440 | sorghum | 273 | 653 |
| LYM490 | sorghum|09v1|SB06G032170 | sorghum | 274 | 655 |
| LYM491 | sorghum|09v1|SB06G033090 | sorghum | 275 | 656 |
| LYM497 | sorghum|09v1|SB08G000390 | sorghum | 276 | 662 |
| LYM502 | sorghum|09v1|SB08G019150 | sorghum | 277 | 667 |
| LYM504 | sorghum|09v1|SB08G022310 | sorghum | 278 | 669 |
| LYM307_H7 | sorghum|09v1|SB01G033760 | sorghum | 279 | 677 |
| LYM311 | barley|gb157SOLEXA|AV909117 | barley | 280 | — |
| LYM325 | barley|gb157SOLEXA|BF623560 | barley | 281 | — |
| LYM420 | sorghum|09v1|AW287430 | sorghum | 282 | — |
| LYM422 | sorghum|09v1|AW745990 | sorghum | 283 | — |
| LYM425 | sorghum|09v1|BF655529 | sorghum | 284 | — |
| LYM426 | sorghum|09v1|BG050685 | sorghum | 285 | — |
| LYM429 | sorghum|09v1|BI140081 | sorghum | 286 | — |
| LYM432 | sorghum|09v1|CF073969 | sorghum | 287 | — |
| LYM434 | sorghum|09v1|CF758775 | sorghum | 288 | — |
| LYM297 | arabidopsis|gb165|AT2G36560 | arabidopsis | 2 | 482 |
| LYM337 | barley|gb157SOLEXA|BQ756072 | barley | 203 | — |
| LYM425 | sorghum|09v1|BF655529 | sorghum | 206 | — |
| LYM428 | sorghum|09v1|BG947594 | sorghum | 208 | — |
| LYM434 | sorghum|09v1|CF758775 | sorghum | 213 | — |
| LYM46 | barley|gb157SOLEXA|AV914235 | barley | 289 | 481 |
| LYM298 | arabidopsis|gb165|AT3G04550 | arabidopsis | 290 | 483 |
| LYM299 | arabidopsis|gb165|AT5G45360 | arabidopsis | 291 | 484 |
| LYM300 | barley|gb157SOLEXA|AF039024 | barley | 292 | 485 |
| LYM301 | barley|gb157SOLEXA|AJ471689 | barley | 293 | 486 |
| LYM302 | barley|gb157SOLEXA|AJ478368 | barley | 294 | 487 |
| LYM303 | barley|gb157SOLEXA|AL450771 | barley | 295 | 728 |
| LYM305 | barley|gb157SOLEXA|AL501188 | barley | 296 | 729 |
| LYM306 | barley|gb157SOLEXA|AL507201 | barley | 297 | 491 |
| LYM308 | barley|gb157SOLEXA|AV833964 | barley | 298 | 493 |
| LYM309 | barley|gb157SOLEXA|AV834630 | barley | 299 | 494 |
| LYM310 | barley|gb157SOLEXA|AV836092 | barley | 300 | 495 |
| LYM312 | barley|gb157SOLEXA|AV932936 | barley | 301 | 730 |
| LYM313 | barley|gb157SOLEXA|BE060106 | barley | 302 | 497 |
| LYM314 | barley|gb157SOLEXA|BE412725 | barley | 303 | 498 |
| LYM315 | barley|gb157SOLEXA|BE412988 | barley | 304 | 499 |
| LYM316 | barley|gb157SOLEXA|BE412990 | barley | 305 | 500 |
| LYM317 | barley|gb157SOLEXA|BE413214 | barley | 306 | 501 |
| LYM318 | barley|gb157SOLEXA|BE413493 | barley | 307 | 502 |
| LYM319 | barley|gb157SOLEXA|BE421137 | barley | 308 | 503 |
| LYM320 | barley|gb157SOLEXA|BE421502 | barley | 309 | 731 |
| LYM321 | barley|gb157SOLEXA|BE437947 | barley | 310 | 732 |
| LYM322 | barley|gb157SOLEXA|BE438129 | barley | 311 | 733 |
| LYM323 | barley|gb157SOLEXA|BF263342 | barley | 312 | 734 |
| LYM324 | barley|gb157SOLEXA|BF264152 | barley | 313 | 735 |
| LYM327 | barley|gb157SOLEXA|BF628395 | barley | 314 | 736 |
| LYM328 | barley|gb157SOLEXA|BG299354 | barley | 315 | 737 |
| LYM329 | barley|gb157SOLEXA|BG300782 | barley | 316 | 738 |
| LYM330 | barley|gb157SOLEXA|BG366539 | barley | 317 | 739 |
| LYM331 | barley|gb157SOLEXA|BG415251 | barley | 318 | 740 |
| LYM332 | barley|gb157SOLEXA|BI947101 | barley | 319 | 741 |
| LYM333 | barley|gb157SOLEXA|BI951290 | barley | 320 | 516 |
| LYM334 | barley|gb157SOLEXA|BI953288 | barley | 321 | 517 |
| LYM335 | barley|gb157SOLEXA|BJ447518 | barley | 322 | 518 |
| LYM336 | barley|gb157SOLEXA|BQ665724 | barley | 323 | 742 |
| LYM338 | barley|gb157SOLEXA|BU977002 | barley | 324 | 693 |

TABLE 1-continued

Identified genes for increasing yield, growth rate, vigor, biomass, growth rate, oil content, abiotic stress tolerance, nitrogen use efficiency, water use efficiency and fertilizer use efficiency of a plant

| Gene Name | Cluster Name | Organism | Polyn. SEQ ID NO: | Polyp. SEQ ID NO: |
|---|---|---|---|---|
| LYM339 | barley|gb157SOLEXA|CB875456 | barley | 325 | 743 |
| LYM340 | brachypodium|09v1|GT776162 | brachypodium | 326 | 744 |
| LYM341 | brachypodium|09v1|SRR031795S0011089 | brachypodium | 327 | 523 |
| LYM343 | cotton|gb164|AW186747 | cotton | 328 | 745 |
| LYM344 | cotton|gb164|AW187142 | cotton | 329 | 746 |
| LYM345 | cotton|gb164|CO128772 | cotton | 330 | 747 |
| LYM346 | maize|gb170|AA979954 | maize | 331 | 748 |
| LYM348 | maize|gb170|AI491658 | maize | 332 | 749 |
| LYM349 | maize|gb170|AI586701 | maize | 333 | 530 |
| LYM350 | maize|gb170|AI612450 | maize | 334 | 531 |
| LYM351 | maize|gb170|AI629497 | maize | 335 | 532 |
| LYM352 | maize|gb170|AI649898 | maize | 336 | 533 |
| LYM353 | maize|gb170|AI714592 | maize | 337 | 750 |
| LYM354 | maize|gb170|AI734481 | maize | 338 | 751 |
| LYM355 | maize|gb170|AI734524 | maize | 339 | 752 |
| LYM356 | maize|gb170|AI820388 | maize | 340 | 537 |
| LYM357 | maize|gb170|AI834390 | maize | 341 | 538 |
| LYM359 | maize|gb170|AI939790 | maize | 342 | 539 |
| LYM360 | maize|gb170|AI964644 | maize | 343 | 540 |
| LYM361 | maize|gb170|AI978097 | maize | 344 | 541 |
| LYM362 | maize|gb170|AW053081 | maize | 345 | 542 |
| LYM363 | maize|gb170|AW053216 | maize | 346 | 753 |
| LYM364 | maize|gb170|AW066128 | maize | 347 | 754 |
| LYM365 | maize|gb170|AW066984 | maize | 348 | 545 |
| LYM366 | maize|gb170|AW119986 | maize | 349 | 755 |
| LYM367 | maize|gb170|AW163846 | maize | 350 | 756 |
| LYM369 | maize|gb170|AW400051 | maize | 351 | 757 |
| LYM370 | maize|gb170|AW455701 | maize | 352 | 758 |
| LYM371 | maize|gb170|AW461159 | maize | 353 | 759 |
| LYM372 | maize|gb170|AW499159 | maize | 354 | 760 |
| LYM373 | maize|gb170|AW573473 | maize | 355 | 761 |
| LYM374 | maize|gb170|BE238502 | maize | 356 | 554 |
| LYM375 | maize|gb170|BE512179 | maize | 357 | 762 |
| LYM376 | maize|gb170|BG842270 | maize | 358 | 556 |
| LYM377 | maize|gb170|BI398419 | maize | 359 | 557 |
| LYM378 | maize|gb170|BM075597 | maize | 360 | 558 |
| LYM379 | maize|gb170|BM953346 | maize | 361 | 559 |
| LYM380 | maize|gb170|BQ294380 | maize | 362 | 560 |
| LYM381 | maize|gb170|BU197916 | maize | 363 | 763 |
| LYM382 | maize|gb170|CF005206 | maize | 364 | 764 |
| LYM384 | maize|gb170|DR786060 | maize | 365 | 564 |
| LYM385 | maize|gb170|DT942887 | maize | 366 | 765 |
| LYM386 | maize|gb170|DW783146 | maize | 367 | 566 |
| LYM387 | maize|gb170|T18700 | maize | 368 | 766 |
| LYM388 | maize|gb170|W49854 | maize | 369 | 568 |
| LYM389 | rice|gb170|GFXAP002539X8 | rice | 370 | 569 |
| LYM390 | rice|gb170|OS01G10070 | rice | 371 | 570 |
| LYM391 | rice|gb170|OS01G13930 | rice | 372 | 571 |
| LYM392 | rice|gb170|OS01G42870 | rice | 373 | 572 |
| LYM393 | rice|gb170|OS01G45470 | rice | 374 | 573 |
| LYM394 | rice|gb170|OS01G72670 | rice | 375 | 574 |
| LYM395 | rice|gb170|OS02G03230 | rice | 376 | 575 |
| LYM396 | rice|gb170|OS02G12310 | rice | 377 | 576 |
| LYM398 | rice|gb170|OS02G58150 | rice | 378 | 578 |
| LYM399 | rice|gb170|OS03G04470 | rice | 379 | 579 |
| LYM400 | rice|gb170|OS03G14690 | rice | 380 | 580 |
| LYM401 | rice|gb170|OS03G17490 | rice | 381 | 767 |
| LYM402 | rice|gb170|OS03G53660 | rice | 382 | 582 |
| LYM403 | rice|gb170|OS04G53300 | rice | 383 | 583 |
| LYM404 | rice|gb170|OS04G54240 | rice | 384 | 584 |
| LYM405 | rice|gb170|OS04G58890 | rice | 385 | 585 |
| LYM406 | rice|gb170|OS04G59050 | rice | 386 | 586 |
| LYM407 | rice|gb170|OS05G05680 | rice | 387 | 587 |
| LYM409 | rice|gb170|OS05G42270 | rice | 388 | 589 |
| LYM410 | rice|gb170|OS06G43760 | rice | 389 | 768 |
| LYM413 | rice|gb170|OS07G42390 | rice | 390 | 593 |
| LYM414 | rice|gb170|OS09G12150 | rice | 391 | 769 |
| LYM415 | rice|gb170|OS09G31120 | rice | 392 | 595 |
| LYM416 | rice|gb170|OS10G27450 | rice | 393 | 596 |
| LYM417 | rice|gb170|OS10G34920 | rice | 394 | 597 |
| LYM418 | rice|gb170|OS11G08940 | rice | 395 | 598 |
| LYM419 | sorghum|09v1|AW285700 | sorghum | 396 | 599 |

TABLE 1-continued

Identified genes for increasing yield, growth rate, vigor, biomass, growth rate, oil content, abiotic stress tolerance, nitrogen use efficiency, water use efficiency and fertilizer use efficiency of a plant

| Gene Name | Cluster Name | Organism | Polyn. SEQ ID NO: | Polyp. SEQ ID NO: |
|---|---|---|---|---|
| LYM421 | sorghum|09v1|AW565098 | sorghum | 397 | 600 |
| LYM423 | sorghum|09v1|BE367258 | sorghum | 398 | 601 |
| LYM424 | sorghum|09v1|BF507223 | sorghum | 399 | 770 |
| LYM427 | sorghum|09v1|BG463613 | sorghum | 400 | 603 |
| LYM433 | sorghum|09v1|CF481648 | sorghum | 401 | 604 |
| LYM435 | sorghum|09v1|SB01G001570 | sorghum | 402 | 605 |
| LYM436 | sorghum|09v1|SB01G001880 | sorghum | 403 | 606 |
| LYM437 | sorghum|09v1|SB01G005600 | sorghum | 404 | 607 |
| LYM438 | sorghum|09v1|SB01G009590 | sorghum | 405 | 608 |
| LYM439 | sorghum|09v1|SB01G012100 | sorghum | 406 | 609 |
| LYM440 | sorghum|09v1|SB01G022260 | sorghum | 407 | 610 |
| LYM441 | sorghum|09v1|SB01G028160 | sorghum | 408 | 771 |
| LYM442 | sorghum|09v1|SB01G036980 | sorghum | 409 | 612 |
| LYM443 | sorghum|09v1|SB01G038030 | sorghum | 410 | 613 |
| LYM444 | sorghum|09v1|SB01G041100 | sorghum | 411 | 772 |
| LYM445 | sorghum|09v1|SB01G045170 | sorghum | 412 | 773 |
| LYM446 | sorghum|09v1|SB01G045830 | sorghum | 413 | 616 |
| LYM447 | sorghum|09v1|SB01G045970 | sorghum | 414 | 617 |
| LYM448 | sorghum|09v1|SB01G047790 | sorghum | 415 | 618 |
| LYM449 | sorghum|09v1|SB01G049680 | sorghum | 416 | 619 |
| LYM450 | sorghum|09v1|SB02G002380 | sorghum | 417 | 620 |
| LYM451 | sorghum|09v1|SB02G003540 | sorghum | 418 | 621 |
| LYM452 | sorghum|09v1|SB02G005600 | sorghum | 419 | 622 |
| LYM453 | sorghum|09v1|SB02G024770 | sorghum | 420 | 774 |
| LYM454 | sorghum|09v1|SB02G036860 | sorghum | 421 | 624 |
| LYM455 | sorghum|09v1|SB02G042460 | sorghum | 422 | 625 |
| LYM456 | sorghum|09v1|SB03G000620 | sorghum | 423 | 626 |
| LYM457 | sorghum|09v1|SB03G002840 | sorghum | 424 | 627 |
| LYM458 | sorghum|09v1|SB03G005490 | sorghum | 425 | 628 |
| LYM460 | sorghum|09v1|SB03G010610 | sorghum | 426 | 775 |
| LYM461 | sorghum|09v1|SB03G028800 | sorghum | 427 | 630 |
| LYM463 | sorghum|09v1|SB03G036240 | sorghum | 428 | 776 |
| LYM464 | sorghum|09v1|SB03G037450 | sorghum | 429 | 632 |
| LYM465 | sorghum|09v1|SB03G042320 | sorghum | 430 | 777 |
| LYM466 | sorghum|09v1|SB03G042690 | sorghum | 431 | 778 |
| LYM467 | sorghum|09v1|SB03G044230 | sorghum | 432 | 635 |
| LYM468 | sorghum|09v1|SB03G046070 | sorghum | 433 | 636 |
| LYM471 | sorghum|09v1|SB04G009670 | sorghum | 434 | 779 |
| LYM472 | sorghum|09v1|SB04G017800 | sorghum | 435 | 780 |
| LYM473 | sorghum|09v1|SB04G020170 | sorghum | 436 | 639 |
| LYM474 | sorghum|09v1|SB04G022570 | sorghum | 437 | 640 |
| LYM475 | sorghum|09v1|SB04G023155 | sorghum | 438 | 781 |
| LYM476 | sorghum|09v1|SB04G028950 | sorghum | 439 | 642 |
| LYM477 | sorghum|09v1|SB04G030560 | sorghum | 440 | 643 |
| LYM478 | sorghum|09v1|SB05G000940 | sorghum | 441 | 644 |
| LYM480 | sorghum|09v1|SB05G001550 | sorghum | 442 | 646 |
| LYM481 | sorghum|09v1|SB05G005450 | sorghum | 443 | 782 |
| LYM483 | sorghum|09v1|SB05G018376 | sorghum | 444 | 783 |
| LYM484 | sorghum|09v1|SB05G019020 | sorghum | 445 | 649 |
| LYM485 | sorghum|09v1|SB06G021970 | sorghum | 446 | 650 |
| LYM486 | sorghum|09v1|SB06G024300 | sorghum | 447 | 651 |
| LYM487 | sorghum|09v1|SB06G027830 | sorghum | 448 | 652 |
| LYM488 | sorghum|09v1|SB06G029440 | sorghum | 449 | 784 |
| LYM489 | sorghum|09v1|SB06G030740 | sorghum | 450 | 654 |
| LYM490 | sorghum|09v1|SB06G032170 | sorghum | 451 | 655 |
| LYM491 | sorghum|09v1|SB06G033090 | sorghum | 452 | 656 |
| LYM492 | sorghum|09v1|SB07G001470 | sorghum | 453 | 657 |
| LYM493 | sorghum|09v1|SB07G003070 | sorghum | 454 | 785 |
| LYM494 | sorghum|09v1|SB07G005420 | sorghum | 455 | 659 |
| LYM495 | sorghum|09v1|SB07G027350 | sorghum | 456 | 660 |
| LYM496 | sorghum|09v1|SB07G027880 | sorghum | 457 | 786 |
| LYM497 | sorghum|09v1|SB08G000390 | sorghum | 458 | 662 |
| LYM498 | sorghum|09v1|SB08G000930 | sorghum | 459 | 663 |
| LYM499 | sorghum|09v1|SB08G002960 | sorghum | 460 | 787 |
| LYM500 | sorghum|09v1|SB08G007640 | sorghum | 461 | 788 |
| LYM501 | sorghum|09v1|SB08G009120 | sorghum | 462 | 789 |
| LYM502 | sorghum|09v1|SB08G019150 | sorghum | 463 | 667 |
| LYM503 | sorghum|09v1|SB08G019960 | sorghum | 464 | 668 |
| LYM504 | sorghum|09v1|SB08G022310 | sorghum | 465 | 669 |
| LYM505 | sorghum|09v1|SB09G004700 | sorghum | 466 | 670 |
| LYM506 | sorghum|09v1|SB10G023650 | sorghum | 467 | 671 |
| LYM507 | sorghum|09v1|SB10G023690 | sorghum | 468 | 672 |

TABLE 1-continued

Identified genes for increasing yield, growth rate, vigor, biomass, growth rate, oil content, abiotic stress tolerance, nitrogen use efficiency, water use efficiency and fertilizer use efficiency of a plant

| Gene Name | Cluster Name | Organism | Polyn. SEQ ID NO: | Polyp. SEQ ID NO: |
|---|---|---|---|---|
| LYM509 | sorghum|09v1|SB10G029550 | sorghum | 469 | 674 |
| LYM510 | wheat|gb164|CA745761 | wheat | 470 | 790 |
| LYM304_H3 | brachypodium|09v1|DV468923 | brachypodium | 471 | 676 |
| LYM307_H7 | sorghum|09v1|SB01G033760 | sorghum | 472 | 791 |
| LYM326_H4 | brachypodium|09v1|GT790559 | brachypodium | 473 | 678 |
| LYM368_H4 | sorghum|09v1|SB04G022750 | sorghum | 474 | 679 |
| LYM397_H2 | sorghum|09v1|SB04G036540 | sorghum | 475 | 792 |
| LYM311 | barley|gb157SOLEXA|AV909117 | barley | 476 | — |
| LYM325 | barley|gb157SOLEXA|BF623560 | barley | 477 | — |
| LYM420 | sorghum|09v1|AW287430 | sorghum | 478 | — |
| LYM422 | sorghum|09v1|AW745990 | sorghum | 479 | — |
| LYM432 | sorghum|09v1|CF073969 | sorghum | 480 | — |

Table 1: Provided are the identified genes, their annotation, organism and polynucleotide and polypeptide sequence identifiers. "polyn." = polynucleotide; "polyp." = polypeptide.

Example 2

Identification of Homologous Sequences that Increase Yield, Fiber Yield, Fiber Quality, Growth Rate, Biomass, Oil Content, VIGOR, ABST, and/or NUE of a Plant The concepts of orthology and paralogy have recently been applied to functional characterizations and classifications on the scale of whole-genome comparisons. Orthologs and paralogs constitute two major types of homologs: The first evolved from a common ancestor by specialization, and the latter are related by duplication events. It is assumed that paralogs arising from ancient duplication events are likely to have diverged in function while true orthologs are more likely to retain identical function over evolutionary time.

To identify putative orthologs of the genes affecting plant yield, oil yield, oil content, seed yield, growth rate, vigor, biomass, abiotic stress tolerance, and fertilizer use efficiency (FUE) genes and/or nitrogen use efficiency, all sequences were aligned using the BLAST (Basic Local Alignment Search Tool). Sequences sufficiently similar were tentatively grouped. These putative orthologs were further organized under a Phylogram—a branching diagram (tree) assumed to be a representation of the evolutionary relationships among the biological taxa. Putative ortholog groups were analyzed as to their agreement with the phylogram and in cases of disagreements these ortholog groups were broken accordingly.

Expression data was analyzed and the EST libraries were classified using a fixed vocabulary of custom terms such as developmental stages (e.g., genes showing similar expression profile through development with up regulation at specific stage, such as at the seed filling stage) and/or plant organ (e.g., genes showing similar expression profile across their organs with up regulation at specific organs such as seed). The annotations from all the ESTs clustered to a gene were analyzed statistically by comparing their frequency in the cluster versus their abundance in the database, allowing the construction of a numeric and graphic expression profile of that gene, which is termed "digital expression". The rationale of using these two complementary methods with methods of phenotypic association studies of QTLs, SNPs and phenotype expression correlation is based on the assumption that true orthologs are likely to retain identical function over evolutionary time. These methods provide different sets of indications on function similarities between two homologous genes, similarities in the sequence level—identical amino acids in the protein domains and similarity in expression profiles.

The search and identification of homologous genes involves the screening of sequence information available, for example, in public databases such as the DNA Database of Japan (DDBJ), Genbank, and the European Molecular Biology Laboratory Nucleic Acid Sequence Database (EMBL) or versions thereof or the MIPS database. A number of different search algorithms have been developed, including but not limited to the suite of programs referred to as BLAST programs. There are five implementations of BLAST, three designed for nucleotide sequence queries (BLASTN, BLASTX, and TBLASTX) and two designed for protein sequence queries (BLASTP and TBLASTN) (Coulson, Trends in Biotechnology: 76-80, 1994; Birren et al., Genome Analysis, I: 543, 1997). Such methods involve alignment and comparison of sequences. The BLAST algorithm calculates percent sequence identity and performs a statistical analysis of the similarity between the two sequences. The software for performing BLAST analysis is publicly available through the National Centre for Biotechnology Information. Other such software or algorithms are GAP, BESTFIT, FASTA and TFASTA. GAP uses the algorithm of Needleman and Wunsch (J. Mol. Biol. 48: 443-453, 1970) to find the alignment of two complete sequences that maximizes the number of matches and minimizes the number of gaps.

The homologous genes may belong to the same gene family. The analysis of a gene family may be carried out using sequence similarity analysis. To perform this analysis one may use standard programs for multiple alignments e.g. Clustal W. A neighbour-joining tree of the proteins homologous to the genes in this invention may be used to provide an overview of structural and ancestral relationships. Sequence identity may be calculated using an alignment program as described above. It is expected that other plants will carry a similar functional gene (ortholog) or a family of similar genes and those genes will provide the same preferred phenotype as the genes presented here. Advantageously, these family members may be useful in the methods of the invention. Example of other plants are included here but not limited to, barley (*Hordeum vulgare*), Arabidopsis (*Arabidopsis thaliana*), maize (*Zea mays*), cotton (*Gossypium*), Oilseed rape (*Bras-* sica napus), Rice (*Oryza sativa*), Sugar cane (*Saccharum officinarum*), Sorghum (*Sorghum bicolor*), Soybean (*Glycine max*), Sunflower (*Helianthus annuus*), Tomato (*Lycopersicon esculentum*), Wheat (*Triticum aestivum*).

The above-mentioned analyses for sequence homology can be carried out on a full-length sequence, but may also be based on a comparison of certain regions such as conserved domains. The identification of such domains, would also be well within the realm of the person skilled in the art and would involve, for example, a computer readable format of the nucleic acids of the present invention, the use of alignment software programs and the use of publicly available information on protein domains, conserved motifs and boxes. This information is available in the PRODOM (Hypertext Transfer Protocol://World Wide Web (dot) biochem (dot) ucl (dot) ac (dot) uk/bsm/dbbrowser/protocol/prodomqry (dot) html), PIR (Hypertext Transfer Protocol://pir (dot) Georgetown (dot) edu/) or Pfam (Hypertext Transfer Protocol://World Wide Web (dot) sanger (dot) ac (dot) uk/Software/Pfam/) database. Sequence analysis programs designed for motif searching may be used for identification of fragments, regions and conserved domains as mentioned above. Preferred computer programs include, but are not limited to, MEME, SIGNALSCAN, and GENESCAN.

A person skilled in the art may use the homologous sequences provided herein to find similar sequences in other species and other organisms. Homologues of a protein encompass, peptides, oligopeptides, polypeptides, proteins and enzymes having amino acid substitutions, deletions and/or insertions relative to the unmodified protein in question and having similar biological and functional activity as the unmodified protein from which they are derived. To produce such homologues, amino acids of the protein may be replaced by other amino acids having similar properties (conservative changes, such as similar hydrophobicity, hydrophilicity, antigenicity, propensity to form or break a-helical structures or 3-sheet structures). Conservative substitution tables are well known in the art (see for example Creighton (1984) Proteins. W.H. Freeman and Company). Homologues of a nucleic acid encompass nucleic acids having nucleotide substitutions, deletions and/or insertions relative to the unmodified nucleic acid in question and having similar biological and functional activity as the unmodified nucleic acid from which they are derived.

Table 2, hereinbelow, lists a summary of orthologous and homologous sequences of the polynucleotide sequences (SEQ ID NOs:1-288 and 289-480) and polypeptide sequences (SEQ ID NOs:481-727 and 728-792) presented in Table 1 above and in Table 32 below, which were identified from the databases using the NCBI BLAST software (e.g., using the Blastp and tBlastn algorithms) and needle (EMBOSS package) as being at least 80% homologous to the selected polynucleotides and polypeptides, and which are expected to increase plant yield, seed yield, oil yield, oil content, growth rate, fiber yield, fiber quality, biomass, vigor, ABST and/or NUE of a plant.

TABLE 2

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 793 | LYM298 | arabidopsis_lyrata\|09v1\|JGIAL008806_P1 | 2947 | 483 | 94.4 | globlastp |
| 794 | LYM299 | arabidopsis_lyrata\|09v1\|JGIAL028327_P1 | 2948 | 484 | 95 | globlastp |
| 795 | LYM300 | wheat\|gb164\|BM135033 | 2949 | 485 | 82.1 | globlastp |
| 796 | LYM300 | wheat\|10v2\|BE430200_P1 | 2949 | 485 | 82.1 | globlastp |
| 797 | LYM300 | wheat\|gb164\|BE430200 | 2950 | 485 | 81.91 | glotblastn |
| 798 | LYM300 | wheat\|gb164\|BE606947 | 2951 | 485 | 80 | globlastp |
| 799 | LYM302 | wheat\|10v2\|BE415864_P1 | 2952 | 487 | 91.2 | globlastp |
| 800 | LYM302 | wheat\|gb164\|BE415864 | 2953 | 487 | 90.4 | globlastp |
| 801 | LYM302 | oat\|10v2\|GO592242_P1 | 2954 | 487 | 82.6 | globlastp |
| 802 | LYM304 | wheat\|10v2\|BE604238_T1 | 2955 | 489 | 97.7 | glotblastn |
| 802 | LYM304_H3 | wheat\|10v2\|BE604238_P1 | 2955 | 676 | 90.9 | globlastp |
| 803 | LYM304 | wheat\|gb164\|BE604238 | 2956 | 489 | 97.13 | glotblastn |
| 803 | LYM304_H3 | wheat\|gb164\|BE604238 | 2956 | 676 | 87.3 | globlastp |
| 804 | LYM304 | wheat\|10v2\|AL825256_T1 | 2957 | 489 | 95.98 | glotblastn |
| 805 | LYM304 | wheat\|gb164\|CA607048 | 2958 | 489 | 95.98 | glotblastn |
| 806 | LYM304 | oat\|10v2\|CN816603_T1 | 2959 | 489 | 91.95 | glotblastn |
| 806 | LYM304_H3 | oat\|10v2\|CN816603_P1 | 2959 | 676 | 91.5 | globlastp |
| 807 | LYM304 | wheat\|gb164\|AL822468 | 2960 | 489 | 90.8 | globlastp |
| 808 | LYM304 | fescue\|gb161\|DT681301_T1 | 2961 | 489 | 88.51 | glotblastn |
| 809 | LYM304 | rice\|gb170\|OS06G10770 | 2962 | 489 | 85.63 | glotblastn |
| 809 | LYM304_H3 | rice\|gb170\|OS06G10770 | 2962 | 676 | 81.2 | globlastp |
| 810 | LYM304 | sorghum\|09v1\|SB10G006970 | 2963 | 489 | 84.48 | glotblastn |
| 810 | LYM304_H3 | sorghum\|09v1\|SB10G006970 | 2963 | 676 | 80.7 | globlastp |
| 811 | LYM304 | foxtail_millet\|10v2\|FXTRMSLX00901077D1_T1 | 2964 | 489 | 83.33 | glotblastn |
| 812 | LYM304 | millet\|10v1\|EVO454PM128453_T1 | 2965 | 489 | 83.33 | glotblastn |
| 812 | LYM304_H3 | millet\|10v1\|EVO454PM128453_P1 | 2965 | 676 | 80 | globlastp |
| 813 | LYM304 | sugarcane\|10v1\|BQ529603_T1 | 2966 | 489 | 82.76 | glotblastn |
| 814 | LYM304 | sugarcane\|gb157.3\|BQ529603 | 2967 | 489 | 82.76 | glotblastn |
| 815 | LYM304 | millet\|09v1\|EVO454PM128453 | 2968 | 489 | 82.2 | globlastp |
| 816 | LYM304 | wheat\|10v2\|CA485187_P1 | 2969 | 489 | 82.2 | globlastp |
| 817 | LYM304 | switchgrass\|gb167\|FE628239 | 2970 | 489 | 82.18 | glotblastn |
| 818 | LYM304 | wheat\|gb164\|CA485187 | 2971 | 489 | 81.6 | globlastp |
| 819 | LYM305 | barley\|10v2\|BE413415_P1 | 2972 | 490 | 94.9 | globlastp |
| 820 | LYM306 | wheat\|10v2\|BF482499_P1 | 2973 | 491 | 95.6 | globlastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 821 | LYM306 | wheat\|gb164\|BF482499 | 2974 | 491 | 91.6 | globlastp |
| 822 | LYM306 | brachypodium\|09v1\|DV471800_P1 | 2975 | 491 | 85.5 | globlastp |
| 823 | LYM306 | oat\|10v2\|GR314164_P1 | 2976 | 491 | 85.2 | globlastp |
| 824 | LYM307 | wheat\|10v2\|CA497658_T1 | 2977 | 492 | 98.65 | glotblastn |
| 825 | LYM307 | wheat\|gb164\|CA497658 | 2978 | 492 | 98.65 | glotblastn |
| 826 | LYM307 | brachypodium\|09v1\|GT768682_T1 | 2979 | 492 | 97.3 | glotblastn |
| 826 | LYM307_H7 | brachypodium\|09v1\|GT768682_P1 | 2979 | 791 | 84.7 | globlastp |
| 827 | LYM307 | rice\|gb170\|OS03G26960 | 2980 | 492 | 94.59 | glotblastn |
| 827 | LYM307_H7 | rice\|gb170\|OS03G26960 | 2980 | 791 | 86.3 | globlastp |
| 828 | LYM307 | millet\|09v1\|CD724364 | 2981 | 492 | 93.69 | glotblastn |
| 829 | LYM307 | millet\|10v1\|CD724364_T1 | 2982 | 492 | 93.69 | glotblastn |
| 830 | LYM307 | switchgrass\|gb167\|FE618254 | 2983 | 492 | 93.24 | glotblastn |
| 831 | LYM307 | maize\|10v1\|AI941642_T1 | 2984 | 492 | 92.34 | glotblastn |
| 831 | LYM307_H7 | maize\|10v1\|AI941642_T1 | 2984 | 677 | 93.58 | glotblastn |
| 832 | LYM307 | maize\|gb170\|AI941642 | 2985 | 492 | 92.34 | glotblastn |
| 832 | LYM307_H7 | maize\|gb170\|AI941642 | 2985 | 791 | 93.4 | globlastp |
| 833 | LYM307 | prunus\|10v1\|BU046517_T1 | 2986 | 492 | 90.54 | glotblastn |
| 834 | LYM307 | strawberry\|11v1\|CO818023_T1 | 2987 | 492 | 89.19 | glotblastn |
| 835 | LYM307 | cassava\|09v1\|DB921661_T1 | 2988 | 492 | 88.74 | glotblastn |
| 836 | LYM307 | cacao\|10v1\|CU590610_T1 | 2989 | 492 | 88.29 | glotblastn |
| 837 | LYM307 | oak\|10v1\|FP035476_T1 | 2990 | 492 | 88.29 | glotblastn |
| 838 | LYM307 | pigeonpea\|10v1\|SRR054580S0008307_T1 | 2991 | 492 | 87.84 | glotblastn |
| 839 | LYM307 | sequoia\|10v1\|SRR065044S0120822_T1 | 2992 | 492 | 87.84 | glotblastn |
| 840 | LYM307 | medicago\|09v1\|BF631940_T1 | 2993 | 492 | 87.84 | glotblastn |
| 841 | LYM307 | cotton\|10v2\|AI728035_T1 | 2994 | 492 | 87.39 | glotblastn |
| 842 | LYM307 | castorbean\|09v1\|GE633986_T1 | 2995 | 492 | 87.39 | glotblastn |
| 843 | LYM307 | podocarpus\|10v1\|SRR065014S0002749_T1 | 2996 | 492 | 86.94 | glotblastn |
| 844 | LYM307 | cowpea\|gb166\|FG829824_T1 | 2997 | 492 | 86.94 | glotblastn |
| 845 | LYM307 | poplar\|10v1\|BU893016_T1 | 2998 | 492 | 86.94 | glotblastn |
| 846 | LYM307 | poplar\|gb170\|BU893016 | 2999 | 492 | 86.94 | glotblastn |
| 847 | LYM307 | arabidopsis\|10v1\|AT2G38770_T1 | 3000 | 492 | 86.94 | glotblastn |
| 848 | LYM307 | soybean\|11v1\|GLYMA20G00260_T1 | 3001 | 492 | 86.94 | glotblastn |
| 849 | LYM307 | soybean\|gb168\|AW587177 | 3001 | 492 | 86.94 | glotblastn |
| 850 | LYM307 | lotus\|09v1\|BP085687_T1 | 3002 | 492 | 86.49 | glotblastn |
| 851 | LYM307 | soybean\|11v1\|GLYMA0048S00340_T1 | 3003 | 492 | 86.49 | glotblastn |
| 852 | LYM307 | soybean\|gb168\|BE822147 | 3004 | 492 | 86.49 | glotblastn |
| 853 | LYM307 | arabidopsis_lyrata\|09v1\|JGIAL015120_T1 | 3005 | 492 | 86.49 | glotblastn |
| 854 | LYM307 | aquilegia\|10v2\|DT738373_T1 | 3006 | 492 | 86.49 | glotblastn |
| 855 | LYM307 | canola\|10v1\|BG732277_T1 | 3007 | 492 | 86.04 | glotblastn |
| 856 | LYM307 | pine\|10v2\|BE662622_T1 | 3008 | 492 | 85.59 | glotblastn |
| 857 | LYM307 | canola\|gb161\|BG732277 | 3009 | 492 | 85.59 | glotblastn |
| 858 | LYM307 | solanum_phureja\|09v1\|SPHAW398539 | 3010 | 492 | 85.59 | glotblastn |
| 859 | LYM307 | tomato\|09v1\|AW398539 | 3011 | 492 | 85.59 | glotblastn |
| 860 | LYM307 | cucumber\|09v1\|BGI454G0037397_T1 | 3012 | 492 | 85.59 | glotblastn |
| 861 | LYM307 | citrus\|gb166\|CB291414_T1 | 3013 | 492 | 85.14 | glotblastn |
| 862 | LYM307 | foxtail_millet\|10v2\|FXTRMSLX04048331D1_T1 | 3014 | 492 | 83.33 | glotblastn |
| 863 | LYM307 | monkeyflower\|10v1\|GO948235_T1 | 3015 | 492 | 81.98 | glotblastn |
| 864 | LYM307 | monkeyflower\|10v1\|GO948236_T1 | 3016 | 492 | 81.98 | glotblastn |
| 865 | LYM307 | aristolochia\|10v1\|SRR039082S0072841_T1 | 3017 | 492 | 80.63 | glotblastn |
| 866 | LYM307 | aquilegia\|gb157.3\|DT738373 | 3018 | 492 | 80.63 | glotblastn |
| 867 | LYM309 | wheat\|10v2\|BE500784_P1 | 3019 | 494 | 96.4 | globlastp |
| 867 | LYM495 | wheat\|10v2\|BE500784_P1 | 3019 | 660 | 82.3 | globlastp |
| 868 | LYM309 | wheat\|gb164\|BF200740 | 3020 | 494 | 87.9 | globlastp |
| 868 | LYM495 | wheat\|gb164\|BF200740 | 3020 | 660 | 82.63 | globlastp |
| 869 | LYM309 | brachypodium\|09v1\|GT789184_P1 | 3021 | 494 | 87.2 | globlastp |
| 869 | LYM495 | brachypodium\|09v1\|GT789184_P1 | 3021 | 660 | 83.6 | globlastp |
| 870 | LYM309 | pseudoroegneria\|gb167\|FF342430_P1 | 3022 | 494 | 86.5 | globlastp |
| 871 | LYM309 | rice\|gb170\|OS08G40430 | 3023 | 494 | 84.7 | globlastp |
| 871 | LYM495 | rice\|gb170\|OS08G40430 | 3023 | 660 | 88.9 | globlastp |
| 872 | LYM309 | rice\|gb170\|OS08G40420 | 3024 | 494 | 84.68 | glotblastn |
| 872 | LYM495 | rice\|gb170\|OS08G40420 | 3024 | 660 | 88.92 | glotblastn |
| 873 | LYM309 | wheat\|gb164\|AL817405 | 3025 | 494 | 84.5 | globlastp |
| 873 | LYM495 | wheat\|gb164\|AL817405 | 3025 | 660 | 82.34 | glotblastn |
| 874 | LYM309 | switchgrass\|gb167\|FE651785 | 3026 | 494 | 80.18 | glotblastn |
| 874 | LYM495 | switchgrass\|gb167\|FE651785 | 3026 | 660 | 91.9 | globlastp |
| 875 | LYM313 | rye\|gb164\|BE493923 | 3027 | 497 | 89.6 | globlastp |
| 876 | LYM313 | wheat\|10v2\|CA498090_P1 | 3028 | 497 | 88.1 | globlastp |
| 877 | LYM313 | wheat\|gb164\|CA498090 | 3028 | 497 | 88.1 | globlastp |
| 878 | LYM313 | wheat\|10v2\|BE637619_P1 | 3029 | 497 | 87.7 | globlastp |
| 879 | LYM313 | wheat\|gb164\|BE637619 | 3030 | 497 | 86.2 | globlastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 880 | LYM314 | leymus\|gb166\|EG376544_P1 | 3031 | 498 | 93.7 | globlastp |
| 881 | LYM314 | wheat\|10v2\|BE403164_P1 | 3032 | 498 | 89.6 | globlastp |
| 882 | LYM314 | wheat\|gb164\|BE403164 | 3032 | 498 | 89.6 | globlastp |
| 883 | LYM314 | wheat\|10v2\|BE404241_P1 | 3033 | 498 | 89.2 | globlastp |
| 884 | LYM314 | wheat\|gb164\|BE404241 | 3033 | 498 | 89.2 | globlastp |
| 885 | LYM314 | wheat\|10v2\|BE405115_P1 | 3034 | 498 | 89 | globlastp |
| 886 | LYM314 | wheat\|gb164\|BE405115 | 3034 | 498 | 89 | globlastp |
| 887 | LYM315 | oat\|10v2\|BE439287_P1 | 3035 | 499 | 86.8 | globlastp |
| 888 | LYM315 | brachypodium\|09v1\|DV475843_P1 | 3036 | 499 | 86.5 | globlastp |
| 889 | LYM315 | rice\|gb170\|OS01G01790 | 3037 | 499 | 82.3 | globlastp |
| 890 | LYM316 | wheat\|10v2\|BI750788_P1 | 3038 | 500 | 97.7 | globlastp |
| 891 | LYM316 | wheat\|gb164\|BI750788 | 3039 | 500 | 97.7 | globlastp |
| 892 | LYM316 | brachypodium\|09v1\|GT775994_P1 | 3040 | 500 | 96.2 | globlastp |
| 893 | LYM316 | sorghum\|09v1\|SB08G023070 | 3041 | 500 | 94.9 | globlastp |
| 894 | LYM316 | rice\|gb170\|OS12G44150 | 3042 | 500 | 94.7 | globlastp |
| 895 | LYM316 | maize\|10v1\|AI947455_P1 | 3043 | 500 | 94.7 | globlastp |
| 896 | LYM316 | brachypodium\|09v1\|DV485303_P1 | 3044 | 500 | 92.7 | globlastp |
| 897 | LYM316 | rice\|gb170\|OS03G48310 | 3045 | 500 | 92.3 | globlastp |
| 898 | LYM316 | maize\|gb170\|AI444726 | 3046 | 500 | 92 | globlastp |
| 899 | LYM316 | maize\|10v1\|AI444726_P1 | 3047 | 500 | 91.3 | globlastp |
| 900 | LYM316 | solanum_phureja\|09v1\|SPHTOMLHA1 | 3048 | 500 | 89.8 | globlastp |
| 901 | LYM316 | tomato\|09v1\|TOMLHA1 | 3049 | 500 | 89.68 | glotblastn |
| 902 | LYM316 | maize\|10v1\|ZMU08984_P1 | 3050 | 500 | 89.5 | globlastp |
| 903 | LYM316 | maize\|gb170\|ZMU08984 | 3050 | 500 | 89.5 | globlastp |
| 904 | LYM316 | soybean\|11v1\|GLYMA05G01460_P1 | 3051 | 500 | 89.2 | globlastp |
| 905 | LYM316 | soybean\|gb168\|BQ137671 | 3051 | 500 | 89.2 | globlastp |
| 906 | LYM316 | cacao\|10v1\|CU477584_T1 | 3052 | 500 | 89.05 | glotblastn |
| 907 | LYM316 | oak\|10v1\|CU640330_P1 | 3053 | 500 | 89 | globlastp |
| 908 | LYM316 | strawberry\|11v1\|CO379666_P1 | 3054 | 500 | 89 | globlastp |
| 909 | LYM316 | cucumber\|09v1\|DV634280_P1 | 3055 | 500 | 89 | globlastp |
| 910 | LYM316 | cucumber\|09v1\|BGI454G0068170_P1 | 3056 | 500 | 89 | globlastp |
| 911 | LYM316 | soybean\|11v1\|GLYMA17G10420_P1 | 3057 | 500 | 88.9 | globlastp |
| 912 | LYM316 | soybean\|11v1\|GLYMA06G20200_P1 | 3058 | 500 | 88.9 | globlastp |
| 913 | LYM316 | soybean\|gb168\|BE823826 | 3058 | 500 | 88.9 | globlastp |
| 914 | LYM316 | prunus\|gb167\|CB818450 | 3059 | 500 | 88.9 | globlastp |
| 915 | LYM316 | walnuts\|gb166\|AY347715 | 3060 | 500 | 88.8 | globlastp |
| 916 | LYM316 | soybean\|11v1\|GLYMA04G34370_P1 | 3061 | 500 | 88.8 | globlastp |
| 917 | LYM316 | soybean\|gb168\|BQ453861 | 3061 | 500 | 88.8 | globlastp |
| 918 | LYM316 | tomato\|09v1\|AF275745 | 3062 | 500 | 88.74 | glotblastn |
| 919 | LYM316 | cucumber\|09v1\|BGI454G0029194_P1 | 3063 | 500 | 88.7 | globlastp |
| 920 | LYM316 | rice\|gb170\|OS07G09340 | 3064 | 500 | 88.7 | globlastp |
| 921 | LYM316 | sorghum\|09v1\|SB02G005440 | 3065 | 500 | 88.7 | globlastp |
| 922 | LYM316 | solanum_phureja\|09v1\|SPHAF275745 | 3066 | 500 | 88.7 | globlastp |
| 923 | LYM316 | potato\|10v1\|BF459938_P1 | 3067 | 500 | 88.6 | globlastp |
| 924 | LYM316 | potato\|gb157.2\|BF459938 | 3067 | 500 | 88.6 | globlastp |
| 925 | LYM316 | aquilegia\|10v2\|DR912485_P1 | 3068 | 500 | 88.5 | globlastp |
| 926 | LYM316 | sunflower\|10v1\|CD855840_P1 | 3069 | 500 | 88.5 | globlastp |
| 927 | LYM316 | millet\|10v1\|EVO454PM000746_P1 | 3070 | 500 | 88.5 | globlastp |
| 928 | LYM316 | pine\|10v2\|AW226212_P1 | 3071 | 500 | 88.4 | globlastp |
| 929 | LYM316 | taxus\|10v1\|SRR032523S0008818_P1 | 3072 | 500 | 88.4 | globlastp |
| 930 | LYM316 | arabidopsis\|10v1\|AT5G62670_P1 | 3073 | 500 | 88.4 | globlastp |
| 931 | LYM316 | arabidopsis\|gb165\|AT5G62670 | 3073 | 500 | 88.4 | globlastp |
| 932 | LYM316 | orobanche\|10v1\|SRR023189S0000310_P1 | 3074 | 500 | 88.3 | globlastp |
| 933 | LYM316 | sciadopitys\|10v1\|SRR065035S0004583_P1 | 3075 | 500 | 88.3 | globlastp |
| 934 | LYM316 | poplar\|10v1\|AI166273_P1 | 3076 | 500 | 88.3 | globlastp |
| 935 | LYM316 | poplar\|gb170\|AI166273 | 3076 | 500 | 88.3 | globlastp |
| 936 | LYM316 | soybean\|gb168\|CD410987 | 3077 | 500 | 88.3 | globlastp |
| 937 | LYM316 | pseudotsuga\|10v1\|SRR065119S0000105_P1 | 3078 | 500 | 88.2 | globlastp |
| 938 | LYM316 | brachypodium\|09v1\|GT769251_P1 | 3079 | 500 | 88.2 | globlastp |
| 939 | LYM316 | cotton\|10v2\|SRR032367S0004261_P1 | 3080 | 500 | 88.1 | globlastp |
| 940 | LYM316 | triphysaria\|gb164\|BE574923 | 3081 | 500 | 88 | globlastp |
| 941 | LYM316 | cassava\|09v1\|JGICASSAVA3457M1_P1 | 3082 | 500 | 88 | globlastp |
| 942 | LYM316 | poplar\|10v1\|BU821931_P1 | 3083 | 500 | 87.9 | globlastp |
| 943 | LYM316 | cotton\|10v2\|CO084073_P1 | 3084 | 500 | 87.8 | globlastp |
| 944 | LYM316 | poplar\|gb170\|BU821931 | 3085 | 500 | 87.8 | globlastp |
| 945 | LYM316 | monkeyflower\|10v1\|SRR037227S0002431_P1 | 3086 | 500 | 87.7 | globlastp |
| 946 | LYM316 | chestnut\|gb170\|SRR006295S0001140_P1 | 3087 | 500 | 87.7 | globlastp |
| 947 | LYM316 | prunus\|10v1\|CB821619_P1 | 3088 | 500 | 87.5 | globlastp |
| 948 | LYM316 | monkeyflower\|10v1\|DV206482_P1 | 3089 | 500 | 87.3 | globlastp |
| 949 | LYM316 | castorbean\|09v1\|XM002517411_P1 | 3090 | 500 | 87.2 | globlastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 950 | LYM316 | sunflower\|10v1\|DY937446_P1 | 3091 | 500 | 87.2 | globlastp |
| 951 | LYM316 | arabidopsis\|10v1\|AT3G47950_P1 | 3092 | 500 | 87.1 | globlastp |
| 952 | LYM316 | foxtail_millet\|10v2\|OXEC612066T1_P1 | 3093 | 500 | 86.8 | globlastp |
| 953 | LYM316 | soybean\|11v1\|GLYMA19G02270_P1 | 3094 | 500 | 86.5 | globlastp |
| 954 | LYM316 | cacao\|10v1\|CF972872_P1 | 3095 | 500 | 86.4 | globlastp |
| 955 | LYM316 | switchgrass\|gb167\|FL749584 | 3096 | 500 | 86.2 | globlastp |
| 956 | LYM316 | strawberry\|11v1\|SRR034859S0009654_P1 | 3097 | 500 | 85.2 | globlastp |
| 957 | LYM316 | aristolochia\|10v1\|SRR039082S0479301_P1 | 3098 | 500 | 84.3 | globlastp |
| 958 | LYM316 | pine\|10v2\|CX649213_T1 | 3099 | 500 | 84.13 | glotblastn |
| 959 | LYM316 | cassava\|09v1\|DV444631_T1 | 3100 | 500 | 84.04 | glotblastn |
| 960 | LYM316 | foxtail_millet\|10v2\|OXEC613731T1_P1 | 3101 | 500 | 83.1 | globlastp |
| 961 | LYM316 | maize\|10v1\|GFXZMU09989X1_P1 | 3102 | 500 | 82.9 | globlastp |
| 962 | LYM316 | soybean\|11v1\|BM567790_P1 | 3103 | 500 | 82.4 | globlastp |
| 963 | LYM316 | soybean\|gb168\|BF634181 | 3104 | 500 | 82.4 | globlastp |
| 964 | LYM316 | podocarpus\|10v1\|SRR065014S0001544_P1 | 3105 | 500 | 82.3 | globlastp |
| 965 | LYM316 | cleome_gynandra\|10v1\|SRR015532S0001594_P1 | 3106 | 500 | 81.4 | globlastp |
| 966 | LYM316 | cassava\|09v1\|DV445742_P1 | 3107 | 500 | 81.3 | globlastp |
| 967 | LYM316 | poplar\|10v1\|AY165042_P1 | 3108 | 500 | 80.9 | globlastp |
| 968 | LYM316 | soybean\|11v1\|GLYMA14G17360_P1 | 3109 | 500 | 80.9 | globlastp |
| 969 | LYM316 | banana\|10v1\|GFXFN396603X3_P1 | 3110 | 500 | 80.7 | globlastp |
| 970 | LYM316 | castorbean\|09v1\|EG674264_P1 | 3111 | 500 | 80.7 | globlastp |
| 971 | LYM316 | monkeyflower\|10v1\|GR053706_P1 | 3112 | 500 | 80.7 | globlastp |
| 972 | LYM316 | sorghum\|09v1\|SB06G031240_P1 | 3113 | 500 | 80.7 | globlastp |
| 973 | LYM316 | soybean\|11v1\|GLYMA17G29370_T1 | 3114 | 500 | 80.6 | glotblastn |
| 974 | LYM316 | sugarcane\|10v1\|BQ532941_T1 | 3115 | 500 | 80.54 | glotblastn |
| 975 | LYM316 | maize\|10v1\|AI001235_P1 | 3116 | 500 | 80.5 | globlastp |
| 976 | LYM316 | oak\|10v1\|DN950122_P1 | 3117 | 500 | 80.5 | globlastp |
| 977 | LYM316 | chestnut\|gb170\|SRR006295S0006926_P1 | 3118 | 500 | 80.4 | globlastp |
| 978 | LYM316 | foxtail_millet\|10v2\|SICRP039993_P1 | 3119 | 500 | 80.4 | globlastp |
| 979 | LYM316 | maize\|10v1\|AI615212_P1 | 3120 | 500 | 80.4 | globlastp |
| 980 | LYM316 | poplar\|10v1\|BU884336_P1 | 3121 | 500 | 80.4 | globlastp |
| 981 | LYM316 | rice\|gb170\|OS04G56160_P1 | 3122 | 500 | 80.4 | globlastp |
| 982 | LYM316 | soybean\|11v1\|GLYMA09G06250_P1 | 3123 | 500 | 80.4 | globlastp |
| 983 | LYM316 | soybean\|11v1\|GLYMA15G17530_P1 | 3124 | 500 | 80.4 | globlastp |
| 984 | LYM316 | potato\|10v1\|BF459991_P1 | 3125 | 500 | 80.3 | globlastp |
| 985 | LYM316 | pseudotsuga\|10v1\|SRR065119S0010587_P1 | 3126 | 500 | 80.2 | globlastp |
| 986 | LYM316 | solanum_phureja\|09v1\|SPHTOMTRALTBL_P1 | 3127 | 500 | 80.2 | globlastp |
| 987 | LYM316 | soybean\|11v1\|GLYMA13G00840_P1 | 3128 | 500 | 80.2 | globlastp |
| 988 | LYM316 | cacao\|10v1\|CA796153_P1 | 3129 | 500 | 80.1 | globlastp |
| 989 | LYM316 | cacao\|10v1\|CU477696_P1 | 3130 | 500 | 80.1 | globlastp |
| 990 | LYM316 | cotton\|10v2\|CO113314_P1 | 3131 | 500 | 80.1 | globlastp |
| 991 | LYM316 | cucumber\|09v1\|AJ703811_P1 | 3132 | 500 | 80.1 | globlastp |
| 992 | LYM316 | monkeyflower\|10v1\|DV206165_P1 | 3133 | 500 | 80.1 | globlastp |
| 993 | LYM316 | orobanche\|10v1\|SRR023189S0000837_P1 | 3134 | 500 | 80.1 | globlastp |
| 994 | LYM316 | physcomitrella\|10v1\|AW700088_P1 | 3135 | 500 | 80.1 | globlastp |
| 995 | LYM316 | poplar\|10v1\|BI071253_P1 | 3136 | 500 | 80.1 | globlastp |
| 996 | LYM316 | prunus\|10v1\|CN491211_P1 | 3137 | 500 | 80.1 | globlastp |
| 997 | LYM316 | arabidopsis_lyrata\|09v1\|CRPALE021507_P1 | 3138 | 500 | 80 | globlastp |
| 998 | LYM316 | arabidopsis\|10v1\|AT4G30190_P1 | 3139 | 500 | 80 | globlastp |
| 999 | LYM316 | cotton\|10v2\|CO113293_P1 | 3140 | 500 | 80 | globlastp |
| 1000 | LYM316 | millet\|10v1\|DQ875455_P1 | 3141 | 500 | 80 | globlastp |
| 1001 | LYM316 | tomato\|09v1\|TOMTRALTBL_P1 | 3142 | 500 | 80 | globlastp |
| 1002 | LYM317 | wheat\|10v2\|BE428966_P1 | 3143 | 501 | 97.7 | globlastp |
| 1003 | LYM317 | pseudoroegneria\|gb167\|FF343824 | 3144 | 501 | 97.4 | globlastp |
| 1004 | LYM317 | leymus\|gb166\|EG376251_P1 | 3145 | 501 | 97.4 | globlastp |
| 1005 | LYM317 | leymus\|gb166\|EG375010_P1 | 3146 | 501 | 97.1 | globlastp |
| 1006 | LYM317 | brachypodium\|09v1\|DV469643_P1 | 3147 | 501 | 94.2 | globlastp |
| 1007 | LYM317 | sugarcane\|gb157.3\|CA085456 | 3148 | 501 | 88.6 | globlastp |
| 1008 | LYM317 | sugarcane\|gb157.3\|BQ536025 | 3148 | 501 | 88.6 | globlastp |
| 1009 | LYM317 | sugarcane\|gb157.3\|CA071453 | 3149 | 501 | 88.4 | globlastp |
| 1010 | LYM317 | sorghum\|09v1\|SB01G036580 | 3150 | 501 | 88.1 | globlastp |
| 1011 | LYM317 | cenchrus\|gb166\|BM084530_P1 | 3151 | 501 | 86.9 | globlastp |
| 1012 | LYM317 | maize\|10v1\|AI861382_P1 | 3152 | 501 | 86.6 | globlastp |
| 1013 | LYM317 | maize\|gb170\|AI861382 | 3152 | 501 | 86.6 | globlastp |
| 1014 | LYM317 | switchgrass\|gb167\|DN142628 | 3153 | 501 | 86.3 | globlastp |
| 1015 | LYM317 | switchgrass\|gb167\|DN140729 | 3154 | 501 | 86 | globlastp |
| 1016 | LYM317 | rice\|gb170\|OS03G21040T2 | 3155 | 501 | 85.4 | globlastp |
| 1017 | LYM317 | foxtail_millet\|10v2\|SICRP025043_T1 | 3156 | 501 | 84.86 | glotblastn |
| 1018 | LYM317 | sugarcane\|gb157.3\|CA112033 | 3157 | 501 | 82.18 | glotblastn |
| 1019 | LYM318 | wheat\|10v2\|BE352604_P1 | 3158 | 502 | 97.1 | globlastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 1020 | LYM318 | wheat\|gb164\|BE352604 | 3159 | 502 | 94.6 | globlastp |
| 1021 | LYM318 | switchgrass\|gb167\|DN145977 | 3160 | 502 | 93.5 | globlastp |
| 1022 | LYM318 | foxtail_millet\|10v2\|SICRP022490_P1 | 3161 | 502 | 93.3 | globlastp |
| 1023 | LYM318 | millet\|10v1\|EVO454PM001279_P1 | 3162 | 502 | 92.9 | globlastp |
| 1024 | LYM318 | switchgrass\|gb167\|DN143219 | 3163 | 502 | 92.7 | globlastp |
| 1025 | LYM318 | brachypodium\|09v1\|DV476722_P1 | 3164 | 502 | 92.3 | globlastp |
| 1026 | LYM318 | maize\|10v1\|AI737467_P1 | 3165 | 502 | 92.3 | globlastp |
| 1027 | LYM318 | rice\|gb170\|OS08G43640 | 3166 | 502 | 91.9 | globlastp |
| 1028 | LYM318 | sorghum\|09v1\|SB07G024800 | 3167 | 502 | 91.7 | globlastp |
| 1029 | LYM318 | sugarcane\|gb157.3\|BU103272 | 3168 | 502 | 91.6 | globlastp |
| 1030 | LYM318 | maize\|10v1\|AI947388_P1 | 3169 | 502 | 91.4 | globlastp |
| 1031 | LYM318 | maize\|gb170\|AI947388 | 3169 | 502 | 91.4 | globlastp |
| 1032 | LYM318 | rice\|gb170\|OS09G37000 | 3170 | 502 | 89.2 | globlastp |
| 1033 | LYM318 | switchgrass\|gb167\|FE599643 | 3171 | 502 | 88.5 | globlastp |
| 1034 | LYM318 | brachypodium\|09v1\|DV471273_P1 | 3172 | 502 | 88.5 | globlastp |
| 1035 | LYM318 | wheat\|gb164\|BE399426 | 3173 | 502 | 84.48 | glotblastn |
| 1036 | LYM318 | oat\|10v2\|GO589547_P1 | 3174 | 502 | 83.6 | globlastp |
| 1037 | LYM318 | millet\|09v1\|EVO454PM001279 | 3175 | 502 | 81.6 | glotblastn |
| 1038 | LYM318 | oak\|10v1\|FP029519_P1 | 3176 | 502 | 81.4 | globlastp |
| 1039 | LYM318 | cacao\|10v1\|CF974024_P1 | 3177 | 502 | 80.8 | globlastp |
| 1040 | LYM318 | chestnut\|gb170\|SRR006295S0011484_P1 | 3178 | 502 | 80.8 | globlastp |
| 1041 | LYM318 | soybean\|11v1\|GLYMA04G02370_P1 | 3179 | 502 | 80.8 | globlastp |
| 1042 | LYM318 | soybean\|gb168\|BE660782 | 3179 | 502 | 80.8 | globlastp |
| 1043 | LYM318 | momordica\|10v1\|SRR071315S0003995_P1 | 3180 | 502 | 80.6 | globlastp |
| 1044 | LYM318 | nasturtium\|10v1\|GH171179_P1 | 3181 | 502 | 80.4 | globlastp |
| 1045 | LYM318 | poplar\|gb170\|BI129079 | 3182 | 502 | 80.4 | globlastp |
| 1046 | LYM318 | medicago\|09v1\|AW695167_P1 | 3183 | 502 | 80.3 | globlastp |
| 1047 | LYM318 | melon\|10v1\|DV632592_P1 | 3184 | 502 | 80.2 | globlastp |
| 1048 | LYM318 | peanut\|10v1\|EE126134_P1 | 3185 | 502 | 80.2 | globlastp |
| 1049 | LYM318 | tobacco\|gb162\|AB001422 | 3186 | 502 | 80.2 | globlastp |
| 1050 | LYM318 | poplar\|10v1\|BU811347_P1 | 3187 | 502 | 80.2 | globlastp |
| 1051 | LYM318 | poplar\|gb170\|BU811347 | 3187 | 502 | 80.2 | globlastp |
| 1052 | LYM318 | sunflower\|10v1\|CD850830_P1 | 3188 | 502 | 80.2 | globlastp |
| 1053 | LYM318 | sunflower\|gb162\|CD850830 | 3188 | 502 | 80.2 | globlastp |
| 1054 | LYM318 | cassava\|09v1\|DV441286_P1 | 3189 | 502 | 80.2 | globlastp |
| 1055 | LYM318 | artemisia\|gb164\|EY080009 | 3190 | 502 | 80.2 | globlastp |
| 1056 | LYM318 | cowpea\|gb166\|FF388382_P1 | 3191 | 502 | 80.2 | globlastp |
| 1057 | LYM318 | soybean\|11v1\|GLYMA06G02410_P1 | 3192 | 502 | 80.2 | globlastp |
| 1058 | LYM318 | soybean\|gb168\|AW695167 | 3192 | 502 | 80.2 | globlastp |
| 1059 | LYM318 | castorbean\|09v1\|EG677995_T1 | 3193 | 502 | 80 | glotblastn |
| 1060 | LYM319 | wheat\|gb164\|BE419309 | 3194 | 503 | 98.2 | globlastp |
| 1061 | LYM319 | wheat\|gb164\|BE443380 | 3195 | 503 | 98.2 | globlastp |
| 1062 | LYM319 | wheat\|10v2\|BE419309_P1 | 3195 | 503 | 98.2 | globlastp |
| 1063 | LYM319 | wheat\|10v2\|BE428077_P1 | 3196 | 503 | 96.8 | globlastp |
| 1064 | LYM319 | oat\|10v2\|GR322926_P1 | 3197 | 503 | 94.7 | globlastp |
| 1065 | LYM319 | brachypodium\|09v1\|GT759567_P1 | 3198 | 503 | 93.7 | globlastp |
| 1066 | LYM319 | rice\|gb170\|OS09G20350 | 3199 | 503 | 83.2 | globlastp |
| 1067 | LYM320 | brachypodium\|09v1\|DV481104_P1 | 3200 | 504 | 84.1 | globlastp |
| 1068 | LYM322 | sorghum\|09v1\|SB04G027090 | 3201 | 506 | 87.2 | globlastp |
| 1069 | LYM322 | foxtail_millet\|10v2\|SICRP011275_T1 | 3202 | 506 | 86.2 | glotblastn |
| 1070 | LYM322 | switchgrass\|gb167\|FE630202 | 3203 | 506 | 85.42 | glotblastn |
| 1071 | LYM322 | maize\|10v1\|AI782996_P1 | 3204 | 506 | 84.6 | globlastp |
| 1072 | LYM322 | maize\|gb170\|AI782996 | 3204 | 506 | 84.6 | globlastp |
| 1073 | LYM322 | sugarcane\|10v1\|CA088583_T1 | 3205 | 506 | 83.85 | glotblastn |
| 1074 | LYM322 | millet\|10v1\|EVO454PM036524_P1 | 3206 | 506 | 83.3 | globlastp |
| 1075 | LYM322 | foxtail_millet\|10v2\|FXTRMSLX01164775D1_T1 | 3207 | 506 | 82.03 | glotblastn |
| 1076 | LYM323 | wheat\|gb164\|AL827748 | 3208 | 507 | 95.4 | globlastp |
| 1077 | LYM323 | wheat\|gb164\|DR737479 | 3209 | 507 | 84 | glotblastn |
| 1078 | LYM323 | wheat\|10v2\|CJ616758_P1 | 3210 | 507 | 83.3 | globlastp |
| 1079 | LYM323 | barley\|10v2\|BF622357_P1 | 3211 | 507 | 81.1 | globlastp |
| 1080 | LYM323 | wheat\|10v2\|CA722056_P1 | 3212 | 507 | 81.1 | globlastp |
| 1081 | LYM323 | wheat\|10v2\|BQ901526_P1 | 3213 | 507 | 80.1 | globlastp |
| 1082 | LYM324 | wheat\|gb164\|BE404741 | 3214 | 508 | 91.6 | globlastp |
| 1083 | LYM324 | wheat\|gb164\|BE606638 | 3215 | 508 | 91.6 | globlastp |
| 1084 | LYM324 | wheat\|10v2\|BE404741_P1 | 3216 | 508 | 91 | globlastp |
| 1085 | LYM324 | wheat\|10v2\|BE606638_P1 | 3217 | 508 | 90.4 | globlastp |
| 1086 | LYM324 | brachypodium\|09v1\|GT806106_P1 | 3218 | 508 | 87.1 | globlastp |
| 1087 | LYM324 | rice\|gb170\|OS01G07810 | 3219 | 508 | 83.2 | globlastp |
| 1088 | LYM326 | leymus\|gb166\|EG400080_T1 | 3220 | 509 | 95.88 | glotblastn |
| 1089 | LYM326 | wheat\|10v2\|BE445234_T1 | 3221 | 509 | 95.06 | glotblastn |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 1089 | LYM326_H4 | wheat|10v2|BE445234_P1 | 3221 | 678 | 80.3 | globlastp |
| 1090 | LYM326 | wheat|gb164|BE445234 | 3222 | 509 | 95.06 | glotblastn |
| 1090 | LYM326_H4 | wheat|gb164|BE445234 | 3222 | 678 | 80.26 | glotblastn |
| 1091 | LYM326 | oat|10v2|GR328664_T1 | 3223 | 509 | 87.24 | glotblastn |
| 1092 | LYM326 | maize|10v1|BG410328_T1 | 3224 | 509 | 86.01 | glotblastn |
| 1093 | LYM326 | maize|gb170|BG410328 | 3224 | 509 | 86.01 | glotblastn |
| 1094 | LYM326 | sorghum|09v1|SB04G001270 | 3225 | 509 | 85.19 | glotblastn |
| 1094 | LYM326_H4 | sorghum|09v1|SB04G001270 | 3225 | 678 | 80.16 | glotblastn |
| 1095 | LYM326 | rice|gb170|OS02G02520 | 3226 | 509 | 83.13 | glotblastn |
| 1096 | LYM327 | wheat|10v2|BE425355_P1 | 3227 | 510 | 88.2 | globlastp |
| 1097 | LYM327 | wheat|gb164|BE425355 | 3227 | 510 | 88.2 | globlastp |
| 1098 | LYM327 | rye|gb164|BE586531 | 3228 | 510 | 87.1 | globlastp |
| 1099 | LYM327 | wheat|10v2|BG608337_P1 | 3229 | 510 | 83.7 | globlastp |
| 1100 | LYM327 | wheat|gb164|BG608337 | 3229 | 510 | 83.7 | globlastp |
| 1101 | LYM327 | wheat|10v2|BE497048_P1 | 3230 | 510 | 81.6 | globlastp |
| 1102 | LYM327 | wheat|gb164|BE497048 | 3230 | 510 | 81.6 | globlastp |
| 1103 | LYM327 | wheat|gb164|DR739426 | 3231 | 510 | 80.61 | glotblastn |
| 1104 | LYM327 | barley|10v2|BI949893_P1 | 3232 | 510 | 80.2 | globlastp |
| 1105 | LYM327 | pseudoroegneria|gb167|FF365337 | 3233 | 510 | 80.2 | globlastp |
| 1106 | LYM327 | wheat|10v2|BE402321_P1 | 3234 | 510 | 80 | globlastp |
| 1107 | LYM330 | wheat|10v2|BE498332_P1 | 3235 | 513 | 88.9 | globlastp |
| 1108 | LYM330 | wheat|gb164|BE498332 | 3235 | 513 | 88.9 | globlastp |
| 1109 | LYM330 | pseudoroegneria|gb167|FF348503 | 3236 | 513 | 85.9 | globlastp |
| 1110 | LYM331 | barley|gb157SOLEXA|AV910488 | 3237 | 514 | 83.7 | globlastp |
| 1111 | LYM331 | rice|gb170|OS02G03720_P1 | 3238 | 514 | 81.2 | globlastp |
| 1112 | LYM331 | brachypodium|09v1|GT789518_P1 | 3239 | 514 | 80.5 | globlastp |
| 1113 | LYM332 | wheat|10v2|BE490464_P1 | 3240 | 515 | 95.2 | globlastp |
| 1114 | LYM332 | wheat|10v2|CA597955_P1 | 3241 | 515 | 95.2 | globlastp |
| 1115 | LYM332 | wheat|gb164|BQ743265 | 3242 | 515 | 95.2 | globlastp |
| 1116 | LYM332 | brachypodium|09v1|DV484469_P1 | 3243 | 515 | 87.7 | globlastp |
| 1117 | LYM332 | rice|gb170|OS04G44530 | 3244 | 515 | 87 | globlastp |
| 1118 | LYM332 | foxtail_millet|10v2|FXTRMSLX00224883D1_P1 | 3245 | 515 | 85 | globlastp |
| 1119 | LYM332 | millet|10v1|EVO454PM009535_P1 | 3246 | 515 | 84.8 | globlastp |
| 1120 | LYM332 | maize|10v1|AW055525_P1 | 3247 | 515 | 83.4 | globlastp |
| 1121 | LYM332 | maize|gb170|AW055525 | 3247 | 515 | 83.4 | globlastp |
| 1122 | LYM332 | maize|10v1|AW018233_T1 | 3248 | 515 | 83.33 | glotblastn |
| 1123 | LYM332 | maize|gb170|AW018233 | 3249 | 515 | 83.3 | globlastp |
| 1124 | LYM332 | sorghum|09v1|SB06G023190 | 3250 | 515 | 83.1 | globlastp |
| 1125 | LYM333 | wheat|10v2|AL827009_P1 | 3251 | 516 | 86.8 | globlastp |
| 1126 | LYM333 | wheat|gb164|AL827009 | 3252 | 516 | 86.8 | globlastp |
| 1127 | LYM334 | wheat|10v2|BG606663_P1 | 3253 | 517 | 89.5 | globlastp |
| 1128 | LYM334 | wheat|gb164|BG606663 | 3254 | 517 | 88.8 | globlastp |
| 1129 | LYM334 | oat|10v2|GR340052_P1 | 3255 | 517 | 80.7 | globlastp |
| 1130 | LYM335 | wheat|10v2|BG608153_P1 | 3256 | 518 | 81 | globlastp |
| 1131 | LYM341 | barley|10v2|BF255151_P1 | 3257 | 523 | 86.2 | globlastp |
| 1132 | LYM341 | barley|gb157SOLEXA|BF255151 | 3258 | 523 | 85.9 | globlastp |
| 1133 | LYM341 | wheat|10v2|BE489094_P1 | 3259 | 523 | 84.6 | globlastp |
| 1134 | LYM341 | wheat|gb164|BE499583 | 3260 | 523 | 84.4 | globlastp |
| 1135 | LYM342 | brachypodium|09v1|DV471725_P1 | 3261 | 524 | 81.9 | globlastp |
| 1136 | LYM343 | oak|10v1|FP039541_P1 | 3262 | 525 | 80 | globlastp |
| 1137 | LYM345 | cotton|10v2|DT544816_P1 | 3263 | 527 | 94.2 | globlastp |
| 1138 | LYM345 | cacao|10v1|CU505040_P1 | 3264 | 527 | 85.8 | globlastp |
| 1139 | LYM346 | maize|10v1|BE224797_P1 | 3265 | 528 | 97.3 | globlastp |
| 1140 | LYM346 | maize|gb170|BE224797 | 3265 | 528 | 97.3 | globlastp |
| 1141 | LYM346 | sugarcane|10v1|CA141777_P1 | 3266 | 528 | 96.2 | globlastp |
| 1142 | LYM346 | sorghum|09v1|SB03G010800 | 3267 | 528 | 96.2 | globlastp |
| 1143 | LYM346 | switchgrass|gb167|FE621427 | 3268 | 528 | 93.4 | globlastp |
| 1144 | LYM346 | sugarcane|10v1|CA084777_P1 | 3269 | 528 | 86.6 | globlastp |
| 1145 | LYM346 | sugarcane|gb157.3|CA084777 | 3269 | 528 | 86.6 | globlastp |
| 1146 | LYM346 | oat|10v2|GO588228_P1 | 3270 | 528 | 84.8 | globlastp |
| 1147 | LYM346 | brachypodium|09v1|DV476378_P1 | 3271 | 528 | 83.8 | globlastp |
| 1148 | LYM348 | sorghum|09v1|SB06G030390 | 3272 | 529 | 95.8 | globlastp |
| 1149 | LYM348 | foxtail_millet|10v2|FXTRMSLX00976092D1_P1 | 3273 | 529 | 93.4 | globlastp |
| 1150 | LYM348 | barley|10v2|BF631070_P1 | 3274 | 529 | 89.3 | globlastp |
| 1151 | LYM348 | wheat|gb164|BE425951 | 3275 | 529 | 88.77 | glotblastn |
| 1152 | LYM348 | switchgrass|gb167|FL737932 | 3276 | 529 | 86 | globlastp |
| 1153 | LYM348 | rice|gb170|OS04G55050 | 3277 | 529 | 85.7 | globlastp |
| 1154 | LYM348 | brachypodium|09v1|DV470592_P1 | 3278 | 529 | 85.5 | globlastp |
| 1155 | LYM349 | sorghum|09v1|SB03G044720 | 3279 | 530 | 95.7 | globlastp |
| 1156 | LYM349 | rice|gb170|OS01G70390 | 3280 | 530 | 90.6 | globlastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 1157 | LYM349 | brachypodium\|09v1\|SRR031795S0016465_P1 | 3281 | 530 | 87.3 | globlastp |
| 1158 | LYM350 | sorghum\|09v1\|SB10G031240 | 3282 | 531 | 95.8 | globlastp |
| 1159 | LYM350 | sugarcane\|10v1\|CA092260_P1 | 3283 | 531 | 94.4 | globlastp |
| 1160 | LYM350 | sugarcane\|gb157.3\|CA092260 | 3283 | 531 | 94.4 | globlastp |
| 1161 | LYM350 | switchgrass\|gb167\|DN140794 | 3284 | 531 | 89.2 | globlastp |
| 1162 | LYM350 | switchgrass\|gb167\|DN152334 | 3285 | 531 | 84.7 | globlastp |
| 1163 | LYM350 | foxtail_millet\|10v2\|SICRP011626_P1 | 3286 | 531 | 83.4 | globlastp |
| 1164 | LYM350 | millet\|10v1\|EVO454PM003260_T1 | 3287 | 531 | 82.89 | glotblastn |
| 1165 | LYM351 | sorghum\|09v1\|SB08G020890 | 3288 | 532 | 91.5 | globlastp |
| 1166 | LYM351 | switchgrass\|gb167\|FL770825 | 3289 | 532 | 89.38 | glotblastn |
| 1167 | LYM351 | millet\|10v1\|EVO454PM052672_P1 | 3290 | 532 | 87.9 | globlastp |
| 1168 | LYM351 | rice\|gb170\|OS12G41590 | 3291 | 532 | 82.5 | globlastp |
| 1169 | LYM351 | barley\|10v2\|BF624095_T1 | 3292 | 532 | 81.79 | glotblastn |
| 1170 | LYM351 | barley\|gb157SOLEXA\|BF624095 | 3292 | 532 | 81.79 | glotblastn |
| 1171 | LYM351 | brachypodium\|09v1\|DV470161_T1 | 3293 | 532 | 81.09 | glotblastn |
| 1172 | LYM351 | wheat\|10v2\|BQ578337_T1 | 3294 | 532 | 80.07 | glotblastn |
| 1173 | LYM352 | maize\|10v1\|FK962564_T1 | 3295 | 533 | 98.1 | glotblastn |
| 1174 | LYM352 | maize\|10v1\|ZMCRP2V098316_T1 | — | 533 | 88.61 | glotblastn |
| 1175 | LYM352 | maize\|10v1\|DW790475_T1 | 3296 | 533 | 81.66 | glotblastn |
| 1176 | LYM354 | sugarcane\|10v1\|CA071540_P1 | 3297 | 535 | 94.6 | globlastp |
| 1177 | LYM354 | sugarcane\|gb157.3\|CA071540 | 3298 | 535 | 94 | globlastp |
| 1178 | LYM354 | switchgrass\|gb167\|FE629774 | 3299 | 535 | 87.9 | globlastp |
| 1179 | LYM354 | foxtail_millet\|10v2\|SICRP038756_P1 | 3300 | 535 | 86.2 | globlastp |
| 1180 | LYM354 | rice\|gb170\|OS02G55590 | 3301 | 535 | 80.7 | globlastp |
| 1181 | LYM356 | sorghum\|09v1\|SB04G033890 | 3302 | 537 | 94.7 | globlastp |
| 1182 | LYM356 | sugarcane\|10v1\|CA088037_P1 | 3303 | 537 | 93.9 | globlastp |
| 1183 | LYM356 | switchgrass\|gb167\|FE619329 | 3304 | 537 | 92.4 | globlastp |
| 1184 | LYM356 | millet\|10v1\|EVO454PM004917_P1 | 3305 | 537 | 90.3 | globlastp |
| 1185 | LYM356 | rice\|gb170\|OS02G52270_P1 | 3306 | 537 | 86.6 | globlastp |
| 1186 | LYM356 | brachypodium\|09v1\|GT777127_P1 | 3307 | 537 | 85.9 | globlastp |
| 1187 | LYM356 | oat\|10v2\|GO590102_P1 | 3308 | 537 | 85.1 | globlastp |
| 1188 | LYM356 | wheat\|10v2\|BE398624_P1 | 3309 | 537 | 82.1 | globlastp |
| 1189 | LYM356 | foxtail_millet\|10v2\|FXTRMSLX00005143D1_P1 | 3310 | 537 | 81.8 | globlastp |
| 1190 | LYM356 | barley\|10v2\|BG416537_P1 | 3311 | 537 | 81.3 | globlastp |
| 1191 | LYM356 | sugarcane\|gb157.3\|CA088037 | 3312 | 537 | 81.3 | globlastp |
| 1192 | LYM359 | sorghum\|09v1\|SB09G020350 | 3313 | 539 | 89.6 | globlastp |
| 1193 | LYM359 | switchgrass\|gb167\|FE598142 | 3314 | 539 | 88.1 | globlastp |
| 1194 | LYM359 | foxtail_millet\|10v2\|FXTRMSLX00780257D2_P1 | 3315 | 539 | 85.4 | globlastp |
| 1195 | LYM359 | leymus\|gb166\|EG387725_P1 | 3316 | 539 | 81.1 | globlastp |
| 1196 | LYM359 | wheat\|10v2\|AL820331_P1 | 3317 | 539 | 80.1 | globlastp |
| 1197 | LYM360 | sorghum\|09v1\|SB03G046050 | 3318 | 540 | 93.8 | globlastp |
| 1198 | LYM360 | rice\|gb170\|OS01G72340 | 3319 | 540 | 82 | globlastp |
| 1199 | LYM361 | sugarcane\|10v1\|CA073987_P1 | 541 | 541 | 100 | globlastp |
| 1200 | LYM361 | sugarcane\|gb157.3\|CA073987 | 541 | 541 | 100 | globlastp |
| 1201 | LYM361 | switchgrass\|gb167\|FE604030 | 3320 | 541 | 98.6 | globlastp |
| 1202 | LYM361 | maize\|gb170\|LLBE224739 | 3321 | 541 | 98.6 | globlastp |
| 1203 | LYM361 | maize\|10v1\|T69045_P1 | 3321 | 541 | 98.6 | globlastp |
| 1204 | LYM361 | maize\|gb170\|T69045 | 3321 | 541 | 98.6 | globlastp |
| 1205 | LYM361 | maize\|10v1\|BE051344_P1 | 3321 | 541 | 98.6 | globlastp |
| 1206 | LYM361 | maize\|gb170\|BE051344 | 3321 | 541 | 98.6 | globlastp |
| 1207 | LYM361 | switchgrass\|gb167\|FE607881 | 3320 | 541 | 98.6 | globlastp |
| 1208 | LYM361 | sorghum\|09v1\|SB03G040400 | 3322 | 541 | 98.6 | globlastp |
| 1209 | LYM361 | foxtail_millet\|10v2\|SICRP029404_P1 | 3323 | 541 | 97.9 | globlastp |
| 1210 | LYM361 | millet\|09v1\|CD725401 | 3323 | 541 | 97.9 | globlastp |
| 1211 | LYM361 | millet\|10v1\|CD725401_P1 | 3323 | 541 | 97.9 | globlastp |
| 1212 | LYM361 | cynodon\|10v1\|ES292039_P1 | 3324 | 541 | 97.2 | globlastp |
| 1213 | LYM361 | rice\|gb170\|OS01G63890 | 3325 | 541 | 97.2 | globlastp |
| 1214 | LYM361 | sugarcane\|10v1\|CA092601_P1 | 3326 | 541 | 95.9 | globlastp |
| 1215 | LYM361 | switchgrass\|gb167\|FL883964 | 3326 | 541 | 95.9 | globlastp |
| 1216 | LYM361 | sugarcane\|gb157.3\|CA092601 | 3326 | 541 | 95.9 | globlastp |
| 1217 | LYM361 | barley\|10v2\|BG300925_P1 | 3327 | 541 | 95.9 | globlastp |
| 1218 | LYM361 | barley\|gb157SOLEXA\|BG300925 | 3327 | 541 | 95.9 | globlastp |
| 1219 | LYM361 | sorghum\|09v1\|SB09G022770 | 3326 | 541 | 95.9 | globlastp |
| 1220 | LYM361 | foxtail_millet\|10v2\|SICRP007700_P1 | 3328 | 541 | 95.2 | globlastp |
| 1221 | LYM361 | oat\|10v2\|GO587638_P1 | 3329 | 541 | 95.2 | globlastp |
| 1222 | LYM361 | fescue\|gb161\|DT681630_P1 | 3330 | 541 | 95.2 | globlastp |
| 1223 | LYM361 | wheat\|gb164\|CA721336 | 3331 | 541 | 95.2 | globlastp |
| 1224 | LYM361 | wheat\|gb164\|BG263183 | 3331 | 541 | 95.2 | globlastp |
| 1225 | LYM361 | switchgrass\|gb167\|FE608157 | 3332 | 541 | 95.2 | globlastp |
| 1226 | LYM361 | wheat\|10v2\|BF201868_P1 | 3331 | 541 | 95.2 | globlastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 1227 | LYM361 | cynodon\|10v1\|ES292016_P1 | 3333 | 541 | 94.5 | globlastp |
| 1228 | LYM361 | rice\|gb170\|OS05G37390 | 3334 | 541 | 94.5 | globlastp |
| 1229 | LYM361 | banana\|10v1\|FF559231_P1 | 3335 | 541 | 94.5 | globlastp |
| 1230 | LYM361 | banana\|gb167\|FF559231 | 3336 | 541 | 94.5 | globlastp |
| 1231 | LYM361 | millet\|09v1\|CD726270 | 3337 | 541 | 94.5 | globlastp |
| 1232 | LYM361 | millet\|10v1\|CD726270_P1 | 3337 | 541 | 94.5 | globlastp |
| 1233 | LYM361 | brachypodium\|09v1\|GT807282_P1 | 3338 | 541 | 93.8 | globlastp |
| 1234 | LYM361 | aristolochia\|10v1\|SRR039082S0000613_P1 | 3339 | 541 | 93.1 | globlastp |
| 1235 | LYM361 | oat\|10v2\|CN820723_P1 | 3340 | 541 | 93.1 | globlastp |
| 1236 | LYM361 | wheat\|gb164\|BE414873 | 3341 | 541 | 93.1 | globlastp |
| 1237 | LYM361 | oil_palm\|gb166\|EL686982_P1 | 3342 | 541 | 93.1 | globlastp |
| 1238 | LYM361 | barley\|10v2\|BE603233_P1 | 3343 | 541 | 93.1 | globlastp |
| 1239 | LYM361 | barley\|gb157SOLEXA\|BE603233 | 3343 | 541 | 93.1 | globlastp |
| 1240 | LYM361 | wheat\|gb164\|CA640118 | 3341 | 541 | 93.1 | globlastp |
| 1241 | LYM361 | wheat\|10v2\|BE493692_P1 | 3343 | 541 | 93.1 | globlastp |
| 1242 | LYM361 | wheat\|gb164\|BE493692 | 3343 | 541 | 93.1 | globlastp |
| 1243 | LYM361 | wheat\|10v2\|BE414873_P1 | 3341 | 541 | 93.1 | globlastn |
| 1244 | LYM361 | pineapple\|10v1\|DT337088_P1 | 3344 | 541 | 92.4 | globlastp |
| 1245 | LYM361 | eucalyptus\|gb166\|CT982737_P1 | 3345 | 541 | 92.4 | globlastp |
| 1246 | LYM361 | amborella\|gb166\|CD483512_P1 | 3346 | 541 | 91 | globlastp |
| 1247 | LYM361 | aquilegia\|10v2\|JGIAC018781_P1 | 3347 | 541 | 90.3 | globlastp |
| 1248 | LYM361 | aristolochia\|10v1\|SRR039082S0449912_P1 | 3348 | 541 | 90.3 | globlastp |
| 1249 | LYM361 | momordica\|10v1\|SRR071315S0038100_P1 | 3349 | 541 | 90.3 | globlastp |
| 1250 | LYM361 | cucumber\|09v1\|AM728462_P1 | 3349 | 541 | 90.3 | globlastp |
| 1251 | LYM361 | rice\|gb170\|OS12G05410 | 3350 | 541 | 90.3 | globlastp |
| 1252 | LYM361 | melon\|10v1\|AM716068_P1 | 3349 | 541 | 90.3 | globlastp |
| 1253 | LYM361 | melon\|gb165\|AM716068 | 3349 | 541 | 90.3 | globlastp |
| 1254 | LYM361 | acacia\|10v1\|FS590895_P1 | 3351 | 541 | 89.7 | globlastp |
| 1255 | LYM361 | oak\|10v1\|DN950254_P1 | 3352 | 541 | 89.7 | globlastp |
| 1256 | LYM361 | sunflower\|10v1\|CX943795_P1 | 3353 | 541 | 89.7 | globlastp |
| 1257 | LYM361 | grape\|gb160\|BQ798937_P1 | 3354 | 541 | 89.7 | globlastp |
| 1258 | LYM361 | canola\|10v1\|CD822899_P1 | 3355 | 541 | 89.7 | globlastp |
| 1259 | LYM361 | canola\|gb161\|CD822899 | 3355 | 541 | 89.7 | globlastp |
| 1260 | LYM361 | cotton\|10v2\|SRR032367S0627871_P1 | 3356 | 541 | 89.7 | globlastp |
| 1261 | LYM361 | cotton\|gb164\|AI729628 | 3356 | 541 | 89.7 | globlastp |
| 1262 | LYM361 | b_rapa\|gb162\|CX266853_P1 | 3355 | 541 | 89.7 | globlastp |
| 1263 | LYM361 | canola\|10v1\|DY017536_P1 | 3355 | 541 | 89.7 | globlastp |
| 1264 | LYM361 | canola\|gb161\|DY017536 | 3355 | 541 | 89.7 | globlastp |
| 1265 | LYM361 | apple\|gb171\|CN916494_P1 | 3357 | 541 | 89.7 | globlastp |
| 1266 | LYM361 | sunflower\|gb162\|CX943795 | 3353 | 541 | 89.7 | globlastp |
| 1267 | LYM361 | chestnut\|gb170\|SRR006295S0026079_P1 | 3352 | 541 | 89.7 | globlastp |
| 1268 | LYM361 | cassava\|09v1\|DV451765_P1 | 3358 | 541 | 89.7 | globlastp |
| 1269 | LYM361 | lotus\|09v1\|LLBF177618_P1 | 3359 | 541 | 89.7 | globlastp |
| 1270 | LYM361 | b_oleracea\|gb161\|AM062209_P1 | 3355 | 541 | 89.7 | globlastp |
| 1271 | LYM361 | castorbean\|09v1\|EV521206_P1 | 3360 | 541 | 89.7 | globlastp |
| 1272 | LYM361 | b_juncea\|10v2\|E7FJ1I304DOLGM_P1 | 3361 | 541 | 89 | globlastp |
| 1273 | LYM361 | hevea\|10v1\|EC600539_P1 | 3362 | 541 | 89 | globlastp |
| 1274 | LYM361 | ipomoea_nil\|10v1\|CJ740253_P1 | 3363 | 541 | 89 | globlastp |
| 1275 | LYM361 | nasturtium\|10v1\|SRR032558S0006072_P1 | 3364 | 541 | 89 | globlastp |
| 1276 | LYM361 | strawberry\|11v1\|CO381831_P1 | 3365 | 541 | 89 | globlastp |
| 1277 | LYM361 | strawberry\|gb164\|CO381831 | 3365 | 541 | 89 | globlastp |
| 1278 | LYM361 | ipomoea\|gb157.2\|BU691892 | 3363 | 541 | 89 | globlastp |
| 1279 | LYM361 | rose\|gb157.2\|EC588056 | 3366 | 541 | 89 | globlastp |
| 1280 | LYM361 | cacao\|10v1\|CF974197_P1 | 3367 | 541 | 89 | globlastp |
| 1281 | LYM361 | cacao\|gb167\|CF974197 | 3367 | 541 | 89 | globlastp |
| 1282 | LYM361 | radish\|gb164\|EY934302 | 3361 | 541 | 89 | globlastp |
| 1283 | LYM361 | prunus\|10v1\|BU045215_P1 | 3368 | 541 | 89 | globlastp |
| 1284 | LYM361 | prunus\|gb167\|BU045215 | 3368 | 541 | 89 | globlastp |
| 1285 | LYM361 | citrus\|gb166\|CK938051_P1 | 3369 | 541 | 89 | globlastp |
| 1286 | LYM361 | senecio\|gb170\|DY659224 | 3370 | 541 | 89 | globlastp |
| 1287 | LYM361 | cowpea\|gb166\|FG841129_P1 | 3371 | 541 | 89 | globlastp |
| 1288 | LYM361 | soybean\|11v1\|GLYMA05G28440_P1 | 3371 | 541 | 89 | globlastp |
| 1289 | LYM361 | soybean\|gb168\|BF177618 | 3371 | 541 | 89 | globlastp |
| 1290 | LYM361 | radish\|gb164\|EV566892 | 3361 | 541 | 89 | globlastp |
| 1291 | LYM361 | peanut\|10v1\|GO266374_P1 | 3371 | 541 | 89 | globlastp |
| 1292 | LYM361 | peanut\|gb171\|ES767033 | 3371 | 541 | 89 | globlastp |
| 1293 | LYM361 | soybean\|11v1\|GLYMA08G11450_P1 | 3371 | 541 | 89 | globlastp |
| 1294 | LYM361 | soybean\|gb168\|BG239642 | 3371 | 541 | 89 | globlastp |
| 1295 | LYM361 | liquorice\|gb171\|FS239962_P1 | 3371 | 541 | 89 | globlastp |
| 1296 | LYM361 | brachypodium\|09v1\|DV469043_T1 | 3372 | 541 | 88.59 | glotblastn |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 1297 | LYM361 | aquilegia\|10v2\|JGIAC015311_P1 | 3373 | 541 | 88.3 | globlastp |
| 1298 | LYM361 | artemisia\|10v1\|SRR019254S0169291_P1 | 3374 | 541 | 88.3 | globlastp |
| 1299 | LYM361 | b_juncea\|10v2\|E6ANDIZ01DW66Q_P1 | 3375 | 541 | 88.3 | globlastp |
| 1300 | LYM361 | canola\|10v1\|ES922658_P1 | 3376 | 541 | 88.3 | globlastp |
| 1301 | LYM361 | cleome_spinosa\|10v1\|SRR015531S0005388_P1 | 3377 | 541 | 88.3 | globlastp |
| 1302 | LYM361 | cyamopsis\|10v1\|EG975817_P1 | 3378 | 541 | 88.3 | globlastp |
| 1303 | LYM361 | eggplant\|10v1\|FS019113_P1 | 3379 | 541 | 88.3 | globlastp |
| 1304 | LYM361 | pigeonpea\|10v1\|SRR054580S0005740_P1 | 3380 | 541 | 88.3 | globlastp |
| 1305 | LYM361 | salvia\|10v1\|CV163574_P1 | 3381 | 541 | 88.3 | globlastp |
| 1306 | LYM361 | sunflower\|10v1\|EE623253_P1 | 3382 | 541 | 88.3 | globlastp |
| 1307 | LYM361 | poppy\|gb166\|FE964500_P1 | 3383 | 541 | 88.3 | globlastp |
| 1308 | LYM361 | monkeyflower\|09v1\|GO975256 | 3384 | 541 | 88.3 | globlastp |
| 1309 | LYM361 | monkeyflower\|09v1\|DV209147 | 3384 | 541 | 88.3 | globlastp |
| 1310 | LYM361 | radish\|gb164\|EX765001 | 3385 | 541 | 88.3 | globlastp |
| 1311 | LYM361 | antirrhinum\|gb166\|AJ791799_P1 | 3386 | 541 | 88.3 | globlastp |
| 1312 | LYM361 | canola\|10v1\|CD820875_P1 | 3387 | 541 | 88.3 | globlastp |
| 1313 | LYM361 | canola\|gb161\|CD820875 | 3387 | 541 | 88.3 | globlastp |
| 1314 | LYM361 | monkeyflower\|09v1\|GO961216 | 3384 | 541 | 88.3 | globlastp |
| 1315 | LYM361 | nuphar\|gb166\|CD474973_P1 | 3388 | 541 | 88.3 | globlastp |
| 1316 | LYM361 | petunia\|gb171\|CV295984_P1 | 3389 | 541 | 88.3 | globlastp |
| 1317 | LYM361 | sunflower\|gb162\|EL432089 | 3382 | 541 | 88.3 | globlastp |
| 1318 | LYM361 | coffea\|10v1\|DV679962_P1 | 3390 | 541 | 88.3 | globlastp |
| 1319 | LYM361 | coffea\|gb157.2\|DV679962 | 3390 | 541 | 88.3 | globlastp |
| 1320 | LYM361 | radish\|gb164\|EX751181 | 3391 | 541 | 88.3 | globlastp |
| 1321 | LYM361 | brachypodium\|09v1\|DV486314_P1 | 3392 | 541 | 88.3 | globlastp |
| 1322 | LYM361 | dandelion\|10v1\|DY826045_P1 | 3393 | 541 | 88.3 | globlastp |
| 1323 | LYM361 | dandelion\|gb161\|DY826045 | 3393 | 541 | 88.3 | globlastp |
| 1324 | LYM361 | apple\|gb171\|CN444255_P1 | 3394 | 541 | 88.3 | globlastp |
| 1325 | LYM361 | b_rapa\|gb162\|CA991816_P1 | 3387 | 541 | 88.3 | globlastp |
| 1326 | LYM361 | monkeyflower\|10v1\|DV209147_P1 | 3384 | 541 | 88.3 | globlastp |
| 1327 | LYM361 | b_juncea\|10v2\|E6ANDIZ02GACXH_P1 | 3395 | 541 | 87.6 | globlastp |
| 1328 | LYM361 | dandelion\|10v1\|DR400677_P1 | 3396 | 541 | 87.6 | globlastp |
| 1329 | LYM361 | guizotia\|10v1\|GE571913_P1 | 3397 | 541 | 87.6 | globlastp |
| 1330 | LYM361 | lolium\|10v1\|SRR029311S0010475_P1 | 3398 | 541 | 87.6 | globlastp |
| 1331 | LYM361 | tragopogon\|10v1\|SRR020205S0252287_P1 | 3399 | 541 | 87.6 | globlastp |
| 1332 | LYM361 | canola\|gb161\|CX280171 | 3400 | 541 | 87.6 | globlastp |
| 1333 | LYM361 | medicago\|09v1\|DW018876_P1 | 3401 | 541 | 87.6 | globlastp |
| 1334 | LYM361 | poplar\|10v1\|BI068981_P1 | 3402 | 541 | 87.6 | globlastp |
| 1335 | LYM361 | poplar\|gb170\|BI068981 | 3402 | 541 | 87.6 | globlastp |
| 1336 | LYM361 | poplar\|10v1\|AI161903_P1 | 3403 | 541 | 87.6 | globlastp |
| 1337 | LYM361 | poplar\|gb170\|AI161903 | 3403 | 541 | 87.6 | globlastp |
| 1338 | LYM361 | basilicum\|10v1\|DY334449_P1 | 3404 | 541 | 87.6 | globlastp |
| 1339 | LYM361 | basilicum\|gb157.3\|DY334449 | 3404 | 541 | 87.6 | globlastp |
| 1340 | LYM361 | safflower\|gb162\|EL372749 | 3399 | 541 | 87.6 | globlastp |
| 1341 | LYM361 | catharanthus\|gb166\|EG555992_P1 | 3405 | 541 | 87.6 | globlastp |
| 1342 | LYM361 | centaurea\|gb166\|EH739373_P1 | 3399 | 541 | 87.6 | globlastp |
| 1343 | LYM361 | canola\|10v1\|DY011439_P1 | 3406 | 541 | 87.6 | globlastp |
| 1344 | LYM361 | canola\|gb161\|EE419840 | 3406 | 541 | 87.6 | globlastp |
| 1345 | LYM361 | cucumber\|09v1\|DN909678_P1 | 3407 | 541 | 87.6 | globlastp |
| 1346 | LYM361 | cynara\|gb167\|GE587828_P1 | 3399 | 541 | 87.6 | globlastp |
| 1347 | LYM361 | gerbera\|09v1\|AJ751246_P1 | 3399 | 541 | 87.6 | globlastp |
| 1348 | LYM361 | radish\|gb164\|EV545365 | 3408 | 541 | 87.59 | glotblastn |
| 1349 | LYM361 | b_juncea\|10v2\|E6ANDIZ01A1NHB_P1 | 3409 | 541 | 86.9 | globlastp |
| 1350 | LYM361 | lettuce\|10v1\|DW080225_P1 | 3410 | 541 | 86.9 | globlastp |
| 1351 | LYM361 | melon\|10v1\|VMEL01979838432456_P1 | 3411 | 541 | 86.9 | globlastp |
| 1352 | LYM361 | canola\|10v1\|CX280171_P1 | 3412 | 541 | 86.9 | globlastp |
| 1353 | LYM361 | b_oleracea\|gb161\|EE533984_P1 | 3413 | 541 | 86.9 | globlastp |
| 1354 | LYM361 | lettuce\|gb157.2\|DW074112 | 3414 | 541 | 86.9 | globlastp |
| 1355 | LYM361 | potato\|10v1\|BQ518828_P1 | 3415 | 541 | 86.9 | globlastp |
| 1356 | LYM361 | potato\|gb157.2\|BQ518828 | 3415 | 541 | 86.9 | globlastp |
| 1357 | LYM361 | artemisia\|10v1\|EY066674_P1 | 3410 | 541 | 86.9 | globlastp |
| 1358 | LYM361 | artemisia\|gb164\|EY066674 | 3410 | 541 | 86.9 | globlastp |
| 1359 | LYM361 | cichorium\|gb171\|EH682067_P1 | 3416 | 541 | 86.9 | globlastp |
| 1360 | LYM361 | triphysaria\|10v1\|EY130493_P1 | 3417 | 541 | 86.9 | globlastp |
| 1361 | LYM361 | triphysaria\|gb164\|EY130493 | 3417 | 541 | 86.9 | globlastp |
| 1362 | LYM361 | tomato\|09v1\|BG131354 | 3415 | 541 | 86.9 | globlastp |
| 1363 | LYM361 | lettuce\|10v1\|DW056441_P1 | 3410 | 541 | 86.9 | globlastp |
| 1364 | LYM361 | lettuce\|gb157.2\|DW124838 | 3410 | 541 | 86.9 | globlastp |
| 1365 | LYM361 | gerbera\|09v1\|AJ755101_P1 | 3418 | 541 | 86.9 | globlastp |
| 1366 | LYM361 | solanum_phureja\|09v1\|SPHBG131354 | 3415 | 541 | 86.9 | globlastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 1367 | LYM361 | arabidopsis\|10v1\|AT4G21110__P1 | 3419 | 541 | 86.9 | globlastp |
| 1368 | LYM361 | arabidopsis__lyrata\|09v1\|JGIAL026050__P1 | 3419 | 541 | 86.9 | globlastp |
| 1369 | LYM361 | pepper\|gb171\|BM063341__P1 | 3415 | 541 | 86.9 | globlastp |
| 1370 | LYM361 | medicago\|09v1\|AW127096__T1 | 3420 | 541 | 86.9 | glotblastn |
| 1371 | LYM361 | rice\|gb170\|OS04G55280 | 3421 | 541 | 86.84 | glotblastn |
| 1372 | LYM361 | guizotia\|10v1\|GE571769__T1 | 3422 | 541 | 86.21 | glotblastn |
| 1373 | LYM361 | cichorium\|gb171\|EH698674__T1 | 3423 | 541 | 86.21 | glotblastn |
| 1374 | LYM361 | spurge\|gb161\|DV132742 | 3424 | 541 | 86.21 | glotblastn |
| 1375 | LYM361 | b__juncea\|10v2\|E6ANDIZ01C61GG1__P1 | 3425 | 541 | 86.2 | globlastp |
| 1376 | LYM361 | eggplant\|10v1\|FS028388__P1 | 3426 | 541 | 86.2 | globlastp |
| 1377 | LYM361 | podocarpus\|10v1\|SRR065014S0009839__P1 | 3427 | 541 | 86.2 | globlastp |
| 1378 | LYM361 | tragopogon\|10v1\|SRR020205S0014468__P1 | 3428 | 541 | 86.2 | globlastp |
| 1379 | LYM361 | lettuce\|10v1\|DW078223__P1 | 3429 | 541 | 86.2 | globlastp |
| 1380 | LYM361 | lotus\|09v1\|BI420153__P1 | 3430 | 541 | 86.2 | globlastp |
| 1381 | LYM361 | kiwi\|gb166\|FG397440__P1 | 3431 | 541 | 86.2 | globlastp |
| 1382 | LYM361 | chestnut\|gb170\|SRR006295S0103363__P1 | 3432 | 541 | 86.2 | globlastp |
| 1383 | LYM361 | peanut\|10v1\|GO323342__P1 | 3433 | 541 | 86.2 | globlastp |
| 1384 | LYM361 | peanut\|gb171\|GO323342 | 3433 | 541 | 86.2 | globlastp |
| 1385 | LYM361 | radish\|gb164\|EX907259 | 3434 | 541 | 86.2 | globlastp |
| 1386 | LYM361 | radish\|gb164\|EV550603 | 3435 | 541 | 86.2 | globlastp |
| 1387 | LYM361 | triphysaria\|10v1\|EY143984__P1 | 3436 | 541 | 86.2 | globlastp |
| 1388 | LYM361 | triphysaria\|gb164\|EY143984 | 3436 | 541 | 86.2 | globlastp |
| 1389 | LYM361 | oak\|10v1\|FP063615__P1 | 3437 | 541 | 85.5 | globlastp |
| 1390 | LYM361 | pigeonpea\|10v1\|SRR054580S0029542__P1 | 3438 | 541 | 85.5 | globlastp |
| 1391 | LYM361 | lettuce\|gb157.2\|DW056441 | 3439 | 541 | 85.5 | globlastp |
| 1392 | LYM361 | radish\|gb164\|EV536001 | 3440 | 541 | 85.5 | globlastp |
| 1393 | LYM361 | cassava\|09v1\|DV441361__P1 | 3441 | 541 | 85.5 | globlastp |
| 1394 | LYM361 | b__rapa\|gb162\|EE520703__P1 | 3442 | 541 | 85.5 | globlastp |
| 1395 | LYM361 | liriodendron\|gb166\|DT584581__P1 | 3443 | 541 | 85.5 | globlastp |
| 1396 | LYM361 | b__juncea\|10v2\|E6ANDIZ01A17L4__P1 | 3444 | 541 | 84.8 | globlastp |
| 1397 | LYM361 | gnetum\|10v1\|CB082682__P1 | 3445 | 541 | 84.8 | globlastp |
| 1398 | LYM361 | sequoia\|10v1\|SRR065044S0037904__P1 | 3446 | 541 | 84.8 | globlastp |
| 1399 | LYM361 | taxus\|10v1\|SRR032523S0008600__P1 | 3447 | 541 | 84.8 | globlastp |
| 1400 | LYM361 | pine\|gb157.2\|CF670895 | 3448 | 541 | 84.8 | globlastp |
| 1401 | LYM361 | pepper\|gb171\|GD089582__P1 | 3449 | 541 | 84.8 | globlastp |
| 1402 | LYM361 | safflower\|gb162\|EL403744 | 3450 | 541 | 84.8 | globlastp |
| 1403 | LYM361 | thellungiella\|gb167\|BY802080 | 3451 | 541 | 84.8 | globlastp |
| 1404 | LYM361 | petunia\|gb171\|FN009876__P1 | 3452 | 541 | 84.8 | globlastp |
| 1405 | LYM361 | cacao\|10v1\|CU469868__P1 | 3453 | 541 | 84.8 | globlastp |
| 1406 | LYM361 | cacao\|gb167\|CU469868 | 3453 | 541 | 84.8 | globlastp |
| 1407 | LYM361 | salvia\|10v1\|SRR014553S0020301__P1 | 3454 | 541 | 84.1 | globlastp |
| 1408 | LYM361 | soybean\|gb168\|AW127096 | 3455 | 541 | 84.1 | globlastp |
| 1409 | LYM361 | iceplant\|gb164\|CA832422__P1 | 3456 | 541 | 84.1 | globlastp |
| 1410 | LYM361 | fern\|gb171\|DK951780__P1 | 3457 | 541 | 84.1 | globlastp |
| 1411 | LYM361 | cryptomeria\|gb166\|BY878663__P1 | 3458 | 541 | 84.1 | globlastp |
| 1412 | LYM361 | solanum__phureja\|09v1\|SPHBG123343 | 3459 | 541 | 84.1 | globlastp |
| 1413 | LYM361 | potato\|gb157.2\|BG590089 | 3460 | 541 | 84.1 | globlastp |
| 1414 | LYM361 | potato\|10v1\|BG590089__P1 | 3460 | 541 | 84.1 | globlastp |
| 1415 | LYM361 | pine\|10v2\|BF517331__P1 | 3461 | 541 | 83.4 | globlastp |
| 1416 | LYM361 | tomato\|09v1\|BG123343 | 3462 | 541 | 83.4 | globlastp |
| 1417 | LYM361 | potato\|gb157.2\|CK854087 | 3463 | 541 | 83.4 | globlastp |
| 1418 | LYM361 | kiwi\|gb166\|FG406174__P1 | 3464 | 541 | 83.4 | globlastp |
| 1419 | LYM361 | ginseng\|10v1\|GR874863__P1 | 3465 | 541 | 82.8 | globlastp |
| 1420 | LYM361 | pine\|gb157.2\|BF517331 | 3466 | 541 | 82.8 | globlastp |
| 1421 | LYM361 | marchantia\|gb166\|BJ857236__P1 | 3467 | 541 | 82.8 | globlastp |
| 1422 | LYM361 | citrus\|gb166\|CX636054__P1 | 3468 | 541 | 82.8 | globlastp |
| 1423 | LYM361 | sciadopitys\|10v1\|SRR065035S0113890__T1 | 3469 | 541 | 82.76 | glotblastn |
| 1424 | LYM361 | pseudotsuga\|10v1\|SRR065119S0057200__P1 | 3470 | 541 | 82.1 | globlastp |
| 1425 | LYM361 | leymus\|gb166\|EG386976__P1 | 3471 | 541 | 82.1 | globlastp |
| 1426 | LYM361 | lolium\|10v1\|DT670946__P1 | 3472 | 541 | 82.1 | globlastp |
| 1427 | LYM361 | fern\|gb171\|DK956086__P1 | 3473 | 541 | 82.1 | globlastp |
| 1428 | LYM361 | cleome__spinosa\|10v1\|SRR015531S0048103__T1 | 3474 | 541 | 82.07 | glotblastn |
| 1429 | LYM361 | ceratodon\|10v1\|SRR074890S0014886__P1 | 3475 | 541 | 81.4 | globlastp |
| 1430 | LYM361 | castorbean\|09v1\|XM002529032__P1 | 3476 | 541 | 81.4 | globlastp |
| 1431 | LYM361 | physcomitrella\|10v1\|BQ040629__P1 | 3477 | 541 | 81.4 | globlastp |
| 1432 | LYM361 | orobanche\|10v1\|SRR023189S0055567__P1 | 3478 | 541 | 80.7 | globlastp |
| 1433 | LYM361 | sugarcane\|10v1\|CA153039__T1 | 3479 | 541 | 80.69 | glotblastn |
| 1434 | LYM361 | iceplant\|gb164\|BE036439__T1 | 3480 | 541 | 80.69 | glotblastn |
| 1435 | LYM361 | strawberry\|11v1\|CRPFV015322__P1 | 3481 | 541 | 80 | globlastp |
| 1436 | LYM361 | physcomitrella\|10v1\|BJ586722__P1 | 3482 | 541 | 80 | globlastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 1437 | LYM362 | sorghum|09v1|SB06G027130 | 3483 | 542 | 91.4 | globlastp |
| 1438 | LYM363 | sugarcane|10v1|BQ529715_P1 | 3484 | 543 | 95.9 | globlastp |
| 1439 | LYM363 | sugarcane|gb157.3|BQ529715 | 3485 | 543 | 95.4 | globlastp |
| 1440 | LYM363 | barley|10v2|BF626430_P1 | 3486 | 543 | 83.9 | globlastp |
| 1441 | LYM363 | barley|gb157SOLEXA|BF626430 | 3486 | 543 | 83.9 | globlastp |
| 1442 | LYM364 | sorghum|09v1|SB02G009450 | 3487 | 544 | 92.8 | globlastp |
| 1443 | LYM364 | switchgrass|gb167|DN151397 | 3488 | 544 | 80 | globlastp |
| 1444 | LYM365 | maize|10v1|BF733100_P1 | 3489 | 545 | 95.1 | globlastp |
| 1445 | LYM365 | sorghum|09v1|SB04G002260 | 3490 | 545 | 90.9 | globlastp |
| 1446 | LYM365 | foxtail_millet|10v2|SICRP011045_T1 | 3491 | 545 | 89.16 | glotblastn |
| 1447 | LYM365 | maize|gb170|BF733100 | 3492 | 545 | 88.5 | globlastp |
| 1448 | LYM365 | switchgrass|gb167|FE605040 | 3493 | 545 | 81.6 | globlastp |
| 1449 | LYM365 | pseudoroegneria|gb167|FF352749 | 3494 | 545 | 81.4 | globlastp |
| 1450 | LYM366 | sorghum|09v1|SB10G008220 | 3495 | 546 | 95.2 | globlastp |
| 1451 | LYM366 | foxtail_millet|10v2|SICRP029763_P1 | 3496 | 546 | 93.6 | globlastp |
| 1452 | LYM366 | switchgrass|gb167|FL775385 | 3497 | 546 | 93.6 | globlastp |
| 1453 | LYM366 | switchgrass|gb167|FL795206 | 3498 | 546 | 92 | globlastp |
| 1454 | LYM366 | millet|10v1|EVO454PM340015_P1 | 3499 | 546 | 92 | globlastp |
| 1455 | LYM366 | millet|09v1|EVO454PM417719 | 3500 | 546 | 91.44 | glotblastn |
| 1456 | LYM366 | sugarcane|10v1|CA293234_P1 | 3501 | 546 | 91.4 | globlastp |
| 1457 | LYM366 | rice|gb170|OS06G12500 | 3502 | 546 | 88.8 | globlastp |
| 1458 | LYM368 | sugarcane|gb157.3|CA080429 | 3503 | 548 | 90.24 | glotblastn |
| 1458 | LYM368_H4 | sugarcane|gb157.3|CA080429 | 3503 | 679 | 89.9 | globlastp |
| 1459 | LYM368 | maize|gb170|AI065874 | 3504 | 548 | 89.84 | glotblastn |
| 1459 | LYM368_H4 | maize|gb170|AI065874 | 3504 | 679 | 91.3 | globlastp |
| 1460 | LYM368 | maize|gb170|AI901397 | 3505 | 548 | 89.84 | glotblastn |
| 1460 | LYM368_H4 | maize|gb170|AI901397 | 3505 | 679 | 83.8 | globlastp |
| 1461 | LYM368 | maize|10v1|AI901397_T1 | 3504 | 548 | 89.84 | glotblastn |
| 1461 | LYM368_H4 | maize|10v1|AI901397_P1 | 3504 | 679 | 91.3 | globlastp |
| 1462 | LYM368 | foxtail_millet|10v2|FXTRMSLX00831270D1_T1 | 3506 | 548 | 82.11 | glotblastn |
| 1463 | LYM368 | millet|09v1|EVO454PM004516 | 3507 | 548 | 81.3 | globlastp |
| 1464 | LYM368 | millet|10v1|EVO454PM004516_T1 | 3508 | 548 | 81.3 | glotblastn |
| 1465 | LYM368 | maize|gb170|LLCD443651 | 3509 | 548 | 80.08 | glotblastn |
| 1466 | LYM369 | maize|10v1|AI637228_P1 | 3510 | 549 | 91.3 | globlastp |
| 1467 | LYM369 | maize|gb170|AI637228 | 3510 | 549 | 91.3 | globlastp |
| 1468 | LYM369 | wheat|gb164|CA486301 | 3511 | 549 | 90.9 | globlastp |
| 1469 | LYM369 | sorghum|09v1|SB01G038910 | 3511 | 549 | 90.9 | globlastp |
| 1470 | LYM369 | foxtail_millet|10v2|OXFXTSLX00010659D1T1_P1 | 3512 | 549 | 90.1 | globlastp |
| 1471 | LYM369 | switchgrass|gb167|DN151852 | 3513 | 549 | 88.8 | globlastp |
| 1472 | LYM369 | cenchrus|gb166|EB653323_P1 | 3514 | 549 | 88.2 | globlastp |
| 1473 | LYM369 | switchgrass|gb167|DN150334 | 3515 | 549 | 88 | globlastp |
| 1474 | LYM369 | rice|gb170|OS03G17470 | 3516 | 549 | 85.2 | globlastp |
| 1475 | LYM369 | oat|10v2|GO586094_P1 | 3517 | 549 | 83.6 | globlastp |
| 1476 | LYM369 | lovegrass|gb167|EH190420_T1 | 3518 | 549 | 83.47 | glotblastn |
| 1477 | LYM369 | barley|10v2|BE411508_P1 | 3519 | 549 | 82 | globlastp |
| 1478 | LYM369 | pseudoroegneria|gb167|FF346054 | 3520 | 549 | 81.4 | globlastp |
| 1479 | LYM369 | leymus|gb166|EG394008_T1 | 3521 | 549 | 81.4 | glotblastn |
| 1480 | LYM369 | brachypodium|09v1|DV478072_P1 | 3522 | 549 | 81.1 | globlastp |
| 1481 | LYM371 | sorghum|09v1|SB03G003745 | 3523 | 551 | 87.7 | globlastp |
| 1482 | LYM371 | maize|gb170|CK145019 | 3524 | 551 | 86.3 | globlastp |
| 1483 | LYM371 | switchgrass|gb167|FL781064 | 3525 | 551 | 81.63 | glotblastn |
| 1484 | LYM373 | sorghum|09v1|SB03G028740 | 3526 | 553 | 96.9 | globlastp |
| 1485 | LYM373 | sugarcane|10v1|CA087307_P1 | 3527 | 553 | 96.7 | globlastp |
| 1486 | LYM373 | sugarcane|gb157.3|CA087307 | 3528 | 553 | 96.6 | globlastp |
| 1487 | LYM373 | switchgrass|gb167|FE600362 | 3529 | 553 | 92.7 | globlastp |
| 1488 | LYM373 | rice|gb170|OS01G43910 | 3530 | 553 | 89.9 | globlastp |
| 1489 | LYM373 | millet|09v1|EB411080 | 3531 | 553 | 89.4 | globlastp |
| 1490 | LYM373 | brachypodium|09v1|DV478255_P1 | 3532 | 553 | 88.8 | globlastp |
| 1491 | LYM373 | wheat|10v2|BE405537_P1 | 3533 | 553 | 88.3 | globlastp |
| 1492 | LYM373 | wheat|gb164|BE405537 | 3534 | 553 | 88.1 | globlastp |
| 1493 | LYM373 | barley|10v2|AV836431_P1 | 3535 | 553 | 87.2 | globlastp |
| 1494 | LYM373 | fescue|gb161|DT687544_P1 | 3536 | 553 | 83.1 | globlastp |
| 1495 | LYM374 | maize|10v1|EE187960_P1 | 3537 | 554 | 98.3 | globlastp |
| 1496 | LYM374 | maize|gb170|EE187960 | 3538 | 554 | 93.6 | globlastp |
| 1497 | LYM374 | maize|10v1|AI855357_P1 | 3539 | 554 | 86 | globlastp |
| 1498 | LYM374 | sorghum|09v1|SB07G024770 | 3540 | 554 | 85.3 | globlastp |
| 1499 | LYM376 | sugarcane|10v1|CA102891_P1 | 3541 | 556 | 97.5 | globlastp |
| 1500 | LYM376 | sugarcane|gb157.3|CA102891 | 3541 | 556 | 97.5 | globlastp |
| 1501 | LYM376 | foxtail_millet|10v2|SICRP002879_P1 | 3542 | 556 | 95.8 | globlastp |
| 1502 | LYM376 | sorghum|09v1|SB06G020530 | 3543 | 556 | 95.8 | globlastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 1503 | LYM376 | millet\|10v1\|PMSLX0036334D1_P1 | 3544 | 556 | 94.3 | globlastp |
| 1504 | LYM376 | switchgrass\|gb167\|FE638189 | 3545 | 556 | 94.1 | globlastp |
| 1505 | LYM376 | oat\|10v2\|GR318581_P1 | 3546 | 556 | 89.1 | globlastp |
| 1506 | LYM376 | oat\|10v2\|GR341075_P1 | 3546 | 556 | 89.1 | globlastp |
| 1507 | LYM376 | wheat\|gb164\|CA742260 | 3547 | 556 | 89.1 | globlastp |
| 1508 | LYM376 | wheat\|gb164\|BE443106 | 3548 | 556 | 89.1 | globlastp |
| 1509 | LYM376 | wheat\|10v2\|BE443106_P1 | 3547 | 556 | 89.1 | globlastp |
| 1510 | LYM376 | barley\|10v2\|BI951581_P1 | 3549 | 556 | 88.2 | globlastp |
| 1511 | LYM376 | barley\|gb157SOLEXA\|BI951581 | 3549 | 556 | 88.2 | globlastp |
| 1512 | LYM376 | brachypodium\|09v1\|GT770899_P1 | 3550 | 556 | 87.6 | globlastp |
| 1513 | LYM376 | wheat\|gb164\|CA690234 | 3551 | 556 | 87.4 | globlastp |
| 1514 | LYM376 | rice\|gb170\|OS04G40670 | 3552 | 556 | 84.8 | globlastp |
| 1515 | LYM376 | fescue\|gb161\|DT691534_P1 | 3553 | 556 | 84 | globlastp |
| 1516 | LYM382 | sugarcane\|gb157.3\|CA089412 | 3554 | 562 | 94.7 | globlastp |
| 1517 | LYM382 | maize\|10v1\|BE025386_P1 | 3555 | 562 | 94.5 | globlastp |
| 1518 | LYM382 | maize\|gb170\|BE025386 | 3555 | 562 | 94.5 | globlastp |
| 1519 | LYM382 | sorghum\|09v1\|SB09G005480 | 3556 | 562 | 90.4 | globlastp |
| 1520 | LYM382 | switchgrass\|gb167\|FE625547 | 3557 | 562 | 89.2 | globlastp |
| 1521 | LYM382 | brachypodium\|09v1\|DV477955_P1 | 3558 | 562 | 84.9 | globlastp |
| 1522 | LYM382 | oat\|10v2\|GR317157_P1 | 3559 | 562 | 83.6 | globlastp |
| 1523 | LYM382 | barley\|10v2\|BF261359_P1 | 3560 | 562 | 81.7 | globlastp |
| 1524 | LYM382 | rice\|gb170\|OS05G08640 | 3561 | 562 | 80.9 | globlastp |
| 1525 | LYM385 | maize\|10v1\|ZMCRP2V006931_T1 | 3562 | 565 | 97.32 | glotblastn |
| 1526 | LYM385 | maize\|10v1\|ZMCRP2V101351_T1 | 3563 | 565 | 95.79 | glotblastn |
| 1527 | LYM385 | maize\|10v1\|ZMCRP2V103873_T1 | 3564 | 565 | 94.64 | glotblastn |
| 1528 | LYM385 | maize\|10v1\|ZMCRP2V150534_T1 | 3565 | 565 | 94.64 | glotblastn |
| 1529 | LYM385 | maize\|10v1\|EG106499_T1 | 3566 | 565 | 93.49 | glotblastn |
| 1530 | LYM385 | maize\|10v1\|ZMCRP2V072664_P1 | 3567 | 565 | 93.1 | globlastp |
| 1531 | LYM385 | maize\|10v1\|ZMCRP2V158795_T1 | 3568 | 565 | 92.72 | glotblastn |
| 1532 | LYM385 | maize\|10v1\|ZMCRP2V052949_P1 | 3569 | 565 | 92.7 | globlastp |
| 1533 | LYM385 | maize\|10v1\|ZMCRP2V198465_P1 | 3570 | 565 | 92.7 | globlastp |
| 1534 | LYM385 | maize\|10v1\|ZMCRP2V062992_T1 | 3571 | 565 | 92.34 | glotblastn |
| 1535 | LYM385 | maize\|10v1\|ZMCRP2V009897_P1 | 3572 | 565 | 92.3 | globlastp |
| 1536 | LYM385 | maize\|10v1\|ZMCRP2V013149_P1 | 3573 | 565 | 92 | globlastp |
| 1537 | LYM385 | maize\|10v1\|ZMCRP2V220907_T1 | 3574 | 565 | 91.19 | glotblastn |
| 1538 | LYM385 | maize\|10v1\|ZMCRP2V036361_P1 | 3575 | 565 | 90.8 | globlastp |
| 1539 | LYM385 | maize\|10v1\|ZMCRP2V173171_T1 | 3576 | 565 | 89.66 | glotblastn |
| 1540 | LYM385 | maize\|10v1\|ZMCRP2V110808_P1 | 3577 | 565 | 87.7 | globlastp |
| 1541 | LYM385 | maize\|10v1\|SRR014552S0020338_P1 | 3578 | 565 | 85.8 | globlastp |
| 1542 | LYM385 | maize\|gb170\|LLBI389401 | 3579 | 565 | 84.7 | globlastp |
| 1543 | LYM385 | maize\|10v1\|ZMCRP2V206060_T1 | 3580 | 565 | 84.29 | glotblastn |
| 1544 | LYM385 | maize\|10v1\|EU961782_P1 | 3581 | 565 | 83.5 | globlastp |
| 1545 | LYM385 | maize\|gb170\|EU961782 | 3582 | 565 | 82 | globlastp |
| 1546 | LYM387 | sorghum\|09v1\|SB01G011750 | 3583 | 567 | 80 | globlastp |
| 1547 | LYM388 | sugarcane\|gb157.3\|CA076939 | 3584 | 568 | 98.6 | globlastp |
| 1548 | LYM388 | sorghum\|09v1\|SB10G009560 | 3585 | 568 | 98 | globlastp |
| 1549 | LYM388 | foxtail_millet\|10v2\|OXFXTSLX00018958D1T1_P1 | 3586 | 568 | 95.3 | globlastp |
| 1550 | LYM388 | millet\|10v1\|EVO454PM004255_P1 | 3587 | 568 | 95.3 | globlastp |
| 1551 | LYM388 | switchgrass\|gb167\|DN144787 | 3588 | 568 | 93.9 | globlastp |
| 1552 | LYM388 | switchgrass\|gb167\|DN145508 | 3589 | 568 | 92.7 | globlastp |
| 1553 | LYM388 | switchgrass\|gb167\|FL840870 | 3590 | 568 | 92 | globlastp |
| 1554 | LYM388 | cynodon\|10v1\|ES292609_P1 | 3591 | 568 | 89.9 | globlastp |
| 1555 | LYM388 | lovegrass\|gb167\|DN480848_P1 | 3592 | 568 | 88.7 | globlastp |
| 1556 | LYM388 | maize\|gb170\|AW438322 | 3593 | 568 | 88.3 | globlastp |
| 1557 | LYM388 | maize\|10v1\|AW438322_P1 | 3593 | 568 | 88.3 | globlastp |
| 1558 | LYM388 | brachypodium\|09v1\|DV475893_P1 | 3594 | 568 | 85.7 | globlastp |
| 1559 | LYM388 | maize\|gb170\|LLEE031732 | 3595 | 568 | 85.6 | globlastp |
| 1560 | LYM388 | leymus\|gb166\|CD808936_P1 | 3596 | 568 | 84.4 | globlastp |
| 1561 | LYM388 | foxtail_millet\|10v2\|FXTSLX00025055_P1 | 3597 | 568 | 83.8 | globlastp |
| 1562 | LYM388 | wheat\|10v2\|BG274116_P1 | 3598 | 568 | 83.8 | globlastp |
| 1563 | LYM388 | wheat\|10v2\|BQ789371_P1 | 3597 | 568 | 83.8 | globlastp |
| 1564 | LYM388 | pseudoroegneria\|gb167\|FF342073 | 3599 | 568 | 83.8 | globlastp |
| 1565 | LYM388 | rice\|gb170\|OS06G15400 | 3600 | 568 | 83.3 | globlastp |
| 1566 | LYM388 | oat\|10v2\|CN818325_P1 | 3601 | 568 | 83.2 | globlastp |
| 1567 | LYM388 | wheat\|10v2\|BF293736_T1 | 3602 | 568 | 83.12 | glotblastn |
| 1568 | LYM388 | wheat\|10v2\|BE418483_P1 | 3603 | 568 | 83.1 | globlastp |
| 1569 | LYM388 | fescue\|gb161\|DT680555_P1 | 3604 | 568 | 83.1 | globlastp |
| 1570 | LYM388 | barley\|10v2\|BE420957XX2_P1 | 3605 | 568 | 83.1 | globlastp |
| 1571 | LYM388 | barley\|gb157SOLEXA\|AL450585 | 3605 | 568 | 83.1 | globlastp |
| 1572 | LYM388 | lolium\|09v1\|AU246422 | 3606 | 568 | 83.1 | globlastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 1573 | LYM388 | lolium\|10v1\|AU246422_P1 | 3606 | 568 | 83.1 | globlastp |
| 1574 | LYM388 | wheat\|10v2\|CA597940_T1 | 3607 | 568 | 82.47 | glotblastn |
| 1575 | LYM388 | rye\|gb164\|BE704519 | 3608 | 568 | 82.47 | glotblastn |
| 1576 | LYM388 | maize\|10v1\|W59830_P1 | 3609 | 568 | 80.9 | globlastp |
| 1576 | LYM476 | maize\|10v1\|W59830_P1 | 3609 | 642 | 83.6 | globlastp |
| 1577 | LYM388 | maize\|gb170\|W59830 | 3609 | 568 | 80.9 | globlastp |
| 1577 | LYM476 | maize\|gb170\|W59830 | 3609 | 642 | 83.6 | globlastp |
| 1578 | LYM392 | brachypodium\|09v1\|GT772123_P1 | 3610 | 572 | 82.3 | globlastp |
| 1579 | LYM392 | sorghum\|09v1\|SB03G027850 | 3611 | 572 | 81.61 | glotblastn |
| 1580 | LYM392 | maize\|10v1\|BM381239_P1 | 3612 | 572 | 81.2 | globlastp |
| 1581 | LYM392 | maize\|gb170\|BM381239 | 3612 | 572 | 81.2 | globlastp |
| 1582 | LYM392 | sugarcane\|10v1\|BQ537130_P1 | 3613 | 572 | 81 | globlastp |
| 1583 | LYM392 | oat\|10v2\|GR314082_P1 | 3614 | 572 | 80.9 | globlastp |
| 1584 | LYM392 | wheat\|10v2\|BI480480_T1 | 3615 | 572 | 80.04 | glotblastn |
| 1585 | LYM393 | sugarcane\|10v1\|BQ537441_P1 | 3616 | 573 | 83.9 | globlastp |
| 1586 | LYM393 | sugarcane\|gb157.3\|BQ534913 | 3616 | 573 | 83.9 | globlastp |
| 1587 | LYM393 | sorghum\|09v1\|SB03G029290 | 3616 | 573 | 83.9 | Globlastp |
| 1588 | LYM393 | sugarcane\|gb157.3\|BQ534082 | 3616 | 573 | 83.9 | Globlastp |
| 1589 | LYM393 | sugarcane\|10v1\|BQ534082_P1 | 3616 | 573 | 83.9 | Globlastp |
| 1590 | LYM393 | switchgrass\|gb167\|DN145383 | 3617 | 573 | 83.6 | Globlastp |
| 1591 | LYM393 | switchgrass\|gb167\|GD008504 | 3618 | 573 | 83.6 | Globlastp |
| 1592 | LYM393 | zostera\|10v1\|SRR057351S0259397_T1 | 3619 | 573 | 81.97 | Glotblastn |
| 1593 | LYM393 | lovegrass\|gb167\|DN480320_T1 | 3620 | 573 | 81.97 | Glotblastn |
| 1594 | LYM393 | switchgrass\|gb167\|FL843312 | 3621 | 573 | 80.3 | Globlastp |
| 1595 | LYM393 | millet\|09v1\|EVO454PM039216 | — | 573 | 80 | Glotblastn |
| 1596 | LYM395 | brachypodium\|09v1\|DV479992_P1 | 3622 | 575 | 86.5 | Globlastp |
| 1597 | LYM395 | pseudoroegneria\|gb167\|FF343684 | 3623 | 575 | 86.5 | Globlastp |
| 1598 | LYM395 | barley\|10v2\|BG300466_P1 | 3624 | 575 | 86 | globlastp |
| 1599 | LYM395 | barley\|gb157SOLEXA\|BG300466 | 3624 | 575 | 86 | Globlastp |
| 1600 | LYM395 | leymus\|gb166\|EG378693_P1 | 3625 | 575 | 86 | Globlastp |
| 1601 | LYM395 | sorghum\|09v1\|SB04G002070 | 3626 | 575 | 84.8 | Globlastp |
| 1602 | LYM395 | sugarcane\|gb157.3\|CA071035 | 3627 | 575 | 84.6 | Globlastp |
| 1603 | LYM395 | sugarcane\|10v1\|CA071035_P1 | 3628 | 575 | 84.4 | Globlastp |
| 1604 | LYM395 | switchgrass\|gb167\|DN144256 | 3629 | 575 | 84 | Globlastp |
| 1605 | LYM395 | switchgrass\|gb167\|DN145741 | 3630 | 575 | 83.5 | Globlastp |
| 1606 | LYM395 | maize\|10v1\|AA011879_P1 | 3631 | 575 | 83.4 | Globlastp |
| 1607 | LYM395 | maize\|gb170\|AA011879 | 3632 | 575 | 83 | Globlastp |
| 1608 | LYM395 | foxtail_millet\|10v2\|SICRP030709_P1 | 3633 | 575 | 82.6 | Globlastp |
| 1609 | LYM397 | brachypodium\|09v1\|GT779489_P1 | 3634 | 577 | 82 | Globlastp |
| 1609 | LYM397_H2 | brachypodium\|09v1\|GT779489_T1 | 3634 | 680 | 81.27 | Glotblastn |
| 1610 | LYM398 | brachypodium\|09v1\|DV472507_P1 | 3635 | 578 | 81.8 | Globlastp |
| 1611 | LYM398 | switchgrass\|gb167\|DN141900 | 3636 | 578 | 80.7 | Globlastp |
| 1612 | LYM400 | brachypodium\|09v1\|GT776786_P1 | 3637 | 580 | 88.8 | Globlastp |
| 1613 | LYM400 | sorghum\|09v1\|SB01G040970 | 3638 | 580 | 88.4 | Globlastp |
| 1614 | LYM400 | wheat\|10v2\|BE516698_P1 | 3639 | 580 | 87.7 | Globlastp |
| 1615 | LYM400 | wheat\|gb164\|BE516698 | 3640 | 580 | 87.5 | Globlastp |
| 1616 | LYM400 | maize\|10v1\|BE924837_P1 | 3641 | 580 | 87.5 | Globlastp |
| 1617 | LYM400 | maize\|gb170\|BE924837 | 3642 | 580 | 87.47 | Glotblastn |
| 1618 | LYM400 | barley\|10v2\|BE438908_P1 | 3643 | 580 | 87.3 | Globlastp |
| 1619 | LYM400 | foxtail_millet\|10v2\|OXEC612720T1_P1 | 3644 | 580 | 86.3 | Globlastp |
| 1620 | LYM400 | oat\|10v2\|CN815176_P1 | 3645 | 580 | 85.6 | Globlastp |
| 1621 | LYM400 | rice\|gb170\|OS10G10500 | 3646 | 580 | 84.5 | Globlastp |
| 1622 | LYM400 | brachypodium\|09v1\|SRR031797S0365169_P1 | 3647 | 580 | 80.9 | Globlastp |
| 1623 | LYM400 | millet\|10v1\|EVO454PM000568_P1 | 3648 | 580 | 80.4 | Globlastp |
| 1624 | LYM400 | maize\|10v1\|AW017832_P1 | 3649 | 580 | 80 | globlastp |
| 1625 | LYM400 | maize\|gb170\|AW017832 | 3649 | 580 | 80 | Globlastp |
| 1626 | LYM402 | brachypodium\|09v1\|GT813612_P1 | 3650 | 582 | 88.1 | Globlastp |
| 1627 | LYM402 | sorghum\|09v1\|SB01G008180 | 3651 | 582 | 80.2 | Globlastp |
| 1628 | LYM404 | rice\|gb170\|OS04G54300 | 3652 | 584 | 92 | Globlastp |
| 1629 | LYM404 | rice\|gb170\|OS04G54310 | 3653 | 584 | 90.7 | Glotblastn |
| 1630 | LYM404 | fescue\|gb161\|DT709832_P1 | 3654 | 584 | 90 | Globlastp |
| 1631 | LYM404 | wheat\|gb164\|AL819712 | 3655 | 584 | 90 | Globlastp |
| 1632 | LYM404 | wheat\|10v2\|AL819712_P1 | 3655 | 584 | 90 | Globlastp |
| 1633 | LYM404 | wheat\|gb164\|CD915389 | 3656 | 584 | 88.9 | Globlastp |
| 1634 | LYM404 | wheat\|10v2\|CJ538972_P1 | 3657 | 584 | 88.6 | Globlastp |
| 1635 | LYM404 | wheat\|10v2\|CD907992_P1 | 3658 | 584 | 88.6 | Globlastp |
| 1636 | LYM404 | wheat\|gb164\|CD907992 | 3659 | 584 | 88.6 | Globlastp |
| 1637 | LYM404 | wheat\|10v2\|CA615634_T1 | 3660 | 584 | 88.51 | Glotblastn |
| 1638 | LYM404 | wheat\|gb164\|CA615634 | 3660 | 584 | 88.51 | Glotblastn |
| 1639 | LYM404 | brachypodium\|09v1\|DV468904_T1 | 3661 | 584 | 88.37 | Glotblastn |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 1640 | LYM404 | wheat\|gb164\|BE424453 | 3662 | 584 | 87.9 | Globlastp |
| 1641 | LYM404 | wheat\|10v2\|BE517528_P1 | 3663 | 584 | 87.8 | Globlastp |
| 1642 | LYM404 | wheat\|gb164\|BE517528 | 3663 | 584 | 87.8 | Globlastp |
| 1643 | LYM404 | wheat\|gb164\|BE419640 | 3664 | 584 | 87.5 | Glotblastn |
| 1644 | LYM404 | wheat\|10v2\|BE419640_T1 | — | 584 | 87.5 | Glotblastn |
| 1645 | LYM404 | oat\|10v2\|GR357592_P1 | 3665 | 584 | 86.8 | Globlastp |
| 1646 | LYM404 | wheat\|10v2\|CA646285_P1 | 3666 | 584 | 86.7 | Globlastp |
| 1647 | LYM404 | wheat\|10v2\|BE425044_P1 | 3667 | 584 | 86.7 | Globlastp |
| 1648 | LYM404 | wheat\|gb164\|BE425044 | 3667 | 584 | 86.7 | Globlastp |
| 1649 | LYM404 | wheat\|gb164\|AL809396 | 3668 | 584 | 86.7 | Globlastp |
| 1650 | LYM404 | pseudoroegneria\|gb167\|FF354284 | 3669 | 584 | 86.7 | Globlastp |
| 1651 | LYM404 | wheat\|gb164\|CA646285 | 3666 | 584 | 86.7 | Globlastp |
| 1652 | LYM404 | wheat\|10v2\|BQ802698_P1 | 3670 | 584 | 86.4 | Globlastp |
| 1653 | LYM404 | wheat\|10v2\|BG606870_T1 | 3671 | 584 | 86.36 | Glotblastn |
| 1654 | LYM404 | wheat\|gb164\|BG606870 | 3671 | 584 | 86.36 | Glotblastn |
| 1655 | LYM404 | wheat\|gb164\|BQ802698 | 3672 | 584 | 86.36 | Glotblastn |
| 1656 | LYM404 | wheat\|10v2\|AL819097_P1 | 3673 | 584 | 85.6 | Globlastp |
| 1657 | LYM404 | wheat\|gb164\|CA615057 | 3674 | 584 | 85.6 | Globlastp |
| 1658 | LYM404 | wheat\|10v2\|CD905343_P1 | 3675 | 584 | 85.6 | Globlastp |
| 1659 | LYM404 | wheat\|gb164\|CD905343 | 3675 | 584 | 85.6 | globlastp |
| 1660 | LYM404 | maize\|gb170\|LLDQ245819 | 3673 | 584 | 85.6 | Globlastp |
| 1661 | LYM404 | barley\|gb157SOLEXA\|BG344791 | 3676 | 584 | 85.6 | Globlastp |
| 1662 | LYM404 | wheat\|gb164\|AL819097 | 3673 | 584 | 85.6 | Globlastp |
| 1663 | LYM404 | wheat\|gb164\|CJ775901 | 3677 | 584 | 85.6 | Globlastp |
| 1664 | LYM404 | wheat\|10v2\|CA730798_P1 | 3678 | 584 | 85.2 | Globlastp |
| 1665 | LYM404 | wheat\|gb164\|CA730798 | 3678 | 584 | 85.2 | Globlastp |
| 1666 | LYM404 | wheat\|10v2\|CA644742_P1 | 3679 | 584 | 85.2 | Globlastp |
| 1667 | LYM404 | wheat\|gb164\|CA644742 | 3679 | 584 | 85.2 | Globlastp |
| 1668 | LYM404 | barley\|10v2\|AJ434840_P1 | 3680 | 584 | 84.6 | Globlastp |
| 1669 | LYM404 | barley\|gb157SOLEXA\|AJ434840 | 3680 | 584 | 84.6 | Globlastp |
| 1670 | LYM404 | barley\|gb157SOLEXA\|AL502808 | 3681 | 584 | 84.4 | Globlastp |
| 1671 | LYM404 | lolium\|10v1\|AU245769_P1 | 3682 | 584 | 84.4 | Globlastp |
| 1672 | LYM404 | wheat\|gb164\|BM136835 | 3683 | 584 | 84.4 | Globlastp |
| 1673 | LYM404 | barley\|10v2\|AJ434835_P1 | 3684 | 584 | 84.4 | Globlastp |
| 1674 | LYM404 | barley\|gb157SOLEXA\|AL507407 | 3684 | 584 | 84.4 | Globlastp |
| 1675 | LYM404 | barley\|10v2\|BG344791_P1 | 3681 | 584 | 84.4 | Globlastp |
| 1676 | LYM404 | maize\|gb170\|LLDQ246118 | 3685 | 584 | 84.1 | Globlastp |
| 1677 | LYM404 | wheat\|10v2\|CJ630414_P1 | 3686 | 584 | 84.1 | Globlastp |
| 1678 | LYM404 | sorghum\|09v1\|SB06G029900 | 3687 | 584 | 83.9 | Globlastp |
| 1679 | LYM404 | wheat\|10v2\|CA608688_P1 | 3688 | 584 | 83.7 | Globlastp |
| 1680 | LYM404 | wheat\|gb164\|CA608688 | 3688 | 584 | 83.7 | Globlastp |
| 1681 | LYM404 | wheat\|gb164\|BE429674 | 3689 | 584 | 83.33 | Glotblastn |
| 1682 | LYM404 | wheat\|10v2\|BQ802339_P1 | 3690 | 584 | 83.3 | Globlastp |
| 1683 | LYM404 | wheat\|gb164\|BQ578897 | 3691 | 584 | 83.3 | Globlastp |
| 1684 | LYM404 | wheat\|gb164\|BJ276368 | 3692 | 584 | 83.3 | Globlastp |
| 1685 | LYM404 | barley\|10v2\|AJ473977_P1 | 3693 | 584 | 83.3 | Globlastp |
| 1686 | LYM404 | barley\|gb157SOLEXA\|AJ473977 | 3693 | 584 | 83.3 | Globlastp |
| 1687 | LYM404 | wheat\|gb164\|CJ835344 | 3694 | 584 | 83 | Globlastp |
| 1688 | LYM404 | wheat\|gb164\|CJ630414 | 3695 | 584 | 83 | Globlastp |
| 1689 | LYM404 | wheat\|10v2\|CA614688_P1 | 3696 | 584 | 83 | Globlastp |
| 1690 | LYM404 | wheat\|gb164\|CA614688 | 3696 | 584 | 83 | Globlastp |
| 1691 | LYM404 | wheat\|10v2\|CA603078_T1 | 3697 | 584 | 82.95 | glotblastn |
| 1692 | LYM404 | wheat\|gb164\|CA603078 | 3697 | 584 | 82.95 | Glotblastn |
| 1693 | LYM404 | foxtail_millet\|10v2\|FXTRMSLX02628570D1_P1 | 3698 | 584 | 82.6 | Globlastp |
| 1694 | LYM404 | millet\|10v1\|PMSLX0019838D2_P1 | 3699 | 584 | 82.6 | Globlastp |
| 1695 | LYM404 | wheat\|10v2\|CA716773_P1 | 3700 | 584 | 82.6 | Globlastp |
| 1696 | LYM404 | wheat\|gb164\|CA716773 | 3700 | 584 | 82.6 | Globlastp |
| 1697 | LYM404 | wheat\|10v2\|BU099355_P1 | 3701 | 584 | 82.6 | Globlastp |
| 1698 | LYM404 | wheat\|gb164\|BU099355 | 3701 | 584 | 82.6 | Globlastp |
| 1699 | LYM404 | maize\|gb170\|LLDQ244531 | 3700 | 584 | 82.6 | Globlastp |
| 1700 | LYM404 | oat\|10v2\|GO596539_P1 | 3702 | 584 | 82.4 | Globlastp |
| 1701 | LYM404 | wheat\|10v2\|CA602736_P1 | 3703 | 584 | 82.4 | Globlastp |
| 1702 | LYM404 | wheat\|gb164\|CA602736 | 3703 | 584 | 82.4 | Globlastp |
| 1703 | LYM404 | oat\|10v2\|GO584079_P1 | 3704 | 584 | 82.2 | Globlastp |
| 1704 | LYM404 | wheat\|10v2\|CJ952645_P1 | 3705 | 584 | 82.2 | Globlastp |
| 1705 | LYM404 | wheat\|gb164\|CJ952645 | 3705 | 584 | 82.2 | Globlastp |
| 1706 | LYM404 | barley\|gb157SOLEXA\|BQ467210 | 3706 | 584 | 82.2 | Globlastp |
| 1707 | LYM404 | barley\|10v2\|AJ473476_P1 | 3707 | 584 | 81.8 | Globlastp |
| 1708 | LYM404 | barley\|gb157SOLEXA\|AJ473476 | 3707 | 584 | 81.8 | Globlastp |
| 1709 | LYM404 | wheat\|gb164\|AL819290 | 3708 | 584 | 81.8 | Globlastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 1710 | LYM404 | switchgrass\|gb167\|FE599818 | 3709 | 584 | 81.4 | Globlastp |
| 1711 | LYM404 | millet\|09v1\|EB411010 | 3710 | 584 | 81.4 | Globlastp |
| 1712 | LYM404 | millet\|10v1\|EB411010__P1 | 3711 | 584 | 81.4 | Globlastp |
| 1713 | LYM404 | wheat\|10v2\|BE402489__T1 | 3712 | 584 | 81.11 | Glotblastn |
| 1714 | LYM404 | wheat\|gb164\|BE402489 | 3712 | 584 | 81.11 | Glotblastn |
| 1715 | LYM404 | barley\|10v2\|BQ467210__P1 | 3713 | 584 | 81.1 | Globlastp |
| 1716 | LYM404 | barley\|10v2\|BLYB__P1 | 3714 | 584 | 81.1 | Globlastp |
| 1717 | LYM404 | barley\|gb157SOLEXA\|BG299705 | 3714 | 584 | 81.1 | Globlastp |
| 1718 | LYM404 | foxtail_millet\|10v2\|FXTRMSLX01003033D1__P1 | 3715 | 584 | 80.2 | Globlastp |
| 1719 | LYM404 | sugarcane\|10v1\|CA123349__P1 | 3716 | 584 | 80.2 | Globlastp |
| 1720 | LYM404 | switchgrass\|gb167\|FE598208 | 3717 | 584 | 80.2 | Globlastp |
| 1721 | LYM404 | sorghum\|09v1\|SB06G029870 | 3718 | 584 | 80.2 | Globlastp |
| 1722 | LYM404 | sugarcane\|gb1057.3\|CA118620 | 3719 | 584 | 80.2 | globlastp |
| 1723 | LYM404 | barley\|10v2\|AJ462592__P1 | 3720 | 584 | 80 | Globlastp |
| 1724 | LYM404 | wheat\|10v2\|BM137753__P1 | 3721 | 584 | 80 | Globlastp |
| 1725 | LYM404 | wheat\|10v2\|CA608848__P1 | 3722 | 584 | 80 | Globlastp |
| 1726 | LYM406 | rice\|gb170\|CV721513 | 3723 | 586 | 86.38 | Glotblastn |
| 1727 | LYM407 | rice\|gb170\|OS05G05670 | 3724 | 587 | 94.87 | Glotblastn |
| 1728 | LYM407 | barley\|gb157SOLEXA\|AL499770 | 3725 | 587 | 87.1 | Globlastp |
| 1729 | LYM407 | wheat\|10v2\|BE426383__P1 | 3726 | 587 | 87.1 | Globlastp |
| 1730 | LYM407 | wheat\|gb164\|BE426383 | 3726 | 587 | 87.1 | Globlastp |
| 1731 | LYM407 | leymus\|gb166\|CD808664__P1 | 3727 | 587 | 87.1 | Globlastp |
| 1732 | LYM407 | wheat\|10v2\|BE401493__P1 | 3728 | 587 | 86.8 | Globlastp |
| 1733 | LYM407 | wheat\|gb164\|AL825859 | 3728 | 587 | 86.8 | Globlastp |
| 1734 | LYM407 | wheat\|gb164\|CA682233 | 3729 | 587 | 86.5 | Globlastp |
| 1735 | LYM407 | wheat\|gb164\|BF428684 | 3730 | 587 | 86.5 | Globlastp |
| 1736 | LYM407 | leymus\|gb166\|EG375196__P1 | 3731 | 587 | 86.5 | Globlastp |
| 1737 | LYM407 | barley\|10v2\|BE437955__P1 | 3732 | 587 | 86.5 | Globlastp |
| 1738 | LYM407 | wheat\|10v2\|BF428684__P1 | 3730 | 587 | 86.5 | Globlastp |
| 1739 | LYM407 | wheat\|10v2\|BF428537__P1 | 3733 | 587 | 86.1 | Globlastp |
| 1740 | LYM407 | wheat\|10v2\|CA662087__P1 | 3733 | 587 | 86.1 | Globlastp |
| 1741 | LYM407 | pseudoroegneria\|gb167\|FF341565 | 3734 | 587 | 86.1 | Globlastp |
| 1742 | LYM407 | wheat\|10v2\|BE417991__P1 | 3735 | 587 | 86.1 | Globlastp |
| 1743 | LYM407 | wheat\|gb164\|BE417991 | 3735 | 587 | 86.1 | Globlastp |
| 1744 | LYM407 | barley\|gb157SOLEXA\|BE437955 | 3736 | 587 | 85.8 | Globlastp |
| 1745 | LYM407 | oat\|10v2\|AB128047__P1 | 3737 | 587 | 84.7 | Globlastp |
| 1746 | LYM407 | oat\|10v2\|GR313748__P1 | 3738 | 587 | 84.7 | Globlastp |
| 1747 | LYM407 | oat\|10v2\|GR324586__P1 | 3739 | 587 | 84.7 | Globlastp |
| 1748 | LYM407 | brachypodium\|09v1\|DV473156__P1 | 3740 | 587 | 84.3 | Globlastp |
| 1749 | LYM407 | oat\|10v2\|GR325179__P1 | 3741 | 587 | 84.1 | Globlastp |
| 1750 | LYM407 | brachypodium\|09v1\|DV473203__P1 | 3742 | 587 | 84 | Globlastp |
| 1751 | LYM407 | sorghum\|09v1\|SB09G003800 | 3743 | 587 | 80.7 | Globlastp |
| 1752 | LYM407 | maize\|10v1\|BG836303__T1 | 3744 | 587 | 80.51 | Glotblastn |
| 1753 | LYM407 | maize\|gb170\|BG836303 | 3744 | 587 | 80.51 | Glotblastn |
| 1754 | LYM407 | sorghum\|09v1\|SB09G003790 | 3745 | 587 | 80.19 | glotblastn |
| 1755 | LYM407 | maize\|10v1\|BM080388__P1 | 3746 | 587 | 80.1 | Globlastp |
| 1756 | LYM407 | maize\|gb170\|BM080388 | 3746 | 587 | 80.1 | Globlastp |
| 1757 | LYM409 | wheat\|gb164\|BE428448 | 3747 | 589 | 81.75 | Glotblastn |
| 1758 | LYM410 | maize\|gb170\|AI855346 | 3748 | 590 | 86.7 | Globlastp |
| 1759 | LYM410 | maize\|gb170\|CD946231 | 3749 | 590 | 85.84 | Glotblastn |
| 1760 | LYM410 | sorghum\|09v1\|SB04G035150 | 3750 | 590 | 83.49 | Glotblastn |
| 1761 | LYM415 | sorghum\|09v1\|SB02G028180 | 3751 | 595 | 88.3 | Globlastp |
| 1762 | LYM415 | brachypodium\|09v1\|DV477194__P1 | 3752 | 595 | 87 | Globlastp |
| 1763 | LYM415 | millet\|10v1\|PMSLX0031089D2__T1 | 3753 | 595 | 86.29 | Glotblastn |
| 1764 | LYM415 | maize\|10v1\|BM337874__P1 | 3754 | 595 | 85.3 | Globlastp |
| 1765 | LYM415 | maize\|gb170\|BM337874 | 3754 | 595 | 85.3 | Globlastp |
| 1766 | LYM416 | brachypodium\|09v1\|DV470050__P1 | 3755 | 596 | 85.7 | Globlastp |
| 1767 | LYM416 | switchgrass\|gb167\|FL829674 | 3756 | 596 | 85.5 | Globlastp |
| 1768 | LYM416 | wheat\|10v2\|BE413636__P1 | 3757 | 596 | 84.3 | Globlastp |
| 1769 | LYM416 | barley\|10v2\|AV916358__P1 | 3758 | 596 | 82.8 | Globlastp |
| 1770 | LYM416 | barley\|gb157SOLEXA\|AV916358 | 3758 | 596 | 82.8 | Globlastp |
| 1771 | LYM416 | sorghum\|09v1\|SB01G022060 | 3759 | 596 | 82.67 | Glotblastn |
| 1772 | LYM416 | maize\|10v1\|BM267353__T1 | 3760 | 596 | 80.4 | Glotblastn |
| 1773 | LYM416 | maize\|gb170\|BM267353 | 3761 | 596 | 80.4 | Globlastp |
| 1774 | LYM417 | switchgrass\|gb167\|FE605074__T1 | 3762 | 597 | 80.45 | Glotblastn |
| 1775 | LYM418 | rice\|gb170\|OS12G07980 | 3763 | 598 | 97.3 | Globlastp |
| 1776 | LYM418 | oat\|gb164\|CN818423 | 3764 | 598 | 95.95 | Glotblastn |
| 1777 | LYM418 | oat\|10v2\|GO585999__P1 | 3765 | 598 | 94.6 | Globlastp |
| 1778 | LYM418 | oat\|10v2\|CN818423__P1 | 3765 | 598 | 94.6 | Globlastp |
| 1779 | LYM418 | cotton\|gb164\|BG443918 | 3766 | 598 | 94.59 | Glotblastn |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 1780 | LYM418 | pineapple\|gb157.2\|CO731527 | 3767 | 598 | 93.33 | Glotblastn |
| 1780 | LYM418 | pineapple\|10v1\|CO731527_P1 | 3782 | 598 | 91.9 | Globlastp |
| 1781 | LYM418 | wheat\|gb164\|CA605578 | 3768 | 598 | 93.24 | Glotblastn |
| 1782 | LYM418 | wheat\|gb164\|CA742116 | 3769 | 598 | 93.24 | Glotblastn |
| 1783 | LYM418 | wheat\|gb164\|BE445451 | 3770 | 598 | 93.24 | Glotblastn |
| 1784 | LYM418 | wheat\|10v2\|BE445451_P1 | 3771 | 598 | 93.2 | globlastp |
| 1785 | LYM418 | leymus\|gb166\|EG392853_P1 | 3771 | 598 | 93.2 | Globlastp |
| 1786 | LYM418 | pseudoroegneria\|gb167\|FF359248 | 3771 | 598 | 93.2 | Globlastp |
| 1787 | LYM418 | brachypodium\|09v1\|GT762052_P1 | 3772 | 598 | 93.2 | Globlastp |
| 1788 | LYM418 | millet\|09v1\|EVO454PM003526 | 3773 | 598 | 93.2 | Globlastp |
| 1789 | LYM418 | millet\|10v1\|EVO454PM003526_P1 | 3773 | 598 | 93.2 | Globlastp |
| 1790 | LYM418 | wheat\|10v2\|CD927277_P1 | 3771 | 598 | 93.2 | Globlastp |
| 1791 | LYM418 | wheat\|gb164\|CD927277 | 3771 | 598 | 93.2 | Globlastp |
| 1792 | LYM418 | wheat\|10v2\|BE471110_P1 | 3774 | 598 | 93.2 | Globlastp |
| 1793 | LYM418 | wheat\|gb164\|BE471110 | 3774 | 598 | 93.2 | Globlastp |
| 1794 | LYM418 | lolium\|09v1\|AU245988 | 3775 | 598 | 93.2 | Globlastp |
| 1795 | LYM418 | lolium\|10v1\|AU245988_P1 | 3775 | 598 | 93.2 | Globlastp |
| 1796 | LYM418 | barley\|10v2\|BE601861_P1 | 3771 | 598 | 93.2 | Globlastp |
| 1797 | LYM418 | barley\|gb157SOLEXA\|BE601861 | 3771 | 598 | 93.2 | Globlastp |
| 1798 | LYM418 | fescue\|gb161\|DT688465_P1 | 3771 | 598 | 93.2 | Globlastp |
| 1799 | LYM418 | wheat\|10v2\|BQ903037_P1 | 3771 | 598 | 93.2 | Globlastp |
| 1800 | LYM418 | wheat\|gb164\|BQ903037 | 3771 | 598 | 93.2 | Globlastp |
| 1801 | LYM418 | barley\|10v2\|BF257863_P1 | 3771 | 598 | 93.2 | Globlastp |
| 1802 | LYM418 | barley\|gb157SOLEXA\|AL506323 | 3771 | 598 | 93.2 | Globlastp |
| 1803 | LYM418 | wheat\|10v2\|CA605578_P1 | 3771 | 598 | 93.2 | Globlastp |
| 1804 | LYM418 | aristolochia\|10v1\|SRR039086S0073523_P1 | 3776 | 598 | 91.9 | Globlastp |
| 1805 | LYM418 | cacao\|10v1\|CU481369_P1 | 3777 | 598 | 91.9 | Globlastp |
| 1806 | LYM418 | curcuma\|10v1\|DY385628_P1 | 3778 | 598 | 91.9 | Globlastp |
| 1807 | LYM418 | cynodon\|10v1\|ES296934_P1 | 3779 | 598 | 91.9 | Globlastp |
| 1808 | LYM418 | foxtail_millet\|10v2\|OXFXTSLX00015150D1T1_P1 | 3780 | 598 | 91.9 | Globlastp |
| 1809 | LYM418 | heritiera\|10v1\|SRR005794S0001491_P1 | 3781 | 598 | 91.9 | Globlastp |
| 1810 | LYM418 | cotton\|10v2\|AJ513288_P1 | 3777 | 598 | 91.9 | Globlastp |
| 1811 | LYM418 | cotton\|gb164\|AJ513288 | 3777 | 598 | 91.9 | Globlastp |
| 1812 | LYM418 | cacao\|10v1\|CA795814_P1 | 3777 | 598 | 91.9 | Globlastp |
| 1813 | LYM418 | cacao\|gb167\|CA795814 | 3777 | 598 | 91.9 | globlastp |
| 1814 | LYM418 | grape\|gb160\|BQ793781_P1 | 3777 | 598 | 91.9 | Globlastp |
| 1815 | LYM418 | cotton\|gb164\|AI729188 | 3777 | 598 | 91.9 | Globlastp |
| 1816 | LYM418 | switchgrass\|gb167\|FE599523 | 3783 | 598 | 91.9 | Globlastp |
| 1817 | LYM418 | banana\|10v1\|FL659758_P1 | 3784 | 598 | 91.9 | Globlastp |
| 1818 | LYM418 | banana\|gb167\|FL659758 | 3784 | 598 | 91.9 | Globlastp |
| 1819 | LYM418 | switchgrass\|gb167\|DN150897 | 3783 | 598 | 91.9 | Globlastp |
| 1820 | LYM418 | safflower\|gb162\|EL374434 | 3785 | 598 | 91.89 | Glotblastn |
| 1821 | LYM418 | ginger\|gb164\|DY367049_T1 | 3786 | 598 | 91.89 | Glotblastn |
| 1822 | LYM418 | ipomoea\|gb157.2\|EE880087 | 3787 | 598 | 91.89 | Glotblastn |
| 1823 | LYM418 | oil_palm\|gb166\|EL690696_T1 | 3788 | 598 | 90.54 | Glotblastn |
| 1824 | LYM418 | ginger\|gb164\|DY345687_T1 | 3789 | 598 | 90.54 | Glotblastn |
| 1825 | LYM418 | sunflower\|gb162\|CD853045 | 3790 | 598 | 90.54 | Glotblastn |
| 1826 | LYM418 | ipomoea_batatas\|10v1\|EE880087_P1 | 3791 | 598 | 90.5 | Globlastp |
| 1827 | LYM418 | ipomoea_nil\|10v1\|CJ739709_P1 | 3791 | 598 | 90.5 | Globlastp |
| 1828 | LYM418 | nasturtium\|10v1\|GH166341_P1 | 3792 | 598 | 90.5 | Globlastp |
| 1829 | LYM418 | nasturtium\|10v1\|SRR032558S0062783_P1 | 3792 | 598 | 90.5 | Globlastp |
| 1830 | LYM418 | pine\|10v2\|AA739786_P1 | 3793 | 598 | 90.5 | Globlastp |
| 1831 | LYM418 | pine\|10v2\|BX253951_P1 | 3793 | 598 | 90.5 | Globlastp |
| 1832 | LYM418 | prunus\|10v1\|CN494842_P1 | 3794 | 598 | 90.5 | Globlastp |
| 1833 | LYM418 | triphysaria\|10v1\|SRR023501S0042197_P1 | 3795 | 598 | 90.5 | Globlastp |
| 1834 | LYM418 | zostera\|10v1\|AM771009_P1 | 3796 | 598 | 90.5 | Globlastp |
| 1835 | LYM418 | amborella\|gb166\|CK766571_P1 | 3797 | 598 | 90.5 | Globlastp |
| 1836 | LYM418 | spruce\|gb162\|CO215259 | 3798 | 598 | 90.5 | Globlastp |
| 1837 | LYM418 | spruce\|gb162\|CO216844 | 3798 | 598 | 90.5 | Globlastp |
| 1838 | LYM418 | poplar\|10v1\|AI165261_P1 | 3795 | 598 | 90.5 | Globlastp |
| 1839 | LYM418 | poplar\|gb170\|AI165261 | 3795 | 598 | 90.5 | Globlastp |
| 1840 | LYM418 | maize\|10v1\|AI621467_P1 | 3799 | 598 | 90.5 | Globlastp |
| 1841 | LYM418 | maize\|gb170\|AI621467 | 3799 | 598 | 90.5 | Globlastp |
| 1842 | LYM418 | sugarcane\|gb157.3\|CA077022 | 3799 | 598 | 90.5 | globlastp |
| 1843 | LYM418 | pine\|gb157.2\|BX250295 | 3793 | 598 | 90.5 | Globlastp |
| 1844 | LYM418 | sorghum\|09v1\|SB08G004910 | 3799 | 598 | 90.5 | Globlastp |
| 1845 | LYM418 | banana\|10v1\|GFXAC186754X43_P1 | 3800 | 598 | 90.5 | Globlastp |
| 1846 | LYM418 | banana\|gb167\|FF557988 | 3800 | 598 | 90.5 | Globlastp |
| 1847 | LYM418 | catharanthus\|gb166\|EG561722_P1 | 3801 | 598 | 90.5 | Globlastp |
| 1848 | LYM418 | pine\|gb157.2\|BG275115 | 3793 | 598 | 90.5 | Globlastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 1849 | LYM418 | poplar\|10v1\|BU822258_P1 | 3795 | 598 | 90.5 | Globlastp |
| 1850 | LYM418 | poplar\|gb170\|BU822258 | 3795 | 598 | 90.5 | Globlastp |
| 1851 | LYM418 | senecio\|gb170\|SRR006592S0000348 | 3802 | 598 | 90.5 | Globlastp |
| 1852 | LYM418 | maize\|10v1\|AI901423_P1 | 3799 | 598 | 90.5 | Globlastp |
| 1853 | LYM418 | sugarcane\|gb157.3\|BQ536239 | 3799 | 598 | 90.5 | Globlastp |
| 1854 | LYM418 | ipomoea\|gb157.2\|CJ739709 | 3791 | 598 | 90.5 | Globlastp |
| 1855 | LYM418 | coffea\|10v1\|DV684513_P1 | 3795 | 598 | 90.5 | Globlastp |
| 1856 | LYM418 | coffea\|gb157.2\|DV684513 | 3795 | 598 | 90.5 | Globlastp |
| 1857 | LYM418 | centaurea\|gb166\|EH737458_P1 | 3802 | 598 | 90.5 | Globlastp |
| 1858 | LYM418 | pine\|gb157.2\|AA739786 | 3793 | 598 | 90.5 | Globlastp |
| 1859 | LYM418 | tea\|10v1\|FE861249_P1 | 3795 | 598 | 90.5 | Globlastp |
| 1860 | LYM418 | sugarcane\|10v1\|BQ536239_P1 | 3799 | 598 | 90.5 | Globlastp |
| 1861 | LYM418 | artemisia\|10v1\|SRR019254S0058219_P1 | 3803 | 598 | 89.2 | Globlastp |
| 1862 | LYM418 | dandelion\|10v1\|DY811211_P1 | 3803 | 598 | 89.2 | Globlastp |
| 1863 | LYM418 | ipomoea_nil\|10v1\|BJ557301_P1 | 3804 | 598 | 89.2 | Globlastp |
| 1863 | LYM418 | ipomoea\|gb157.2\|BJ557301 | 3804 | 598 | 89.2 | Globlastp |
| 1864 | LYM418 | orobanche\|10v1\|SRR023189S0002300_P1 | 3805 | 598 | 89.2 | Globlastp |
| 1865 | LYM418 | pseudotsuga\|10v1\|SRR065119S0000333_P1 | 3806 | 598 | 89.2 | Globlastp |
| 1866 | LYM418 | tragopogon\|10v1\|SRR020205S0001890_P1 | 3807 | 598 | 89.2 | Globlastp |
| 1867 | LYM418 | sunflower\|10v1\|CD853045_P1 | 3803 | 598 | 89.2 | Globlastp |
| 1868 | LYM418 | dandelion\|gb161\|DY811211 | 3803 | 598 | 89.2 | globlastp |
| 1869 | LYM418 | lettuce\|10v1\|DW050308_P1 | 3807 | 598 | 89.2 | Globlastp |
| 1870 | LYM418 | lettuce\|gb157.2\|DW050308 | 3807 | 598 | 89.2 | Globlastp |
| 1871 | LYM418 | senecio\|gb170\|DY665725 | 3803 | 598 | 89.2 | Globlastp |
| 1872 | LYM418 | oil_palm\|gb166\|EL692702_P1 | 3808 | 598 | 89.2 | Globlastp |
| 1873 | LYM418 | beet\|gb162\|BI643320_P1 | 3809 | 598 | 89.2 | Globlastp |
| 1874 | LYM418 | cycas\|gb166\|CB089512_P1 | 3810 | 598 | 89.2 | Globlastp |
| 1875 | LYM418 | flax\|09v1\|EH792185_P1 | 3811 | 598 | 89.2 | Globlastp |
| 1876 | LYM418 | apple\|gb171\|CN495618_P1 | 3812 | 598 | 89.2 | Globlastp |
| 1877 | LYM418 | kiwi\|gb166\|FG414750_P1 | 3813 | 598 | 89.2 | Globlastp |
| 1878 | LYM418 | nicotiana_benthamiana\|gb162\|ES887115_P1 | 3814 | 598 | 89.2 | Globlastp |
| 1879 | LYM418 | tea\|gb171\|FE861249 | 3815 | 598 | 89.2 | Globlastp |
| 1880 | LYM418 | physcomitrella\|10v1\|BJ940377_P1 | 3816 | 598 | 89.2 | Globlastp |
| 1881 | LYM418 | apple\|gb171\|CN494842_P1 | 3812 | 598 | 89.2 | Globlastp |
| 1882 | LYM418 | sunflower\|10v1\|CD854431_P1 | 3807 | 598 | 89.2 | Globlastp |
| 1883 | LYM418 | lettuce\|10v1\|DW099010_P1 | 3807 | 598 | 89.2 | Globlastp |
| 1884 | LYM418 | strawberry\|11v1\|EX686189_P1 | 3817 | 598 | 89.2 | Globlastp |
| 1885 | LYM418 | lettuce\|10v1\|DW060973_P1 | 3807 | 598 | 89.2 | Globlastp |
| 1886 | LYM418 | rhizophora\|10v1\|SRR005793S0007723_T1 | 3818 | 598 | 89.19 | Glotblastn |
| 1887 | LYM418 | cotton\|gb164\|BE055248 | 3819 | 598 | 89.19 | Glotblastn |
| 1888 | LYM418 | citrus\|gb166\|BQ625142_T1 | 3820 | 598 | 89.19 | Glotblastn |
| 1889 | LYM418 | spurge\|gb161\|BG381771 | 3821 | 598 | 89.19 | Glotblastn |
| 1890 | LYM418 | wheat\|10v2\|CA618761_T1 | 3822 | 598 | 89.19 | Glotblastn |
| 1890 | LYM418 | wheat\|gb164\|CA618761 | 3823 | 598 | 89.19 | Glotblastn |
| 1891 | LYM418 | basilicum\|10v1\|DY334993XX1_T1 | — | 598 | 89.19 | Glotblastn |
| 1892 | LYM418 | melon\|gb165\|AM714995 | 3824 | 598 | 87.84 | Glotblastn |
| 1893 | LYM418 | canola\|10v1\|CD831654_P1 | 3825 | 598 | 87.8 | Globlastp |
| 1894 | LYM418 | cleome_gynandra\|10v1\|SRR015532S0006189_P1 | 3826 | 598 | 87.8 | Globlastp |
| 1895 | LYM418 | cleome_spinosa\|10v1\|SRR015531S0107223_P1 | 3827 | 598 | 87.8 | globlastp |
| 1896 | LYM418 | eggplant\|10v1\|FS001074_P1 | 3828 | 598 | 87.8 | Globlastp |
| 1897 | LYM418 | guizotia\|10v1\|GE552831_P1 | 3829 | 598 | 87.8 | Globlastp |
| 1898 | LYM418 | momordica\|10v1\|SRR071315S0001036_P1 | 3830 | 598 | 87.8 | Globlastp |
| 1899 | LYM418 | oak\|10v1\|DN950448_P1 | 3831 | 598 | 87.8 | Globlastp |
| 1900 | LYM418 | podocarpus\|10v1\|SRR065014S0022655_P1 | 3832 | 598 | 87.8 | Globlastp |
| 1901 | LYM418 | podocarpus\|10v1\|SRR065014S0040756_P1 | 3832 | 598 | 87.8 | Globlastp |
| 1902 | LYM418 | potato\|10v1\|BE919537_P1 | 3833 | 598 | 87.8 | Globlastp |
| 1903 | LYM418 | salvia\|10v1\|SRR014553S0000375_P1 | 3834 | 598 | 87.8 | Globlastp |
| 1904 | LYM418 | melon\|10v1\|AM714995_P1 | 3830 | 598 | 87.8 | Globlastp |
| 1905 | LYM418 | canola\|gb161\|CD831654 | 3825 | 598 | 87.8 | Globlastp |
| 1906 | LYM418 | antirrhinum\|gb166\|AJ559184_P1 | 3835 | 598 | 87.8 | Globlastp |
| 1907 | LYM418 | radish\|gb164\|EX754681 | 3825 | 598 | 87.8 | Globlastp |
| 1908 | LYM418 | castorbean\|09v1\|XM002532693_P1 | 3836 | 598 | 87.8 | Globlastp |
| 1909 | LYM418 | fern\|gb171\|DK944489_P1 | 3837 | 598 | 87.8 | Globlastp |
| 1910 | LYM418 | potato\|gb157.2\|BE919537 | 3833 | 598 | 87.8 | Globlastp |
| 1911 | LYM418 | b_rapa\|gb162\|EE5190231_P1 | 3825 | 598 | 87.8 | Globlastp |
| 1912 | LYM418 | walnuts\|gb166\|EL891946 | 3838 | 598 | 87.8 | Globlastp |
| 1913 | LYM418 | tomato\|09v1\|BG127484 | 3833 | 598 | 87.8 | Globlastp |
| 1914 | LYM418 | centaurea\|gb166\|EH741303_P1 | 3839 | 598 | 87.8 | Globlastp |
| 1915 | LYM418 | potato\|gb157.2\|BI433807 | 3833 | 598 | 87.8 | Globlastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 1916 | LYM418 | walnuts\|gb166\|CV196253 | 3838 | 598 | 87.8 | Globlastp |
| 1917 | LYM418 | zamia\|gb166\|FD764795 | 3840 | 598 | 87.8 | Globlastp |
| 1918 | LYM418 | medicago\|09v1\|AL378329__P1 | 3841 | 598 | 87.8 | Globlastp |
| 1919 | LYM418 | oak\|10v1\|FP063260__P1 | 3831 | 598 | 87.8 | Globlastp |
| 1920 | LYM418 | oak\|gb170\|DN950448 | 3831 | 598 | 87.8 | Globlastp |
| 1921 | LYM418 | liquorice\|gb171\|FS260075__P1 | 3842 | 598 | 87.8 | Globlastp |
| 1922 | LYM418 | medicago\|09v1\|LLBI310627__P1 | 3843 | 598 | 87.8 | Globlastp |
| 1923 | LYM418 | cucumber\|09v1\|CO997774__P1 | 3830 | 598 | 87.8 | Globlastp |
| 1924 | LYM418 | solanum__phureja\|09v1\|SPHBG127484 | 3833 | 598 | 87.8 | globlastp |
| 1925 | LYM418 | tobacco\|gb162\|EB683494 | 3844 | 598 | 87.8 | Globlastp |
| 1926 | LYM418 | papaya\|gb165\|EX228513__P1 | 3845 | 598 | 87.8 | Globlastp |
| 1927 | LYM418 | monkeyflower\|09v1\|DV206332 | 3846 | 598 | 87.8 | Globlastp |
| 1928 | LYM418 | monkeyflower\|10v1\|DV206332__P1 | 3846 | 598 | 87.8 | Globlastp |
| 1929 | LYM418 | pepper\|gb171\|BM065561__P1 | 3828 | 598 | 87.8 | Globlastp |
| 1930 | LYM418 | zinnia\|gb171\|DV017455 | 3829 | 598 | 87.8 | Globlastp |
| 1931 | LYM418 | bruguiera\|gb166\|BP940736__P1 | 3847 | 598 | 87.8 | Globlastp |
| 1932 | LYM418 | chestnut\|gb170\|SRR006295S0020124__P1 | 3831 | 598 | 87.8 | Globlastp |
| 1933 | LYM418 | cassava\|09v1\|DV453159__P1 | 3836 | 598 | 87.8 | Globlastp |
| 1934 | LYM418 | potato\|10v1\|BI433807__P1 | 3833 | 598 | 87.8 | Globlastp |
| 1935 | LYM418 | sunflower\|gb162\|CD854431 | 3848 | 598 | 87.01 | Glotblastn |
| 1936 | LYM418 | acacia\|10v1\|FS584760__P1 | 3849 | 598 | 86.5 | Globlastp |
| 1937 | LYM418 | b__juncea\|10v2\|E6ANDIZ01EHVPH__P1 | 3850 | 598 | 86.5 | Globlastp |
| 1938 | LYM418 | canola\|10v1\|EE451900__P1 | 3850 | 598 | 86.5 | Globlastp |
| 1939 | LYM418 | sequoia\|10v1\|SRR065044S0010052__P1 | 3851 | 598 | 86.5 | Globlastp |
| 1940 | LYM418 | taxus\|10v1\|SRR032523S0000800__P1 | 3851 | 598 | 86.5 | Globlastp |
| 1941 | LYM418 | taxus\|10v1\|SRR065067S0010041__P1 | 3851 | 598 | 86.5 | Globlastp |
| 1942 | LYM418 | cryptomeria\|gb166\|BP174451__P1 | 3851 | 598 | 86.5 | Globlastp |
| 1943 | LYM418 | arabidopsis\|10v1\|AT1G11475__P1 | 3852 | 598 | 86.5 | Globlastp |
| 1944 | LYM418 | maize\|gb170\|LLDQ245343 | 3850 | 598 | 86.5 | Globlastp |
| 1945 | LYM418 | b__oleracea\|gb161\|AM058057__P1 | 3850 | 598 | 86.5 | Globlastp |
| 1946 | LYM418 | arabidopsis__lyrata\|09v1\|JGIAL001174__P1 | 3852 | 598 | 86.5 | Globlastp |
| 1947 | LYM418 | lotus\|09v1\|LLBW594358__P1 | 3853 | 598 | 86.5 | Globlastp |
| 1948 | LYM418 | brachypodium\|09v1\|GT799495__P1 | 3854 | 598 | 86.5 | Globlastp |
| 1949 | LYM418 | canola\|10v1\|BNU12133__P1 | 3850 | 598 | 86.5 | Globlastp |
| 1950 | LYM418 | canola\|gb161\|BNU12133 | 3850 | 598 | 86.5 | globlastp |
| 1951 | LYM418 | lotus\|09v1\|BW595213__P1 | 3853 | 598 | 86.5 | Globlastp |
| 1952 | LYM418 | chickpea\|09v2\|GR397948__P1 | 3855 | 598 | 86.5 | Globlastp |
| 1953 | LYM418 | b__rapa\|gb162\|CX269260__P1 | 3850 | 598 | 86.5 | Globlastp |
| 1954 | LYM418 | canola\|10v1\|DY006722__P1 | 3850 | 598 | 86.5 | Globlastp |
| 1955 | LYM418 | canola\|gb161\|DY006722 | 3850 | 598 | 86.5 | Globlastp |
| 1956 | LYM418 | b__juncea\|10v2\|E6ANDIZ01BWWKH__P1 | 3850 | 598 | 86.5 | Globlastp |
| 1957 | LYM418 | b__juncea\|gb164\|EVGN01227624003276 | 3850 | 598 | 86.5 | Globlastp |
| 1958 | LYM418 | radish\|gb164\|EX888737 | 3850 | 598 | 86.5 | Globlastp |
| 1959 | LYM418 | canola\|10v1\|CD819775__P1 | 3850 | 598 | 86.5 | Globlastp |
| 1960 | LYM418 | canola\|gb161\|CD819775 | 3850 | 598 | 86.5 | Globlastp |
| 1961 | LYM418 | clover\|gb162\|BB930543__P1 | 3856 | 598 | 86.5 | Globlastp |
| 1962 | LYM418 | thellungiella\|gb167\|BY829924 | 3857 | 598 | 86.5 | Globlastp |
| 1963 | LYM418 | radish\|gb164\|EV525321 | 3850 | 598 | 86.5 | Globlastp |
| 1964 | LYM418 | lotus\|09v1\|BW599973__P1 | 3853 | 598 | 86.5 | Globlastp |
| 1965 | LYM418 | soybean\|11v1\|GLYMA06G10100__P1 | 3858 | 598 | 86.5 | Globlastp |
| 1966 | LYM418 | soybean\|gb168\|BU964480 | 3858 | 598 | 86.5 | Globlastp |
| 1967 | LYM418 | soybean\|11v1\|GLYMA04G10140__P1 | 3859 | 598 | 86.5 | Globlastp |
| 1968 | LYM418 | ceratodon\|10v1\|SRR074892S0702482__T1 | 3860 | 598 | 86.49 | Glotblastn |
| 1969 | LYM418 | lettuce\|gb157.2\|DW099010 | 3861 | 598 | 85.7 | Globlastp |
| 1970 | LYM418 | cenchrus\|gb166\|EB656453__P1 | 3862 | 598 | 85.3 | Globlastp |
| 1971 | LYM418 | millet\|10v1\|EVO454PM030932__P1 | 3863 | 598 | 85.3 | Globlastp |
| 1972 | LYM418 | cowpea\|gb166\|FF392803__T1 | 3864 | 598 | 85.14 | Glotblastn |
| 1973 | LYM418 | tamarix\|gb166\|EG970875 | 3865 | 598 | 85.14 | Glotblastn |
| 1974 | LYM418 | cotton\|gb164\|ES808379 | 3866 | 598 | 85.14 | Glotblastn |
| 1975 | LYM418 | triphysaria\|10v1\|EY006973__T1 | 3867 | 598 | 85.14 | Glotblastn |
| 1976 | LYM418 | triphysaria\|gb164\|EY006973 | 3867 | 598 | 85.14 | Glotblastn |
| 1977 | LYM418 | pigeonpea\|10v1\|SRR054580S0037161__P1 | 3868 | 598 | 85.1 | Globlastp |
| 1978 | LYM418 | sciadopitys\|10v1\|SRR065035S0004294__P1 | 3869 | 598 | 85.1 | globlastp |
| 1979 | LYM418 | soybean\|gb168\|BI310627 | 3870 | 598 | 85.1 | Globlastp |
| 1980 | LYM418 | oak\|10v1\|DN949703__P1 | 3871 | 598 | 85.1 | Globlastp |
| 1981 | LYM418 | oak\|gb170\|DN949703 | 3871 | 598 | 85.1 | Globlastp |
| 1982 | LYM418 | cowpea\|gb166\|FF390921__P1 | 3872 | 598 | 85.1 | Globlastp |
| 1983 | LYM418 | spikemoss\|gb165\|DN838654 | 3873 | 598 | 85.1 | Globlastp |
| 1984 | LYM418 | bean\|gb167\|CA902225__P1 | 3872 | 598 | 85.1 | Globlastp |
| 1985 | LYM418 | peanut\|10v1\|EE126621__P1 | 3874 | 598 | 85.1 | Globlastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 1986 | LYM418 | peanut\|gb171\|EE126621 | 3874 | 598 | 85.1 | Globlastp |
| 1987 | LYM418 | chestnut\|gb170\|SRR006295S0024295__P1 | 3871 | 598 | 85.1 | Globlastp |
| 1988 | LYM418 | mesostigma\|gb166\|DN259476__P1 | 3875 | 598 | 85.1 | Globlastp |
| 1989 | LYM418 | soybean\|11v1\|GLYMA01G03590__P1 | 3876 | 598 | 85.1 | Globlastp |
| 1990 | LYM418 | soybean\|gb168\|BI969339 | 3876 | 598 | 85.1 | Globlastp |
| 1991 | LYM418 | soybean\|gb168\|BQ785621 | 3876 | 598 | 85.1 | Globlastp |
| 1992 | LYM418 | peanut\|10v1\|CD038619__P1 | 3874 | 598 | 85.1 | Globlastp |
| 1993 | LYM418 | peanut\|gb171\|CD038619 | 3874 | 598 | 85.1 | Globlastp |
| 1994 | LYM418 | peanut\|10v1\|EE123543__P1 | 3874 | 598 | 85.1 | Globlastp |
| 1995 | LYM418 | peanut\|gb171\|EE123543 | 3874 | 598 | 85.1 | Globlastp |
| 1996 | LYM418 | radish\|gb164\|EV569312 | 3877 | 598 | 85.1 | Globlastp |
| 1997 | LYM418 | millet\|09v1\|EVO454PM030932 | 3878 | 598 | 84 | Glotblastn |
| 1998 | LYM418 | gnetum\|10v1\|SRR064399S0056000__P1 | 3879 | 598 | 83.8 | Globlastp |
| 1999 | LYM418 | arabidopsis\|10v1\|AT1G61700__P1 | 3880 | 598 | 83.8 | Globlastp |
| 2000 | LYM418 | arabidopsis__lyrata\|09v1\|JGIAL005777__P1 | 3880 | 598 | 83.8 | Globlastp |
| 2001 | LYM418 | maize\|gb170\|LLFL220754 | 3881 | 598 | 83.78 | Glotblastn |
| 2002 | LYM418 | lettuce\|gb157.2\|DW118622 | 3882 | 598 | 83.5 | Globlastp |
| 2003 | LYM418 | poppy\|gb166\|FE965029__T1 | — | 598 | 83.13 | Glotblastn |
| 2004 | LYM418 | aquilegia\|10v2\|JGIAC019942__P1 | 3883 | 598 | 82.7 | Globlastp |
| 2005 | LYM418 | lettuce\|gb157.2\|DW060973 | 3884 | 598 | 82.5 | Globlastp |
| 2006 | LYM418 | artemisia\|10v1\|EY067798__T1 | 3885 | 598 | 82.43 | glotblastn |
| 2007 | LYM418 | eggplant\|10v1\|FS071046__T1 | 3886 | 598 | 82.43 | Glotblastn |
| 2008 | LYM418 | cotton\|gb164\|DR456367 | 3887 | 598 | 82.35 | Glotblastn |
| 2009 | LYM418 | strawberry\|gb164\|EX686189 | 3888 | 598 | 81.5 | Globlastp |
| 2010 | LYM418 | cotton\|gb164\|BF274001 | 3889 | 598 | 81.18 | Glotblastn |
| 2011 | LYM418 | cynodon\|10v1\|ES300419__P1 | 3890 | 598 | 81.1 | Globlastp |
| 2012 | LYM418 | sorghum\|09v1\|SB05G005840 | 3891 | 598 | 81.1 | Globlastp |
| 2013 | LYM418 | chlamydomonas\|gb162\|AV387081__T1 | 3892 | 598 | 81.08 | Glotblastn |
| 2014 | LYM418 | cucumber\|09v1\|CSCRP016122__T1 | 3893 | 598 | 81.08 | Glotblastn |
| 2015 | LYM418 | zinnia\|gb171\|DV017458 | — | 598 | 80.25 | Glotblastn |
| 2016 | LYM421 | maize\|10v1\|AI861160__P1 | 3894 | 600 | 94.6 | Globlastp |
| 2017 | LYM421 | maize\|gb170\|AI861160 | 3895 | 600 | 93.8 | Globlastp |
| 2018 | LYM421 | rice\|gb170\|OS03G12730 | 3896 | 600 | 86.7 | Globlastp |
| 2019 | LYM421 | brachypodium\|09v1\|SRR031796S0016409__P1 | 3897 | 600 | 84.5 | Globlastp |
| 2020 | LYM435 | maize\|10v1\|DT648738__P1 | 3898 | 605 | 85.5 | Globlastp |
| 2021 | LYM435 | sorghum\|09v1\|SB01G001585 | 3899 | 605 | 82.23 | Glotblastn |
| 2022 | LYM436 | maize\|10v1\|AW455688__P1 | 3900 | 606 | 91.1 | Globlastp |
| 2023 | LYM436 | maize\|gb170\|AW455688 | 3900 | 606 | 91.1 | Globlastp |
| 2024 | LYM436 | switchgrass\|gb167\|FE600197 | 3901 | 606 | 84.4 | Globlastp |
| 2025 | LYM437 | maize\|10v1\|AI601005__P1 | 3902 | 607 | 98.3 | Globlastp |
| 2026 | LYM437 | maize\|gb170\|AI601005 | 3902 | 607 | 98.3 | Globlastp |
| 2027 | LYM437 | maize\|10v1\|AI637244__P1 | 3903 | 607 | 97.5 | Globlastp |
| 2028 | LYM437 | maize\|gb170\|AI637244 | 3903 | 607 | 97.5 | Globlastp |
| 2029 | LYM437 | switchgrass\|gb167\|FE606343 | 3904 | 607 | 97.2 | Globlastp |
| 2030 | LYM437 | cenchrus\|gb166\|EB660720__P1 | 3905 | 607 | 97.2 | Globlastp |
| 2031 | LYM437 | rice\|gb170\|OS03G57870 | 3906 | 607 | 94.6 | Globlastp |
| 2032 | LYM437 | brachypodium\|09v1\|DV472921__P1 | 3907 | 607 | 91.8 | Globlastp |
| 2033 | LYM437 | wheat\|10v2\|BG274587__P1 | 3908 | 607 | 90.4 | Globlastp |
| 2034 | LYM437 | wheat\|gb164\|BE402399 | 3908 | 607 | 90.4 | Globlastp |
| 2035 | LYM437 | barley\|10v2\|AV836369__P1 | 3909 | 607 | 90.4 | Globlastp |
| 2036 | LYM437 | barley\|gb157SOLEXA\|AL505233 | 3909 | 607 | 90.4 | globlastp |
| 2037 | LYM437 | foxtail__millet\|10v2\|SICRP014018__T1 | 3910 | 607 | 84.18 | Glotblastn |
| 2038 | LYM437 | aquilegia\|10v2\|JGIAC004711__P1 | 3911 | 607 | 82.2 | Globlastp |
| 2039 | LYM437 | ipomoea\|gb157.2\|CJ752953 | 3912 | 607 | 81.4 | Globlastp |
| 2040 | LYM437 | aristolochia\|10v1\|FD750372__P1 | 3913 | 607 | 80.8 | Globlastp |
| 2041 | LYM437 | cichorium\|gb171\|EH675731__T1 | 3914 | 607 | 80.79 | Glotblastn |
| 2042 | LYM437 | soybean\|11v1\|BU549346__P1 | 3915 | 607 | 80.5 | Globlastp |
| 2043 | LYM437 | soybean\|gb168\|AW585000 | 3915 | 607 | 80.5 | Globlastp |
| 2044 | LYM437 | oat\|10v2\|GO596333__T1 | 3916 | 607 | 80.23 | Glotblastn |
| 2045 | LYM437 | eggplant\|10v1\|FS006898__P1 | 3917 | 607 | 80.2 | Globlastp |
| 2046 | LYM437 | solanum__phureja\|09v1\|SPHBG643831 | 3918 | 607 | 80.2 | Globlastp |
| 2047 | LYM438 | maize\|10v1\|CD941418__P1 | 3919 | 608 | 88.3 | Globlastp |
| 2048 | LYM438 | maize\|gb170\|CD941418 | 3919 | 608 | 88.3 | Globlastp |
| 2049 | LYM438 | foxtail__millet\|10v2\|SICRP019893__T1 | 3920 | 608 | 85.64 | Glotblastn |
| 2050 | LYM438 | switchgrass\|gb167\|FE622579 | 3921 | 608 | 85.2 | Globlastp |
| 2051 | LYM438 | rice\|gb170\|OS03G51580 | 3922 | 608 | 80.7 | Globlastp |
| 2052 | LYM440 | maize\|gb170\|BG319904 | 3923 | 610 | 87.3 | Globlastp |
| 2052 | LYM440 | maize\|10v1\|BG319904__P1 | 4276 | 718 | 87.2 | Globlastp |
| 2053 | LYM440 | millet\|10v1\|EVO454PM003935__P1 | 3924 | 610 | 86.3 | Globlastp |
| 2054 | LYM440 | rice\|gb170\|OS08G14440__P1 | 3925 | 610 | 80.6 | Globlastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 2055 | LYM441 | rice\|gb170\|OS10G42490 | 3926 | 611 | 80.1 | Globlastp |
| 2056 | LYM442 | sugarcane\|10v1\|BQ529804_P1 | 3927 | 612 | 93.7 | Globlastp |
| 2057 | LYM442 | sugarcane\|gb157.3\|BQ529804 | 3927 | 612 | 93.7 | Globlastp |
| 2058 | LYM442 | maize\|10v1\|BM072707_P1 | 3928 | 612 | 86 | Globlastp |
| 2059 | LYM442 | maize\|gb170\|BM072707 | 3928 | 612 | 86 | Globlastp |
| 2060 | LYM443 | sorghum\|09v1\|SB01G038035 | 3929 | 613 | 90 | Globlastp |
| 2061 | LYM443 | switchgrass\|gb167\|FE619547 | 3930 | 613 | 80.4 | globlastp |
| 2062 | LYM444 | maize\|10v1\|AW787625_P1 | 3931 | 614 | 94.9 | Globlastp |
| 2063 | LYM444 | maize\|gb170\|AW787625 | 3931 | 614 | 94.9 | Globlastp |
| 2064 | LYM444 | millet\|10v1\|PMSLX0044651D1_P1 | 3932 | 614 | 92.7 | Globlastp |
| 2065 | LYM444 | maize\|10v1\|BQ035172_T1 | 3933 | 614 | 90.11 | Glotblastn |
| 2066 | LYM444 | maize\|gb170\|BQ035172 | 3934 | 614 | 90.1 | Globlastp |
| 2067 | LYM444 | rice\|gb170\|OS03G14370 | 3935 | 614 | 87.3 | Globlastp |
| 2068 | LYM444 | brachypodium\|09v1\|SRR031796S0003201_P1 | 3936 | 614 | 84.9 | Globlastp |
| 2069 | LYM444 | maize\|10v1\|ZMCRP2V190058_T1 | 3937 | 614 | 83.78 | Glotblastn |
| 2070 | LYM446 | maize\|10v1\|AW308657_P1 | 3938 | 616 | 95.7 | Globlastp |
| 2071 | LYM446 | foxtail_millet\|10v2\|SICRP034406_P1 | 3939 | 616 | 94.2 | Globlastp |
| 2072 | LYM446 | brachypodium\|09v1\|DV469284_P1 | 3940 | 616 | 90 | Globlastp |
| 2073 | LYM446 | maize\|gb170\|AW308657 | 3941 | 616 | 89.4 | Globlastp |
| 2074 | LYM446 | oat\|10v2\|GR360645_T1 | 3942 | 616 | 87.23 | Glotblastn |
| 2075 | LYM446 | barley\|10v2\|BQ460120_P1 | 3943 | 616 | 86.7 | Globlastp |
| 2076 | LYM446 | barley\|gb157SOLEXA\|BQ460120 | 3943 | 616 | 86.7 | Globlastp |
| 2077 | LYM446 | cynodon\|10v1\|ES301316_P1 | 3944 | 616 | 85 | Globlastp |
| 2078 | LYM446 | rice\|gb170\|OS03G07370 | 3945 | 616 | 84.7 | Globlastp |
| 2079 | LYM446 | wheat\|10v2\|CA700687_P1 | 3946 | 616 | 83.7 | Globlastp |
| 2080 | LYM446 | wheat\|gb164\|CA635851 | 3947 | 616 | 81.2 | Globlastp |
| 2081 | LYM447 | maize\|10v1\|DW780791_P1 | 3948 | 617 | 92.2 | Globlastp |
| 2082 | LYM447 | maize\|gb170\|DW780791 | 3949 | 617 | 87.8 | Globlastp |
| 2083 | LYM447 | foxtail_millet\|10v2\|SICRP016156_T1 | 3950 | 617 | 85.69 | Glotblastn |
| 2084 | LYM447 | brachypodium\|09v1\|SRR031798S0273458_T1 | 3951 | 617 | 81.36 | Glotblastn |
| 2085 | LYM448 | maize\|gb170\|AW787353 | 3952 | 618 | 92.8 | Globlastp |
| 2086 | LYM448 | maize\|10v1\|AW787353_P1 | 3953 | 618 | 92.1 | Globlastp |
| 2087 | LYM448 | switchgrass\|gb167\|FE654400 | 3954 | 618 | 85.3 | Globlastp |
| 2088 | LYM448 | sugarcane\|10v1\|CA145812_P1 | 3955 | 618 | 82.7 | Globlastp |
| 2089 | LYM448 | sugarcane\|gb157.3\|CA145812 | 3956 | 618 | 82.4 | globlastp |
| 2090 | LYM449 | maize\|10v1\|AW147097_P1 | 3957 | 619 | 90.9 | Globlastp |
| 2091 | LYM449 | maize\|gb170\|AW147097 | 3957 | 619 | 90.9 | Globlastp |
| 2092 | LYM449 | rice\|gb170\|OS03G02330 | 3958 | 619 | 80.3 | Globlastp |
| 2093 | LYM450 | maize\|10v1\|CO528205_P1 | 3959 | 620 | 80.5 | Globlastp |
| 2094 | LYM450 | maize\|gb170\|CO528205 | 3960 | 620 | 80.3 | Globlastp |
| 2095 | LYM452 | maize\|gb170\|BQ619125 | 3961 | 622 | 85.4 | Globlastp |
| 2096 | LYM452 | maize\|10v1\|BQ619125_P1 | 3962 | 622 | 84.6 | Globlastp |
| 2097 | LYM453 | maize\|10v1\|AI461465_P1 | 3963 | 623 | 89.9 | Globlastp |
| 2098 | LYM453 | maize\|gb170\|AI670283 | 3963 | 623 | 89.9 | Globlastp |
| 2099 | LYM453 | maize\|gb170\|CF630644 | 3964 | 623 | 88.5 | Globlastp |
| 2100 | LYM453 | maize\|10v1\|CF630644_P1 | 3965 | 623 | 88 | Globlastp |
| 2101 | LYM454 | maize\|10v1\|AI586492_P1 | 3966 | 624 | 95.6 | Globlastp |
| 2102 | LYM454 | switchgrass\|gb167\|FE610910 | 3967 | 624 | 91.25 | Glotblastn |
| 2103 | LYM454 | rice\|gb170\|OS07G38260 | 3968 | 624 | 84 | Globlastp |
| 2104 | LYM454 | wheat\|gb164\|BE400205 | 3969 | 624 | 83.7 | Globlastp |
| 2105 | LYM454 | barley\|10v2\|BE413033_P1 | 3970 | 624 | 83.3 | Globlastp |
| 2106 | LYM454 | barley\|gb157SOLEXA\|AL450715 | 3970 | 624 | 83.3 | Globlastp |
| 2107 | LYM454 | brachypodium\|09v1\|DV472226_P1 | 3971 | 624 | 83.2 | Globlastp |
| 2108 | LYM454 | foxtail_millet\|10v2\|SICRP004784_T1 | 3972 | 624 | 83.17 | Glotblastn |
| 2109 | LYM454 | wheat\|10v2\|BE405727_P1 | 3973 | 624 | 83.1 | Globlastp |
| 2110 | LYM455 | maize\|10v1\|DT941652_P1 | 3974 | 625 | 84.7 | Globlastp |
| 2111 | LYM455 | maize\|gb170\|DT941652 | 3974 | 625 | 84.7 | Globlastp |
| 2112 | LYM457 | sugarcane\|gb157.3\|CA075773 | 3975 | 627 | 86.2 | Globlastp |
| 2113 | LYM458 | wheat\|gb164\|CA484331 | 3976 | 628 | 94.44 | Glotblastn |
| 2114 | LYM458 | wheat\|10v2\|CA484331_P1 | 3977 | 628 | 94.4 | Globlastp |
| 2115 | LYM458 | sugarcane\|10v1\|BQ533118_P1 | 3978 | 628 | 89.7 | Globlastp |
| 2116 | LYM458 | sugarcane\|gb157.3\|BQ533118 | 3979 | 628 | 89.7 | Globlastp |
| 2117 | LYM458 | sugarcane\|gb157.3\|CA102307 | 3980 | 628 | 89 | Globlastp |
| 2118 | LYM458 | sugarcane\|gb157.3\|BQ533973 | 3981 | 628 | 88.9 | Globlastp |
| 2119 | LYM458 | sugarcane\|10v1\|BQ533973_P1 | 3981 | 628 | 88.9 | Globlastp |
| 2120 | LYM458 | sugarcane\|10v1\|CA102307_T1 | 3982 | 628 | 88.19 | glotblastn |
| 2121 | LYM461 | foxtail_millet\|10v2\|FXTRMSLX01618069D1_P1 | 3983 | 630 | 96.9 | Globlastp |
| 2122 | LYM461 | maize\|10v1\|AI491437_P1 | 3984 | 630 | 96.9 | Globlastp |
| 2123 | LYM461 | maize\|gb170\|AI491437 | 3984 | 630 | 96.9 | Globlastp |
| 2124 | LYM461 | rice\|gb170\|OS01G44110 | 3985 | 630 | 91.8 | Globlastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 2125 | LYM461 | brachypodium|09v1|DV482433_P1 | 3986 | 630 | 90.8 | Globlastp |
| 2126 | LYM461 | barley|10v2|BE196273_P1 | 3987 | 630 | 89.6 | Globlastp |
| 2127 | LYM461 | wheat|10v2|BE406810_P1 | 3988 | 630 | 89.5 | Globlastp |
| 2128 | LYM461 | wheat|gb164|BE400643 | 3989 | 630 | 89.5 | Globlastp |
| 2129 | LYM461 | wheat|10v2|BE500293_T1 | 3990 | 630 | 88.48 | Glotblastn |
| 2130 | LYM461 | switchgrass|gb167|DN144010 | 3991 | 630 | 80.6 | Globlastp |
| 2131 | LYM464 | maize|10v1|BI273479_P1 | 3992 | 632 | 91 | Globlastp |
| 2132 | LYM464 | maize|gb170|BI273479 | 3992 | 632 | 91 | Globlastp |
| 2133 | LYM464 | foxtail_millet|10v2|SICRP024464_T1 | 3993 | 632 | 81.51 | Glotblastn |
| 2134 | LYM466 | rice|gb170|OS01G67220 | 3994 | 634 | 88.8 | Globlastp |
| 2135 | LYM466 | brachypodium|09v1|DV469198_P1 | 3995 | 634 | 83 | Globlastp |
| 2136 | LYM467 | maize|gb170|AI987474 | 3996 | 635 | 93.8 | Globlastp |
| 2137 | LYM467 | maize|10v1|AI987474_P1 | 3997 | 635 | 93.7 | Globlastp |
| 2138 | LYM467 | maize|10v1|AI902162_P1 | 3998 | 635 | 92.8 | Globlastp |
| 2139 | LYM468 | maize|10v1|AW067000_T1 | 3999 | 636 | 84.86 | Glotblastn |
| 2140 | LYM468 | maize|gb170|AW067000 | 4000 | 636 | 81.12 | Glotblastn |
| 2141 | LYM468 | rice|gb170|OS01G72350 | 4001 | 636 | 80 | Globlastp |
| 2142 | LYM473 | maize|10v1|AW181144_P1 | 4002 | 639 | 93.6 | Globlastp |
| 2143 | LYM473 | maize|gb170|AW181144 | 4002 | 639 | 93.6 | Globlastp |
| 2144 | LYM473 | millet|10v1|EVO454PM001191_P1 | 4003 | 639 | 90.9 | Globlastp |
| 2145 | LYM473 | switchgrass|gb167|FE630245 | 4004 | 639 | 90.4 | Globlastp |
| 2146 | LYM473 | brachypodium|09v1|DV479845_P1 | 4005 | 639 | 85.2 | Globlastp |
| 2147 | LYM473 | rice|gb170|OS01G27940 | 4006 | 639 | 84.8 | Globlastp |
| 2148 | LYM473 | brachypodium|09v1|DV481394_T1 | 4007 | 639 | 84.76 | Glotblastn |
| 2149 | LYM473 | cenchrus|gb166|EB653347_P1 | 4008 | 639 | 83.5 | Globlastp |
| 2150 | LYM473 | wheat|10v2|BE497866_P1 | 4009 | 639 | 82.7 | Globlastp |
| 2151 | LYM473 | barley|gb157SOLEXA|BI952752 | 4010 | 639 | 82.42 | Glotblastn |
| 2152 | LYM473 | barley|10v2|BG366664_P1 | 4011 | 639 | 82.3 | globlastp |
| 2153 | LYM473 | wheat|gb164|BE497866 | 4012 | 639 | 82.19 | Glotblastn |
| 2154 | LYM473 | oat|10v2|CN821117_T1 | 4013 | 639 | 81.58 | Glotblastn |
| 2155 | LYM474 | maize|10v1|BM259128_P1 | 4014 | 640 | 91.4 | Globlastp |
| 2156 | LYM474 | maize|gb170|BM259128 | 4014 | 640 | 91.4 | Globlastp |
| 2157 | LYM474 | switchgrass|gb167|FL787161 | 4015 | 640 | 80.95 | Glotblastn |
| 2158 | LYM474 | switchgrass|gb167|FL954360 | 4016 | 640 | 80.8 | Globlastp |
| 2159 | LYM474 | foxtail_millet|10v2|SICRP022522_T1 | 4017 | 640 | 80.66 | Glotblastn |
| 2160 | LYM474 | sugarcane|10v1|CA228273_P1 | 4018 | 640 | 80.5 | Globlastp |
| 2161 | LYM474 | foxtail_millet|10v2|FXTRMSLX00498195D1_T1 | 4019 | 640 | 80.19 | Glotblastn |
| 2162 | LYM476 | sugarcane|10v1|CF569829_P1 | 4020 | 642 | 84.7 | Globlastp |
| 2163 | LYM476 | sugarcane|gb157.3|CF569829 | 4021 | 642 | 84.7 | Globlastp |
| 2164 | LYM477 | maize|10v1|CD661856_P1 | 4022 | 643 | 94.8 | Globlastp |
| 2165 | LYM477 | maize|gb170|CD661856 | 4022 | 643 | 94.8 | Globlastp |
| 2166 | LYM477 | sugarcane|gb157.3|CA275566 | 4023 | 643 | 94.27 | Glotblastn |
| 2167 | LYM478 | maize|10v1|BM072994_P1 | 4024 | 644 | 90.2 | Globlastp |
| 2168 | LYM478 | sugarcane|gb157.3|BQ535919 | 4025 | 644 | 90.1 | Globlastp |
| 2169 | LYM478 | sugarcane|gb157.3|CA138971 | 4026 | 644 | 90.1 | Globlastp |
| 2170 | LYM478 | sugarcane|gb157.3|CA131868 | 4027 | 644 | 90.1 | Globlastp |
| 2171 | LYM478 | sugarcane|10v1|BQ535919_P1 | 4027 | 644 | 90.1 | Globlastp |
| 2172 | LYM478 | maize|gb170|BG837042 | 4028 | 644 | 89.91 | Glotblastn |
| 2173 | LYM478 | maize|10v1|BG837042_P1 | 4029 | 644 | 89.9 | Globlastp |
| 2174 | LYM478 | sugarcane|gb157.3|CA074917 | 4030 | 644 | 89.2 | Globlastp |
| 2175 | LYM478 | sugarcane|gb157.3|CA109848 | 4031 | 644 | 89.2 | Globlastp |
| 2176 | LYM478 | sugarcane|gb157.3|CA130732 | 4032 | 644 | 89.2 | Globlastp |
| 2177 | LYM478 | maize|gb170|LLCO451725 | 4033 | 644 | 88.99 | Glotblastn |
| 2178 | LYM478 | sugarcane|gb157.3|CA158243 | 4034 | 644 | 87.39 | glotblastn |
| 2179 | LYM478 | sugarcane|gb157.3|CA094465 | 4035 | 644 | 86.49 | Glotblastn |
| 2180 | LYM478 | sugarcane|gb157.3|CA132959 | 4036 | 644 | 86.49 | Glotblastn |
| 2181 | LYM478 | sugarcane|gb157.3|CA144364 | 4037 | 644 | 83.8 | Globlastp |
| 2182 | LYM478 | switchgrass|gb167|DN142212 | 4038 | 644 | 83.5 | Globlastp |
| 2183 | LYM478 | cynodon|10v1|ES299681_P1 | 4039 | 644 | 81.8 | Globlastp |
| 2184 | LYM480 | foxtail_millet|10v2|OXFXTSLX00010151D1T1_T1 | 4040 | 646 | 81.1 | Glotblastn |
| 2185 | LYM480 | sorghum|09v1|SB08G001950 | 4041 | 646 | 80.38 | Glotblastn |
| 2186 | LYM480 | sugarcane|10v1|CA067698_P1 | 4042 | 646 | 80.2 | Globlastp |
| 2187 | LYM481 | maize|10v1|AW202494_P1 | 4043 | 647 | 82.6 | Globlastp |
| 2188 | LYM481 | maize|gb170|AW202494 | 4043 | 647 | 82.6 | Globlastp |
| 2189 | LYM483 | sorghum|09v1|SB05G018443 | 4044 | 648 | 89.45 | Glotblastn |
| 2190 | LYM485 | maize|gb170|AW147025 | 4045 | 650 | 92.6 | Globlastp |
| 2191 | LYM485 | maize|10v1|AW147025_P1 | 4046 | 650 | 89.7 | Globlastp |
| 2192 | LYM485 | rice|gb170|OS04G42840 | 4047 | 650 | 87.1 | Globlastp |
| 2193 | LYM485 | brachypodium|09v1|DV476624_P1 | 4048 | 650 | 85.9 | Globlastp |
| 2194 | LYM486 | maize|10v1|AI734670_P1 | 4049 | 651 | 96.1 | Globlastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 2195 | LYM486 | maize\|gb170\|AI734670 | 4049 | 651 | 96.1 | Globlastp |
| 2196 | LYM486 | brachypodium\|09v1\|DV479343_P1 | 4050 | 651 | 89.1 | Globlastp |
| 2197 | LYM486 | rice\|gb170\|OS04G46180 | 4051 | 651 | 88.8 | Globlastp |
| 2198 | LYM486 | wheat\|10v2\|BE446780_P1 | 4052 | 651 | 88.3 | Globlastp |
| 2199 | LYM486 | barley\|10v2\|BF622824_P1 | 4053 | 651 | 88 | Globlastp |
| 2200 | LYM486 | wheat\|10v2\|BE446356_P1 | 4054 | 651 | 88 | Globlastp |
| 2201 | LYM486 | foxtail_millet\|10v2\|SICRP012708_P1 | 4055 | 651 | 81.5 | Globlastp |
| 2202 | LYM487 | sugarcane\|10v1\|CA082908_P1 | 4056 | 652 | 99 | Globlastp |
| 2203 | LYM487 | sugarcane\|gb157.3\|CA082908 | 4056 | 652 | 99 | Globlastp |
| 2204 | LYM487 | maize\|10v1\|AI619147_P1 | 4057 | 652 | 98.5 | Globlastp |
| 2205 | LYM487 | maize\|gb170\|AI619147 | 4057 | 652 | 98.5 | Globlastp |
| 2206 | LYM487 | maize\|10v1\|BQ294334_P1 | 4058 | 652 | 97.5 | Globlastp |
| 2207 | LYM487 | maize\|gb170\|BQ294334 | 4058 | 652 | 97.5 | globlastp |
| 2208 | LYM487 | switchgrass\|gb167\|FL703852 | 4059 | 652 | 97.1 | Globlastp |
| 2209 | LYM487 | millet\|09v1\|EVO454PM008070 | 4060 | 652 | 96.3 | Globlastp |
| 2210 | LYM487 | millet\|10v1\|EVO454PM008071_T1 | 4061 | 652 | 96.27 | Glotblastn |
| 2211 | LYM487 | rice\|gb170\|OS08G13350 | 4062 | 652 | 92.1 | Globlastp |
| 2212 | LYM487 | brachypodium\|09v1\|GT776449_P1 | 4063 | 652 | 88 | Globlastp |
| 2213 | LYM487 | rice\|gb170\|OS04G51710 | 4064 | 652 | 87.1 | Globlastp |
| 2214 | LYM487 | brachypodium\|09v1\|GT772403_P1 | 4065 | 652 | 86.9 | Globlastp |
| 2215 | LYM487 | millet\|09v1\|CD726424 | 4066 | 652 | 86.3 | Globlastp |
| 2216 | LYM487 | millet\|10v1\|CD726424_P1 | 4066 | 652 | 86.3 | Globlastp |
| 2217 | LYM487 | sugarcane\|gb157.3\|CA084353 | 4067 | 652 | 86.3 | Globlastp |
| 2218 | LYM487 | sugarcane\|10v1\|CA084353_P1 | 4068 | 652 | 86.1 | Globlastp |
| 2219 | LYM487 | wheat\|10v2\|BE400599_P1 | 4069 | 652 | 85.9 | Globlastp |
| 2220 | LYM487 | wheat\|gb164\|BE400599 | 4069 | 652 | 85.9 | Globlastp |
| 2221 | LYM487 | switchgrass\|gb167\|FE623823 | 4070 | 652 | 85.5 | Globlastp |
| 2222 | LYM487 | sorghum\|09v1\|SB07G006900 | 4071 | 652 | 85.5 | Globlastp |
| 2223 | LYM487 | maize\|10v1\|AW129881_P1 | 4072 | 652 | 85.3 | Globlastp |
| 2224 | LYM487 | maize\|gb170\|AW129881 | 4072 | 652 | 85.3 | Globlastp |
| 2225 | LYM487 | maize\|10v1\|AW282193_P1 | 4073 | 652 | 85.1 | Globlastp |
| 2226 | LYM487 | brachypodium\|09v1\|DV481308_P1 | 4074 | 652 | 85.1 | Globlastp |
| 2227 | LYM487 | barley\|10v2\|AV833313_P1 | 4075 | 652 | 81.8 | Globlastp |
| 2228 | LYM487 | barley\|gb157SOLEXA\|AV833313 | 4075 | 652 | 81.8 | Globlastp |
| 2229 | LYM487 | wheat\|10v2\|BE445358_P1 | 4076 | 652 | 81.8 | Globlastp |
| 2230 | LYM487 | wheat\|gb164\|BQ801650 | 4077 | 652 | 81.4 | Globlastp |
| 2231 | LYM487 | zostera\|10v1\|SRR057351S0019718_P1 | 4078 | 652 | 80.3 | Globlastp |
| 2232 | LYM489 | sugarcane\|gb157.3\|CA101920 | 4079 | 654 | 96.4 | Globlastp |
| 2233 | LYM489 | sorghum\|09v1\|SB06G030750 | 4080 | 654 | 94 | Globlastp |
| 2234 | LYM489 | maize\|10v1\|BI595677_P1 | 4081 | 654 | 90.5 | Globlastp |
| 2235 | LYM489 | maize\|gb170\|BI595677 | 4081 | 654 | 90.5 | Globlastp |
| 2236 | LYM489 | maize\|10v1\|AA979922_P1 | 4082 | 654 | 85.7 | globlastp |
| 2237 | LYM489 | maize\|gb170\|AA979922 | 4082 | 654 | 85.7 | Globlastp |
| 2238 | LYM490 | maize\|10v1\|W21761_P1 | 4083 | 655 | 92.3 | Globlastp |
| 2239 | LYM490 | maize\|gb170\|W21761 | 4083 | 655 | 92.3 | Globlastp |
| 2240 | LYM490 | foxtail_millet\|10v2\|SICRP032859_P1 | 4084 | 655 | 91.4 | Globlastp |
| 2241 | LYM490 | rice\|gb170\|OS04G57310 | 4085 | 655 | 82.9 | Globlastp |
| 2242 | LYM490 | oat\|10v2\|GR330176_P1 | 4086 | 655 | 80.8 | Globlastp |
| 2243 | LYM490 | brachypodium\|09v1\|DV481980_P1 | 4087 | 655 | 80.6 | Globlastp |
| 2244 | LYM491 | maize\|10v1\|DV171526_P1 | 4088 | 656 | 89.1 | Globlastp |
| 2245 | LYM491 | maize\|gb170\|DV171526 | 4088 | 656 | 89.1 | Globlastp |
| 2246 | LYM491 | foxtail_millet\|10v2\|SICRP012980_T1 | 4089 | 656 | 80.69 | Glotblastn |
| 2247 | LYM493 | maize\|10v1\|AW287758_P1 | 4090 | 658 | 97.6 | Globlastp |
| 2248 | LYM493 | maize\|gb170\|AW287758 | 4090 | 658 | 97.6 | Globlastp |
| 2249 | LYM493 | switchgrass\|gb167\|FL704106 | 4091 | 658 | 93.8 | Globlastp |
| 2250 | LYM493 | foxtail_millet\|10v2\|EC612467_P1 | 4092 | 658 | 89.7 | Globlastp |
| 2251 | LYM493 | brachypodium\|09v1\|GT766073_P1 | 4093 | 658 | 87.6 | Globlastp |
| 2252 | LYM493 | barley\|10v2\|BE412717_P1 | 4094 | 658 | 87.6 | Globlastp |
| 2253 | LYM493 | barley\|gb157SOLEXA\|BE412717 | 4094 | 658 | 87.6 | Globlastp |
| 2254 | LYM493 | wheat\|10v2\|BQ842285_P1 | 4095 | 658 | 87.4 | Globlastp |
| 2255 | LYM493 | wheat\|gb164\|BE430947 | 4096 | 658 | 87.4 | Globlastp |
| 2256 | LYM493 | rice\|gb170\|OS08G04630 | 4097 | 658 | 86.14 | Glotblastn |
| 2257 | LYM493 | millet\|09v1\|EVO454PM003547 | 4098 | 658 | 82.6 | Globlastp |
| 2258 | LYM495 | maize\|gb170\|AI491510 | 4099 | 660 | 93.1 | Globlastp |
| 2259 | LYM495 | maize\|10v1\|AI491510_P1 | 4100 | 660 | 92.8 | Globlastp |
| 2260 | LYM497 | sorghum\|09v1\|SB05G000365 | 4101 | 662 | 85 | Globlastp |
| 2261 | LYM497 | maize\|10v1\|CA404468_P1 | 4102 | 662 | 83.3 | Globlastp |
| 2262 | LYM497 | maize\|gb170\|CA404468 | 4103 | 662 | 82.5 | Globlastp |
| 2263 | LYM498 | maize\|10v1\|AW331749_P1 | 4104 | 663 | 96.5 | Globlastp |
| 2264 | LYM498 | maize\|gb170\|AW331749 | 4104 | 663 | 96.5 | Globlastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 2265 | LYM498 | maize\|10v1\|GRMZM2G014329T01__P1 | 4105 | 663 | 96.2 | Globlastp |
| 2266 | LYM498 | millet\|10v1\|EVO454PM063336__P1 | 4106 | 663 | 92.9 | globlastp |
| 2267 | LYM498 | millet\|09v1\|EVO454PM063336 | 4107 | 663 | 92.7 | Globlastp |
| 2268 | LYM498 | foxtail__millet\|10v2\|SICRP020841__T1 | 4108 | 663 | 92.69 | Glotblastn |
| 2269 | LYM498 | rice\|gb170\|OS11G01875 | 4109 | 663 | 88.75 | Glotblastn |
| 2270 | LYM498 | rice\|gb170\|OS12G01930 | 4110 | 663 | 87.7 | Globlastp |
| 2271 | LYM498 | wheat\|10v2\|BE415292__P1 | 4111 | 663 | 84.6 | Globlastp |
| 2272 | LYM498 | wheat\|gb164\|BE415292 | 4112 | 663 | 84.4 | Globlastp |
| 2273 | LYM498 | brachypodium\|09v1\|DV477205__P1 | 4113 | 663 | 80 | Globlastp |
| 2274 | LYM499 | maize\|10v1\|AI491601__P1 | 4114 | 664 | 87.8 | Globlastp |
| 2275 | LYM500 | maize\|10v1\|CF045034__P1 | 4115 | 665 | 83.9 | Globlastp |
| 2276 | LYM500 | maize\|gb170\|CF045034 | 4115 | 665 | 83.9 | Globlastp |
| 2277 | LYM502 | maize\|10v1\|CF046508__P1 | 4116 | 667 | 89.6 | Globlastp |
| 2278 | LYM502 | maize\|gb170\|CF046508 | 4116 | 667 | 89.6 | Globlastp |
| 2279 | LYM502 | switchgrass\|gb167\|FL824724 | 4117 | 667 | 89 | Globlastp |
| 2280 | LYM502 | maize\|10v1\|BG320787__P1 | 4118 | 667 | 85.8 | Globlastp |
| 2281 | LYM502 | maize\|gb170\|BG320787 | 4118 | 667 | 85.8 | Globlastp |
| 2282 | LYM504 | maize\|10v1\|AA051885__P1 | 4119 | 669 | 89.1 | Globlastp |
| 2283 | LYM504 | maize\|gb170\|AA051885 | 4119 | 669 | 89.1 | Globlastp |
| 2284 | LYM504 | switchgrass\|gb167\|FE651560 | 4120 | 669 | 85.7 | Globlastp |
| 2285 | LYM504 | oat\|10v2\|CN820747__P1 | 4121 | 669 | 82.2 | Globlastp |
| 2286 | LYM504 | brachypodium\|09v1\|GT763669__P1 | 4122 | 669 | 81.7 | Globlastp |
| 2287 | LYM504 | rice\|gb170\|OS12G43130 | 4123 | 669 | 81 | Globlastp |
| 2288 | LYM504 | barley\|10v2\|BE422206__P1 | 4124 | 669 | 80.9 | Globlastp |
| 2289 | LYM504 | wheat\|10v2\|BE425225__P1 | 4125 | 669 | 80.6 | Globlastp |
| 2290 | LYM504 | wheat\|gb164\|BE425225 | 4126 | 669 | 80.39 | Glotblastn |
| 2291 | LYM504 | leymus\|gb166\|EG378293__T1 | 4127 | 669 | 80.24 | Glotblastn |
| 2292 | LYM505 | sugarcane\|10v1\|CA065398__P1 | 4128 | 670 | 91.9 | Globlastp |
| 2293 | LYM505 | sugarcane\|gb157.3\|CA065398 | 4128 | 670 | 91.9 | Globlastp |
| 2294 | LYM505 | foxtail__millet\|10v2\|OXFXTSLX00011066T1__P1 | 4129 | 670 | 85.5 | Globlastp |
| 2295 | LYM505 | millet\|10v1\|PMSLX0012653D2__P1 | 4130 | 670 | 84.8 | Globlastp |
| 2296 | LYM505 | switchgrass\|gb167\|FE603625 | 4131 | 670 | 84 | Globlastp |
| 2297 | LYM507 | maize\|10v1\|AI948254__P1 | 4132 | 672 | 81.1 | globlastp |
| 2298 | LYM509 | maize\|10v1\|AW927894__P1 | 4133 | 674 | 92.6 | Globlastp |
| 2299 | LYM509 | sugarcane\|10v1\|CA087363__P1 | 4134 | 674 | 87.1 | Globlastp |
| 2300 | LYM509 | sugarcane\|gb157.3\|CA087363 | 4135 | 674 | 86.6 | Globlastp |
| 2301 | LYM509 | switchgrass\|gb167\|FL699837 | 4136 | 674 | 85.53 | Glotblastn |
| 2302 | LYM509 | foxtail__millet\|10v2\|OXEC613219T1__P1 | 4137 | 674 | 83.5 | Globlastp |
| 2303 | LYM509 | millet\|10v1\|EVO454PM016056__P1 | 4138 | 674 | 83.5 | Globlastp |
| 2304 | LYM510 | barley\|gb157SOLEXA\|BI949234 | 4139 | 675 | 81.95 | Glotblastn |
| 2305 | LYM368__H4 | switchgrass\|gb167\|FL694165__P1 | 4140 | 679 | 81.9 | Globlastp |
| 2306 | LYM312 | wheat\|gb164\|AL822986 | 4141 | 686 | 93.21 | Glotblastn |
| 2307 | LYM312 | wheat\|10v2\|BE500856__T1 | 4142 | 686 | 91.7 | Glotblastn |
| 2308 | LYM312 | oat\|10v2\|CN815344__T1 | 4143 | 686 | 86.84 | Glotblastn |
| 2309 | LYM312 | brachypodium\|09v1\|GT849852__T1 | 4144 | 686 | 83.77 | Glotblastn |
| 2310 | LYM312 | rice\|gb170\|OS05G25450 | 4145 | 686 | 83.77 | Glotblastn |
| 2311 | LYM312 | sorghum\|09v1\|SB06G0290710 | 4146 | 686 | 83.08 | Glotblastn |
| 2312 | LYM312 | sugarcane\|10v2\|BQ804036__T1 | 4147 | 686 | 83.08 | Glotblastn |
| 2313 | LYM312 | sugarcane\|gb157.3\|BQ804036 | 4148 | 686 | 82.71 | Glotblastn |
| 2314 | LYM312 | millet\|09v1\|EVO454PM008579 | 4149 | 686 | 81.13 | Glotblastn |
| 2315 | LYM312 | millet\|10v1\|EVO454PM008579__T1 | 4150 | 686 | 81.13 | Glotblastn |
| 2316 | LYM315 | switchgrass\|gb167\|FE607688 | 4151 | 687 | 84.09 | Glotblastn |
| 2317 | LYM315 | sorghum\|09v1\|SB03G008585 | 4152 | 687 | 83.36 | Glotblastn |
| 2318 | LYM315 | maize\|10v1\|AW076289__T1 | 4153 | 687 | 83 | Glotblastn |
| 2319 | LYM315 | maize\|gb170\|AW076289 | 4153 | 687 | 83 | Glotblastn |
| 2320 | LYM315 | maize\|10v1\|BG840481__T1 | 4154 | 687 | 80.47 | Glotblastn |
| 2321 | LYM316 | wheat\|10v2\|BE606637XX1__T1 | 4155 | 688 | 94.1 | Glotblastn |
| 2322 | LYM316 | maize\|gb170\|AI947455 | 4156 | 688 | 93.9 | Glotblastn |
| 2323 | LYM316 | millet\|10v1\|EVO454PM020446__T1 | 4157 | 688 | 91.64 | Glotblastn |
| 2324 | LYM316 | sorghum\|09v1\|SB01G011610 | 4158 | 688 | 91.46 | glotblastn |
| 2325 | LYM316 | millet\|09v1\|EVO454PM003214 | 4159 | 688 | 91.4 | Globlastp |
| 2326 | LYM316 | castorbean\|09v1\|XM002511462__T1 | 4160 | 688 | 89.55 | Glotblastn |
| 2327 | LYM316 | lotus\|09v1\|GO023600__T1 | 4161 | 688 | 89.37 | Glotblastn |
| 2328 | LYM316 | cotton\|gb164\|BF268247 | 4162 | 688 | 89.02 | Glotblastn |
| 2329 | LYM316 | prunus\|10v1\|CB818450__T1 | 4163 | 688 | 89.02 | Glotblastn |
| 2330 | LYM316 | pigeonpea\|10v1\|SRR054580S0025341__T1 | 4164 | 688 | 88.85 | Glotblastn |
| 2331 | LYM316 | artemisia\|10v1\|EY050657__T1 | 4165 | 688 | 88.5 | Glotblastn |
| 2332 | LYM316 | oak\|10v1\|FP038022__T1 | 4166 | 688 | 88.5 | Glotblastn |
| 2333 | LYM316 | sunflower\|gb162\|CD855840 | 4167 | 688 | 88.5 | Glotblastn |
| 2334 | LYM316 | triphysaria\|10v1\|BE574923__T1 | 4168 | 688 | 88.33 | Glotblastn |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 2335 | LYM316 | arabidopsis_lyrata\|09v1\|JGIAL030919_T1 | 4169 | 688 | 88.15 | Glotblastn |
| 2336 | LYM316 | pepper\|gb171\|BM067292_T1 | 4170 | 688 | 88.15 | Glotblastn |
| 2337 | LYM316 | gnetum\|10v1\|SRR064399S0004048_T1 | 4171 | 688 | 87.98 | Glotblastn |
| 2338 | LYM316 | switchgrass\|gb167\|FL699125 | 4172 | 688 | 87.8 | Glotblastn |
| 2339 | LYM316 | oat\|10v2\|GO588185_T1 | 4173 | 688 | 87.46 | Glotblastn |
| 2340 | LYM316 | taxus\|10v1\|SRR032523S0016620_T1 | 4174 | 688 | 86.24 | Glotblastn |
| 2341 | LYM316 | millet\|10v1\|EVO454PM006153_P1 | 4175 | 688 | 85.9 | Globlastp |
| 2342 | LYM316 | wheat\|10v2\|BU100161_P1 | 4176 | 688 | 85.9 | Globlastp |
| 2343 | LYM316 | lettuce\|10v1\|DW080995_T1 | 4177 | 688 | 85.54 | Glotblastn |
| 2344 | LYM316 | switchgrass\|gb167\|FE638151 | 4178 | 688 | 85.5 | Globlastp |
| 2345 | LYM316 | grape\|gb160\|CB346136_P1 | 4179 | 688 | 85.5 | Globlastp |
| 2346 | LYM316 | wheat\|gb164\|BU100161 | 4180 | 688 | 85.4 | Globlastp |
| 2347 | LYM316 | lettuce\|gb157.2\|DW080995 | 4181 | 688 | 85.37 | Glotblastn |
| 2348 | LYM316 | sunflower\|gb162\|CD854072 | 4182 | 688 | 85.29 | Glotblastn |
| 2349 | LYM316 | sunflower\|10v1\|CD854072_T1 | 4183 | 688 | 85.12 | Glotblastn |
| 2350 | LYM316 | sugarcane\|10v1\|CA068038_P1 | 4184 | 688 | 84.7 | globlastp |
| 2351 | LYM316 | sugarcane\|gb157.3\|CA068038 | 4184 | 688 | 84.7 | Globlastp |
| 2352 | LYM316 | cacao\|gb167\|CU477584 | 4185 | 688 | 84.2 | Globlastp |
| 2353 | LYM316 | maize\|10v1\|AW172100_T1 | 4186 | 688 | 83.97 | Glotblastn |
| 2354 | LYM316 | maize\|gb170\|AW172100 | 4186 | 688 | 83.97 | Glotblastn |
| 2355 | LYM316 | millet\|09v1\|EVO454PM020446 | 4187 | 688 | 83.9 | Globlastp |
| 2356 | LYM316 | triphysaria\|10v1\|EY002042_T1 | 4188 | 688 | 83.56 | Glotblastn |
| 2357 | LYM316 | citrus\|gb166\|CF504937_P1 | 4189 | 688 | 83.4 | Globlastp |
| 2358 | LYM316 | pigeonpea\|10v1\|SRR054580S0022176_T1 | 4190 | 688 | 82.75 | Glotblastn |
| 2359 | LYM316 | spikemoss\|gb165\|FE433020 | 4191 | 688 | 81.71 | Glotblastn |
| 2360 | LYM316 | soybean\|gb168\|CA901776 | 4192 | 688 | 81.53 | Glotblastn |
| 2361 | LYM316 | spikemoss\|gb165\|FE428833 | 4193 | 688 | 81.53 | Glotblastn |
| 2362 | LYM316 | cassava\|09v1\|CK901350_T1 | 4194 | 688 | 81.46 | Glotblastn |
| 2363 | LYM316 | peanut\|10v1\|EL966922_P1 | 4195 | 688 | 80.7 | Globlastp |
| 2364 | LYM316 | marchantia\|gb166\|BJ841272_T1 | 4196 | 688 | 80.66 | Glotblastn |
| 2365 | LYM316 | centaurea\|gb166\|EL934603_T1 | 4197 | 688 | 80.48 | Glotblastn |
| 2366 | LYM316 | melon\|10v1\|VMEL01572033803113_P1 | 4198 | 688 | 80.3 | Globlastp |
| 2367 | LYM316 | millet\|09v1\|EVO454PM000746 | 4199 | 688 | 80.2 | Globlastp |
| 2368 | LYM323 | wheat\|gb164\|BE213629 | 4200 | 689 | 92.21 | Glotblastn |
| 2369 | LYM323 | wheat\|gb164\|CK213492 | 4201 | 689 | 90.91 | Glotblastn |
| 2370 | LYM323 | barley\|gb157SOLEXA\|BF265424 | 4202 | 689 | 90.91 | Glotblastn |
| 2371 | LYM323 | barley\|10v2\|BI953318_T1 | 4203 | 689 | 89.61 | Glotblastn |
| 2372 | LYM323 | pine\|10v2\|SRR036960S0253724_T1 | 4204 | 689 | 89.61 | Glotblastn |
| 2373 | LYM323 | wheat\|10v2\|BG909365_T1 | 4205 | 689 | 89.61 | Glotblastn |
| 2374 | LYM323 | wheat\|10v2\|CA670391_T1 | 4206 | 689 | 89.61 | Glotblastn |
| 2375 | LYM323 | wheat\|gb164\|BE418436 | 4207 | 689 | 89.61 | Glotblastn |
| 2376 | LYM323 | wheat\|gb164\|CO347212 | 4208 | 689 | 89.61 | Glotblastn |
| 2377 | LYM323 | lolium\|10v1\|AY693395_T1 | 4209 | 689 | 88.31 | glotblastn |
| 2378 | LYM323 | oat\|10v2\|CN817199_T1 | 4210 | 689 | 88.31 | Glotblastn |
| 2379 | LYM323 | oat\|10v2\|CN817812_T1 | 4211 | 689 | 88.31 | Glotblastn |
| 2380 | LYM323 | oat\|10v2\|CN818219_T1 | 4212 | 689 | 88.31 | Glotblastn |
| 2381 | LYM323 | oat\|10v2\|GR321961_T1 | 4213 | 689 | 88.31 | Glotblastn |
| 2382 | LYM323 | oat\|10v2\|GR334226_T1 | 4214 | 689 | 88.31 | Glotblastn |
| 2383 | LYM323 | oat\|10v2\|GR339228_T1 | 4215 | 689 | 88.31 | Glotblastn |
| 2384 | LYM323 | oat\|10v2\|GR339741_T1 | 4216 | 689 | 88.31 | Glotblastn |
| 2385 | LYM323 | oat\|10v2\|GR342788_T1 | 4217 | 689 | 88.31 | Glotblastn |
| 2386 | LYM323 | oat\|10v2\|SRR020741S0000225_T1 | 4218 | 689 | 88.31 | Glotblastn |
| 2387 | LYM323 | oat\|10v2\|SRR020741S0000254_T1 | 4219 | 689 | 88.31 | Glotblastn |
| 2388 | LYM323 | oat\|10v2\|SRR020741S0003459_T1 | 4217 | 689 | 88.31 | Glotblastn |
| 2389 | LYM323 | oat\|10v2\|SRR020741S0004650_T1 | 4220 | 689 | 88.31 | Glotblastn |
| 2390 | LYM323 | oat\|10v2\|SRR020741S0006351_T1 | 4221 | 689 | 88.31 | Glotblastn |
| 2391 | LYM323 | oat\|10v2\|SRR020741S0011600_T1 | 4222 | 689 | 88.31 | Glotblastn |
| 2392 | LYM323 | oat\|10v2\|SRR020741S0016059_T1 | 4223 | 689 | 88.31 | Glotblastn |
| 2393 | LYM323 | oat\|10v2\|SRR020741S0022525_T1 | 4224 | 689 | 88.31 | Glotblastn |
| 2394 | LYM323 | oat\|10v2\|SRR020741S0028818_T1 | 4225 | 689 | 88.31 | Glotblastn |
| 2395 | LYM323 | oat\|10v2\|SRR020741S0044276_T1 | 4226 | 689 | 88.31 | Glotblastn |
| 2396 | LYM323 | oat\|10v2\|SRR020741S0048787_T1 | 4226 | 689 | 88.31 | Glotblastn |
| 2397 | LYM323 | oat\|10v2\|SRR020741S0127028_T1 | 4227 | 689 | 88.31 | Glotblastn |
| 2398 | LYM323 | wheat\|10v2\|CJ915595_T1 | 4228 | 689 | 88.31 | Glotblastn |
| 2399 | LYM323 | barley\|gb157SOLEXA\|BI952774 | 4229 | 689 | 88.31 | Glotblastn |
| 2400 | LYM323 | oat\|gb164\|CN817388 | 4217 | 689 | 88.31 | Glotblastn |
| 2401 | LYM323 | barley\|gb157SOLEXA\|BF625183 | 4230 | 689 | 88.31 | Glotblastn |
| 2402 | LYM323 | oat\|gb164\|CN817243 | 4231 | 689 | 88.31 | Glotblastn |
| 2403 | LYM323 | oat\|10v2\|CN817710_T1 | 4232 | 689 | 88.31 | Glotblastn |
| 2404 | LYM323 | oat\|gb164\|CN817436 | 4233 | 689 | 88.31 | Glotblastn |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 2405 | LYM323 | oat\|gb164\|CN817998 | 4234 | 689 | 88.31 | Glotblastn |
| 2406 | LYM323 | oat\|gb164\|CN817172 | 4217 | 689 | 88.31 | Glotblastn |
| 2407 | LYM323 | oat\|gb164\|CN817167 | 4217 | 689 | 88.31 | Glotblastn |
| 2408 | LYM323 | oat\|10v2\|SRR020741S0001370__T1 | 4235 | 689 | 87.01 | glotblastn |
| 2409 | LYM323 | barley\|gb157SOLEXA\|BF264953 | 4236 | 689 | 87.01 | Glotblastn |
| 2410 | LYM323 | oat\|10v2\|CN817235__P1 | 4237 | 689 | 86.1 | Globlastp |
| 2411 | LYM323 | barley\|10v2\|BI951845__T1 | 4238 | 689 | 85.71 | Glotblastn |
| 2412 | LYM323 | oat\|10v2\|SRR020741S0008834__T1 | 4239 | 689 | 85.71 | Glotblastn |
| 2413 | LYM323 | wheat\|gb164\|CA600933 | 4207 | 689 | 85.71 | Glotblastn |
| 2414 | LYM323 | wheat\|gb164\|CK152475 | 4240 | 689 | 85.71 | Glotblastn |
| 2415 | LYM323 | wheat\|gb164\|CA679683 | 4241 | 689 | 84.42 | Glotblastn |
| 2416 | LYM323 | wheat\|gb164\|CK213116 | 4242 | 689 | 83.12 | Glotblastn |
| 2417 | LYM323 | wheat\|gb164\|CK214032 | 4243 | 689 | 83.12 | Glotblastn |
| 2418 | LYM323 | wheat\|gb164\|CA607800 | 4244 | 689 | 81.93 | Glotblastn |
| 2419 | LYM323 | wheat\|gb164\|CK211860 | 4245 | 689 | 81.82 | Glotblastn |
| 2420 | LYM323 | barley\|gb157SOLEXA\|BI951845 | 4246 | 689 | 80.52 | Glotblastn |
| 2421 | LYM323 | barley\|gb157SOLEXA\|BF065474 | 4247 | 689 | 80.52 | Glotblastn |
| 2422 | LYM323 | lolium\|09v1\|AU246702 | 4248 | 689 | 80.5 | Globlastp |
| 2423 | LYM336 | wheat\|10v2\|CA623592__P1 | 4249 | 691 | 87.9 | Globlastp |
| 2424 | LYM336 | wheat\|gb164\|CA623592 | 4250 | 691 | 86.9 | Globlastp |
| 2425 | LYM336 | brachypodium\|09v1\|DV480139__T1 | 4251 | 691 | 86.15 | Glotblastn |
| 2426 | LYM345 | cotton\|10v2\|CO079665__T1 | 4252 | 696 | 86.34 | Glotblastn |
| 2427 | LYM345 | cassava\|09v1\|DB934296__T1 | 4253 | 696 | 80.43 | Glotblastn |
| 2428 | LYM345 | poplar\|10v1\|DB875465__T1 | 4254 | 696 | 80.12 | Glotblastn |
| 2429 | LYM345 | poplar\|gb170\|DB875465 | 4255 | 696 | 80.12 | Glotblastn |
| 2430 | LYM357 | sorghum\|09v1\|SB09G028110 | 4256 | 699 | 93.6 | Globlastp |
| 2431 | LYM357 | switchgrass\|gb167\|FE606773 | 4257 | 699 | 84.7 | Globlastp |
| 2432 | LYM357 | millet\|10v1\|EVO454PM006647__P1 | 4258 | 699 | 84.5 | Globlastp |
| 2433 | LYM360 | foxtail__millet\|10v2\|FXTRMSLX00107249D2__P1 | 4259 | 700 | 89.1 | Globlastp |
| 2434 | LYM360 | sugarcane\|gb157.3\|CA075955 | 4260 | 700 | 84.15 | Globlastp |
| 2435 | LYM360 | wheat\|10v2\|BF201212__T1 | 4261 | 700 | 83.17 | Glotblastn |
| 2436 | LYM360 | brachypodium\|09v1\|DV476893__T1 | 4262 | 700 | 82.54 | Glotblastn |
| 2437 | LYM374 | sugarcane\|gb157.3\|CA074001 | 4263 | 704 | 92.75 | Glotblastn |
| 2438 | LYM374 | maize\|gb170\|AI855357 | 4264 | 704 | 90.1 | globlastp |
| 2439 | LYM374 | sugarcane\|10v1\|CA154822__T1 | 4265 | 704 | 83.94 | Glotblastn |
| 2440 | LYM374 | switchgrass\|gb167\|FL800516 | 4266 | 704 | 83.51 | Glotblastn |
| 2441 | LYM374 | cenchrus\|gb166\|EB656749__T1 | 4267 | 704 | 80.71 | Glotblastn |
| 2442 | LYM386 | sorghum\|09v1\|SB02G035320 | 4268 | 707 | 83.3 | Globlastp |
| 2443 | LYM409 | barley\|10v2\|BJ446916__P1 | 4269 | 710 | 81.7 | Globlastp |
| 2444 | LYM409 | wheat\|10v2\|BE428448__P1 | 4270 | 710 | 81.5 | Globlastp |
| 2445 | LYM409 | brachypodium\|09v1\|GT770696__P1 | 4271 | 710 | 81.5 | Globlastp |
| 2446 | LYM409 | oat\|10v2\|GR318556__T1 | 4272 | 710 | 80.45 | Glotblastn |
| 2447 | LYM421 | sugarcane\|10v1\|CA133760__P1 | 4273 | 713 | 81.8 | Globlastp |
| 2448 | LYM421 | sugarcane\|gb157.3\|CA133760 | 4273 | 713 | 81.8 | Globlastp |
| 2449 | LYM421 | switchgrass\|gb167\|FL728344 | 4274 | 713 | 80 | Globlastp |
| 2450 | LYM427 | sorghum\|09v1\|CN129490 | 4275 | 715 | 94.78 | Glotblastn |
| 2451 | LYM440 | foxtail__millet\|10v2\|OXEC613292T1__P1 | 4277 | 718 | 84.5 | Globlastp |
| 2452 | LYM440 | oat\|10v2\|CN817360__P1 | 4278 | 718 | 84.1 | Globlastp |
| 2453 | LYM440 | brachypodium\|09v1\|DV470928__P1 | 4279 | 718 | 84.1 | Globlastp |
| 2454 | LYM440 | switchgrass\|gb167\|FE600332 | 4280 | 718 | 84 | Globlastp |
| 2455 | LYM440 | wheat\|gb164\|BE585654 | 4281 | 718 | 82 | Globlastp |
| 2456 | LYM440 | wheat\|10v2\|BE425246__P1 | 4282 | 718 | 81.6 | Globlastp |
| 2457 | LYM440 | pseudoroegneria\|gb167\|FF344793 | 4283 | 718 | 81.6 | Globlastp |
| 2458 | LYM440 | wheat\|gb164\|BE425246 | 4282 | 718 | 81.6 | Globlastp |
| 2459 | LYM440 | leymus\|gb166\|CD808992__P1 | 4284 | 718 | 81.6 | Globlastp |
| 2460 | LYM440 | barley\|10v2\|AV835151__P1 | 4285 | 718 | 81.3 | Globlastp |
| 2461 | LYM440 | barley\|gb157SOLEXA\|AV835151 | 4285 | 718 | 81.3 | Globlastp |
| 2462 | LYM440 | millet\|09v1\|EVO454PM003935 | 4286 | 718 | 80.8 | Globlastp |
| 2463 | LYM460 | maize\|10v1\|CO524622__P1 | 4287 | 720 | 80.1 | Globlastp |
| 2464 | LYM460 | maize\|gb170\|CO524622 | 4287 | 720 | 80.1 | Globlastp |
| 2465 | LYM465 | maize\|10v1\|CD970702__P1 | 4288 | 721 | 87.6 | Globlastp |
| 2466 | LYM465 | maize\|gb170\|CD970702 | 4289 | 721 | 87.2 | Globlastp |
| 2467 | LYM467 | rice\|gb170\|OS01G69920 | 4290 | 722 | 83.96 | glotblastn |
| 2468 | LYM467 | brachypodium\|09v1\|DV471951__T1 | 4291 | 722 | 81.95 | Glotblastn |
| 2469 | LYM467 | millet\|10v1\|CD726346__P1 | 4292 | 722 | 81.6 | Globlastp |
| 2470 | LYM479 | maize\|gb170\|BE345370 | 4293 | 725 | 85.87 | Glotblastn |
| 2471 | LYM479 | sugarcane\|gb157.3\|CA070878 | 4294 | 725 | 85.2 | Globlastp |
| 2472 | LYM479 | maize\|10v1\|BE345370__P1 | 4295 | 725 | 81.9 | Globlastp |
| 2473 | LYM479 | millet\|10v1\|EVO454PM010588__T1 | 4296 | 725 | 80.34 | Glotblastn |
| 2474 | LYM483 | sorghum\|09v1\|SB05G018540 | 4297 | 726 | 80.28 | Glotblastn |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 2475 | LYM484 | sorghum|09v1|SBGWP067232 | 4298 | 727 | 88.84 | Glotblastn |
| 2476 | LYM305 | wheat|10v2|CD870432__P1 | 4299 | 729 | 95.8 | Globlastp |
| 2477 | LYM305 | brachypodium|09v1|SRR031795S0008555__P1 | 4300 | 729 | 88.4 | Globlastp |
| 2478 | LYM305 | rice|gb170|OS02G56310__P1 | 4301 | 729 | 80.8 | Globlastp |
| 2479 | LYM320 | wheat|gb164|BE489120 | 4302 | 731 | 97.14 | Glotblastn |
| 2480 | LYM320 | wheat|10v2|BE404444__T1 | 4303 | 731 | 97.14 | Glotblastn |
| 2481 | LYM320 | wheat|gb164|BE426702 | 4304 | 731 | 95.71 | Glotblastn |
| 2482 | LYM320 | wheat|gb164|BE404444 | 4305 | 731 | 95.71 | Glotblastn |
| 2483 | LYM320 | brachypodium|09v1|CRPBD004741__T1 | 4306 | 731 | 84.29 | Glotblastn |
| 2484 | LYM321 | wheat|10v2|BF292772__P1 | 4307 | 732 | 99.7 | Globlastp |
| 2485 | LYM321 | wheat|10v2|AL826398__P1 | 4308 | 732 | 99.3 | Globlastp |
| 2486 | LYM321 | wheat|gb164|BE400505 | 4308 | 732 | 99.3 | Globlastp |
| 2487 | LYM321 | wheat|10v2|BE406477__P1 | 4309 | 732 | 99.2 | Globlastp |
| 2488 | LYM321 | wheat|10v2|BF293528__P1 | 4310 | 732 | 99.2 | Globlastp |
| 2489 | LYM321 | barley|10v2|AV922200__P1 | 4311 | 732 | 99 | Globlastp |
| 2490 | LYM321 | oat|10v2|CN819912__P1 | 4312 | 732 | 98.4 | Globlastp |
| 2491 | LYM321 | brachypodium|09v1|DV480013__P1 | 4313 | 732 | 98.2 | Globlastp |
| 2492 | LYM321 | fescue|gb161|DT680639__P1 | 4314 | 732 | 98 | Globlastp |
| 2493 | LYM321 | millet|09v1|EVO454PM006280 | 4315 | 732 | 96.7 | Globlastp |
| 2494 | LYM321 | millet|10v1|EVO454PM007156__P1 | 4315 | 732 | 96.7 | Globlastp |
| 2495 | LYM321 | switchgrass|gb167|FE634889 | 4316 | 732 | 96.7 | Globlastp |
| 2496 | LYM321 | rice|gb170|OS01G19450 | 4317 | 732 | 96.5 | Globlastp |
| 2497 | LYM321 | foxtail__millet|10v2|OXFXTRMSLX00035855D1T1__P1 | 4318 | 732 | 96.2 | globlastp |
| 2498 | LYM321 | sorghum|09v1|SB03G012420 | 4319 | 732 | 96.2 | Globlastp |
| 2499 | LYM321 | sugarcane|10v1|CA069900__P1 | 4320 | 732 | 95.6 | Globlastp |
| 2500 | LYM321 | sugarcane|gb157.3|CA069900 | 4320 | 732 | 95.6 | Globlastp |
| 2501 | LYM321 | pigeonpea|10v1|SRR054580S0025411__P1 | 4321 | 732 | 93.6 | Globlastp |
| 2502 | LYM321 | citrus|gb166|CD574299__P1 | 4322 | 732 | 93.3 | Globlastp |
| 2503 | LYM321 | soybean|11v1|GLYMA15G15020__P1 | 4323 | 732 | 92.6 | Globlastp |
| 2504 | LYM321 | soybean|gb168|BE316107 | 4323 | 732 | 92.6 | Globlastp |
| 2505 | LYM321 | cacao|10v1|CU481185__P1 | 4324 | 732 | 92.4 | Globlastp |
| 2506 | LYM321 | cassava|09v1|CK645760__P1 | 4325 | 732 | 92.4 | Globlastp |
| 2507 | LYM321 | cotton|10v2|BG444263__P1 | 4326 | 732 | 92.4 | Globlastp |
| 2508 | LYM321 | cotton|gb164|AI726866 | 4327 | 732 | 92.4 | Globlastp |
| 2509 | LYM321 | arabidopsis__lyrata|09v1|JGIAL009077__P1 | 4328 | 732 | 92.3 | Globlastp |
| 2510 | LYM321 | soybean|gb168|AW685462 | 4329 | 732 | 92.3 | Globlastp |
| 2511 | LYM321 | cowpea|gb166|FF391707__P1 | 4330 | 732 | 92.3 | Globlastp |
| 2512 | LYM321 | lotus|09v1|AW719405__P1 | 4331 | 732 | 92.1 | Globlastp |
| 2513 | LYM321 | cotton|gb164|AI054464 | 4332 | 732 | 92.1 | Globlastp |
| 2514 | LYM321 | papaya|gb165|AM903596__P1 | 4333 | 732 | 92.1 | Globlastp |
| 2515 | LYM321 | cucumber|09v1|DV632339__P1 | 4334 | 732 | 92.1 | Globlastp |
| 2516 | LYM321 | castorbean|09v1|EG657629__T1 | 4335 | 732 | 91.95 | Glotblastn |
| 2517 | LYM321 | cassava|09v1|DV451519__P1 | 4336 | 732 | 91.9 | Globlastp |
| 2518 | LYM321 | liquorice|gb171|EF571302__P1 | 4337 | 732 | 91.9 | Globlastp |
| 2519 | LYM321 | soybean|11v1|GLYMA07G36840__P1 | 4338 | 732 | 91.9 | Globlastp |
| 2520 | LYM321 | soybean|gb168|AW719405 | 4338 | 732 | 91.9 | Globlastp |
| 2521 | LYM321 | arabidopsis|10v1|AT5G49460__P1 | 4339 | 732 | 91.9 | Globlastp |
| 2522 | LYM321 | arabidopsis|10v1|AT3G0650__P1 | 4340 | 732 | 91.9 | Globlastp |
| 2523 | LYM321 | orobanche|10v1|SRR023189S0004714__P1 | 4341 | 732 | 91.8 | globlastp |
| 2524 | LYM321 | poplar|10v1|AI164251__P1 | 4342 | 732 | 91.8 | Globlastp |
| 2525 | LYM321 | arabidopsis__lyrata|09v1|JGIAL029318__P1 | 4343 | 732 | 91.8 | Globlastp |
| 2526 | LYM321 | canola|10v1|CD816535__P1 | 4344 | 732 | 91.8 | Globlastp |
| 2527 | LYM321 | canola|gb161|CX193985 | 4345 | 732 | 91.8 | Globlastp |
| 2528 | LYM321 | oak|10v1|DN950375__P1 | 4346 | 732 | 91.8 | Globlastp |
| 2529 | LYM321 | chestnut|gb170|SRR006295S0000953__T1 | 4347 | 732 | 91.61 | Glotblastn |
| 2530 | LYM321 | prunus|10v1|BU046198__P1 | 4348 | 732 | 91.6 | Globlastp |
| 2531 | LYM321 | sunflower|10v1|CX946588__P1 | 4349 | 732 | 91.4 | Globlastp |
| 2532 | LYM321 | sunflower|gb162|CX946588 | 4350 | 732 | 91.4 | Globlastp |
| 2533 | LYM321 | soybean|11v1|GLYMA17G03700__P1 | 4351 | 732 | 91.3 | Globlastp |
| 2534 | LYM321 | melon|10v1|AM733929__T1 | 4352 | 732 | 91.12 | Glotblastn |
| 2535 | LYM321 | grape|gb160|BQ800086__P1 | 4353 | 732 | 91.1 | Globlastp |
| 2536 | LYM321 | solanum__phureja|09v1|SPHBG128839 | 4354 | 732 | 91 | Globlastp |
| 2537 | LYM321 | soybean|gb168|DY632707 | 4355 | 732 | 91 | Globlastp |
| 2538 | LYM321 | medicago|09v1|AW685462__P1 | 4356 | 732 | 91 | Globlastp |
| 2539 | LYM321 | tomato|09v1|BG128839 | 4357 | 732 | 91 | Globlastp |
| 2540 | LYM321 | tomato|09v1|BG127685 | 4358 | 732 | 90.8 | Globlastp |
| 2541 | LYM321 | pepper|gb171|AF290958__P1 | 4359 | 732 | 90.8 | Globlastp |
| 2542 | LYM321 | potato|10v1|BI407063__P1 | 4360 | 732 | 90.8 | Globlastp |
| 2543 | LYM321 | potato|gb157.2|BI407063 | 4360 | 732 | 90.8 | Globlastp |
| 2544 | LYM321 | peanut|gb171|EH043879 | 4361 | 732 | 90.79 | Glotblastn |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 2545 | LYM321 | orobanche|10v1|SRR023189S0029113__P1 | 4362 | 732 | 90.6 | Globlastp |
| 2546 | LYM321 | podocarpus|10v1|SRR065014S0004936__P1 | 4363 | 732 | 90.6 | Globlastp |
| 2547 | LYM321 | solanum__phureja|09v1|SPHBG127685 | 4364 | 732 | 90.6 | Globlastp |
| 2548 | LYM321 | cucumber|09v1|AM733929__P1 | 4365 | 732 | 90.6 | Globlastp |
| 2549 | LYM321 | strawberry|11v1|CO380638__P1 | 4366 | 732 | 90.5 | Globlastp |
| 2550 | LYM321 | aquilegia|10v2|DR918406__P1 | 4367 | 732 | 90.5 | Globlastp |
| 2551 | LYM321 | aquilegia|gb157.3|DR918406 | 4367 | 732 | 90.5 | globlastp |
| 2552 | LYM321 | tobacco|gb162|AJ344605 | 4368 | 732 | 90.46 | Glotblastn |
| 2553 | LYM321 | cacao|10v1|CA794428__P1 | 4369 | 732 | 90.3 | Globlastp |
| 2554 | LYM321 | nasturtium|10v1|SRR032558S0008004__P1 | 4370 | 732 | 90.3 | Globlastp |
| 2555 | LYM321 | pseudotsuga|10v1|SRR065119S0012390__P1 | 4371 | 732 | 90.3 | Globlastp |
| 2556 | LYM321 | triphysaria|10v1|BM356770__P1 | 4372 | 732 | 90.3 | Globlastp |
| 2557 | LYM321 | triphysaria|gb164|BM356770 | 4372 | 732 | 90.3 | Globlastp |
| 2558 | LYM321 | prunus|gb167|BU046198 | 4373 | 732 | 90.13 | Glotblastn |
| 2559 | LYM321 | pine|10v2|AW056672__P1 | 4374 | 732 | 90 | Globlastp |
| 2560 | LYM321 | zostera|10v1|SRR057351S0000267__P1 | 4375 | 732 | 90 | Globlastp |
| 2561 | LYM321 | pine|gb157.2|AW056672 | 4376 | 732 | 90 | Globlastp |
| 2562 | LYM321 | sunflower|gb162|BG874299 | 4377 | 732 | 90 | Globlastp |
| 2563 | LYM321 | sunflower|10v1|BG874299__P1 | 4378 | 732 | 89.8 | Globlastp |
| 2564 | LYM321 | apple|gb171|CN492537__P1 | 4379 | 732 | 89.8 | Globlastp |
| 2565 | LYM321 | centaurea|gb166|EL932820__T1 | 4380 | 732 | 89.64 | Glotblastn |
| 2566 | LYM321 | artemisia|10v1|EY039774__P1 | 4381 | 732 | 89.6 | Globlastp |
| 2567 | LYM321 | spruce|gb162|CO217937 | 4382 | 732 | 89.6 | Globlastp |
| 2568 | LYM321 | poplar|gb170|AI164251 | 4383 | 732 | 89.6 | Globlastp |
| 2569 | LYM321 | sequoia|10v1|SRR065044S0000472__P1 | 4384 | 732 | 89.5 | Globlastp |
| 2570 | LYM321 | cichorium|gb171|DT211033__P1 | 4385 | 732 | 89.5 | Globlastp |
| 2571 | LYM321 | centaurea|gb166|EH715001__T1 | 4386 | 732 | 89.47 | Glotblastn |
| 2572 | LYM321 | cynara|gb167|GE577055__T1 | 4387 | 732 | 89.31 | Glotblastn |
| 2573 | LYM321 | gnetum|10v1|CB080847__P1 | 4388 | 732 | 89.3 | Globlastp |
| 2574 | LYM321 | monkeyflower|09v1|DV209951 | 4389 | 732 | 89.3 | Globlastp |
| 2575 | LYM321 | monkeyflower|10v1|DV209951__P1 | 4389 | 732 | 89.3 | Globlastp |
| 2576 | LYM321 | lettuce|gb157.2|DW104577 | 4390 | 732 | 89.1 | Globlastp |
| 2577 | LYM321 | monkeyflower|10v1|DV206182__P1 | 4391 | 732 | 89.1 | globlastp |
| 2578 | LYM321 | lettuce|10v1|DW051369__P1 | 4390 | 732 | 89.1 | globlastp |
| 2579 | LYM321 | taxus|10v1|SRR032523S0004931__T1 | 4392 | 732 | 88.98 | glotblastn |
| 2580 | LYM321 | monkeyflower|09v1|DV206182 | 4393 | 732 | 88.98 | glotblastn |
| 2581 | LYM321 | poplar|10v1|CV239972__P1 | 4394 | 732 | 88.6 | globlastp |
| 2582 | LYM321 | poplar|gb170|CV239972 | 4395 | 732 | 88.6 | globlastp |
| 2583 | LYM321 | aristolochia|10v1|SRR039086S0168375__T1 | 4396 | 732 | 87.68 | glotblastn |
| 2584 | LYM321 | artemisia|10v1|EY049275__T1 | 4397 | 732 | 87.17 | glotblastn |
| 2585 | LYM321 | lettuce|gb157.2|DW051369 | 4398 | 732 | 85.2 | globlastp |
| 2586 | LYM321 | physcomitrella|10v1|BJ158308__P1 | 4399 | 732 | 85.1 | globlastp |
| 2587 | LYM321 | ceratodon|10v1|SRR074890S0041190__P1 | 4400 | 732 | 84.9 | globlastp |
| 2588 | LYM321 | physcomitrella|10v1|BI436732__P1 | 4401 | 732 | 83.9 | globlastp |
| 2589 | LYM321 | safflower|gb162|EL377310 | 4402 | 732 | 83.55 | glotblastn |
| 2590 | LYM321 | maize|gb170|LLBG549613 | 4403 | 732 | 82.7 | globlastp |
| 2591 | LYM321 | oak|gb170|DN950375 | 4404 | 732 | 81.6 | globlastp |
| 2592 | LYM322 | wheat|10v2|BE404343__P1 | 4405 | 733 | 96.6 | globlastp |
| 2593 | LYM322 | wheat|gb164|BE404343 | 4405 | 733 | 96.6 | globlastp |
| 2594 | LYM322 | brachypodium|09v1|DV489083__P1 | 4406 | 733 | 92.2 | globlastp |
| 2595 | LYM322 | rice|gb170|OS02G42520T2 | 4407 | 733 | 88.8 | globlastp |
| 2596 | LYM323 | barley|10v2|BI953348__T1 | 4408 | 734 | 98.85 | glotblastn |
| 2597 | LYM323 | wheat|gb164|BE213407 | 4409 | 734 | 98.3 | globlastp |
| 2598 | LYM323 | wheat|gb164|BE489914 | 4410 | 734 | 98.3 | globlastp |
| 2599 | LYM323 | wheat|10v2|BF482226__P1 | 4411 | 734 | 97.7 | globlastp |
| 2600 | LYM323 | wheat|10v2|GFXAB020946X1__P1 | 4411 | 734 | 97.7 | globlastp |
| 2601 | LYM323 | wheat|gb164|BE213240 | 4412 | 734 | 97.7 | globlastp |
| 2602 | LYM323 | maize|gb170|LLDQ245093 | 4412 | 734 | 97.7 | globlastp |
| 2603 | LYM323 | pseudoroegneria|gb167|FF353666 | 4412 | 734 | 97.7 | globlastp |
| 2604 | LYM323 | wheat|gb164|BE213401 | 4413 | 734 | 97.7 | globlastp |
| 2605 | LYM323 | barley|10v2|BI951458__P1 | 4414 | 734 | 97.1 | globlastp |
| 2606 | LYM323 | barley|10v2|BI956160__P1 | 4414 | 734 | 97.1 | globlastp |
| 2607 | LYM323 | wheat|10v2|GFXAB020926X1__P1 | 4415 | 734 | 97.1 | globlastp |
| 2608 | LYM323 | wheat|10v2|GFXAB042065X1__P1 | 4416 | 734 | 97.1 | globlastp |
| 2609 | LYM323 | wheat|10v2|GFXWHTRUBIAAX1__P1 | 4416 | 734 | 97.1 | globlastp |
| 2610 | LYM323 | wheat|gb164|BE216925 | 4417 | 734 | 96.6 | globlastp |
| 2611 | LYM323 | wheat|10v2|GFXAB020956X1__P1 | 4417 | 734 | 96.6 | globlastp |
| 2612 | LYM323 | leymus|gb166|EG382657__P1 | 4418 | 734 | 96 | globlastp |
| 2613 | LYM323 | wheat|gb164|BE213269 | 4419 | 734 | 96 | globlastp |
| 2614 | LYM323 | wheat|gb164|BE418127 | 4420 | 734 | 96 | globlastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 2615 | LYM323 | wheat\|10v2\|BF291663_P1 | 4420 | 734 | 96 | globlastp |
| 2616 | LYM323 | wheat\|10v2\|BF293094_P1 | 4421 | 734 | 95.4 | globlastp |
| 2617 | LYM323 | wheat\|10v2\|BF293721_P1 | 4422 | 734 | 95.4 | globlastp |
| 2618 | LYM323 | wheat\|10v2\|CA635260_P1 | 4423 | 734 | 95.4 | globlastp |
| 2619 | LYM323 | wheat\|10v2\|GFXAB020932X1_P1 | 4424 | 734 | 95.4 | globlastp |
| 2620 | LYM323 | wheat\|10v2\|CA671861_P1 | 4423 | 734 | 95.4 | globlastp |
| 2621 | LYM323 | wheat\|gb164\|AL825247 | 4425 | 734 | 95.4 | globlastp |
| 2622 | LYM323 | wheat\|gb164\|AL827502 | 4426 | 734 | 95.4 | globlastp |
| 2623 | LYM323 | wheat\|gb164\|BE213286 | 4427 | 734 | 95.4 | globlastp |
| 2624 | LYM323 | wheat\|10v2\|CA683563_P1 | 4427 | 734 | 95.4 | globlastp |
| 2625 | LYM323 | wheat\|10v2\|CA731726_P1 | 4428 | 734 | 94.9 | globlastp |
| 2626 | LYM323 | wheat\|gb164\|BE213546 | 4429 | 734 | 94.9 | globlastp |
| 2627 | LYM323 | rye\|gb164\|BE705092 | 4430 | 734 | 94.9 | globlastp |
| 2628 | LYM323 | wheat\|gb164\|BE213432 | 4431 | 734 | 94.9 | globlastp |
| 2629 | LYM323 | wheat\|10v2\|CA722290_P1 | 4432 | 734 | 94.8 | globlastp |
| 2630 | LYM323 | barley\|10v2\|AJ228934_P1 | 4433 | 734 | 94.3 | globlastp |
| 2631 | LYM323 | barley\|10v2\|AV832438_P1 | 4433 | 734 | 94.3 | globlastp |
| 2632 | LYM323 | barley\|10v2\|AV922102_P1 | 4433 | 734 | 94.3 | globlastp |
| 2633 | LYM323 | barley\|10v2\|BE411188_P1 | 4433 | 734 | 94.3 | globlastp |
| 2634 | LYM323 | wheat\|10v2\|BE213432_P1 | 4434 | 734 | 94.3 | globlastp |
| 2635 | LYM323 | leymus\|gb166\|CD808613_P1 | 4435 | 734 | 94.3 | globlastp |
| 2636 | LYM323 | cotton\|gb164\|BF277368 | 4433 | 734 | 94.3 | globlastp |
| 2637 | LYM323 | rye\|gb164\|BE493853 | 4436 | 734 | 94.3 | globlastp |
| 2638 | LYM323 | foxtail_millet\|10v2\|FXTSLX00054363_P1 | 4437 | 734 | 93.7 | globlastp |
| 2639 | LYM323 | wheat\|10v2\|BE401540_P1 | 4438 | 734 | 93.7 | globlastp |
| 2640 | LYM323 | wheat\|10v2\|BE401556_P1 | 4438 | 734 | 93.7 | globlastp |
| 2641 | LYM323 | wheat\|10v2\|BE417960_P1 | 4438 | 734 | 93.7 | globlastp |
| 2642 | LYM323 | wheat\|10v2\|BE499537_P1 | 4438 | 734 | 93.7 | globlastp |
| 2643 | LYM323 | wheat\|10v2\|CA598944_P1 | 4438 | 734 | 93.7 | globlastp |
| 2644 | LYM323 | wheat\|10v2\|CA676828_P1 | 4438 | 734 | 93.7 | globlastp |
| 2645 | LYM323 | wheat\|10v2\|CA688017_P1 | 4438 | 734 | 93.7 | globlastp |
| 2646 | LYM323 | wheat\|10v2\|CA688479_P1 | 4438 | 734 | 93.7 | globlastp |
| 2647 | LYM323 | wheat\|10v2\|CA708934_P1 | 4438 | 734 | 93.7 | globlastp |
| 2648 | LYM323 | wheat\|10v2\|CK152475_P1 | 4438 | 734 | 93.7 | globlastp |
| 2649 | LYM323 | wheat\|10v2\|GFXAB042066X1_P1 | 4438 | 734 | 93.7 | globlastp |
| 2650 | LYM323 | wheat\|10v2\|X83095_P1 | 4438 | 734 | 93.7 | globlastp |
| 2651 | LYM323 | wheat\|10v2\|X00234_P1 | 4438 | 734 | 93.7 | globlastp |
| 2652 | LYM323 | wheat\|gb164\|X00234 | 4438 | 734 | 93.7 | globlastp |
| 2653 | LYM323 | wheat\|gb164\|BE213524 | 4438 | 734 | 93.7 | globlastp |
| 2654 | LYM323 | leymus\|gb166\|CD808567_P1 | 4439 | 734 | 93.7 | globlastp |
| 2655 | LYM323 | pseudoroegneria\|gb167\|FF340115 | 4438 | 734 | 93.7 | globlastp |
| 2656 | LYM323 | wheat\|10v2\|BE401484_P1 | 4438 | 734 | 93.7 | globlastp |
| 2657 | LYM323 | wheat\|gb164\|BE213613 | 4438 | 734 | 93.7 | globlastp |
| 2658 | LYM323 | pseudoroegneria\|gb167\|FF343207 | 4438 | 734 | 93.7 | globlastp |
| 2659 | LYM323 | rye\|gb164\|BE493974 | 4438 | 734 | 93.7 | globlastp |
| 2660 | LYM323 | wheat\|gb164\|BE418243 | 4438 | 734 | 93.7 | globlastp |
| 2661 | LYM323 | wheat\|gb164\|BE213400 | 4438 | 734 | 93.7 | globlastp |
| 2662 | LYM323 | wheat\|10v2\|BE591831_P1 | 4438 | 734 | 93.7 | globlastp |
| 2663 | LYM323 | wheat\|10v2\|BF293130_P1 | 4438 | 734 | 93.7 | globlastp |
| 2664 | LYM323 | wheat\|10v2\|BE418758_P1 | 4438 | 734 | 93.7 | globlastp |
| 2665 | LYM323 | wheat\|10v2\|BI750998_T1 | 4440 | 734 | 93.14 | glotblastn |
| 2666 | LYM323 | barley\|10v2\|HVU43493_P1 | 4441 | 734 | 93.1 | globlastp |
| 2667 | LYM323 | wheat\|10v2\|BE430370_P1 | 4442 | 734 | 93.1 | globlastp |
| 2668 | LYM323 | wheat\|10v2\|CA628296_P1 | 4442 | 734 | 93.1 | globlastp |
| 2669 | LYM323 | fescue\|gb161\|CK802562_P1 | 4443 | 734 | 93.1 | globlastp |
| 2670 | LYM323 | fescue\|gb161\|CK802893_P1 | 4443 | 734 | 93.1 | globlastp |
| 2671 | LYM323 | wheat\|10v2\|CK213583_P1 | 4444 | 734 | 92.6 | globlastp |
| 2672 | LYM323 | leymus\|gb166\|EG384080_P1 | 4445 | 734 | 92.6 | globlastp |
| 2673 | LYM323 | leymus\|gb166\|CD808506_P1 | 4446 | 734 | 92.6 | globlastp |
| 2674 | LYM323 | fescue\|gb161\|CK802838_P1 | 4447 | 734 | 92.5 | globlastp |
| 2675 | LYM323 | foxtail_millet\|10v2\|OXFXTSLX00005856T1_T1 | 4448 | 734 | 92 | glotblastn |
| 2676 | LYM323 | lolium\|10v1\|AU246416_P1 | 4449 | 734 | 92 | globlastp |
| 2677 | LYM323 | lolium\|10v1\|AU246718_P1 | 4450 | 734 | 92 | globlastp |
| 2678 | LYM323 | lolium\|10v1\|AU246894_P1 | 4449 | 734 | 92 | globlastp |
| 2679 | LYM323 | lolium\|10v1\|AU246987_P1 | 4451 | 734 | 92 | globlastp |
| 2680 | LYM323 | oat\|10v2\|AF192778XX2_P1 | 4452 | 734 | 92 | globlastp |
| 2681 | LYM323 | oat\|10v2\|GR315764_P1 | 4452 | 734 | 92 | globlastp |
| 2682 | LYM323 | oat\|10v2\|GR319109_P1 | 4452 | 734 | 92 | globlastp |
| 2683 | LYM323 | oat\|10v2\|GR322170_P1 | 4452 | 734 | 92 | globlastp |
| 2684 | LYM323 | oat\|10v2\|GR330123_P1 | 4452 | 734 | 92 | globlastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 2685 | LYM323 | oat\|10v2\|SRR020741S0011514_P1 | 4452 | 734 | 92 | globlastp |
| 2686 | LYM323 | wheat\|10v2\|GFXAB042064X1_T1 | 4453 | 734 | 92 | glotblastn |
| 2687 | LYM323 | leymus\|gb166\|CD808636_P1 | 4454 | 734 | 92 | globlastp |
| 2688 | LYM323 | fescue\|gb161\|CK802053_P1 | 4455 | 734 | 92 | globlastp |
| 2689 | LYM323 | lolium\|09v1\|AU246467 | 4456 | 734 | 92 | globlastp |
| 2690 | LYM323 | lolium\|10v1\|AU246467_P1 | 4456 | 734 | 92 | globlastp |
| 2691 | LYM323 | lolium\|09v1\|AY693395 | 4449 | 734 | 92 | globlastp |
| 2692 | LYM323 | fescue\|gb161\|DT679236_P1 | 4450 | 734 | 92 | globlastp |
| 2693 | LYM323 | oat\|10v2\|CN817388_P1 | 4452 | 734 | 92 | globlastp |
| 2694 | LYM323 | oat\|10v2\|GR318240_P1 | 4452 | 734 | 92 | globlastp |
| 2695 | LYM323 | barley\|10v2\|BG344511_T1 | 4457 | 734 | 91.95 | glotblastn |
| 2696 | LYM323 | pseudoroegneria\|gb167\|FF350077 | 4458 | 734 | 91.5 | globlastp |
| 2697 | LYM323 | wheat\|10v2\|BE401428_T1 | 4459 | 734 | 91.43 | glotblastn |
| 2698 | LYM323 | barley\|10v2\|BI951695_P1 | 4460 | 734 | 91.4 | globlastp |
| 2699 | LYM323 | oat\|10v2\|CN817197_P1 | 4461 | 734 | 91.4 | globlastp |
| 2700 | LYM323 | oat\|10v2\|CN817540_P1 | 4461 | 734 | 91.4 | globlastp |
| 2701 | LYM323 | oat\|10v2\|GR313438_P1 | 4461 | 734 | 91.4 | globlastp |
| 2702 | LYM323 | oat\|10v2\|GR318094_P1 | 4462 | 734 | 91.4 | globlastp |
| 2703 | LYM323 | oat\|10v2\|GR320691_P1 | 4463 | 734 | 91.4 | globlastp |
| 2704 | LYM323 | oat\|10v2\|SRR020741S0006634_P1 | 4461 | 734 | 91.4 | globlastp |
| 2705 | LYM323 | oat\|10v2\|SRR020741S0070820_P1 | 4461 | 734 | 91.4 | globlastp |
| 2706 | LYM323 | fescue\|gb161\|DT679230_P1 | 4464 | 734 | 91.4 | globlastp |
| 2707 | LYM323 | oat\|gb164\|CN817363 | 4463 | 734 | 91.4 | globlastp |
| 2708 | LYM323 | brachypodium\|09v1\|DV473139_P1 | 4465 | 734 | 91.4 | globlastp |
| 2709 | LYM323 | brachypodium\|09v1\|DV473778_P1 | 4466 | 734 | 91.4 | globlastp |
| 2710 | LYM323 | oat\|10v2\|AF096617XX2_P1 | 4463 | 734 | 91.4 | globlastp |
| 2711 | LYM323 | barley\|10v2\|CA591948_T1 | 4467 | 734 | 91.38 | glotblastn |
| 2712 | LYM323 | oat\|10v2\|GR320859_T1 | 4468 | 734 | 91.38 | glotblastn |
| 2713 | LYM323 | oat\|10v2\|SRR020741S0022596_T1 | 4469 | 734 | 91.38 | glotblastn |
| 2714 | LYM323 | barley\|10v2\|BF622956_P1 | 4470 | 734 | 90.9 | globlastp |
| 2715 | LYM323 | leymus\|gb166\|CD808493_P1 | 4471 | 734 | 90.9 | globlastp |
| 2716 | LYM323 | lolium\|10v1\|AU246624_P1 | 4472 | 734 | 90.8 | globlastp |
| 2717 | LYM323 | oat\|10v2\|AF096617XX1_P1 | 4473 | 734 | 90.8 | globlastp |
| 2718 | LYM323 | oat\|10v2\|GR318091_P1 | 4474 | 734 | 90.8 | globlastp |
| 2719 | LYM323 | oat\|10v2\|GR318615_P1 | 4475 | 734 | 90.8 | globlastp |
| 2720 | LYM323 | oat\|10v2\|GR322397_P1 | 4476 | 734 | 90.8 | globlastp |
| 2721 | LYM323 | oat\|10v2\|GR339642_P1 | 4477 | 734 | 90.8 | globlastp |
| 2722 | LYM323 | oat\|10v2\|SRR020741S0022271_P1 | 4478 | 734 | 90.8 | globlastp |
| 2723 | LYM323 | oat\|10v2\|CN817363_P1 | 4475 | 734 | 90.8 | globlastp |
| 2724 | LYM323 | oat\|gb164\|CN817333 | 4479 | 734 | 90.8 | globlastp |
| 2725 | LYM323 | oat\|10v2\|GR313197_P1 | 4473 | 734 | 90.8 | globlastp |
| 2726 | LYM323 | fescue\|gb161\|DT681296_P1 | 4480 | 734 | 90.8 | globlastp |
| 2727 | LYM323 | rye\|gb164\|GFXAB020942X1 | 4481 | 734 | 90.8 | globlastp |
| 2728 | LYM323 | cotton\|10v2\|BM359089_P1 | 4482 | 734 | 90.5 | globlastp |
| 2729 | LYM323 | barley\|10v2\|BF625183_P1 | 4483 | 734 | 90.3 | globlastp |
| 2730 | LYM323 | wheat\|10v2\|CA660392_T1 | 4484 | 734 | 90.29 | glotblastn |
| 2731 | LYM323 | oat\|10v2\|CN817436_T1 | 4485 | 734 | 90.23 | glotblastn |
| 2732 | LYM323 | oat\|10v2\|CN818311_T1 | 4486 | 734 | 90.23 | glotblastn |
| 2733 | LYM323 | oat\|10v2\|GR331875XX1_T1 | 4487 | 734 | 90.23 | glotblastn |
| 2734 | LYM323 | oat\|10v2\|GR333189_T1 | 4231 | 734 | 90.23 | glotblastn |
| 2735 | LYM323 | barley\|10v2\|BI949564_P1 | 4488 | 734 | 90.2 | globlastp |
| 2736 | LYM323 | oat\|10v2\|GR316246_P1 | 4489 | 734 | 90.2 | globlastp |
| 2737 | LYM323 | oat\|10v2\|GR328381_P1 | 4490 | 734 | 90.2 | globlastp |
| 2738 | LYM323 | oat\|10v2\|GR320823_P1 | 4491 | 734 | 90.2 | globlastp |
| 2739 | LYM323 | oat\|10v2\|CN817268_P1 | 4492 | 734 | 90.2 | globlastp |
| 2740 | LYM323 | oat\|gb164\|CN817197 | 4492 | 734 | 90.2 | globlastp |
| 2741 | LYM323 | fescue\|gb161\|DT679671_P1 | 4493 | 734 | 90.2 | globlastp |
| 2742 | LYM323 | oat\|10v2\|AF192776XX2_P1 | 4494 | 734 | 89.8 | globlastp |
| 2743 | LYM323 | oat\|10v2\|AF104249XX1_P1 | 4495 | 734 | 89.7 | globlastp |
| 2744 | LYM323 | oat\|10v2\|AF104249XX2_P1 | 4495 | 734 | 89.7 | globlastp |
| 2745 | LYM323 | oat\|10v2\|CN817172_P1 | 4495 | 734 | 89.7 | globlastp |
| 2746 | LYM323 | oat\|10v2\|CN817234_P1 | 4495 | 734 | 89.7 | globlastp |
| 2747 | LYM323 | oat\|10v2\|CN817322_P1 | 4496 | 734 | 89.7 | globlastp |
| 2748 | LYM323 | oat\|10v2\|CN817884_P1 | 4497 | 734 | 89.7 | globlastp |
| 2749 | LYM323 | oat\|10v2\|CN817972_P1 | 4498 | 734 | 89.7 | globlastp |
| 2750 | LYM323 | oat\|10v2\|CN818467_P1 | 4499 | 734 | 89.7 | globlastp |
| 2751 | LYM323 | oat\|10v2\|CN818595_P1 | 4498 | 734 | 89.7 | globlastp |
| 2752 | LYM323 | oat\|10v2\|GR313592_P1 | 4498 | 734 | 89.7 | globlastp |
| 2753 | LYM323 | oat\|10v2\|GR316111_P1 | 4496 | 734 | 89.7 | globlastp |
| 2754 | LYM323 | oat\|10v2\|GR318797_P1 | 4499 | 734 | 89.7 | globlastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 2755 | LYM323 | oat\|10v2\|GR319376_P1 | 4498 | 734 | 89.7 | globlastp |
| 2756 | LYM323 | oat\|10v2\|GR331789XX1_P1 | 4495 | 734 | 89.7 | globlastp |
| 2757 | LYM323 | oat\|10v2\|GR338398_P1 | 4500 | 734 | 89.7 | globlastp |
| 2758 | LYM323 | oat\|10v2\|SRR020741S0001757_P1 | 4495 | 734 | 89.7 | globlastp |
| 2759 | LYM323 | oat\|10v2\|SRR020741S0004656_P1 | 4495 | 734 | 89.7 | globlastp |
| 2760 | LYM323 | oat\|10v2\|SRR020741S0007177_P1 | 4499 | 734 | 89.7 | globlastp |
| 2761 | LYM323 | oat\|10v2\|SRR020741S0043377_P1 | 4498 | 734 | 89.7 | globlastp |
| 2762 | LYM323 | oat\|10v2\|SRR020741S0152332_P1 | 4500 | 734 | 89.7 | globlastp |
| 2763 | LYM323 | oat\|10v2\|AF097359XX1_P1 | 4501 | 734 | 89.7 | globlastp |
| 2764 | LYM323 | fescue\|gb161\|CK800817_P1 | 4502 | 734 | 89.7 | globlastp |
| 2765 | LYM323 | lolium\|09v1\|AU246411 | 4503 | 734 | 89.7 | globlastp |
| 2766 | LYM323 | lolium\|10v1\|AU246411_P1 | 4503 | 734 | 89.7 | globlastp |
| 2767 | LYM323 | oat\|10v2\|GR338950_T1 | 4504 | 734 | 89.66 | glotblastn |
| 2768 | LYM323 | oat\|10v2\|GR341316_T1 | 4505 | 734 | 89.66 | glotblastn |
| 2769 | LYM323 | oat\|10v2\|SRR020741S0010662_T1 | 4506 | 734 | 89.14 | glotblastn |
| 2770 | LYM323 | cotton\|10v2\|BG446686_P1 | 4507 | 734 | 89.1 | globlastp |
| 2771 | LYM323 | oat\|10v2\|AF097359XX2_P1 | 4508 | 734 | 89.1 | globlastp |
| 2772 | LYM323 | oat\|10v2\|GR319246XX1_P1 | 4509 | 734 | 89.1 | globlastp |
| 2773 | LYM323 | oat\|10v2\|GR319286_P1 | 4510 | 734 | 89.1 | globlastp |
| 2774 | LYM323 | oat\|10v2\|SRR020741S0010488_P1 | 4510 | 734 | 89.1 | globlastp |
| 2775 | LYM323 | oat\|10v2\|GFXAF200303X1_T1 | 4511 | 734 | 89.08 | glotblastn |
| 2776 | LYM323 | oat\|10v2\|GO597200_T1 | 4512 | 734 | 89.08 | glotblastn |
| 2777 | LYM323 | oat\|10v2\|SRR020741S0038759_T1 | 4231 | 734 | 89.08 | glotblastn |
| 2778 | LYM323 | wheat\|gb164\|BE425600 | 4513 | 734 | 88.6 | globlastp |
| 2779 | LYM323 | brachypodium\|09v1\|DV473211_P1 | 4514 | 734 | 88.6 | globlastp |
| 2780 | LYM323 | oat\|gb164\|CN817234 | 4515 | 734 | 88.6 | globlastp |
| 2781 | LYM323 | oat\|10v2\|SRR020741S0024573_T1 | 4516 | 734 | 88.57 | glotblastn |
| 2782 | LYM323 | oat\|10v2\|SRR020741S0001393_T1 | 4217 | 734 | 88.51 | glotblastn |
| 2783 | LYM323 | oat\|10v2\|SRR020741S0087500_T1 | 4517 | 734 | 88.51 | glotblastn |
| 2784 | LYM323 | oat\|10v2\|AF104250_P1 | 4518 | 734 | 88.5 | globlastp |
| 2785 | LYM323 | oat\|10v2\|GR342208_P1 | 4519 | 734 | 88.5 | globlastp |
| 2786 | LYM323 | oat\|10v2\|SRR020741S0002484_P1 | 4520 | 734 | 88.5 | globlastp |
| 2787 | LYM323 | oat\|10v2\|SRR020741S0007079_P1 | 4521 | 734 | 88.5 | globlastp |
| 2788 | LYM323 | barley\|10v2\|BF624247_P1 | 4522 | 734 | 88 | globlastp |
| 2789 | LYM323 | wheat\|10v2\|CA688552_P1 | 4523 | 734 | 88 | globlastp |
| 2790 | LYM323 | wheat\|gb164\|CK216687 | 4524 | 734 | 88 | globlastp |
| 2791 | LYM323 | oat\|10v2\|AF097360_P1 | 4525 | 734 | 87.9 | globlastp |
| 2792 | LYM323 | oat\|gb164\|CN817884 | 4526 | 734 | 87.9 | globlastp |
| 2793 | LYM323 | wheat\|gb164\|DR737649 | 4527 | 734 | 87.9 | globlastp |
| 2794 | LYM323 | foxtail_millet\|10v2\|OXFXTSLX00013814T1_T1 | 4528 | 734 | 87.43 | glotblastn |
| 2795 | LYM323 | wheat\|10v2\|CK213487_T1 | 4529 | 734 | 87.43 | glotblastn |
| 2795 | LYM323 | wheat\|gb164\|CK213487 | 4530 | 734 | 87.43 | glotblastn |
| 2796 | LYM323 | foxtail_millet\|10v2\|FXTSLX00047355_P1 | 4531 | 734 | 87.4 | globlastp |
| 2797 | LYM323 | oat\|10v2\|SRR020741S0000730_P1 | 4532 | 734 | 87.4 | globlastp |
| 2798 | LYM323 | oat\|10v2\|SRR020741S0009815_P1 | 4533 | 734 | 86.8 | globlastp |
| 2799 | LYM323 | oat\|10v2\|CN817273_P1 | 4534 | 734 | 86.8 | globlastp |
| 2800 | LYM323 | oat\|10v2\|GR337704_T1 | 4535 | 734 | 86.44 | glotblastn |
| 2801 | LYM323 | brachypodium\|09v1\|SRR031799S0026606_P1 | 4536 | 734 | 86.4 | globlastp |
| 2802 | LYM323 | barley\|10v2\|BE411629_P1 | 4537 | 734 | 86.3 | globlastp |
| 2803 | LYM323 | barley\|10v2\|BI954460_T1 | 4538 | 734 | 86.29 | glotblastn |
| 2804 | LYM323 | oat\|gb164\|CN817235 | 4539 | 734 | 85.6 | globlastp |
| 2805 | LYM323 | oat\|10v2\|AF192773XX2_P1 | 4540 | 734 | 85.2 | globlastp |
| 2806 | LYM323 | rye\|gb164\|BE494450 | 4541 | 734 | 85.2 | globlastp |
| 2807 | LYM323 | barley\|10v2\|BE411336_P1 | 4542 | 734 | 85.1 | globlastp |
| 2808 | LYM323 | foxtail_millet\|10v2\|FXTSLX00047015_P1 | 4543 | 734 | 84.6 | globlastp |
| 2809 | LYM323 | rice\|gb170\|AA753240_P1 | 4544 | 734 | 84.6 | globlastp |
| 2810 | LYM323 | wheat\|10v2\|CA484878_P1 | 4544 | 734 | 84.6 | globlastp |
| 2811 | LYM323 | rice\|gb170\|OS12G19470_P1 | 4545 | 734 | 84 | globlastp |
| 2812 | LYM323 | oat\|10v2\|SRR020741S0016505_P1 | 4546 | 734 | 83.5 | globlastp |
| 2813 | LYM323 | rice\|gb170\|OS12G17600_P1 | 4547 | 734 | 83.4 | globlastp |
| 2814 | LYM323 | rice\|gb170\|U38156_P1 | 4548 | 734 | 83.4 | globlastp |
| 2815 | LYM323 | oat\|10v2\|SRR020741S0031808_P1 | 4549 | 734 | 83.3 | globlastp |
| 2816 | LYM323 | oat\|gb164\|CN817273 | 4550 | 734 | 82.8 | globlastp |
| 2817 | LYM323 | wheat\|10v2\|DR737558_T1 | 4551 | 734 | 82.29 | glotblastn |
| 2818 | LYM323 | oat\|10v2\|GR320006_P1 | 4552 | 734 | 81.8 | globlastp |
| 2819 | LYM323 | oat\|10v2\|SRR020741S0039481_P1 | 4553 | 734 | 81.6 | globlastp |
| 2820 | LYM323 | oat\|10v2\|SRR020741S0063119_P1 | 4554 | 734 | 81.6 | globlastp |
| 2821 | LYM323 | oat\|10v2\|CN817333_P1 | 4555 | 734 | 81.6 | globlastp |
| 2822 | LYM323 | lovegrass\|gb167\|EH187915_P1 | 4556 | 734 | 80 | globlastp |
| 2823 | LYM323 | lovegrass\|gb167\|EH188588_P1 | 4557 | 734 | 80 | globlastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 2824 | LYM327 | wheat\|10v2\|BQ484093_P1 | 4558 | 736 | 90.3 | globlastp |
| 2825 | LYM327 | wheat\|gb164\|BQ484093 | 4558 | 736 | 90.3 | globlastp |
| 2826 | LYM327 | wheat\|10v2\|BE443815_P1 | 4559 | 736 | 89.2 | globlastp |
| 2827 | LYM327 | wheat\|gb164\|BE443815 | 4559 | 736 | 89.2 | globlastp |
| 2828 | LYM328 | wheat\|gb164\|BE429282 | 4560 | 737 | 88.71 | glotblastn |
| 2829 | LYM328 | wheat\|gb164\|BG904264 | 4561 | 737 | 85.48 | glotblastn |
| 2830 | LYM328 | wheat\|10v2\|CJ963697_P1 | 4562 | 737 | 84.7 | globlastp |
| 2831 | LYM328 | wheat\|10v2\|AJ603094_P1 | 4563 | 737 | 83.9 | globlastp |
| 2832 | LYM328 | wheat\|gb164\|BE422922 | 4564 | 737 | 83.87 | glotblastn |
| 2833 | LYM329 | wheat\|gb164\|BE497427 | 4565 | 738 | 81.75 | glotblastn |
| 2834 | LYM329 | wheat\|10v2\|BE497427_P1 | 4566 | 738 | 81.4 | globlastp |
| 2835 | LYM331 | wheat\|gb164\|BE213319 | 4567 | 740 | 96.08 | glotblastn |
| 2836 | LYM331 | oat\|10v2\|GR319589_P1 | 4568 | 740 | 88.6 | globlastp |
| 2837 | LYM331 | switchgrass\|gb167\|FE635405_T1 | 4569 | 740 | 80 | glotblastn |
| 2838 | LYM344 | cacao\|10v1\|CU480734_P1 | 4570 | 746 | 86.9 | globlastp |
| 2839 | LYM344 | cacao\|gb167\|CU480734 | 4570 | 746 | 86.9 | globlastp |
| 2840 | LYM346 | sugarcane\|10v1\|CA073967_P1 | 4571 | 748 | 93.4 | globlastp |
| 2841 | LYM346 | sugarcane\|gb157.3\|CA073967 | 4571 | 748 | 93.4 | globlastp |
| 2842 | LYM346 | sorghum\|09v1\|SB07G025410 | 4572 | 748 | 87.3 | globlastp |
| 2843 | LYM346 | wheat\|10v2\|BQ838271_P1 | 4573 | 748 | 83.1 | globlastp |
| 2844 | LYM346 | barley\|10v2\|AW983456_P1 | 4574 | 748 | 83.1 | globlastp |
| 2845 | LYM346 | barley\|gb157SOLEXA\|AL507138 | 4574 | 748 | 83.1 | globlastp |
| 2846 | LYM346 | wheat\|10v2\|BF483471_P1 | 4573 | 748 | 83.1 | globlastp |
| 2847 | LYM346 | wheat\|gb164\|BF483471 | 4573 | 748 | 83.1 | globlastp |
| 2848 | LYM346 | millet\|10v1\|PMSLX0018164D1_P1 | 4575 | 748 | 82 | globlastp |
| 2849 | LYM353 | sorghum\|094v1\|SB01G0460480 | 4576 | 750 | 92.41 | glotblastn |
| 2850 | LYM355 | sorghum\|09v1\|SB04G021010 | 4577 | 752 | 89.4 | globlastp |
| 2851 | LYM355 | sugarcane\|10v1\|CA101409_P1 | 4578 | 752 | 88.9 | globlastp |
| 2852 | LYM355 | sugarcane\|gb157.3\|CA066011 | 4578 | 752 | 88.9 | globlastp |
| 2853 | LYM355 | switchgrass\|gb167\|FL759335 | 4579 | 752 | 87 | globlastp |
| 2854 | LYM355 | brachypodium\|09v1\|DV469589_P1 | 4580 | 752 | 80.4 | globlastp |
| 2855 | LYM355 | rice\|gb170\|OS02G31030 | 4581 | 752 | 80.3 | globlastp |
| 2856 | LYM355 | switchgrass\|gb167\|FL773247_P1 | 4582 | 752 | 80.1 | globlastp |
| 2857 | LYM363 | sorghum\|09v1\|SB02G040470 | 4583 | 753 | 95.7 | globlastp |
| 2858 | LYM363 | millet\|10v1\|EVO454PM003032_T1 | 4584 | 753 | 89.69 | glotblastn |
| 2859 | LYM363 | foxtail_millet\|10v2\|FXTRMSLX00804145D1_P1 | 4585 | 753 | 87.2 | globlastp |
| 2860 | LYM363 | brachypodium\|09v1\|GT760454_P1 | 4586 | 753 | 86.1 | globlastp |
| 2861 | LYM363 | rice\|gb170\|OS07G44070 | 4587 | 753 | 86 | globlastp |
| 2862 | LYM363 | wheat\|gb164\|BE419569 | 4588 | 753 | 83.86 | glotblastn |
| 2863 | LYM363 | wheat\|10v2\|BE419569_P1 | 4589 | 753 | 83.7 | globlastp |
| 2864 | LYM363 | switchgrass\|gb167\|FE647044 | 4590 | 753 | 80.6 | globlastp |
| 2865 | LYM366 | wheat\|10v2\|CJ551040_P1 | 4591 | 755 | 83.3 | globlastp |
| 2866 | LYM366 | wheat\|gb164\|CJ551040 | 4591 | 755 | 83.3 | globlastp |
| 2867 | LYM366 | wheat\|gb164\|CJ580047 | 4592 | 755 | 81.2 | globlastp |
| 2868 | LYM366 | wheat\|10v2\|CJ544810_P1 | 4593 | 755 | 80.6 | globlastp |
| 2869 | LYM367 | sorghum\|09v1\|SB01G045280 | 4594 | 756 | 93.3 | globlastp |
| 2870 | LYM367 | brachypodium\|09v1\|SRR031795S0020888_P1 | 4595 | 756 | 83.4 | globlastp |
| 2871 | LYM367 | rice\|gb170\|OS03G08140 | 4596 | 756 | 83.1 | globlastp |
| 2872 | LYM367 | switchgrass\|gb167\|FL706891 | 4597 | 756 | 82.33 | glotblastn |
| 2873 | LYM367 | wheat\|10v2\|BG262395_P1 | 4598 | 756 | 80.8 | globlastp |
| 2874 | LYM369 | sugarcane\|10v1\|CA100818_T1 | 4599 | 757 | 89.67 | glotblastn |
| 2875 | LYM369 | sugarcane\|gb157.3\|CA100818 | 4600 | 757 | 89.67 | glotblastn |
| 2876 | LYM369 | millet\|09v1\|EVO454PM009868 | 4601 | 757 | 89.3 | globlastp |
| 2877 | LYM369 | millet\|10v1\|EVO454PM009868_P1 | 4601 | 757 | 89.3 | globlastp |
| 2878 | LYM369 | barley\|gb157SOLEXA\|BE411508 | 4602 | 757 | 82.23 | glotblastn |
| 2879 | LYM369 | wheat\|gb164\|BF203113 | 4603 | 757 | 82.23 | glotblastn |
| 2880 | LYM369 | wheat\|gb164\|BE419437 | 4604 | 757 | 81.82 | glotblastn |
| 2881 | LYM369 | wheat\|10v2\|BE419437_T1 | 4605 | 757 | 81.82 | glotblastn |
| 2882 | LYM369 | fescue\|gb161\|CK802835_T1 | 4606 | 757 | 81.4 | glotblastn |
| 2883 | LYM372 | sorghum\|09v1\|SB04G024660 | 4607 | 760 | 87.1 | globlastp |
| 2884 | LYM372 | sugarcane\|10v1\|BQ535890_P1 | 4608 | 760 | 86 | globlastp |
| 2885 | LYM372 | sugarcane\|gb157.3\|BQ535890 | 4609 | 760 | 85.8 | globlastp |
| 2886 | LYM375 | sorghum\|09v1\|SB01G001810 | 4610 | 762 | 88.2 | globlastp |
| 2887 | LYM375 | sugarcane\|10v1\|CA074815_P1 | 4611 | 762 | 84.7 | globlastp |
| 2888 | LYM375 | maize\|10v1\|AI948025_P1 | 4612 | 762 | 84 | globlastp |
| 2889 | LYM375 | maize\|gb170\|AI948025 | 4612 | 762 | 84 | globlastp |
| 2890 | LYM375 | sugarcane\|gb157.3\|CA074815 | 4613 | 762 | 83.9 | globlastp |
| 2891 | LYM375 | switchgrass\|gb167\|FL812389 | 4614 | 762 | 83.19 | glotblastn |
| 2892 | LYM385 | maize\|10v1\|ZMCRP2V208186_P1 | 4615 | 765 | 90.8 | globlastp |
| 2893 | LYM385 | maize\|10v1\|ZMCRP2V019939_T1 | 4616 | 765 | 89.15 | glotblastn |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 2894 | LYM387 | maize\|10v1\|AI665175_P1 | 4617 | 766 | 87.8 | globlastp |
| 2895 | LYM387 | maize\|gb170\|AI665175 | 4617 | 766 | 87.8 | globlastp |
| 2896 | LYM387 | foxtail_millet\|10v2\|SICRP002515_P1 | 4618 | 766 | 85.5 | globlastp |
| 2897 | LYM387 | brachypodium\|09v1\|SRR031795S0027446_P1 | 4619 | 766 | 82.6 | globlastp |
| 2898 | LYM387 | wheat\|gb164\|BQ236742 | 4620 | 766 | 81.52 | globlastn |
| 2899 | LYM387 | millet\|10v1\|EVO454PM429706_P1 | 4621 | 766 | 80.9 | globlastp |
| 2900 | LYM387 | oat\|10v2\|GR327792_T1 | 4622 | 766 | 80.9 | globlastn |
| 2901 | LYM387 | barley\|10v2\|BE454704_T1 | 4623 | 766 | 80.22 | globlastn |
| 2902 | LYM387 | wheat\|10v2\|BE427516_P1 | 4624 | 766 | 80.1 | globlastp |
| 2903 | LYM410 | brachypodium\|09v1\|GT774325_P1 | 4625 | 768 | 89.6 | globlastp |
| 2904 | LYM410 | sorghum\|09v1\|SB10G025350 | 4626 | 768 | 88.5 | globlastp |
| 2905 | LYM410 | maize\|10v1\|CD946231_P1 | 4627 | 768 | 87.4 | globlastp |
| 2906 | LYM410 | maize\|10v1\|AI855346_P1 | 4628 | 768 | 86.9 | globlastp |
| 2907 | LYM441 | maize\|10v1\|AI734556_P1 | 4629 | 771 | 91 | globlastp |
| 2908 | LYM441 | maize\|gb170\|AI734556 | 4630 | 771 | 90.9 | globlastp |
| 2909 | LYM445 | maize\|10v1\|AA979844_P1 | 4631 | 773 | 87.1 | globlastp |
| 2910 | LYM445 | millet\|10v1\|PMSLX0015877D1_P1 | 4632 | 773 | 83.8 | globlastp |
| 2911 | LYM445 | switchgrass\|gb167\|DN142436_P1 | 4633 | 773 | 82.7 | globlastp |
| 2912 | LYM463 | maize\|gb170\|AI739812 | 4634 | 776 | 95.1 | globlastp |
| 2913 | LYM463 | maize\|10v1\|AI739812_P1 | 4635 | 776 | 95 | globlastp |
| 2914 | LYM463 | maize\|10v1\|AI941779_P1 | 4636 | 776 | 93.6 | globlastp |
| 2915 | LYM463 | maize\|gb170\|AI941779 | 4636 | 776 | 93.6 | globlastp |
| 2916 | LYM463 | foxtail_millet\|10v2\|SICRP008195_T1 | 4637 | 776 | 89.76 | glotblastn |
| 2917 | LYM463 | rice\|gb170\|OS01G56910 | 4638 | 776 | 84.9 | globlastp |
| 2918 | LYM463 | brachypodium\|09v1\|DV473125_P1 | 4639 | 776 | 80.5 | globlastp |
| 2919 | LYM466 | maize\|10v1\|AW000428_P1 | 4640 | 778 | 94.6 | globlastp |
| 2920 | LYM466 | maize\|gb170\|AW000428 | 4641 | 778 | 94.4 | globlastp |
| 2921 | LYM466 | maize\|gb170\|AI783091 | 4642 | 778 | 93.4 | globlastp |
| 2922 | LYM466 | maize\|10v1\|AI783091_P1 | 4643 | 778 | 93 | globlastp |
| 2923 | LYM466 | switchgrass\|gb167\|FL820161 | 4644 | 778 | 91.9 | globlastp |
| 2924 | LYM466 | millet\|10v1\|EVO454PM002550_P1 | 4645 | 778 | 91.1 | globlastp |
| 2925 | LYM466 | switchgrass\|gb167\|FE655508 | 4646 | 778 | 90.9 | globlastp |
| 2926 | LYM466 | millet\|09v1\|EVO454PM002550 | 4647 | 778 | 84.1 | globlastp |
| 2927 | LYM466 | barley\|10v2\|BF623940_P1 | 4648 | 778 | 80.6 | globlastp |
| 2928 | LYM466 | wheat\|10v2\|BE404667_P1 | 4649 | 778 | 80.6 | globlastp |
| 2929 | LYM466 | wheat\|gb164\|BE404667 | 4649 | 778 | 80.6 | globlastp |
| 2930 | LYM475 | sugarcane\|gb157.3\|BQ536199 | 4650 | 781 | 91.8 | globlastp |
| 2931 | LYM475 | sugarcane\|10v1\|BQ536199_P1 | 4651 | 781 | 91.8 | globlastp |
| 2932 | LYM475 | sugarcane\|gb157.3\|CA156864 | 4652 | 781 | 90.25 | glotblastn |
| 2933 | LYM475 | maize\|10v1\|CO445714_P1 | 4653 | 781 | 84.3 | globlastp |
| 2934 | LYM475 | maize\|10v1\|DR823853_P1 | 4654 | 781 | 81.6 | globlastp |
| 2935 | LYM475 | maize\|10v1\|EU956996_P1 | 4654 | 781 | 81.6 | globlastp |
| 2936 | LYM475 | millet\|10v1\|CD724611_P1 | 4655 | 781 | 80.9 | globlastp |
| 2937 | LYM488 | maize\|10v1\|CB334691_P1 | 4656 | 784 | 93.2 | globlastp |
| 2938 | LYM488 | maize\|gb170\|CB334691 | 4656 | 784 | 93.2 | globlastp |
| 2939 | LYM496 | sugarcane\|10v1\|CA081211_P1 | 4657 | 786 | 93.7 | globlastp |
| 2940 | LYM496 | maize\|10v1\|AI600771_P1 | 4658 | 786 | 92.1 | globlastp |
| 2941 | LYM496 | maize\|gb170\|AI600771 | 4658 | 786 | 92.1 | globlastp |
| 2942 | LYM496 | switchgrass\|gb167\|FE633056 | 4659 | 786 | 88.3 | globlastp |
| 2943 | LYM496 | sugarcane\|gb157.3\|CA081211 | 4660 | 786 | 86.49 | glotblastn |
| 2944 | LYM496 | millet\|10v1\|EVO454PM005492_P1 | 4661 | 786 | 86.4 | globlastp |
| 2945 | LYM496 | foxtail_millet\|10v2\|SICRP031778_T1 | 4662 | 786 | 84.17 | glotblastn |
| 2946 | LYM397_H2 | maize\|10v1\|AI372372_T1 | 4663 | 792 | 93.25 | glotblastn |

Table 2: Provided are the homologous polypeptides and polynucleotides of the genes for increasing yield (e.g., oil yield, seed yield, fiber yield and/or quality), growth rate, vigor, biomass, abiotic stress tolerance, nitrogen use efficiency, water use efficiency and fertilizer use efficiency genes of a plant which are listed in Table 1 above.
Homology was calculated as % of identity over the aligned sequences.
The query sequences were polynucleotide sequences SEQ ID NOs: 1-288 and 289-480; and polypeptide SEQ ID NOs: 481-727, and 728-792 and the subject sequences are protein sequences identified in the database based on greater than 80% global identity to the predicted translated sequences of the query nucleotide sequences or to the polypeptide sequences.
"Nucl." = polynucleotide;
"polyp." = polypeptide;
"Algor." = algorithm (used for sequence alignment and determination of percent homology);
"Hom."—homology;
"iden."—identity.

The output of the functional genomics approach described herein is a set of genes highly predicted to improve yield and/or other agronomic important traits such as growth rate, vigor, oil content, fiber yield and/or quality, biomass, growth rate, abiotic stress tolerance, nitrogen use efficiency, water use efficiency and fertilizer use efficiency of a plant by increasing their expression. Although each gene is predicted to have its own impact, modifying the mode of expression of more than one gene is expected to provide an additive or synergistic effect on the plant yield and/or other agronomic important yields performance. Altering the expression of each gene described here alone or set of genes together increases the overall yield and/or other agronomic important traits, hence expects to increase agricultural productivity.

Example 3

Production of Barley Transcriptome and High Throughput Correlation Analysis Using 44K Barley Oligonucleotide Micro-Array In order to produce a high throughput correlation analysis, the present inventors utilized a Barley oligonucleotide microarray, produced by Agilent Technologies [Hypertext Transfer Protocol://World Wide Web (dot) chem. (dot) agilent (dot) com/Scripts/PDS (dot) asp?1Page=50879]. The array oligonucleotide represents about 47,500 Barley genes and transcripts. In order to define correlations between the levels of RNA expression and yield or vigor related parameters, various plant characteristics of 25 different Barley accessions were analyzed. Among them, 13 accessions encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

Five tissues at different developmental stages [meristem, flower, booting spike, stem, flag leaf], representing different plant characteristics, were sampled and RNA was extracted as described hereinabove under "GENERAL EXPERIMENTAL AND BIOINFORMATICS METHODS".

For convenience, each micro-array expression information tissue type has received a Set ID as summarized in Table 3 below.

TABLE 3

Barley transcriptome expression sets

| Expression Set | Set ID |
|---|---|
| Meristem | A |
| Flower | B |
| Booting spike | C |
| Stem | D |
| Flag leaf | E |

Table 3: Provided are the identification (ID) letters of each of the Barley expression sets.

Barley yield components and vigor related parameters assessment—13 Barley accessions in 4 repetitive blocks (named A, B, C, and D), each containing 4 plants per plot were grown at net house. Plants were phenotyped on a daily basis following the standard descriptor of barley (Table 4, below). Harvest was conducted while 50% of the spikes were dry to avoid spontaneous release of the seeds. Plants were separated to the vegetative part and spikes, of them, 5 spikes were threshed (grains were separated from the glumes) for additional grain analysis such as size measurement, grain count per spike and grain yield per spike. All material was oven dried and the seeds were threshed manually from the spikes prior to measurement of the seed characteristics (weight and size) using scanning and image analysis. The image analysis system included a personal desktop computer (Intel P4 3.0 GHz processor) and a public domain program—ImageJ 1.37 (Java based image processing program, which was developed at the U.S. National Institutes of Health and freely available on the internet [Hypertext Transfer Protocol://rsbweb (dot) nih (dot) gov/]. Next, analyzed data was saved to text files and processed using the JMP statistical analysis software (SAS institute).

TABLE 4

Barley standard descriptors

| Trait | Parameter | Range | Description |
|---|---|---|---|
| Growth habit | Scoring | 1-9 | Prostrate (1) or Erect (9) |
| Hairiness of basal leaves | Scoring | P (Presence)/ A (Absence) | Absence (1) or Presence (2) |
| Stem pigmentation | Scoring | 1-5 | Green (1), Basal only or Half or more (5) |
| Days to Flowering | Days | | Days from sowing to emergence of awns |
| Plant height | Centimeter (cm) | | Height from ground level to top of the longest spike excluding awns |
| Spikes per plant | Number | | Terminal Counting |
| Spike length | Centimeter (cm) | | Terminal Counting 5 spikes per plant |
| Grains per spike | Number | | Terminal Counting 5 spikes per plant |
| Vegetative dry weight | Gram | | Oven-dried for 48 hours at 70° C. |
| Spikes dry weight | Gram | | Oven-dried for 48 hours at 30° C. |

Table 4.

At the end of the experiment (50% of the spikes were dry) all spikes from plots within blocks A-D were collected, and the following measurements were performed:

(i) Grains per spike—The total number of grains from 5 spikes that were manually threshed was counted. The average grain per spike was calculated by dividing the total grain number by the number of spikes.

(ii) Grain average size (cm)—The total grains from 5 spikes that were manually threshed were scanned and images were analyzed using the digital imaging system. Grain scanning was done using Brother scanner (model DCP-135), at the 200 dpi resolution and analyzed with Image J software. The average grain size was calculated by dividing the total grain size by the total grain number.

(iii) Grain average weight (mgr)—The total grains from 5 spikes that were manually threshed were counted and weight. The average weight was calculated by dividing the total weight by the total grain number.

(iv) Grain yield per spike (gr)—The total grains from 5 spikes that were manually threshed were weight. The grain yield was calculated by dividing the total weight by the spike number.

(v) Spike length analysis—The five chosen spikes per plant were measured using measuring tape excluding the awns.

(vi) Spike number analysis—The spikes per plant were counted.

Additional parameters were measured as follows:

Growth habit scoring—At growth stage 10 (booting), each of the plants was scored for its growth habit nature. The scale that was used was 1 for prostate nature till 9 for erect.

Hairiness of basal leaves—At growth stage 5 (leaf sheath strongly erect; end of tillering), each of the plants was scored for its hairiness nature of the leaf before the last. The scale that was used was 1 for prostate nature till 9 for erect.

Plant height—At harvest stage (50% of spikes were dry), each of the plants was measured for its height using measuring tape. Height was measured from ground level to top of the longest spike excluding awns.

Days to flowering—Each of the plants was monitored for flowering date. Days of flowering was calculated from sowing date till flowering date.

Stem pigmentation—At growth stage 10 (booting), each of the plants was scored for its stem color. The scale that was used was 1 for green till 5 for full purple.

Vegetative dry weight and spike yield—At the end of the experiment (50% of the spikes were dry) all spikes and vegetative material from plots within blocks A-D are collected. The biomass and spikes weight of each plot was separated, measured and divided by the number of plants.

Dry weight=total weight of the vegetative portion above ground (excluding roots) after drying at 70° C. in oven for 48 hours;

Spike yield per plant=total spike weight per plant (gr) after drying at 30° C. in oven for 48 hours.

Harvest Index (for barley)—The harvest index is calculated using Formula V.

Harvest Index=Average spike dry weight per plant/
(Average vegetative dry weight per plant+Average spike dry weight per plant)    Formula V:

TABLE 5

Barley correlated parameters (vectors)

| Correlated parameter with (units) | Correlation Id |
|---|---|
| Grains per spike (numbers) | 1 |
| Grains size (mm$^2$) | 2 |
| Grain weight (miligrams) | 3 |
| Grain Yield per spike (gr/spike) | 4 |
| Spike length (cm) | 5 |
| Spikes per plant (numbers) | 6 |
| Growth habit (scores 1-9) | 7 |
| Hairiness of basal leaves (scoring 1-2) | 8 |
| Plant height (cm) | 9 |
| Days to flowering (days) | 10 |
| Stem pigmentation (scoring 1-5) | 11 |
| Vegetative dry weight (gram) | 12 |
| Harvest Index (ratio) | 13 |

Table 5. Provided are the Barley correlated parameters (vectors).

Experimental Results 13 different Barley accessions were grown and characterized for 13 parameters as described above. The average for each of the measured parameter was calculated using the JMP software and values are summarized in Tables 6 and 7 below. Subsequent correlation analysis between the various transcriptome expression sets (Table 3) and the average parameters, was conducted. Follow, results were integrated to the database (Table 8 below).

TABLE 6

Measured parameters of correlation Ids in Barley accessions

| Accession | Spikes per plant | Days to flowering | Grain weight | Spike length | Grains Size | Grains per spike | Growth habit |
|---|---|---|---|---|---|---|---|
| Amatzya | 48.85 | 62.40 | 35.05 | 12.04 | 0.27 | 20.23 | 2.60 |
| Ashqelon | 48.27 | 64.08 | 28.06 | 10.93 | 0.23 | 17.98 | 2.00 |
| Canada_park | 37.42 | 65.15 | 28.76 | 11.83 | 0.24 | 17.27 | 1.92 |
| Havarim_stream | 61.92 | 58.92 | 17.87 | 9.90 | 0.17 | 17.73 | 3.17 |
| Jordan_est | 33.27 | 63.00 | 41.22 | 11.68 | 0.29 | 14.47 | 4.33 |
| Klil | 41.69 | 70.54 | 29.73 | 11.53 | 0.28 | 16.78 | 2.69 |
| Maale_Efraim | ND | 52.80 | 25.22 | 8.86 | 0.22 | 13.47 | 3.60 |
| Mt_Arbel | 40.63 | 60.88 | 34.99 | 11.22 | 0.28 | 14.07 | 3.50 |
| Mt_Harif | 62.00 | 58.10 | 20.58 | 11.11 | 0.19 | 21.54 | 3.00 |
| Neomi | 49.33 | 53.00 | 27.50 | 8.58 | 0.22 | 12.10 | 3.67 |
| Neot_Kdumim | 50.60 | 60.40 | 37.13 | 10.18 | 0.27 | 14.36 | 2.47 |
| Oren_canyon | 43.09 | 64.58 | 29.56 | 10.51 | 0.27 | 15.28 | 3.50 |
| Yeruham | 51.40 | 56.00 | 19.58 | 9.80 | 0.18 | 17.07 | 3.00 |

Table 6. Provided are the values of each of the parameters measured in Barley accessions according to the following correlation identifications (Correlation Ids): 6 = Spikes per plant; 10 = Days to flowering; 3 = Grain weight; 5 = Spike length; 2 = Grains Size; 1 = Grains per spike; 7 = Growth habit.

TABLE 7

Barley accessions, additional measured parameters

| Accession | Hairiness of basal leaves | Plant height | Grain yield per spike | Stem pigmentation | Vegetative dry weight | Harvest Index |
|---|---|---|---|---|---|---|
| Amatzya | 1.53 | 134.27 | 3.56 | 1.13 | 78.87 | 0.45 |
| Ashqelon | 1.33 | 130.50 | 2.54 | 2.50 | 66.14 | 0.42 |
| Canada_park | 1.69 | 138.77 | 2.58 | 1.69 | 68.49 | 0.40 |
| Havarim_stream | 1.08 | 114.58 | 1.57 | 1.75 | 53.39 | 0.44 |
| Jordan_est | 1.42 | 127.75 | 3.03 | 2.33 | 68.30 | 0.43 |
| Klil | 1.69 | 129.38 | 2.52 | 2.31 | 74.17 | 0.40 |
| Maale_Efraim | 1.30 | 103.89 | 1.55 | 1.70 | 35.35 | 0.52 |
| Mt_Arbel | 1.19 | 121.63 | 2.62 | 2.19 | 58.33 | 0.48 |
| Mt_Harif | 1.00 | 126.80 | 2.30 | 2.30 | 62.23 | 0.44 |
| Neomi | 1.17 | 99.83 | 1.68 | 1.83 | 38.32 | 0.49 |
| Neot_Kdumim | 1.60 | 121.40 | 2.68 | 3.07 | 68.31 | 0.45 |
| Oren_canyon | 1.08 | 118.42 | 2.35 | 1.58 | 56.15 | ND |
| Yeruham | 1.17 | 117.17 | 1.67 | 2.17 | 42.68 | ND |

Table 7. Provided are the values of each of the parameters measured in Barley accessions according to the following correlation identifications (Correlation Ids): 8 = Hairiness of basal leaves; 9 = Plant height; 4 = Grain yield per spike; 11 = Stem pigmentation; 12 = Vegetative dry weight; 13 = Harvest Index.

TABLE 8

Correlation between the expression level of the selected polynucleotides of the invention and their homologues in specific tissues or developmental stages and the phenotypic performance across Barley ecotypes

| Gene Name | Exp. Set | Corr. Vector | R | P |
|---|---|---|---|---|
| LYM46 | B | 6 | 0.73 | 0.016 |
| LYM302 | D | 11 | 0.94 | 0.064 |
| LYM304 | D | 6 | 0.93 | 0.073 |
| LYM304 | C | 6 | 0.74 | 0.009 |
| LYM305 | D | 10 | 0.97 | 0.030 |
| LYM305 | D | 8 | 0.96 | 0.042 |
| LYM305 | D | 9 | 0.94 | 0.059 |

TABLE 8-continued

Correlation between the expression level of the selected polynucleotides of the invention and their homologues in specific tissues or developmental stages and the phenotypic performance across Barley ecotypes

| Gene Name | Exp. Set | Corr. Vector | R | P |
|---|---|---|---|---|
| LYM305 | C | 2 | 0.81 | 0.003 |
| LYM305 | C | 4 | 0.78 | 0.004 |
| LYM305 | C | 3 | 0.78 | 0.004 |
| LYM305 | C | 8 | 0.75 | 0.008 |
| LYM305 | A | 8 | 0.72 | 0.012 |
| LYM307 | A | 6 | 0.84 | 0.001 |
| LYM308 | B | 2 | 0.72 | 0.019 |
| LYM309 | B | 8 | 0.71 | 0.020 |
| LYM313 | D | 5 | 1.00 | 0.003 |
| LYM313 | D | 9 | 0.99 | 0.008 |
| LYM313 | D | 10 | 0.98 | 0.016 |
| LYM313 | D | 12 | 0.98 | 0.021 |
| LYM313 | D | 1 | 0.95 | 0.046 |
| LYM313 | D | 8 | 0.93 | 0.067 |
| LYM313 | D | 2 | 0.91 | 0.091 |
| LYM313 | D | 4 | 0.90 | 0.098 |
| LYM315 | D | 11 | 0.95 | 0.052 |
| LYM316 | D | 3 | 0.94 | 0.062 |
| LYM317 | D | 11 | 0.95 | 0.050 |
| LYM318 | D | 7 | 0.99 | 0.012 |
| LYM319 | D | 11 | 0.95 | 0.053 |
| LYM320 | D | 11 | 0.98 | 0.025 |
| LYM322 | D | 7 | 0.96 | 0.042 |
| LYM324 | C | 6 | 0.74 | 0.010 |
| LYM324 | C | 1 | 0.71 | 0.015 |
| LYM326 | D | 2 | 0.99 | 0.007 |
| LYM326 | D | 1 | 0.99 | 0.010 |
| LYM326 | D | 12 | 0.99 | 0.011 |
| LYM326 | D | 4 | 0.99 | 0.011 |
| LYM326 | D | 5 | 0.94 | 0.056 |
| LYM326 | D | 3 | 0.94 | 0.065 |
| LYM328 | D | 8 | 0.96 | 0.040 |
| LYM328 | D | 10 | 0.92 | 0.084 |
| LYM330 | D | 12 | 1.00 | 0.001 |
| LYM330 | D | 1 | 0.99 | 0.005 |
| LYM330 | D | 5 | 0.98 | 0.017 |
| LYM330 | D | 2 | 0.98 | 0.024 |
| LYM330 | D | 4 | 0.97 | 0.028 |
| LYM330 | D | 9 | 0.95 | 0.050 |
| LYM330 | D | 10 | 0.93 | 0.073 |
| LYM330 | A | 3 | 0.84 | 0.001 |
| LYM330 | A | 2 | 0.82 | 0.002 |
| LYM330 | C | 8 | 0.72 | 0.013 |
| LYM333 | D | 1 | 0.98 | 0.018 |
| LYM333 | D | 4 | 0.96 | 0.038 |
| LYM333 | D | 12 | 0.96 | 0.038 |
| LYM333 | D | 2 | 0.96 | 0.043 |
| LYM333 | D | 5 | 0.95 | 0.046 |
| LYM333 | D | 9 | 0.91 | 0.089 |
| LYM334 | D | 2 | 0.99 | 0.007 |
| LYM334 | D | 4 | 0.99 | 0.012 |
| LYM334 | D | 1 | 0.98 | 0.018 |
| LYM334 | D | 12 | 0.98 | 0.020 |
| LYM334 | D | 3 | 0.95 | 0.050 |
| LYM334 | D | 5 | 0.92 | 0.076 |
| LYM336 | D | 3 | 0.98 | 0.019 |
| LYM336 | D | 2 | 0.92 | 0.083 |
| LYM336 | D | 4 | 0.91 | 0.088 |
| LYM336 | C | 2 | 0.86 | 0.001 |
| LYM336 | C | 3 | 0.85 | 0.001 |
| LYM336 | B | 2 | 0.73 | 0.016 |
| LYM336 | A | 2 | 0.73 | 0.011 |
| LYM337 | D | 8 | 0.92 | 0.078 |
| LYM337 | B | 8 | 0.86 | 0.001 |
| LYM337 | A | 3 | 0.84 | 0.001 |
| LYM337 | A | 2 | 0.81 | 0.003 |
| LYM337 | A | 8 | 0.78 | 0.004 |
| LYM337 | A | 4 | 0.70 | 0.016 |
| LYM338 | B | 6 | 0.80 | 0.006 |
| LYM338 | C | 6 | 0.78 | 0.004 |
| LYM338 | A | 6 | 0.70 | 0.016 |
| LYM311 | D | 7 | 0.92 | 0.079 |
| LYM311 | C | 3 | 0.84 | 0.001 |
| LYM311 | C | 2 | 0.81 | 0.003 |
| LYM311 | C | 4 | 0.73 | 0.011 |
| LYM325 | D | 1 | 0.98 | 0.020 |
| LYM325 | D | 12 | 0.96 | 0.040 |
| LYM325 | D | 4 | 0.96 | 0.042 |
| LYM325 | D | 5 | 0.95 | 0.045 |
| LYM325 | D | 2 | 0.95 | 0.047 |
| LYM325 | D | 9 | 0.91 | 0.087 |
| LYM325 | A | 2 | 0.91 | 0.000 |
| LYM325 | A | 3 | 0.83 | 0.002 |
| LYM325 | A | 10 | 0.78 | 0.004 |
| LYM325 | A | 4 | 0.71 | 0.014 |
| LYM346_H8 | A | 2 | 0.73 | 0.011 |
| LYM361_H12 | A | 2 | 0.87 | 0.001 |
| LYM361_H12 | A | 3 | 0.84 | 0.001 |
| LYM361_H12 | A | 4 | 0.74 | 0.009 |
| LYM363_H5 | D | 5 | 0.94 | 0.063 |
| LYM363_H5 | D | 9 | 0.92 | 0.082 |
| LYM363_H5 | D | 1 | 0.92 | 0.084 |
| LYM363_H5 | D | 12 | 0.90 | 0.100 |
| LYM363_H5 | C | 8 | 0.73 | 0.011 |
| LYM363_H5 | A | 8 | 0.73 | 0.011 |
| LYM376_H6 | D | 1 | 0.97 | 0.028 |
| LYM376_H6 | D | 5 | 0.97 | 0.030 |
| LYM376_H6 | D | 12 | 0.96 | 0.040 |
| LYM376_H6 | D | 9 | 0.94 | 0.061 |
| LYM376_H6 | D | 4 | 0.94 | 0.061 |
| LYM376_H6 | D | 2 | 0.93 | 0.065 |
| LYM388_H14 | D | 6 | 0.93 | 0.074 |
| LYM395_H3 | D | 6 | 0.91 | 0.093 |
| LYM404_H27 | A | 4 | 0.85 | 0.001 |
| LYM404_H27 | A | 5 | 0.80 | 0.003 |
| LYM404_H27 | A | 12 | 0.75 | 0.008 |
| LYM404_H30 | A | 4 | 0.86 | 0.001 |
| LYM404_H30 | A | 3 | 0.83 | 0.002 |
| LYM404_H30 | A | 12 | 0.80 | 0.003 |
| LYM404_H30 | A | 2 | 0.74 | 0.009 |
| LYM404_H37 | A | 4 | 0.89 | 0.000 |
| LYM404_H37 | A | 12 | 0.79 | 0.004 |
| LYM404_H47 | A | 4 | 0.71 | 0.015 |
| LYM404_H53 | A | 4 | 0.71 | 0.014 |
| LYM418_H15 | D | 7 | 0.94 | 0.060 |
| LYM437_H8 | D | 11 | 0.99 | 0.009 |
| LYM454_H4 | D | 3 | 0.95 | 0.048 |
| LYM454_H4 | A | 6 | 0.77 | 0.005 |
| LYM487_H18 | A | 6 | 0.74 | 0.009 |
| LYM510_H1 | D | 5 | 1.00 | 0.002 |
| LYM510_H1 | D | 12 | 0.99 | 0.011 |
| LYM510_H1 | D | 9 | 0.99 | 0.015 |
| LYM510_H1 | D | 10 | 0.97 | 0.028 |
| LYM510_H1 | D | 1 | 0.97 | 0.030 |
| LYM510_H1 | D | 2 | 0.93 | 0.068 |
| LYM510_H1 | D | 4 | 0.93 | 0.074 |
| LYM510_H1 | D | 8 | 0.91 | 0.086 |
| LYM510_H1 | A | 2 | 0.75 | 0.008 |
| LYM510_H1 | C | 10 | 0.71 | 0.015 |

Table 8. Provided are the correlations (R) and p-values (P) between the expression levels of selected genes of some embodiments of the invention in various tissues or developmental stages (Expression sets) and the phenotypic performance in various yield (seed yield, oil yield, oil content), biomass, growth rate and/or vigor components [Correlation (Corr.) vector (Vec.) Expression (Exp.)] Corr. Vector = correlation vector specified in Tables 5, 6 and 7; Exp. Set = expression set specified in Table 3.

Example 4

Production of *Arabidopsis* Transcriptome and High Throughput Correlation Analysis of Yield, Biomass and/or Vigor Related Parameters Using 44K *Arabidopsis* Full Genome Oligonucleotide Micro-Array To produce a high throughput correlation analysis, the present inventors utilized an *Arabidopsis thaliana* oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 40,000 *A. thaliana* genes and transcripts designed based on data from the TIGR ATH1 v.5 database and *Arabidopsis* MPSS (University of Delaware) databases. To define correlations between the levels of RNA expression and yield, biomass components or vigor related parameters, various plant characteristics of 15 different *Arabidopsis* ecotypes were analyzed. Among them, nine ecotypes encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

Five tissues at different developmental stages including root, leaf, flower at anthesis, seed at 5 days after flowering (DAF) and seed at 12 DAF, representing different plant characteristics, were sampled and RNA was extracted as described as described hereinabove under "GENERAL EXPERIMENTAL AND BIOINFORMATICS METHODS". For convenience, each micro-array expression information tissue type has received a Set ID as summarized in Table 9 below.

TABLE 9

Tissues used for *Arabidopsis* transcriptome expression sets

| Expression Set | Set ID |
| --- | --- |
| Root | A |
| Leaf | B |
| Flower | C |
| Seed 5 DAF | D |
| Seed 12 DAF | E |

Table 9: Provided are the identification (ID) letters of each of the *Arabidopsis* expression sets (A-E). DAF = days after flowering.

Yield components and vigor related parameters assessment—eight out of the nine *Arabidopsis* ecotypes were used in each of 5 repetitive blocks (named A, B, C, D and E), each containing 20 plants per plot. The plants were grown in a greenhouse at controlled conditions in 22° C., and the N:P:K fertilizer (20:20:20; weight ratios) [nitrogen (N), phosphorus (P) and potassium (K)] was added. During this time data was collected, documented and analyzed. Additional data was collected through the seedling stage of plants grown in a tissue culture in vertical grown transparent agar plates. Most of chosen parameters were analyzed by digital imaging.

Digital imaging in Tissue culture—A laboratory image acquisition system was used for capturing images of plantlets sawn in square agar plates. The image acquisition system consists of a digital reflex camera (Canon EOS 300D) attached to a 55 mm focal length lens (Canon EF-S series), mounted on a reproduction device (Kaiser RS), which included 4 light units (4×150 Watts light bulb) and located in a darkroom.

Digital imaging in Greenhouse—The image capturing process was repeated every 3-4 days starting at day 7 till day 30. The same camera attached to a 24 mm focal length lens (Canon EF series), placed in a custom made iron mount, was used for capturing images of larger plants sawn in white tubs in an environmental controlled greenhouse. The white tubs were square shape with measurements of 36×26.2 cm and 7.5 cm deep. During the capture process, the tubs were placed beneath the iron mount, while avoiding direct sun light and casting of shadows. This process was repeated every 3-4 days for up to 30 days.

An image analysis system was used, which consists of a personal desktop computer (Intel P4 3.0 GHz processor) and a public domain program—ImageJ 1.37, Java based image processing program, which was developed at the U.S National Institutes of Health and is freely available on the internet at Hypertext Transfer Protocol://rsbweb (dot) nih (dot) gov/. Images were captured in resolution of 6 Mega Pixels (3072×2048 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, area, perimeter, length and width. On day 30, 3-4 representative plants were chosen from each plot of blocks A, B and C. The plants were dissected, each leaf was separated and was introduced between two glass trays, a photo of each plant was taken and the various parameters (such as leaf total area, laminar length etc.) were calculated from the images. The blade circularity was calculated as laminar width divided by laminar length.

Root analysis—During 17 days, the different ecotypes were grown in transparent agar plates. The plates were photographed every 3 days starting at day 7 in the photography room and the roots development was documented (see examples in FIGS. 3A-F). The growth rate of roots was calculated according to Formula VI.

Formula VI: Relative growth rate of root coverage=Regression coefficient of root coverage along time course Vegetative growth rate analysis—was calculated according to Formula VII. The analysis was ended with the appearance of overlapping plants.

Formula VII: Relative vegetative growth rate area=Regression coefficient of vegetative area along time course.

For comparison between ecotypes the calculated rate was normalized using plant developmental stage as represented by the number of true leaves. In cases where plants with 8 leaves had been sampled twice (for example at day 10 and day 13), only the largest sample was chosen and added to the Anova comparison.

Seeds in siliques analysis—On day 70, 15-17 siliques were collected from each plot in blocks D and E. The chosen siliques were light brown color but still intact. The siliques were opened in the photography room and the seeds were scatter on a glass tray, a high resolution digital picture was taken for each plot. Using the images the number of seeds per silique was determined.

Seeds average weight—At the end of the experiment all seeds from plots of blocks A-C were collected. An average weight of 0.02 grams was measured from each sample, the seeds were scattered on a glass tray and a picture was taken. Using the digital analysis, the number of seeds in each sample was calculated.

Oil percentage in seeds—At the end of the experiment all seeds from plots of blocks A-C were collected. Columbia seeds from 3 plots were mixed grounded and then mounted onto the extraction chamber. 210 ml of n-Hexane (Cat No. 080951 Biolab Ltd.) were used as the solvent. The extraction was performed for 30 hours at medium heat 50° C. Once the extraction has ended the n-Hexane was evaporated using the evaporator at 35° C. and vacuum conditions. The process was repeated twice. The information gained from the Soxhlet extractor (Soxhlet, F. Die gewichtsanalytische Bestimmung des Milchfettes, Polytechnisches J. (Dingier's) 1879, 232, 461) was used to create a calibration curve for the Low Resonance NMR. The content of oil of all seed samples was determined using the Low Resonance NMR (MARAN Ultra—Oxford Instrument) and its MultiQuant sowftware package.

Silique length analysis—On day 50 from sowing, 30 siliques from different plants in each plot were sampled in block A. The chosen siliques were green-yellow in color and were collected from the bottom parts of a grown plant's stem. A digital photograph was taken to determine silique's length.

Dry weight and seed yield—On day 80 from sowing, the plants from blocks A-C were harvested and left to dry at 30° C. in a drying chamber. The biomass and seed weight of each plot was separated, measured and divided by the number of plants. Dry weight=total weight of the vegetative portion above ground (excluding roots) after drying at 30° C. in a drying chamber; Seed yield per plant=total seed weight per plant (gr).

Oil yield—The oil yield was calculated using Formula VIII.

Seed Oil yield=Seed yield per plant (gr)*Oil % in seed.     Formula VIII:

Harvest Index (seed)—The harvest index was calculated using Formula IV (described above): Harvest Index=Average seed yield per plant/Average dry weight.

Experimental Results

Nine different *Arabidopsis* ecotypes were grown and characterized for 18 parameters (named as vectors).

TABLE 10

*Arabidopsis* correlated parameters (vectors)

| Correlated parameter with | Correlation ID |
|---|---|
| Root length day 13 (cm) | 1 |
| Root length day 7 (cm) | 2 |
| Relative root growth (cm/day) day 13 | 3 |
| Fresh weight per plant (gr) at bolting stage | 4 |
| Dry matter per plant (gr) | 5 |
| Vegetative growth rate (cm$^2$/day) till 8 true leaves | 6 |
| Blade circularity | 7 |
| Lamina width (cm) | 8 |
| Lamina length (cm) | 9 |
| Total leaf area per plant (cm) | 10 |
| 1000 Seed weight (gr) | 11 |
| Oil % per seed | 12 |
| Seeds per silique | 13 |
| Silique length (cm) | 14 |
| Seed yield per plant (gr) | 15 |
| Oil yield per plant (mg) | 16 |
| Harvest Index | 17 |
| Leaf width/length | 18 |

Table 10. Provided are the *Arabidopsis* correlated parameters (correlation ID Nos. 1-18). Abbreviations: Cm = centimeter(s); gr = gram(s); mg = milligram(s).

The characterized values are summarized in Tables 11 and 12 below.

TABLE 11

Measured parameters in *Arabidopsis* ecotypes

| Ecotype | 15 | 16 | 12 | 11 | 5 | 17 | 10 | 13 | 14 |
|---|---|---|---|---|---|---|---|---|---|
| An-1 | 0.34 | 118.63 | 34.42 | 0.0203 | 0.64 | 0.53 | 46.86 | 45.44 | 1.06 |
| Col-0 | 0.44 | 138.73 | 31.19 | 0.0230 | 1.27 | 0.35 | 109.89 | 53.47 | 1.26 |
| Ct-1 | 0.59 | 224.06 | 38.05 | 0.0252 | 1.05 | 0.56 | 58.36 | 58.47 | 1.31 |
| Cvi (N8580) | 0.42 | 116.26 | 27.76 | 0.0344 | 1.28 | 0.33 | 56.80 | 35.27 | 1.47 |
| Gr-6 | 0.61 | 218.27 | 35.49 | 0.0202 | 1.69 | 0.37 | 114.66 | 48.56 | 1.24 |
| Kondara | 0.43 | 142.11 | 32.91 | 0.0263 | 1.34 | 0.32 | 110.82 | 37.00 | 1.09 |
| Ler-1 | 0.36 | 114.15 | 31.56 | 0.0205 | 0.81 | 0.45 | 88.49 | 39.38 | 1.18 |
| Mt-0 | 0.62 | 190.06 | 30.79 | 0.0226 | 1.21 | 0.51 | 121.79 | 40.53 | 1.18 |
| Shakdara | 0.55 | 187.62 | 34.02 | 0.0235 | 1.35 | 0.41 | 93.04 | 25.53 | 1.00 |

Table 11. Provided are the values of each of the parameters measured in *Arabidopsis* ecotypes: 15 = Seed yield per plant (gram); 16 = oil yield per plant (mg); 12 = oil % per seed; 11 = 1000 seed weight (gr); 5 = dry matter per plant (gr); 17 = harvest index; 10 = total leaf area per plant (cm); 13 = seeds per silique; 14 = Silique length (cm).

TABLE 12

Additional measured parameters in *Arabidopsis* ecotypes

| Ecotype | 6 | 3 | 2 | 1 | 4 | 9 | 8 | 18 | 7 |
|---|---|---|---|---|---|---|---|---|---|
| An-1 | 0.313 | 0.631 | 0.937 | 4.419 | 1.510 | 2.767 | 1.385 | 0.353 | 0.509 |
| Col-0 | 0.378 | 0.664 | 1.759 | 8.530 | 3.607 | 3.544 | 1.697 | 0.288 | 0.481 |
| Ct-1 | 0.484 | 1.176 | 0.701 | 5.621 | 1.935 | 3.274 | 1.460 | 0.316 | 0.450 |
| Cvi (N8580) | 0.474 | 1.089 | 0.728 | 4.834 | 2.082 | 3.785 | 1.374 | 0.258 | 0.370 |
| Gr-6 | 0.425 | 0.907 | 0.991 | 5.957 | 3.556 | 3.690 | 1.828 | 0.356 | 0.501 |
| Kondara | 0.645 | 0.774 | 1.163 | 6.372 | 4.338 | 4.597 | 1.650 | 0.273 | 0.376 |
| Ler-1 | 0.430 | 0.606 | 1.284 | 5.649 | 3.467 | 3.877 | 1.510 | 0.305 | 0.394 |

TABLE 12-continued

Additional measured parameters in *Arabidopsis* ecotypes

| Ecotype | 6 | 3 | 2 | 1 | 4 | 9 | 8 | 18 | 7 |
|---|---|---|---|---|---|---|---|---|---|
| Mt-0 | 0.384 | 0.701 | 1.414 | 7.060 | 3.479 | 3.717 | 1.817 | 0.335 | 0.491 |
| Shakdara | 0.471 | 0.782 | 1.251 | 7.041 | 3.710 | 4.149 | 1.668 | 0.307 | 0.409 |

Table 12. Provided are the values of each of the parameters measured in *Arabidopsis* ecotypes: 6 = Vegetative growth rate (cm$^2$/day) until 8 true leaves; 3 = relative root growth (cm/day) (day 13); 2 = Root length day 7 (cm); 1 = Root length day 13 (cm); 4 = fresh weight per plant (gr) at bolting stage; 9. = Lamima length (cm); 8 = Lamina width (cm); 18 = Leaf width/length; 7 = Blade circularity.

Table 13, below, provides genes of some embodiments of the invention, the characterized parameters (which are used as x axis for correlation) and the correlated tissue transcriptome along with the correlation value (R, calculated using Pearson correlation). When the correlation coefficient (R) between the levels of a gene's expression in a certain tissue and a phenotypic performance across ecotypes is high in absolute value (between 0.5-1), there is an association between the gene (specifically the expression level of this gene) and the phenotypic character.

TABLE 13

Correlation between the expression level of selected genes in specific tissues or developmental stages and the phenotypic performance across *Arabidopsis* ecotypes

| Gene Name | Expression Set | Correlation Vector | R | P |
|---|---|---|---|---|
| LYM297 | C | 1 | 0.77 | 0.024 |
| LYM297 | C | 2 | 0.77 | 0.025 |
| LYM297 | D | 2 | 0.74 | 0.056 |
| LYM298 | C | 9 | 0.73 | 0.038 |
| LYM307_H13 | D | 17 | 0.84 | 0.017 |
| LYM307_H13 | B | 16 | 0.84 | 0.009 |
| LYM307_H13 | B | 15 | 0.83 | 0.012 |
| LYM307_H13 | B | 8 | 0.80 | 0.017 |
| LYM316_H35 | D | 17 | 0.76 | 0.047 |
| LYM316_H35 | C | 8 | 0.75 | 0.031 |
| LYM316_H44 | B | 13 | 0.70 | 0.051 |
| LYM321_H23 | D | 2 | 0.90 | 0.006 |
| LYM321_H23 | D | 1 | 0.83 | 0.021 |
| LYM321_H23 | C | 9 | 0.71 | 0.048 |
| LYM361_H99 | B | 6 | 0.86 | 0.006 |
| LYM361_H99 | D | 6 | 0.85 | 0.014 |
| LYM361_H99 | D | 9 | 0.84 | 0.018 |
| LYM361_H99 | D | 4 | 0.74 | 0.058 |
| LYM418_H99 | D | 3 | 0.90 | 0.006 |
| LYM418_H99 | C | 3 | 0.77 | 0.026 |
| LYM418_H99 | D | 12 | 0.75 | 0.051 |
| LYM418_H99 | B | 3 | 0.74 | 0.035 |
| LYM418_H99 | E | 12 | 0.70 | 0.053 |

Table 13. Provided are the correlations between the expression level of yield improving genes and their homologues in specific tissues or developmental stages (expression sets) and the phenotypic performance (correlation vector) across *Arabidopsis* ecotypes. The phenotypic characters [correlation (Corr.) vector (Vec.)] include yield (seed yield, oil yield, oil content), biomass, growth rate and/or vigor components as described in Tables 10-12. Exp. Set = expression set according to Table 9 hereinabove.

Example 5

Production of *Arabidopsis* Transcriptome and High Throughput Correlation Analysis of Normal and Nitrogen Limiting Conditions Using 44K *Arabidopsis* Oligonucleotide Micro-Array In order to produce a high throughput correlation analysis, the present inventors utilized a *Arabidopsis* oligonucleotide micro-array, produced by Agilent Technologies [Hypertext Transfer Protocol://World Wide Web (dot) chem (dot) agilent (dot) com/Scripts/PDS (dot) asp?1Page=50879]. The array oligonucleotide represents about 44,000 *Arabidopsis* genes and transcripts. To define correlations between the levels of RNA expression with NUE, yield components or vigor related parameters various plant characteristics of 14 different *Arabidopsis* ecotypes were analyzed. Among them, ten ecotypes encompassing the observed variance were selected for RNA expression analysis. The correlation between the RNA levels and the characterized parameters was analyzed using Pearson correlation test [Hypertext Transfer Protocol:// World Wide Web (dot) davidmlane (dot) com/hyperstat/ A34739 (dot) html].

Experimental Procedures

Two tissues of plants [leaves and stems] growing at two different nitrogen fertilization levels (1.5 mM Nitrogen or 6 mM Nitrogen) were sampled and RNA was extracted as described hereinabove under "GENERAL EXPERIMENTAL AND BIOINFORMATICS METHODS". For convenience, each micro-array expression information tissue type has received a Set ID as summarized in Table 14 below.

TABLE 14

Tissues used for *Arabidopsis* transcriptome expression sets

| Expression Set | Set ID |
|---|---|
| Leaves at 1.5 mM Nitrogen fertilization | A |
| Leaves at 6 mM Nitrogen fertilization | B |
| Stems at 1.5 mM Nitrogen fertilization | C |
| Stem at 6 mM Nitrogen fertilization | D |

Table 14: Provided are the identification (ID) letters of each of the *Arabidopsis* expression sets.

Assessment of *Arabidopsis* yield components and vigor related parameters under different nitrogen fertilization levels—10 *Arabidopsis* accessions in 2 repetitive plots each containing 8 plants per plot were grown at greenhouse. The growing protocol used was as follows: surface sterilized seeds were sown in Eppendorf Tubes® (Eppendorf Group) containing 0.5× Murashige-Skoog basal salt medium and grown at 23° C. under 12-hour light and 12-hour dark daily cycles for 10 days. Then, seedlings of similar size were carefully transferred to pots filled with a mix of perlite and peat in a 1:1 ratio. Constant nitrogen limiting conditions were achieved by irrigating the plants with a solution containing 1.5 mM inorganic nitrogen in the form of $KNO_3$, supplemented with 2 mM $CaCl_2$, 1.25 mM $KH_2PO_4$, 1.50 mM $MgSO_4$, 5 mM KCl, 0.01 mM $H_3BO_3$ and microelements, while normal irrigation conditions (Normal Nitrogen conditions) was achieved by applying a solution of 6 mM inorganic nitrogen also in the form of $KNO_3$, supplemented with 2 mM $CaCl_2$, 1.25 mM $KH_2PO_4$, 1.50 mM $MgSO_4$, 0.01 mM $H_3BO_3$ and microelements. To follow plant growth, trays were photographed the day nitrogen limiting conditions were initiated and subsequently every 3 days for about 15 additional days. Rosette plant area was then determined from the digital pictures. ImageJ software was used for quantifying the plant size from the digital pictures [Hypertext Transfer Protocol://rsb (dot) info (dot) nih (dot) gov/ij/] utilizing proprietary scripts designed to analyze the size of rosette area from individual plants as a function of time. The image analysis system included a personal desktop computer (Intel P4 3.0 GHz processor) and a public domain program—ImageJ 1.37 (Java based image processing program, which was developed at the U.S. National Institutes of Health and freely available on the internet [Hypertext Transfer Protocol://rsbweb (dot) nih (dot) gov/]. Next, analyzed data was saved to text files and processed using the JMP statistical analysis software (SAS institute).

Data parameters collected are summarized in Table 15, hereinbelow.

TABLE 15

*Arabidopsis* correlated parameters (vectors)

| Correlated parameter with | Correlation Id |
|---|---|
| N 1.5 mM; Rosette Area at day 8 [cm$^2$] | 1 |
| N 1.5 mM; Rosette Area at day 10 [cm$^2$] | 2 |
| N 1.5 mM; Plot Coverage at day 8 [%] | 3 |
| N 1.5 mM; Plot Coverage at day 10 [%] | 4 |
| N 1.5 mM; Leaf Number at day 10 | 5 |
| N 1.5 mM; Leaf Blade Area at day 10 [cm$^2$] | 6 |
| N 1.5 mM; RGR of Rosette Area at day 3 [cm$^2$/day] | 7 |
| N 1.5 mM; t50 Flowering [day] | 8 |
| N 1.5 mM; Dry Weight [gr/plant] | 9 |
| N 1.5 mM; Seed Yield [gr/plant] | 10 |
| N 1.5 mM; Harvest Index | 11 |
| N 1.5 mM; 1000 Seeds weight [gr] | 12 |
| N 1.5 mM; seed yield/rosette area at day 10 [gr/cm$^2$] | 13 |
| N 1.5 mM; seed yield/leaf blade [gr/cm$^2$] | 14 |
| N 1.5 mM; % Seed yield reduction compared to N 6 mM | 15 |
| N 1.5 mM; % Biomass reduction compared to N 6 mM | 16 |
| N 1.5 mM; N level/DW [SPAD® (KONICA MINOLTA SENSING, INC.) unit/gr] | 17 |
| N 1.5 mM; DW/N level [gr/SPAD® unit] | 18 |
| N 1.5 mM; seed yield/N level [gr/SPAD® unit] | 19 |
| N 6 mM; Rosette Area at day 8 [cm$^2$] | 20 |
| N 6 mM; Rosette Area at day 10 [cm$^2$] | 21 |
| N 6 mM; Plot Coverage at day 8 [%] | 22 |
| N 6 mM; Plot Coverage at day 10 [%] | 23 |
| N 6 mM; Leaf Number at day 10 | 24 |
| N 6 mM; Leaf Blade Area at day 10 | 25 |
| N 6 mM; RGR of Rosette Area at day 3 [cm$^2$/gr] | 26 |
| N 6 mM; t50 Flowering [day] | 27 |
| N 6 mM; Dry Weight [gr/plant] | 28 |
| N 6 mM; Seed Yield [gr/plant] | 29 |
| N 6 mM; Harvest Index | 30 |
| N 6 mM; 1000 Seeds weight [gr] | 31 |
| N 6 mM; seed yield/rosette area day at day 10 [gr/cm$^2$] | 32 |
| N 6 mM; seed yield/leaf blade [gr/cm$^2$] | 33 |
| N 6 mM; N level/FW | 34 |
| N 6 mM; DW/N level [gr/SPAD® unit] | 35 |
| N 6 mM; N level/DW (SPAD® unit/gr plant) | 36 |
| N 6 mM; Seed yield/N unit [gr/SPAD® unit] | 37 |

Table 15. Provided are the *Arabidopsis* correlated parameters (vectors). "N" = Nitrogen at the noted concentrations; "gr." = grams; "SPAD®" = chlorophyll levels; "t50" = time where 50% of plants flowered; "gr/SPAD® unit" = plant biomass expressed in grams per unit of nitrogen in plant measured by SPAD®. "DW" = Plant Dry Weight; "FW" = Plant Fresh weight; "N level/DW" = plant Nitrogen level measured in SPAD® unit per plant biomass [gr]; "DW/N level" = plant biomass per plant [gr]/SPAD® unit; Rosette Area (measured using digital analysis); Plot Coverage at the indicated day [%] (calculated by the dividing the total plant area with the total plot area); Leaf Blade Area at the indicated day [cm$^2$] (measured using digital analysis); RGR (relative growth rate) of Rosette Area at the indicated day [cm$^2$/day]; t50 Flowering [day] (the day in which 50% of plant flower); seed yield/rosette area at day 10 [gr/cm$^2$] (calculated); seed yield/leaf blade [gr/cm$^2$] (calculated); seed yield/N level [gr/SPAD® unit] (calculated).

Assessment of NUE, yield components and vigor-related parameters—Ten *Arabidopsis* ecotypes were grown in trays, each containing 8 plants per plot, in a greenhouse with controlled temperature conditions for about 12 weeks. Plants were irrigated with different nitrogen concentration as described above depending on the treatment applied. During this time, data was collected documented and analyzed. Most of chosen parameters were analyzed by digital imaging.

Digital imaging—Greenhouse Assay

An image acquisition system, which consists of a digital reflex camera (Canon EOS 400D) attached with a 55 mm focal length lens (Canon EF-S series) placed in a custom made Aluminum mount, was used for capturing images of plants planted in containers within an environmental controlled greenhouse. The image capturing process is repeated every 2-3 days starting at day 9-12 till day 16-19 (respectively) from transplanting.

The image processing system which was used is described in Example 4 above. Images were captured in resolution of 10 Mega Pixels (3888×2592 pixels) and stored in a low compression JPEG (Joint Photographic Experts Group standard) format. Next, image processing output data was saved to text files and analyzed using the JMP statistical analysis software (SAS institute).

Leaf analysis—Using the digital analysis leaves data was calculated, including leaf number, leaf blade area, plot coverage, Rosette diameter and Rosette area.

Relative growth rate area: The relative growth rate area of the rosette and the leaves was calculated according to Formulas XII and XIV, respectively.

Seed yield and 1000 seeds weight—At the end of the experiment all seeds from all plots were collected and weighed in order to measure seed yield per plant in terms of total seed weight per plant (gr). For the calculation of 1000 seed weight, an average weight of 0.02 grams was measured from each sample, the seeds were scattered on a glass tray and a picture was taken. Using the digital analysis, the number of seeds in each sample was calculated.

Dry weight and seed yield—At the end of the experiment, plant were harvested and left to dry at 30° C. in a drying chamber. The biomass was separated from the seeds, weighed and divided by the number of plants. Dry weight=total weight of the vegetative portion above ground (excluding roots) after drying at 30° C. in a drying chamber.

Harvest Index (seed)—The harvest index was calculated using Formula IV as described above [Harvest Index=Average seed yield per plant/Average dry weight].

$T_{50}$ days to flowering—Each of the repeats was monitored for flowering date. Days of flowering was calculated from sowing date till 50% of the plots flowered.

Plant nitrogen level—The chlorophyll content of leaves is a good indicator of the nitrogen plant status since the degree of leaf greenness is highly correlated to this parameter. Chlorophyll content was determined using a Minolta SPAD® 502 chlorophyll meter and measurement was performed at time of flowering. SPAD® meter readings were done on young fully developed leaf. Three measurements per leaf were taken per plot. Based on this measurement, parameters such as the ratio between seed yield per nitrogen unit [seed yield/N level=seed yield per plant [gr]/SPAD® unit], plant DW per nitrogen unit [DW/N level=plant biomass per plant [g]/SPAD® unit], and nitrogen level per gram of biomass [N level/DW=SPAD® unit/plant biomass per plant (gr)] were calculated.

Percent of seed yield reduction—measures the amount of seeds obtained in plants when grown under nitrogen-limiting conditions compared to seed yield produced at normal nitrogen levels expressed in %.

Experimental Results 10 different *Arabidopsis* accessions (ecotypes) were grown and characterized for 37 parameters as described above. The average for each of the measured parameters was calculated using the JMP software. Subsequent correlation analysis between the various transcriptome sets (Table 14) was conducted. Following are the results integrated to the database.

TABLE 16

Correlation between the expression level of selected genes of the invention and their homologs in tissues under limiting or normal nitrogen fertilization and the phenotypic performance across Arabidopsis ecotypes

| Gene Name | Probe Name | Expression Set | Correlation Vector | R | P |
|---|---|---|---|---|---|
| LYM298 | A_84_P21158 | B | 3 | 0.87 | 0.001 |
| LYM298 | A_84_P21158 | B | 32 | 0.87 | 0.001 |
| LYM298 | A_84_P21158 | A | 18 | 0.82 | 0.087 |
| LYM298 | A_84_P21158 | B | 6 | 0.79 | 0.006 |
| LYM299 | A_84_P816172 | D | 18 | 0.93 | 0.072 |
| LYM299 | A_84_P816172 | A | 18 | 0.91 | 0.031 |
| LYM299 | A_84_P816172 | C | 18 | 0.91 | 0.032 |
| LYM299 | A_84_P127351 | B | 18 | 0.88 | 0.049 |
| LYM299 | A_84_P127351 | A | 18 | 0.85 | 0.070 |
| LYM299 | A_84_P127351 | A | 12 | 0.78 | 0.008 |
| LYM299 | A_84_P816172 | B | 12 | 0.77 | 0.009 |
| LYM299 | A_84_P127351 | B | 12 | 0.77 | 0.009 |
| LYM307_H13 | A_84_P134635 | C | 18 | 0.92 | 0.027 |
| LYM307_H13 | A_84_P827334 | C | 18 | 0.86 | 0.061 |
| LYM307_H13 | A_84_P827334 | B | 15 | 0.77 | 0.009 |
| LYM316_H35 | A_84_P19774 | A | 35 | 0.86 | 0.060 |
| LYM316_H44 | A_84_P17479 | D | 15 | 0.78 | 0.012 |
| LYM321_H23 | A_84_P21615 | C | 8 | 0.70 | 0.024 |
| LYM321_H24 | A_84_P853745 | C | 35 | 0.95 | 0.015 |
| LYM321_H24 | A_84_P19280 | B | 15 | 0.75 | 0.012 |
| LYM321_H24 | A_84_P19280 | C | 8 | 0.73 | 0.017 |
| LYM321_H24 | A_84_P853745 | C | 9 | 0.70 | 0.024 |
| LYM361_H99 | A_84_P16660 | B | 18 | 0.90 | 0.036 |
| LYM418_H99 | A_84_P591526 | C | 18 | 0.81 | 0.097 |
| LYM418_H138 | A_84_P21797 | D | 35 | 0.96 | 0.042 |
| LYM418_H138 | A_84_P21797 | A | 17 | 0.91 | 0.031 |

Table 16. Provided are the correlations (R) between the expression levels of yield improving genes and their homologs in tissues (leaves or stems) under limiting (1.5 mM Nitrogen) or normal (6 mM Nitrogen) conditions (Expression sets) and the phenotypic performance in various yield (seed yield, oil yield, oil content), biomass, growth rate and/or vigor components [Correlation (Corr.) vector (Vec.)] under limiting or normal Nitrogen conditions. Corr. Vec. = correlation vector according to Table 15 hereinabove; Exp. Set = expression set according to Table 14 hereinabove. P = p value.

Example 6

Production of Sorghum Transcriptome and High Throughput Correlation Analysis with ABST Related Parameters Using 44K Sorghum Oligonucleotide Micro-Arrays In order to produce a high throughput correlation analysis, the present inventors utilized a Sorghum oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 44,000 Sorghum genes and transcripts. In order to define correlations between the levels of RNA expression with ABST and yield components or vigor related parameters, various plant characteristics of 17 different sorghum varieties were analyzed. Among them, 10 varieties encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Correlation of Sorghum Varieties Across Ecotype Grown Under Severe Drought Conditions Experimental Procedures 17 Sorghum varieties were grown in 3 repetitive plots in the field. Briefly, the growing protocol was as follows: sorghum seeds were sown in soil and grown under normal condition until around 35 days from sowing, around V8 (Last leaf visible, but still rolled up, ear beginning to swell). At this point, irrigation was stopped, and severe drought stress was developed. In order to define correlations between the levels of RNA expression with drought, yield components or vigor related parameters, the 17 different sorghum varieties were analyzed. Among them, 10 varieties encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

All 10 selected Sorghum varieties were sample per each treatment. Plant tissues [Flag leaf, Flower meristem and Flower] growing under severe drought stress and plants grown under Normal conditions were sampled and RNA was extracted as described hereinabove under "GENERAL EXPERIMENTAL AND BIOINFORMATICS METHODS". For convenience, each micro-array expression information tissue type has received a Set ID as summarized in Table 17 below.

TABLE 17

Sorghum transcriptome expression sets

| Expression Set | Set ID |
|---|---|
| Sorghum field/Normal/flower meristem | 1 |
| Sorghum field/Normal/flower | 2 |
| Sorghum field/Normal/flag leaf | 3 |
| Drought Stress: Flag leaf | 4 |

Table 17: Provided are the sorghum transcriptome expression sets 1, 2, 3 and 4. Flag leaf = the leaf below the flower; Flower meristem = Apical meristem following panicle initiation; Flower = the flower at the anthesis day. Expression sets 1, 2 and 3 are from plants grown under normal conditions. Expression set 4 derived from plants grown under drought conditions.

The following parameters were collected using digital imaging system:

At the end of the growing period the grains were separated from the Plant 'Head' and the following parameters were measured and collected:

(i) Average Grain Area ($cm^2$)—A sample of ~200 grains were weight, photographed and images were processed using the below described image processing system. The grain area was measured from those images and was divided by the number of grains.

(ii) Average Grain Length (cm)—A sample of ~200 grains were weight, photographed and images were processed using the below described image processing system. The sum of grain lengths (longest axis) was measured from those images and was divided by the number of grains.

At the end of the growing period 5 'Heads' were, photographed and images were processed using the below described image processing system.

(i) Head Average Area ($cm^2$) The 'Head' area was measured from those images and was divided by the number of 'Heads'.

(ii) Head Average Length (cm) The 'Head' length (longest axis) was measured from those images and was divided by the number of 'Heads'.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 5 plants per plot or by measuring the parameter across all the plants within the plot.

Total Seed Weight/Head (gr.)—At the end of the experiment (plant 'Heads') heads from plots within blocks A-C were collected. 5 heads were separately threshed and grains were weighted, all additional heads were threshed together and weighted as well. The average grain weight per head was calculated by dividing the total grain weight by number of total heads per plot (based on plot). In case of 5 heads, the total grains weight of 5 heads was divided by 5.

FW Head/Plant gr—At the end of the experiment (when heads were harvested) total and 5 selected heads per plots within blocks A-C were collected separately. The heads (total and 5) were weighted (gr.) separately and the average fresh weight per plant was calculated for total (FW Head/Plant gr based on plot) and for 5 (FW Head/Plant gr based on 5 plants).

Plant height—Plants were characterized for height during growing period at 5 time points. In each measure, plants were measured for their height using a measuring tape. Height was measured from ground level to top of the longest leaf.

Plant leaf number—Plants were characterized for leaf number during growing period at 5 time points. In each measure, plants were measured for their leaf number by counting all the leaves of 3 selected plants per plot.

Relative Growth Rate was calculated using Formulas IX and X.

Relative growth rate of plant height=Regression coefficient of plant height along time course.  Formula VIII:

Relative growth rate of plant leaf number=Regression coefficient of plant leaf number along time course.  Formula X SPAD®—Chlorophyll content was determined using a Minolta SPAD® 502 chlorophyll meter and measurement was performed 64 days post sowing. SPAD® meter readings were done on young fully developed leaf. Three measurements per leaf were taken per plot.

Vegetative dry weight and Heads—At the end of the experiment (when Inflorescence were dry) all Inflorescence and vegetative material from plots within blocks A-C were collected. The biomass and Heads weight of each plot was separated, measured and divided by the number of Heads.

Dry weight=total weight of the vegetative portion above ground (excluding roots) after drying at 70° C. in oven for 48 hours;

Harvest Index (HI) (*Sorghum*)—The harvest index was calculated using Formula XI.

Harvest Index=Average grain dry weight per Head/
(Average vegetative dry weight per Head+Average Head dry weight).  Formula XI:

FW Heads/(FW Heads+FW Plants)—The total fresh weight of heads and their respective plant biomass were measured at the harvest day. The heads weight was divided by the sum of weights of heads and plants.

Experimental Results 16 different *sorghum* varieties were grown and characterized for different parameters: The average for each of the measured parameter was calculated using the JMP software (Tables 19-20) and a subsequent correlation analysis between the various transcriptome sets (Table 17) and the average parameters, was conducted (Tables 21). Results were then integrated to the database.

TABLE 18

*Sorghum* correlated parameters (vectors)

| Correlation Vector | Correlation Id |
|---|---|
| Average Seed Area cm$^2$-normal | A |
| Average Seed Length cm-normal | B |
| FW/Plant gr based on plot-normal | C |
| FW Head/Plant gr based on 5 plants-normal | D |
| FW Head/Plant gr based on plot-normal | E |
| FW Heads/(FW Heads + FW Plants) based on plot-normal | F |
| Head Average Area cm$^2$-normal | G |
| Head Average Length cm-normal | H |
| HI-normal | J |
| Leaf SPAD® 64 Days Post Sowing-normal | K |
| Relative Growth Rate of Leaf Num-normal | L |
| Relative Growth Rate of Plant Height-normal | M |
| Total Seed Weight/Head gr based on plot-normal | N |
| Total Seed Weight/Head gr based on 5 heads-normal | O |

Table 18. Provided are the *Sorghum* correlated parameters (vectors), "gr." = grams; "SPAD®" = chlorophyll levels; "FW" = Plant Fresh weight; "normal" = standard growth conditions.

TABLE 19

Measured parameters in *Sorghum* accessions

| Seed Id | A | B | C | D | E | F | G | H | J |
|---|---|---|---|---|---|---|---|---|---|
| 20 | 0.1047 | 0.3856 | 162.6 | 406.5 | 175.2 | 0.51 | 120.1 | 25.58 | 200.7 |
| 21 | 0.1124 | 0.4017 | 212.6 | 518 | 223.5 | 0.5101 | 167.6 | 26.84 | 127 |
| 22 | 0.1313 | 0.4446 | 334.8 | 148 | 56.4 | 0.1154 | 85.14 | 21.02 | 51.8 |
| 24 | 0.1293 | 0.4496 | 313.5 | 423 | 111.6 | 0.2626 | 157.3 | 26.84 | 122.4 |
| 25 | | | | | | 0.1204 | | | 54.53 |
| 26 | | | | | | 0.177 | | | 93.92 |
| 27 | 0.1098 | 0.3999 | 151.1 | 423.5 | 126.2 | 0.4591 | 168.5 | 31.33 | 327.3 |
| 28 | 0.1134 | 0.4054 | 137.6 | 386.5 | 107.7 | 0.4316 | 109.3 | 23.18 | 231.5 |
| 29 | 0.1022 | 0.3837 | 168 | 409.5 | 123.9 | 0.4249 | 135.1 | 25.7 | 241.4 |
| 30 | 0.118 | 0.4186 | 129 | 328.9 | 102.8 | 0.4416 | 169 | 28.82 | 304.1 |
| 31 | 0.1205 | 0.4302 | 97.62 | 391 | 82.33 | 0.4581 | 156.1 | 28.13 | 335.6 |
| 32 | 0.1106 | 0.4003 | 99.32 | 435.8 | 77.59 | 0.4473 | 112.1 | 22.97 | 349.6 |
| 33 | 0.1165 | 0.4094 | 112.2 | 429.5 | 91.17 | 0.4474 | 154.7 | 28.09 | 293.2 |
| 34 | 0.108 | 0.4008 | 157.4 | 441 | 150.4 | 0.5134 | 171.7 | 30 | 410.9 |
| 35 | 0.1048 | 0.3947 | 130.5 | 415.8 | 109.1 | 0.4595 | 168.5 | 30.54 | 285.1 |

TABLE 19-continued

Measured parameters in Sorghum accessions

| Seed Id | A | B | C | D | E | F | G | H | J |
|---|---|---|---|---|---|---|---|---|---|
| 36 | 0.1097 | 0.3953 | 135.7 | 429.5 | 107.6 | 0.4425 | 162.5 | 27.17 | 282.7 |
| 37 | 0.1053 | 0.3924 | 209.2 | 428.5 | 130.9 | 0.3856 | 170.5 | 29.26 | 204 |

Table 19: Provided are the values of each of the parameters (as described above) measured in Sorghum accessions (Seed ID) under normal and drought conditions. Growth conditions are specified in the experimental procedure section.

TABLE 20

Additional measured parameters in Sorghum accessions

| Seed Id | L | M | N | O |
|---|---|---|---|---|
| 20 | 0.1032 | 1.891 | 31.12 | 47.4 |
| 21 |  | 1.622 | 26.35 | 46.3 |
| 22 | 0.2128 | 3.418 | 18.72 | 28.37 |
| 24 | 0.1862 | 2.425 | 38.38 | 70.4 |
| 25 | 0.1898 | 3.118 |  |  |
| 26 | 0.1599 | 3.323 |  |  |
| 27 | 0.1957 | 2.178 | 47.67 | 63.45 |
| 28 | 0.1694 | 2.188 | 31 | 44.45 |
| 29 | 0.1821 | 2.572 | 39.99 | 56.65 |
| 30 |  | 2.046 | 38.36 | 60 |
| 31 |  | 2.069 | 32.1 | 45.45 |
| 32 | 0.1754 | 2.547 | 32.69 | 58.19 |
| 33 | 0.117 | 2.327 | 32.79 | 70.6 |
| 34 | 0.207 | 3.039 | 51.53 | 70.1 |
| 35 | 0.1859 | 2.335 | 35.71 | 53.95 |
| 36 | 0.151 | 2.516 | 38.31 | 59.87 |
| 37 | 0.24 | 2.81 | 42.44 | 52.65 |

Table 20: Provided are the values of each of the parameters (as described above) measured in Sorghum accessions (Seed ID) under normal and drought conditions. Growth conditions are specified in the experimental procedure section.

TABLE 21

Correlation between the expression level of selected genes of some embodiments of the invention in various tissues and the phenotypic performance under normal or abiotic stress conditions across Sorghum accessions

| Gene | Exp | Cor | R | P |
|---|---|---|---|---|
| LYM419 | 1 | N | 0.73 | 0.025 |
| LYM421 | 1 | E | 0.81 | 0.008 |
| LYM421 | 1 | N | 0.80 | 0.010 |
| LYM421 | 1 | O | 0.77 | 0.016 |
| LYM424 | 1 | D | 0.88 | 0.002 |
| LYM424 | 3 | E | 0.75 | 0.021 |
| LYM424 | 1 | F | 0.74 | 0.014 |
| LYM424 | 2 | E | 0.71 | 0.032 |
| LYM427 | 1 | E | 0.89 | 0.001 |
| LYM427 | 2 | O | 0.75 | 0.020 |
| LYM428 | 1 | N | 0.81 | 0.008 |
| LYM428 | 1 | O | 0.76 | 0.017 |
| LYM428 | 1 | G | 0.76 | 0.018 |
| LYM428 | 1 | H | 0.73 | 0.027 |
| LYM433 | 2 | N | 0.85 | 0.004 |
| LYM435 | 2 | A | 0.77 | 0.016 |
| LYM435 | 1 | N | 0.75 | 0.020 |
| LYM435 | 2 | B | 0.75 | 0.020 |
| LYM435 | 2 | C | 0.75 | 0.021 |
| LYM435 | 1 | E | 0.73 | 0.024 |
| LYM436 | 2 | C | 0.90 | 0.001 |
| LYM436 | 2 | C | 0.81 | 0.008 |
| LYM437 | 1 | E | 0.82 | 0.007 |
| LYM438 | 2 | D | 0.89 | 0.001 |
| LYM438 | 2 | D | 0.88 | 0.002 |
| LYM438 | 2 | N | 0.84 | 0.004 |
| LYM438 | 2 | O | 0.79 | 0.012 |
| LYM438 | 2 | J | 0.78 | 0.008 |
| LYM438 | 2 | F | 0.77 | 0.009 |
| LYM438 | 2 | E | 0.74 | 0.022 |
| LYM438 | 2 | H | 0.73 | 0.026 |
| LYM438 | 2 | O | 0.73 | 0.027 |
| LYM439 | 1 | B | 0.79 | 0.011 |
| LYM439 | 1 | A | 0.74 | 0.023 |
| LYM440 | 2 | A | 0.77 | 0.015 |
| LYM440 | 2 | B | 0.74 | 0.022 |
| LYM440 | 2 | C | 0.71 | 0.031 |
| LYM441 | 1 | E | 0.83 | 0.006 |
| LYM441 | 2 | F | 0.70 | 0.024 |
| LYM442 | 2 | A | 0.75 | 0.021 |
| LYM442 | 3 | A | 0.75 | 0.021 |
| LYM442 | 3 | B | 0.74 | 0.022 |
| LYM442 | 3 | C | 0.71 | 0.032 |
| LYM443 | 1 | E | 0.85 | 0.004 |
| LYM443 | 1 | N | 0.76 | 0.017 |
| LYM443 | 2 | E | 0.72 | 0.030 |
| LYM444 | 1 | B | 0.83 | 0.006 |
| LYM444 | 1 | A | 0.82 | 0.007 |
| LYM444 | 3 | N | 0.82 | 0.007 |
| LYM444 | 3 | H | 0.73 | 0.026 |
| LYM444 | 3 | G | 0.71 | 0.031 |
| LYM445 | 2 | E | 0.86 | 0.003 |
| LYM445 | 2 | H | 0.85 | 0.003 |
| LYM445 | 2 | N | 0.82 | 0.007 |
| LYM445 | 2 | G | 0.75 | 0.019 |
| LYM445 | 2 | D | 0.74 | 0.022 |
| LYM445 | 3 | G | 0.73 | 0.024 |
| LYM445 | 3 | E | 0.73 | 0.025 |
| LYM445 | 3 | O | 0.72 | 0.030 |
| LYM446 | 2 | B | 0.86 | 0.003 |
| LYM446 | 2 | A | 0.83 | 0.005 |
| LYM446 | 1 | N | 0.77 | 0.015 |
| LYM446 | 1 | G | 0.75 | 0.021 |
| LYM446 | 1 | O | 0.72 | 0.027 |
| LYM446 | 1 | H | 0.71 | 0.033 |
| LYM447 | 1 | N | 0.70 | 0.035 |
| LYM448 | 2 | A | 0.75 | 0.021 |
| LYM448 | 2 | C | 0.74 | 0.022 |
| LYM448 | 2 | B | 0.73 | 0.025 |
| LYM449 | 2 | M | 0.88 | 0.001 |
| LYM449 | 2 | C | 0.77 | 0.015 |
| LYM449 | 1 | O | 0.73 | 0.025 |
| LYM450 | 1 | N | 0.77 | 0.016 |
| LYM451 | 2 | A | 0.89 | 0.001 |
| LYM451 | 2 | B | 0.83 | 0.005 |
| LYM451 | 1 | B | 0.83 | 0.005 |
| LYM451 | 3 | B | 0.80 | 0.009 |
| LYM451 | 1 | A | 0.77 | 0.014 |
| LYM451 | 3 | A | 0.73 | 0.027 |
| LYM452 | 3 | A | 0.83 | 0.005 |
| LYM452 | 3 | B | 0.81 | 0.008 |
| LYM452 | 3 | C | 0.77 | 0.015 |
| LYM452 | 2 | O | 0.71 | 0.034 |
| LYM453 | 1 | B | 0.95 | 0.000 |
| LYM453 | 1 | A | 0.89 | 0.001 |
| LYM455 | 2 | E | 0.72 | 0.029 |
| LYM456 | 1 | B | 0.88 | 0.002 |
| LYM456 | 1 | A | 0.83 | 0.006 |
| LYM456 | 2 | A | 0.80 | 0.010 |
| LYM456 | 3 | B | 0.74 | 0.023 |

TABLE 21-continued

Correlation between the expression level of selected genes of some embodiments of the invention in various tissues and the phenotypic performance under normal or abiotic stress conditions across Sorghum accessions

| Gene | Exp | Cor | R | P |
|---|---|---|---|---|
| LYM456 | 2 | B | 0.71 | 0.033 |
| LYM456 | 3 | A | 0.71 | 0.033 |
| LYM456 | 2 | C | 0.70 | 0.034 |
| LYM457 | 2 | A | 0.89 | 0.001 |
| LYM457 | 2 | B | 0.86 | 0.003 |
| LYM457 | 2 | C | 0.76 | 0.018 |
| LYM457 | 3 | A | 0.75 | 0.020 |
| LYM457 | 3 | B | 0.74 | 0.022 |
| LYM458 | 1 | A | 0.87 | 0.003 |
| LYM458 | 1 | B | 0.81 | 0.009 |
| LYM458 | 3 | A | 0.74 | 0.022 |
| LYM458 | 3 | B | 0.74 | 0.023 |
| LYM458 | 2 | N | 0.73 | 0.027 |
| LYM460 | 1 | N | 0.73 | 0.027 |
| LYM461 | 1 | E | 0.74 | 0.023 |
| LYM463 | 2 | K | 0.82 | 0.004 |
| LYM465 | 1 | C | 0.95 | 0.000 |
| LYM465 | 1 | A | 0.75 | 0.020 |
| LYM465 | 1 | B | 0.71 | 0.034 |
| LYM466 | 3 | N | 0.72 | 0.028 |
| LYM467 | 2 | O | 0.75 | 0.019 |
| LYM467 | 2 | H | 0.73 | 0.027 |
| LYM468 | 1 | B | 0.89 | 0.001 |
| LYM468 | 1 | A | 0.86 | 0.003 |
| LYM468 | 3 | B | 0.74 | 0.023 |
| LYM468 | 3 | C | 0.72 | 0.030 |
| LYM468 | 3 | A | 0.70 | 0.035 |
| LYM472 | 2 | A | 0.91 | 0.001 |
| LYM472 | 2 | B | 0.90 | 0.001 |
| LYM472 | 1 | E | 0.84 | 0.005 |
| LYM472 | 1 | F | 0.77 | 0.009 |
| LYM472 | 1 | O | 0.77 | 0.016 |
| LYM472 | 1 | D | 0.76 | 0.016 |
| LYM472 | 1 | N | 0.74 | 0.022 |
| LYM473 | 1 | G | 0.85 | 0.004 |
| LYM473 | 1 | N | 0.84 | 0.005 |
| LYM473 | 1 | H | 0.81 | 0.008 |
| LYM473 | 1 | E | 0.76 | 0.017 |
| LYM473 | 3 | E | 0.76 | 0.019 |
| LYM473 | 1 | O | 0.75 | 0.019 |
| LYM474 | 1 | E | 0.98 | 0.000 |
| LYM474 | 1 | N | 0.86 | 0.003 |
| LYM474 | 2 | A | 0.80 | 0.009 |
| LYM474 | 1 | O | 0.78 | 0.014 |
| LYM474 | 2 | B | 0.77 | 0.016 |
| LYM474 | 1 | D | 0.75 | 0.020 |
| LYM475 | 2 | G | 0.79 | 0.012 |
| LYM475 | 2 | N | 0.75 | 0.019 |
| LYM475 | 2 | H | 0.75 | 0.021 |
| LYM476 | 2 | C | 0.87 | 0.002 |
| LYM476 | 2 | A | 0.73 | 0.024 |
| LYM476 | 2 | B | 0.70 | 0.035 |
| LYM477 | 1 | B | 0.92 | 0.000 |
| LYM477 | 1 | A | 0.92 | 0.000 |
| LYM477 | 3 | B | 0.80 | 0.010 |
| LYM477 | 3 | A | 0.78 | 0.013 |
| LYM477 | 2 | C | 0.75 | 0.019 |
| LYM478 | 1 | A | 0.85 | 0.004 |
| LYM478 | 1 | B | 0.82 | 0.007 |
| LYM478 | 1 | C | 0.79 | 0.012 |
| LYM479 | 3 | E | 0.71 | 0.034 |
| LYM480 | 1 | C | 0.91 | 0.001 |
| LYM480 | 3 | C | 0.89 | 0.001 |
| LYM480 | 1 | A | 0.80 | 0.010 |
| LYM480 | 1 | B | 0.77 | 0.015 |
| LYM480 | 3 | A | 0.76 | 0.018 |
| LYM480 | 3 | B | 0.70 | 0.034 |
| LYM480 | 3 | M | 0.70 | 0.024 |
| LYM481 | 1 | B | 0.90 | 0.001 |
| LYM481 | 1 | A | 0.86 | 0.003 |
| LYM481 | 3 | E | 0.83 | 0.005 |
| LYM483 | 1 | N | 0.74 | 0.022 |
| LYM484 | 1 | G | 0.90 | 0.001 |
| LYM484 | 1 | H | 0.89 | 0.001 |
| LYM484 | 3 | G | 0.86 | 0.003 |
| LYM484 | 1 | N | 0.81 | 0.008 |
| LYM484 | 3 | H | 0.76 | 0.018 |
| LYM484 | 1 | O | 0.74 | 0.021 |
| LYM484 | 3 | N | 0.72 | 0.027 |
| LYM484 | 2 | G | 0.72 | 0.028 |
| LYM485 | 2 | F | 0.73 | 0.017 |
| LYM486 | 1 | N | 0.84 | 0.004 |
| LYM486 | 1 | E | 0.83 | 0.006 |
| LYM487 | 1 | N | 0.75 | 0.021 |
| LYM487 | 1 | H | 0.73 | 0.025 |
| LYM488 | 1 | N | 0.76 | 0.017 |
| LYM488 | 2 | O | 0.71 | 0.032 |
| LYM488 | 1 | E | 0.71 | 0.033 |
| LYM489 | 2 | C | 0.78 | 0.012 |
| LYM490 | 3 | B | 0.78 | 0.013 |
| LYM490 | 1 | B | 0.76 | 0.017 |
| LYM490 | 3 | A | 0.75 | 0.021 |
| LYM490 | 1 | A | 0.70 | 0.035 |
| LYM491 | 1 | N | 0.71 | 0.031 |
| LYM492 | 1 | O | 0.90 | 0.001 |
| LYM492 | 1 | N | 0.89 | 0.001 |
| LYM492 | 1 | H | 0.85 | 0.003 |
| LYM492 | 1 | G | 0.83 | 0.005 |
| LYM492 | 1 | D | 0.74 | 0.023 |
| LYM493 | 2 | D | 0.84 | 0.005 |
| LYM494 | 1 | N | 0.85 | 0.003 |
| LYM494 | 1 | J | 0.76 | 0.010 |
| LYM494 | 1 | G | 0.76 | 0.018 |
| LYM494 | 1 | H | 0.72 | 0.028 |
| LYM495 | 1 | E | 0.91 | 0.001 |
| LYM495 | 2 | A | 0.85 | 0.004 |
| LYM495 | 2 | B | 0.83 | 0.005 |
| LYM495 | 1 | N | 0.83 | 0.005 |
| LYM495 | 1 | D | 0.74 | 0.023 |
| LYM496 | 3 | B | 0.91 | 0.001 |
| LYM496 | 3 | A | 0.88 | 0.002 |
| LYM497 | 1 | E | 0.85 | 0.004 |
| LYM497 | 3 | A | 0.85 | 0.004 |
| LYM497 | 1 | N | 0.84 | 0.004 |
| LYM497 | 3 | B | 0.81 | 0.008 |
| LYM497 | 3 | C | 0.80 | 0.010 |
| LYM497 | 2 | O | 0.73 | 0.025 |
| LYM498 | 3 | N | 0.78 | 0.013 |
| LYM498 | 1 | O | 0.72 | 0.029 |
| LYM498 | 1 | J | 0.72 | 0.020 |
| LYM498 | 1 | N | 0.71 | 0.034 |
| LYM499 | 2 | O | 0.87 | 0.002 |
| LYM499 | 2 | N | 0.80 | 0.010 |
| LYM499 | 2 | E | 0.77 | 0.016 |
| LYM499 | 1 | N | 0.76 | 0.017 |
| LYM499 | 2 | J | 0.73 | 0.016 |
| LYM499 | 2 | F | 0.72 | 0.018 |
| LYM499 | 2 | D | 0.71 | 0.033 |
| LYM500 | 1 | N | 0.78 | 0.012 |
| LYM500 | 1 | O | 0.73 | 0.024 |
| LYM501 | 3 | N | 0.70 | 0.035 |
| LYM502 | 2 | E | 0.80 | 0.010 |
| LYM503 | 1 | C | 0.87 | 0.002 |
| LYM503 | 3 | E | 0.80 | 0.010 |
| LYM504 | 1 | B | 0.87 | 0.002 |
| LYM504 | 3 | B | 0.86 | 0.003 |
| LYM504 | 1 | A | 0.86 | 0.003 |
| LYM504 | 3 | A | 0.79 | 0.011 |
| LYM505 | 2 | N | 0.81 | 0.009 |
| LYM505 | 2 | F | 0.80 | 0.006 |
| LYM505 | 2 | H | 0.79 | 0.011 |
| LYM505 | 2 | D | 0.77 | 0.014 |
| LYM505 | 2 | E | 0.77 | 0.015 |
| LYM506 | 2 | M | 0.71 | 0.022 |
| LYM507 | 1 | N | 0.90 | 0.001 |
| LYM507 | 2 | O | 0.80 | 0.009 |

TABLE 21-continued

Correlation between the expression level of selected genes of some embodiments of the invention in various tissues and the phenotypic performance under normal or abiotic stress conditions across *Sorghum* accessions

| Gene | Exp | Cor | R | P |
|---|---|---|---|---|
| LYM507 | 2 | N | 0.73 | 0.026 |
| LYM507 | 3 | A | 0.72 | 0.030 |
| LYM507 | 1 | O | 0.71 | 0.032 |
| LYM508 | 1 | B | 0.92 | 0.000 |
| LYM508 | 1 | A | 0.88 | 0.002 |
| LYM508 | 1 | C | 0.88 | 0.002 |
| LYM508 | 1 | M | 0.82 | 0.003 |
| LYM420 | 2 | D | 0.91 | 0.001 |
| LYM420 | 2 | N | 0.86 | 0.003 |
| LYM420 | 2 | G | 0.81 | 0.008 |
| LYM420 | 2 | H | 0.80 | 0.010 |
| LYM420 | 2 | F | 0.79 | 0.007 |
| LYM420 | 1 | A | 0.77 | 0.014 |
| LYM420 | 3 | N | 0.74 | 0.021 |
| LYM420 | 2 | J | 0.73 | 0.017 |
| LYM422 | 1 | C | 0.95 | 0.000 |
| LYM422 | 2 | C | 0.89 | 0.001 |
| LYM422 | 2 | M | 0.78 | 0.007 |
| LYM422 | 2 | A | 0.75 | 0.019 |
| LYM422 | 1 | A | 0.75 | 0.020 |
| LYM422 | 1 | B | 0.71 | 0.034 |
| LYM422 | 2 | B | 0.70 | 0.035 |
| LYM423 | 1 | E | 0.81 | 0.008 |
| LYM423 | 1 | N | 0.77 | 0.015 |
| LYM425 | 1 | N | 0.89 | 0.001 |
| LYM425 | 1 | H | 0.86 | 0.003 |
| LYM425 | 1 | G | 0.86 | 0.003 |
| LYM425 | 1 | O | 0.79 | 0.012 |
| LYM425 | 2 | G | 0.75 | 0.021 |
| LYM425 | 3 | G | 0.74 | 0.023 |
| LYM425 | 2 | O | 0.70 | 0.034 |
| LYM426 | 1 | N | 0.78 | 0.014 |
| LYM429 | 1 | E | 0.76 | 0.018 |
| LYM430 | 1 | N | 0.86 | 0.003 |
| LYM430 | 1 | O | 0.71 | 0.033 |
| LYM431 | 3 | N | 0.80 | 0.010 |
| LYM431 | 2 | E | 0.79 | 0.011 |
| LYM431 | 1 | B | 0.76 | 0.017 |
| LYM431 | 1 | A | 0.72 | 0.028 |
| LYM431 | 3 | E | 0.71 | 0.033 |
| LYM432 | 1 | H | 0.84 | 0.004 |
| LYM432 | 1 | G | 0.74 | 0.022 |
| LYM432 | 1 | N | 0.74 | 0.024 |
| LYM432 | 1 | D | 0.72 | 0.030 |
| LYM434 | 2 | A | 0.89 | 0.001 |
| LYM434 | 1 | O | 0.86 | 0.003 |
| LYM434 | 2 | A | 0.84 | 0.005 |
| LYM434 | 2 | B | 0.81 | 0.009 |
| LYM434 | 1 | N | 0.80 | 0.010 |
| LYM434 | 1 | H | 0.78 | 0.014 |
| LYM434 | 1 | G | 0.76 | 0.018 |
| LYM434 | 2 | B | 0.74 | 0.023 |
| LYM434 | 1 | D | 0.71 | 0.033 |
| LYM307_H7 | 1 | N | 0.81 | 0.009 |
| LYM307_H7 | 1 | O | 0.75 | 0.021 |
| LYM315_H4 | 2 | A | 0.90 | 0.001 |
| LYM315_H4 | 2 | B | 0.85 | 0.004 |
| LYM316_H39 | 3 | B | 0.71 | 0.031 |
| LYM316_H39 | 3 | A | 0.71 | 0.034 |
| LYM317_H8 | 2 | E | 0.86 | 0.003 |
| LYM318_H7 | 2 | O | 0.79 | 0.012 |
| LYM318_H7 | 3 | L | 0.76 | 0.030 |
| LYM321_H7 | 2 | O | 0.91 | 0.001 |
| LYM321_H7 | 2 | F | 0.73 | 0.017 |
| LYM326_H5 | 2 | A | 0.81 | 0.008 |
| LYM326_H5 | 2 | B | 0.77 | 0.015 |
| LYM326_H5 | 2 | C | 0.75 | 0.020 |
| LYM332_H6 | 1 | B | 0.83 | 0.005 |
| LYM332_H6 | 1 | A | 0.79 | 0.012 |
| LYM348_H1 | 1 | O | 0.78 | 0.013 |
| LYM348_H1 | 1 | N | 0.77 | 0.015 |
| LYM349_H1 | 1 | N | 0.80 | 0.010 |
| LYM349_H1 | 1 | E | 0.71 | 0.032 |
| LYM353_H1 | 2 | C | 0.89 | 0.001 |
| LYM353_H1 | 2 | A | 0.75 | 0.019 |
| LYM353_H1 | 2 | B | 0.70 | 0.035 |
| LYM357_H1 | 2 | A | 0.89 | 0.001 |
| LYM357_H1 | 2 | B | 0.85 | 0.004 |
| LYM360_H1 | 2 | O | 0.76 | 0.017 |
| LYM363_H1 | 2 | F | 0.75 | 0.013 |
| LYM364_H1 | 1 | E | 0.70 | 0.034 |
| LYM364_H1 | 1 | N | 0.70 | 0.035 |
| LYM365_H1 | 3 | B | 0.74 | 0.023 |
| LYM365_H1 | 3 | A | 0.70 | 0.034 |
| LYM368_H4 | 1 | N | 0.84 | 0.005 |
| LYM368_H4 | 3 | C | 0.80 | 0.009 |
| LYM368_H4 | 3 | A | 0.76 | 0.017 |
| LYM373_H1 | 3 | E | 0.73 | 0.025 |
| LYM375_H1 | 1 | C | 0.84 | 0.004 |
| LYM375_H1 | 2 | L | 0.80 | 0.016 |
| LYM376_H2 | 1 | B | 0.86 | 0.003 |
| LYM376_H2 | 1 | A | 0.84 | 0.004 |
| LYM382_H3 | 1 | B | 0.88 | 0.002 |
| LYM382_H3 | 1 | A | 0.86 | 0.003 |
| LYM388_H2 | 2 | C | 0.70 | 0.035 |
| LYM392_H2 | 2 | E | 0.72 | 0.028 |
| LYM395_H5 | 2 | A | 0.90 | 0.001 |
| LYM395_H5 | 2 | B | 0.85 | 0.004 |
| LYM404_H55 | 1 | B | 0.86 | 0.003 |
| LYM404_H55 | 1 | C | 0.82 | 0.006 |
| LYM404_H55 | 1 | A | 0.81 | 0.009 |
| LYM407_H14 | 1 | C | 0.81 | 0.008 |
| LYM407_H14 | 1 | A | 0.71 | 0.033 |
| LYM407_H16 | 1 | A | 0.83 | 0.006 |
| LYM407_H16 | 1 | B | 0.80 | 0.009 |
| LYM407_H16 | 1 | C | 0.74 | 0.022 |
| LYM410_H2 | 1 | N | 0.74 | 0.023 |
| LYM410_H2 | 1 | E | 0.73 | 0.026 |
| LYM410_H2 | 2 | O | 0.71 | 0.032 |
| LYM415_H1 | 3 | E | 0.71 | 0.034 |
| LYM416_H4 | 1 | N | 0.90 | 0.001 |
| LYM416_H4 | 1 | G | 0.89 | 0.001 |
| LYM416_H4 | 1 | H | 0.87 | 0.002 |
| LYM416_H4 | 1 | J | 0.79 | 0.007 |
| LYM416_H4 | 1 | O | 0.79 | 0.012 |
| LYM418_H39 | 1 | N | 0.78 | 0.012 |
| LYM418_H39 | 1 | E | 0.77 | 0.015 |
| LYM418_H146 | 2 | A | 0.77 | 0.016 |
| LYM427_H1 | 1 | E | 0.92 | 0.000 |
| LYM427_H1 | 2 | O | 0.75 | 0.019 |
| LYM475_H1 | 2 | D | 0.82 | 0.007 |
| LYM475_H1 | 2 | G | 0.79 | 0.012 |
| LYM475_H1 | 2 | N | 0.75 | 0.019 |
| LYM475_H1 | 2 | H | 0.75 | 0.021 |
| LYM483_H1 | 1 | N | 0.77 | 0.016 |
| LYM489_H2 | 1 | B | 0.83 | 0.005 |
| LYM489_H2 | 1 | A | 0.77 | 0.016 |
| LYM497_H1 | 3 | A | 0.86 | 0.003 |
| LYM497_H1 | 3 | B | 0.82 | 0.006 |
| LYM497_H1 | 3 | C | 0.73 | 0.027 |

Table 21. Provided are the correlations (R) between the expression levels of yield improving genes and their homologs in tissues [Flag leaf, Flower meristem and Flower; Expression sets (Exp)] and the phenotypic performance in various yield, biomass, growth rate and/or vigor components [Correlation vector (cor)] under stress conditions or normal conditions across *Sorghum* accessions. P = p value.

*Sorghum* vigor related parameters under 100 mM NaCl and low temperature (10±2° C.)—Ten *Sorghum* varieties were grown in 3 repetitive plots, each containing 17 plants, at a net house under semi-hydroponics conditions. Briefly, the growing protocol was as follows: *Sorghum* seeds were sown in trays filled with a mix of vermiculite and peat in a 1:1 ratio. Following germination, the trays were transferred to the high salinity solution (100 mM NaCl in addition to the Full Hogland solution), low temperature (10±2° C. in the presence of Full Hogland solution) or at Normal growth solution [Full Hogland solution at 28±2° C.].

Full Hogland solution consists of: $KNO_3$—0.808 grams/liter, $MgSO_4$—0.12 grams/liter, $KH_2PO_4$—0.172 grams/liter and 0.01% (volume/volume) of 'Super coratin' micro elements (Iron-EDDHA [ethylenediamine-N,N'-bis(2-hydroxyphenylacetic acid)]—40.5 grams/liter; Mn—20.2 grams/liter; Zn 10.1 grams/liter; Co 1.5 grams/liter; and Mo 1.1 grams/liter), solution's pH should be 6.5-6.8].

All 10 selected *Sorghum* varieties were sampled per each treatment. Two tissues [leaves and roots] growing at 100 mM NaCl, low temperature (10±2° C.) or under Normal conditions (full Hogland at a temperature between 28±2° C.) were sampled and RNA was extracted as described hereinabove under "GENERAL EXPERIMENTAL AND BIOINFORMATICS METHODS".

TABLE 22

*Sorghum* transcriptome expression sets

| Expression Set | Set ID |
| --- | --- |
| *Sorghum* roots under cold | 1 |
| *Sorghum* vegetative meristem NaCl | 2 |
| *Sorghum* vegetative meristem under low nitrogen | 3 |
| *Sorghum* vegetative meristem under cold conditions | 4 |
| *Sorghum* roots under NaCl | 5 |
| *Sorghum* vegetative meristem under normal conditions | 6 |
| *Sorghum* roots under low nitrogen | 7 |
| *Sorghum* roots under normal | 8 |

Table 22: Provided are the *Sorghum* transcriptome expression sets. Cold conditions = 10 ± 2° C.; NaCl = 100 mM NaCl; low nitrogen = 1.2 mM Nitrogen; Normal conditions = 16 mM Nitrogen.

Experimental Results 10 different *Sorghum* varieties were grown and characterized for the following parameters: "Leaf number Normal"=leaf number per plant under normal conditions (average of five plants); "Plant Height Normal"=plant height under normal conditions (average of five plants); "Root DW 100 mM NaCl"—root dry weight per plant under salinity conditions (average of five plants); The average for each of the measured parameter was calculated using the JMP software and values are summarized in Table 24 below. Subsequent correlation analysis between the various transcriptome sets and the average parameters were conducted (Table 25). Results were then integrated to the database.

TABLE 23

*Sorghum* correlated parameters (vectors)

| Correlation Vector | Corr. Id |
| --- | --- |
| DW Root/Plant - Cold | A |
| DW Root/Plant - 100 mM NaCl | B |
| DW Shoot/Plant - Low Nitrogen | C |
| DW Root/Plant - Low Nitrogen | D |
| Leaf number TP-3* - Cold | E |
| Leaf number TP-3*- 100 mM NaCl | F |
| Plant Height TP-3*- 100 mM NaCl | G |
| DW Shoot/Plant - Cold | H |
| DW Shoot/Plant - Normal | I |
| Plant Height TP-3* - Low Nitrogen | J |
| Leaf number TP-3* - Low Nitrogen | K |
| DW Shoot/Plant - 100 mM NaCl | L |
| Leaf number TP-3* - Normal | M |
| DW Root/Plant - Normal | N |

Table 23: Provided are the *Sorghum* correlated parameters. Cold conditions = 10 ± 2° C.; NaCl = 100 mM NaCl; low nitrogen = 1.2 mM Nitrogen; Normal conditions = 16 mM Nitrogen
*TP-3 refers to time point 3.

TABLE 24

*Sorghum* accessions, measured parameters

| Seed ID | F | B | L | G | E | A | H | M | I |
| --- | --- | --- | --- | --- | --- | --- | --- | --- | --- |
| 20 | 3.67 | 0.35 | 0.66 | 14.63 | 3.88 | 0.83 | 1.03 | 4.17 | 0.81 |
| 22 | 3.88 | 1.45 | 2.43 | 16.31 | 4.16 | 0.95 | 1.34 | 4.48 | 1.89 |
| 26 | 4.28 | 1.49 | 2.40 | 20.56 | 4.52 | 1.47 | 1.71 | 4.93 | 2.51 |
| 27 | 4.03 | 0.81 | 1.61 | 14.70 | 4.28 | 1.06 | 1.28 | 4.53 | 1.26 |
| 28 | 3.97 | 1.03 | 1.77 | 16.43 | 4.33 | 0.71 | 1.12 | 4.52 | 1.55 |
| 29 | 3.98 | 0.95 | 1.66 | 16.12 | 4.17 | 1.38 | 1.69 | 4.64 | 1.50 |
| 30 | 3.90 | 2.00 | 2.23 | 15.61 | 3.94 | 2.04 | 2.24 | 4.49 | 1.93 |
| 31 | 4.18 | 1.39 | 2.76 | 18.71 | 4.26 | 1.03 | 1.26 | 4.79 | 1.95 |
| 34 | 3.70 | 1.29 | 1.29 | 13.65 | 4.20 | 1.01 | 1.08 | 4.37 | 1.48 |
| 37 | 3.82 | 1.76 | 1.55 | 15.72 | 4.04 | 1.01 | 1.02 | 4.54 | 1.85 |

Table 24: Provided are the measured parameters under 100 mM NaCl and low temperature (8-10° C.) conditions of *Sorghum* accessions (Seed ID) according to the Correlation ID numbers (described in Table 23 above) as follows: F [100 mM NaCl: leaf Number] ; B [100 mM NaCl: Root DW]; L [100 mM NaCl: Shoot DW]; G [100 mM NaCl: Plant height]; E [low temperature: leaf Number]; A [low temperature: Root DW]; H [low temperature: Shoot DW]; M [Normal: leaf Number]; I [Normal: Shoot DW].

TABLE 25

Correlation between the expression level of selected genes of some embodiments of the invention in roots and the phenotypic performance under normal or abiotic stress conditions across *Sorghum* accessions

| Gene | Exp | Cor | R | P |
| --- | --- | --- | --- | --- |
| LYM304_H7 | 7 | K | 0.87 | 0.012 |
| LYM304_H7 | 7 | J | 0.71 | 0.077 |
| LYM307_H7 | 3 | C | 0.72 | 0.030 |
| LYM307_H7 | 3 | J | 0.85 | 0.004 |
| LYM307_H7 | 4 | A | 0.83 | 0.006 |
| LYM307_H7 | 4 | H | 0.88 | 0.002 |
| LYM307_H7 | 5 | F | 0.85 | 0.068 |
| LYM307_H7 | 5 | G | 0.87 | 0.054 |
| LYM307_H7 | 7 | D | 0.74 | 0.056 |
| LYM307_H7 | 7 | J | 0.82 | 0.024 |
| LYM307_H7 | 8 | N | 0.86 | 0.003 |
| LYM307_H7 | 8 | I | 0.75 | 0.020 |
| LYM307_H7 | 8 | M | 0.78 | 0.014 |
| LYM315_H4 | 5 | F | 0.98 | 0.002 |
| LYM315_H4 | 5 | G | 0.87 | 0.056 |
| LYM316_H10 | 7 | K | 0.93 | 0.002 |
| LYM316_H10 | 7 | K | 0.72 | 0.065 |
| LYM316_H39 | 7 | J | 0.70 | 0.078 |
| LYM317_H8 | 3 | D | 0.73 | 0.025 |
| LYM318_H7 | 2 | B | 0.75 | 0.020 |
| LYM321_H7 | 7 | C | 0.72 | 0.070 |
| LYM321_H7 | 7 | J | 0.73 | 0.061 |
| LYM346_H2 | 3 | D | 0.75 | 0.020 |
| LYM346_H2 | 3 | C | 0.72 | 0.028 |
| LYM346_H2 | 4 | A | 0.71 | 0.034 |
| LYM346_H2 | 4 | H | 0.87 | 0.002 |
| LYM346_H5 | 4 | A | 0.71 | 0.033 |
| LYM348_H1 | 2 | B | 0.72 | 0.029 |
| LYM348_H1 | 4 | A | 0.70 | 0.034 |
| LYM348_H1 | 4 | H | 0.86 | 0.003 |
| LYM349_H1 | 4 | H | 0.79 | 0.011 |
| LYM350_H1 | 5 | G | 0.93 | 0.021 |
| LYM350_H1 | 7 | D | 0.86 | 0.012 |
| LYM350_H1 | 7 | C | 0.82 | 0.025 |
| LYM350_H1 | 7 | J | 0.81 | 0.027 |
| LYM353_H1 | 5 | G | 0.85 | 0.066 |
| LYM359_H1 | 8 | N | 0.77 | 0.016 |
| LYM359_H1 | 8 | I | 0.73 | 0.025 |
| LYM360_H1 | 7 | D | 0.78 | 0.038 |
| LYM360_H1 | 7 | C | 0.70 | 0.079 |
| LYM361_H13 | 4 | H | 0.80 | 0.009 |
| LYM361_H7 | 5 | G | 0.99 | 0.001 |
| LYM363_H1 | 5 | G | 0.99 | 0.002 |
| LYM363_H1 | 7 | C | 0.87 | 0.012 |
| LYM363_H1 | 7 | J | 0.84 | 0.017 |
| LYM364_H1 | 2 | B | 0.76 | 0.018 |
| LYM364_H1 | 4 | H | 0.76 | 0.018 |
| LYM365_H1 | 4 | H | 0.73 | 0.024 |
| LYM365_H1 | 7 | J | 0.73 | 0.063 |

TABLE 25-continued

Correlation between the expression level of selected genes of some embodiments of the invention in roots and the phenotypic performance under normal or abiotic stress conditions across *Sorghum* accessions

| Gene | Exp | Cor | R | P |
|---|---|---|---|---|
| LYM368_H4 | 4 | H | 0.82 | 0.007 |
| LYM369_H3 | 7 | K | 0.74 | 0.059 |
| LYM373_H1 | 5 | F | 0.86 | 0.062 |
| LYM375_H1 | 1 | E | 0.71 | 0.021 |
| LYM375_H1 | 3 | J | 0.75 | 0.020 |
| LYM375_H1 | 5 | L | 0.88 | 0.048 |
| LYM375_H1 | 5 | F | 0.89 | 0.041 |
| LYM375_H1 | 5 | G | 0.85 | 0.070 |
| LYM375_H1 | 7 | J | 0.83 | 0.022 |
| LYM375_H1 | 8 | N | 0.79 | 0.011 |
| LYM387_H4 | 7 | J | 0.83 | 0.020 |
| LYM388_H2 | 4 | H | 0.75 | 0.020 |
| LYM388_H2 | 7 | K | 0.77 | 0.045 |
| LYM392_H2 | 6 | N | 0.75 | 0.020 |
| LYM392_H2 | 6 | I | 0.77 | 0.015 |
| LYM393_H2 | 2 | F | 0.77 | 0.015 |
| LYM400_H2 | 1 | E | 0.81 | 0.005 |
| LYM400_H2 | 7 | C | 0.80 | 0.032 |
| LYM402_H2 | 7 | K | 0.82 | 0.023 |
| LYM410_H2 | 7 | D | 0.75 | 0.053 |
| LYM415_H1 | 1 | A | 0.70 | 0.024 |
| LYM416_H4 | 3 | D | 0.89 | 0.001 |
| LYM416_H4 | 3 | C | 0.89 | 0.001 |
| LYM416_H4 | 3 | K | 0.71 | 0.033 |
| LYM416_H4 | 3 | J | 0.85 | 0.003 |
| LYM416_H4 | 4 | A | 0.72 | 0.030 |
| LYM416_H4 | 4 | H | 0.79 | 0.012 |
| LYM416_H4 | 5 | L | 0.88 | 0.050 |
| LYM416_H4 | 5 | F | 0.83 | 0.085 |
| LYM416_H4 | 7 | D | 0.73 | 0.060 |
| LYM416_H4 | 7 | C | 0.88 | 0.010 |
| LYM416_H4 | 7 | J | 0.72 | 0.069 |
| LYM419 | 5 | L | 0.81 | 0.098 |
| LYM428 | 4 | H | 0.87 | 0.002 |
| LYM430 | 7 | D | 0.71 | 0.074 |
| LYM430 | 7 | C | 0.73 | 0.064 |
| LYM433 | 2 | B | 0.71 | 0.033 |
| LYM434 | 4 | A | 0.76 | 0.016 |
| LYM434 | 4 | H | 0.90 | 0.001 |
| LYM440 | 5 | G | 0.82 | 0.089 |
| LYM441 | 3 | D | 0.81 | 0.007 |
| LYM441 | 3 | C | 0.75 | 0.020 |
| LYM441 | 3 | J | 0.80 | 0.010 |
| LYM443 | 2 | L | 0.83 | 0.006 |
| LYM446 | 3 | D | 0.74 | 0.022 |
| LYM446 | 3 | J | 0.72 | 0.028 |
| LYM446 | 4 | A | 0.84 | 0.005 |
| LYM446 | 4 | H | 0.78 | 0.014 |
| LYM446 | 5 | L | 0.92 | 0.029 |
| LYM446 | 7 | D | 0.73 | 0.063 |
| LYM446 | 8 | N | 0.81 | 0.008 |
| LYM446 | 8 | I | 0.77 | 0.016 |
| LYM446 | 8 | M | 0.82 | 0.006 |
| LYM447 | 2 | B | 0.71 | 0.033 |
| LYM447 | 3 | D | 0.75 | 0.020 |
| LYM448 | 3 | D | 0.94 | 0.000 |
| LYM448 | 3 | C | 0.89 | 0.001 |
| LYM448 | 3 | J | 0.84 | 0.004 |
| LYM449 | 1 | A | 0.82 | 0.004 |
| LYM450 | 3 | K | 0.75 | 0.021 |
| LYM450 | 3 | J | 0.76 | 0.018 |
| LYM450 | 4 | A | 0.79 | 0.011 |
| LYM450 | 4 | H | 0.83 | 0.006 |
| LYM450 | 5 | F | 0.90 | 0.040 |
| LYM450 | 5 | G | 0.90 | 0.039 |
| LYM450 | 7 | D | 0.86 | 0.014 |
| LYM450 | 7 | C | 0.81 | 0.028 |
| LYM450 | 7 | K | 0.71 | 0.071 |
| LYM450 | 7 | J | 0.79 | 0.036 |
| LYM451 | 2 | F | 0.74 | 0.023 |
| LYM451 | 2 | G | 0.87 | 0.002 |
| LYM453 | 4 | A | 0.77 | 0.015 |
| LYM453 | 5 | B | 0.95 | 0.015 |
| LYM456 | 7 | K | 0.72 | 0.068 |
| LYM457 | 3 | D | 0.80 | 0.010 |
| LYM457 | 3 | C | 0.82 | 0.007 |
| LYM457 | 3 | K | 0.72 | 0.029 |
| LYM457 | 4 | H | 0.74 | 0.022 |
| LYM460 | 3 | K | 0.75 | 0.021 |
| LYM460 | 3 | J | 0.74 | 0.024 |
| LYM460 | 6 | N | 0.76 | 0.018 |
| LYM460 | 6 | I | 0.78 | 0.012 |
| LYM460 | 7 | K | 0.73 | 0.064 |
| LYM463 | 7 | D | 0.74 | 0.058 |
| LYM463 | 7 | C | 0.71 | 0.075 |
| LYM463 | 7 | J | 0.77 | 0.043 |
| LYM464 | 2 | B | 0.76 | 0.017 |
| LYM464 | 5 | L | 0.99 | 0.002 |
| LYM464 | 8 | N | 0.87 | 0.002 |
| LYM464 | 8 | I | 0.80 | 0.010 |
| LYM466 | 5 | F | 0.81 | 0.097 |
| LYM468 | 1 | A | 0.72 | 0.019 |
| LYM468 | 2 | B | 0.71 | 0.033 |
| LYM468 | 3 | D | 0.76 | 0.017 |
| LYM477 | 2 | G | 0.81 | 0.008 |
| LYM481 | 2 | G | 0.74 | 0.023 |
| LYM481 | 6 | M | 0.71 | 0.032 |
| LYM483 | 2 | B | 0.77 | 0.016 |
| LYM484 | 7 | D | 0.76 | 0.050 |
| LYM485 | 5 | F | 0.98 | 0.003 |
| LYM485 | 5 | G | 0.86 | 0.060 |
| LYM488 | 3 | D | 0.75 | 0.020 |
| LYM488 | 3 | C | 0.80 | 0.009 |
| LYM488 | 4 | H | 0.76 | 0.019 |
| LYM490 | 2 | F | 0.73 | 0.026 |
| LYM490 | 7 | D | 0.74 | 0.057 |
| LYM490 | 7 | C | 0.71 | 0.075 |
| LYM490 | 7 | K | 0.84 | 0.019 |
| LYM491 | 3 | D | 0.71 | 0.033 |
| LYM491 | 3 | C | 0.72 | 0.028 |
| LYM491 | 6 | N | 0.75 | 0.021 |
| LYM491 | 6 | I | 0.79 | 0.012 |
| LYM495 | 3 | D | 0.72 | 0.028 |
| LYM495 | 3 | C | 0.72 | 0.028 |
| LYM495 | 4 | H | 0.71 | 0.032 |
| LYM496 | 7 | K | 0.74 | 0.056 |
| LYM499 | 2 | B | 0.74 | 0.024 |
| LYM501 | 7 | K | 0.74 | 0.059 |
| LYM505 | 8 | N | 0.82 | 0.007 |
| LYM505 | 8 | I | 0.72 | 0.029 |
| LYM508 | 3 | K | 0.76 | 0.017 |
| LYM508 | 5 | B | 0.85 | 0.068 |
| LYM508 | 5 | F | 0.98 | 0.004 |
| LYM508 | 5 | G | 0.83 | 0.079 |
| LYM508 | 7 | K | 0.76 | 0.046 |
| LYM509 | 5 | F | 0.91 | 0.034 |
| LYM509 | 5 | G | 0.82 | 0.089 |
| LYM509 | 7 | C | 0.76 | 0.045 |
| LYM509 | 7 | K | 0.86 | 0.013 |
| LYM509 | 7 | J | 0.74 | 0.057 |

Table 25. Provided are the correlations (R) between the expression levels yield improving genes and their homologs in various tissues [Expression sets (Exp)] and the phenotypic performance [yield, biomass, growth rate and/or vigor components (Correlation vector)] under abiotic stress conditions (salinity) or normal conditions across *Sorghum* accessions. Cor—Correlation vector as described hereinabove (Table 23). P = p value.

Example 7

Production of Maize Transcriptome and High Throughput Correlation Analysis Using 60K Maize Oligonucleotide Micro-Array To produce a high throughput correlation analysis, the present inventors utilized a Maize oligonucleotide micro-array, produced by Agilent Technologies [Hypertxt Transfer Protocol://World Wide Web (dot) chem. (dot) agilent (dot) com/Scripts/PDS (dot) asp?1Page=50879]. The array oligonucleotide represents about 46K Maize genes and transcripts designed based on data from Public databases (Example 1). To define correlations between the levels of RNA expression and yield, biomass components or vigor related parameters, various plant characteristics of 12 different Maize hybrids were analyzed. Among them, 10 hybrids encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

Five tissues at different developmental stages including Ear (flowering—R1), leaf (flowering—R1), Leaf Grain from the basal ear part, Grain from the distal ear, representing different plant characteristics, were sampled and RNA was extracted as described in "GENERAL EXPERIMENTAL AND BIOINFORMATICS METHODS". For convenience, each micro-array expression information tissue type has received a Set ID as summarized in Table 26 below.

TABLE 26

Tissues used for Maize transcriptome expression sets

| | Expression Set | Set ID |
|---|---|---|
| EAR | Flowering-R1 | A |
| EAR | R2-R3 | B |
| Grain basal | R3-R5 | C |
| Grain distal | R3-R5 | D |
| Internode | V6 | E |
| Internode | Flowering-R1 | F |
| Internode | R2-R3 | G |
| Leaf | V6 | H |
| Leaf | Flowering-R1 | J |
| Leaf | R3-R5 | K |

Table 26: Provided are the identification (ID) letters of each of the Maize expression sets (A-K).

The following parameters were collected:

Grain Area ($cm^2$)—At the end of the growing period the grains were separated from the ear. A sample of ~200 grains were weight, photographed and images were processed using the below described image processing system. The grain area was measured from those images and was divided by the number of grains.

Grain Length and Grain width (cm)—At the end of the growing period the grains were separated from the ear. A sample of ~200 grains were weight, photographed and images were processed using the below described image processing system. The sum of grain lengths/or width (longest axis) was measured from those images and was divided by the number of grains.

Ear Area ($cm^2$)—At the end of the growing period 6 ears were, photographed and images were processed using the below described image processing system. The Ear area was measured from those images and was divided by the number of Ears.

Ear Length and Ear Width (cm) At the end of the growing period 6 ears were, photographed and images were processed using the below described image processing system. The Ear length and width (longest axis) was measured from those images and was divided by the number of ears.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 6 plants per plot or by measuring the parameter across all the plants within the plot.

Normalized Grain Weight per plant (gr.)—At the end of the experiment all ears from plots within blocks A-C were collected. 6 ears were separately threshed and grains were weighted, all additional ears were threshed together and weighted as well. The grain weight was normalized using the relative humidity to be 0%. The normalized average grain weight per ear was calculated by dividing the total normalized grain weight by the total number of ears per plot (based on plot). In case of 6 ears, the total grains weight of 6 ears was divided by 6.

Ear FW (gr.)—At the end of the experiment (when ears were harvested) total and 6 selected ears per plots within blocks A-C were collected separately. The plants with (total and 6) were weighted (gr.) separately and the average ear per plant was calculated for total (Ear FW per plot) and for 6 (Ear FW per plant).

Plant height and Ear height—Plants were characterized for height at harvesting. In each measure, 6 plants were measured for their height using a measuring tape. Height was measured from ground level to top of the plant below the tassel. Ear height was measured from the ground level to the place were the main ear is located Leaf number per plant—Plants were characterized for leaf number during growing period at 5 time points. In each measure, plants were measured for their leaf number by counting all the leaves of 3 selected plants per plot.

Relative Growth Rate was calculated using regression coefficient of leaf number change a long time course.

SPAD®—Chlorophyll content was determined using a Minolta SPAD® 502 chlorophyll meter and measurement was performed 64 days post sowing. SPAD® meter readings were done on young fully developed leaf. Three measurements per leaf were taken per plot. Data were taken after 46 and 54 days after sowing (DPS)

Dry weight per plant—At the end of the experiment when all vegetative material from plots within blocks A-C were collected, weight and divided by the number of plants.

Ear diameter [cm]—The diameter of the ear at the mid of the ear was measured using a ruler.

Cob diameter [cm]—The diameter of the cob without grains was measured using a ruler.

Kernel Row Number per Ear—The number of rows in each ear was counted. The average of 6 ears per plot was calculated.

TABLE 27

Maize correlated parameters (vectors)

| Correlated parameter with | Correlation ID |
|---|---|
| Growth rate (Leaf No based) | 1 |
| Plant Height per plot (cm) | 2 |
| Ear Height (cm) | 3 |
| Leaf Number per plant | 4 |
| Ear Length (cm) | 5 |
| Kernel Row Number per Ear | 6 |

TABLE 27-continued

Maize correlated parameters (vectors)

| Correlated parameter with | Correlation ID |
|---|---|
| Ear Width (mm) | 7 |
| Cob diameter (mm) | 8 |
| Ear FW per plant (gr) (based on 6) | 9 |
| Normalized Grain Weight per plant (gr) (based on 6) | 10 |
| Ears FW per plant (gr) (based on all) | 11 |
| Normalized grain weight per plant (gr) (based on all) | 12 |
| Ear Area [cm$^2$] | 13 |
| Ear Width [cm] | 14 |
| Grain Area [cm$^2$] | 15 |
| Grain Length[cm] | 16 |
| Grain Width [cm] | 17 |
| DW per plant (gr) (based on 6) | 18 |

Table 27.

Twelve maize varieties were grown, and characterized for parameters, as described above. The average for each parameter was calculated using the JMP software, and values are summarized in Tables 28 below. Subsequent correlation between the various transcriptome sets for all or sub set of lines was done by the bioinformatic unit and results were integrated into the database.

TABLE 28

Measured parameters in Maize Hybrid

| # | Genotype | Growth rate (Leaf No based) | Plant Height per plot (cm) | Ear Height (cm) | Leaf Number per plant | Ear Length (cm) | Kernel Row Number per Ear |
|---|---|---|---|---|---|---|---|
| 1 | Line 1 | 0.306 | 286.944 | 135.278 | 11.944 | 19.500 | 16.167 |
| 2 | Line 2 | 0.283 | 278.083 | 135.167 | 12.000 | 18.917 | 16.167 |
| 3 | Line 3 | 0.221 | 260.5 | 122.333 | 11.11 | 20.167 | 14.667 |
| 4 | Line 4 | 0.281 | 275.133 | 131.967 | 11.689 | 19.456 | 16.200 |
| 5 | Line 5 | 0.269 | 238.500 | 114.000 | 11.778 | 19.889 | 15.889 |
| 6 | Line 6 | 0.244 | 224.833 | 94.278 | 12.333 | 17.722 | 15.167 |
| 7 | Line 7 | 0.244 | 264.444 | 120.944 | 12.444 | 17.667 | 16.000 |
| 8 | Line 8 | 0.266 | 251.611 | 107.722 | 12.222 | 17.278 | 14.833 |
| 9 | Line 9 | 0.304 | 178.000 | 62.167 | 9.667 | 16.667 | 16 |
| 10 | Line 10 | 0.308 | 279.000 | 139.667 | 11.667 | 17.500 | 17.667 |
| 11 | Line 11 | 0.301 | 278.444 | 112.500 | 12.556 | 20.500 | 15.389 |
| 12 | Line 12 | 0.194 | 163.778 | 60.444 | 9.278 | 19.856 | 14.267 |

Table 28.

TABLE 29

Measured parameters in Maize Hybrid additional parameters

| # | Genotype | Ear Width (mm) | Cob diameter (mm) | Ear FW per plant (gr) (based on 6) | Normalized Grain Weight per plant (gr) (based on 6) | Ears FW per plant (gr) (based on all) | Normalized grain weight per plant (gr) (based on all) |
|---|---|---|---|---|---|---|---|
| 1 | Line 1 | 51.407 | 28.715 | 272.222 | 156.614 | 280.106 | 140.463 |
| 2 | Line 2 | 50.136 | 28.957 | 245.833 | 140.683 | 278.194 | 153.900 |
| 3 | Line 3 | 46.29 | 25.078 | 208.333 | 139.536 | 217.502 | 135.882 |
| 4 | Line 4 | 49.923 | 28.052 | 262.222 | 153.667 | 288.280 | 152.500 |
| 5 | Line 5 | 47.632 | 25.732 | 263.889 | 176.983 | 247.879 | 159.156 |
| 6 | Line 6 | 47.420 | 25.783 | 177.778 | 119.667 | 175.841 | 117.135 |
| 7 | Line 7 | 47.253 | 26.432 | 188.889 | 119.692 | 192.474 | 123.237 |
| 8 | Line 8 | 46.846 | 25.192 | 197.222 | 133.508 | 204.700 | 131.266 |
| 9 | Line 9 | 41.822 | 24.342 | 108.333 | 72.875 | | |
| 10 | Line 10 | 48.283 | 26.933 | 175.000 | 113.850 | 257.692 | 153.260 |
| 11 | Line 11 | 49.275 | 26.668 | 261.111 | 173.231 | 264.236 | 170.662 |
| 12 | Line 12 | 41.837 | | 141.111 | 54.316 | 142.716 | 40.844 |

Table 29.

TABLE 30

Measured parameters in Maize Hybrid additional parameters

| # | Genotype | Ear Area [cm$^2$] | Ear Width [cm] | Grain Area [cm$^2$] | Grain Length [cm] | Grain Width [cm] | DW per plant (gr) (based on 6) |
|---|---|---|---|---|---|---|---|
| 1 | Line 1 | 91.624 | 5.728 | 0.806 | 1.228 | 0.824 | 655.556 |
| 2 | Line 2 | 85.058 | 5.584 | 0.753 | 1.167 | 0.810 | 657.500 |
| 3 | Line 3 | 85.843 | 5.151 | 0.708 | 1.092 | 0.814 | 491.667 |
| 4 | Line 4 | 90.507 | 5.671 | 0.755 | 1.180 | 0.803 | 641.111 |
| 5 | Line 5 | 95.953 | 5.533 | 0.766 | 1.205 | 0.803 | 580.556 |
| 6 | Line 6 | 72.408 | 5.227 | 0.713 | 1.123 | 0.803 | 569.444 |
| 7 | Line 7 | 74.032 | 5.221 | 0.714 | 1.139 | 0.791 | 511.111 |
| 8 | Line 8 | 76.534 | 5.328 | 0.753 | 1.134 | 0.837 | 544.444 |
| 9 | Line 9 | 63.599 | 4.605 | 0.582 | 1.042 | 0.703 | 633.333 |
| 10 | Line 10 | 70.456 | 5.350 | 0.629 | 1.095 | 0.721 | 558.333 |
| 11 | Line 11 | 95.360 | 5.577 | 0.762 | 1.180 | 0.812 | 522.222 |
| 12 | Line 12 | 55.201 | 4.120 | 0.502 | 0.921 | 0.675 | 574.167 |

Table 30.

TABLE 31

Correlation between the expression level of selected genes of some embodiments of the invention in various tissues and the phenotypic performance under normal conditions across maize varieties

| Gene | Exp | Cor | R | P |
|---|---|---|---|---|
| LYM346 | D | 1 | 0.90 | 0.002 |
| LYM346 | D | 15 | 0.86 | 0.006 |
| LYM346 | D | 1 | 0.84 | 0.009 |
| LYM346 | D | 15 | 0.80 | 0.016 |
| LYM346 | D | 7 | 0.73 | 0.038 |
| LYM346 | D | 16 | 0.72 | 0.046 |
| LYM346 | F | 9 | −0.74 | 0.059 |
| LYM346 | F | 5 | −0.74 | 0.059 |
| LYM346 | F | 4 | −0.83 | 0.020 |
| LYM346 | F | 2 | −0.86 | 0.013 |
| LYM346 | F | 13 | −0.86 | 0.013 |
| LYM346 | F | 3 | −0.86 | 0.012 |
| LYM346 | F | 7 | −0.90 | 0.006 |
| LYM346 | F | 16 | −0.90 | 0.005 |
| LYM346 | F | 10 | −0.92 | 0.003 |
| LYM346 | F | 12 | −0.93 | 0.002 |
| LYM346 | F | 17 | −0.95 | 0.001 |
| LYM346 | F | 15 | −0.95 | 0.001 |
| LYM349 | E | 16 | 0.91 | 0.001 |
| LYM349 | F | 2 | 0.91 | 0.005 |
| LYM349 | E | 16 | 0.91 | 0.001 |

TABLE 31-continued

Correlation between the expression level of selected genes of some embodiments of the invention in various tissues and the phenotypic performance under normal conditions across maize varieties

| Gene | Exp | Cor | R | P |
|---|---|---|---|---|
| LYM349 | E | 1 | 0.90 | 0.001 |
| LYM349 | E | 1 | 0.90 | 0.001 |
| LYM349 | E | 2 | 0.90 | 0.001 |
| LYM349 | A | 4 | 0.89 | 0.008 |
| LYM349 | E | 2 | 0.88 | 0.002 |
| LYM349 | A | 2 | 0.88 | 0.010 |
| LYM349 | A | 4 | 0.87 | 0.011 |
| LYM349 | E | 15 | 0.87 | 0.003 |
| LYM349 | F | 2 | 0.87 | 0.012 |
| LYM349 | E | 7 | 0.87 | 0.003 |
| LYM349 | E | 15 | 0.87 | 0.003 |
| LYM349 | A | 7 | 0.86 | 0.012 |
| LYM349 | E | 7 | 0.86 | 0.003 |
| LYM349 | A | 1 | 0.84 | 0.017 |
| LYM349 | E | 5 | 0.84 | 0.005 |
| LYM349 | A | 2 | 0.84 | 0.019 |
| LYM349 | A | 7 | 0.84 | 0.019 |
| LYM349 | F | 11 | 0.83 | 0.021 |
| LYM349 | E | 5 | 0.83 | 0.006 |
| LYM349 | A | 15 | 0.82 | 0.023 |
| LYM349 | E | 9 | 0.82 | 0.007 |
| LYM349 | F | 1 | 0.82 | 0.025 |
| LYM349 | E | 3 | 0.82 | 0.007 |
| LYM349 | E | 9 | 0.81 | 0.008 |
| LYM349 | A | 1 | 0.81 | 0.028 |
| LYM349 | A | 12 | 0.81 | 0.028 |
| LYM349 | E | 6 | 0.80 | 0.009 |
| LYM349 | E | 10 | 0.80 | 0.009 |
| LYM349 | A | 15 | 0.80 | 0.030 |
| LYM349 | E | 3 | 0.80 | 0.010 |
| LYM349 | E | 10 | 0.80 | 0.010 |
| LYM349 | F | 3 | 0.79 | 0.033 |
| LYM349 | A | 16 | 0.79 | 0.034 |
| LYM349 | F | 7 | 0.79 | 0.034 |
| LYM349 | E | 12 | 0.79 | 0.011 |
| LYM349 | A | 17 | 0.79 | 0.036 |
| LYM349 | F | 12 | 0.78 | 0.039 |
| LYM349 | E | 11 | 0.78 | 0.013 |
| LYM349 | E | 6 | 0.78 | 0.014 |
| LYM349 | E | 12 | 0.78 | 0.014 |
| LYM349 | F | 11 | 0.77 | 0.042 |
| LYM349 | A | 16 | 0.77 | 0.043 |
| LYM349 | E | 13 | 0.77 | 0.015 |
| LYM349 | A | 17 | 0.77 | 0.043 |
| LYM349 | A | 12 | 0.77 | 0.044 |
| LYM349 | E | 13 | 0.77 | 0.016 |
| LYM349 | F | 7 | 0.77 | 0.045 |
| LYM349 | E | 11 | 0.76 | 0.017 |
| LYM349 | F | 12 | 0.76 | 0.048 |
| LYM349 | E | 4 | 0.75 | 0.019 |
| LYM349 | E | 4 | 0.75 | 0.020 |
| LYM349 | A | 3 | 0.75 | 0.053 |
| LYM349 | F | 9 | 0.73 | 0.060 |
| LYM349 | F | 15 | 0.73 | 0.064 |
| LYM349 | F | 1 | 0.72 | 0.067 |
| LYM349 | F | 3 | 0.72 | 0.069 |
| LYM349 | A | 10 | 0.72 | 0.069 |
| LYM349 | F | 5 | 0.72 | 0.069 |
| LYM349 | E | 17 | 0.72 | 0.029 |
| LYM349 | E | 17 | 0.71 | 0.031 |
| LYM349 | A | 11 | 0.71 | 0.073 |
| LYM349 | F | 4 | 0.71 | 0.076 |
| LYM349 | F | 13 | 0.70 | 0.079 |
| LYM349 | F | 13 | 0.70 | 0.080 |
| LYM351 | F | 7 | 0.94 | 0.001 |
| LYM351 | J | 10 | 0.94 | 0.002 |
| LYM351 | F | 15 | 0.93 | 0.003 |
| LYM351 | F | 16 | 0.92 | 0.003 |
| LYM351 | J | 5 | 0.92 | 0.003 |
| LYM351 | J | 9 | 0.91 | 0.004 |
| LYM351 | J | 5 | 0.91 | 0.004 |
| LYM351 | J | 13 | 0.91 | 0.004 |
| LYM351 | J | 16 | 0.91 | 0.005 |
| LYM351 | J | 12 | 0.90 | 0.006 |
| LYM351 | J | 10 | 0.90 | 0.006 |
| LYM351 | J | 9 | 0.89 | 0.007 |
| LYM351 | J | 13 | 0.88 | 0.009 |
| LYM351 | F | 12 | 0.87 | 0.011 |
| LYM351 | F | 1 | 0.86 | 0.012 |
| LYM351 | J | 7 | 0.86 | 0.012 |
| LYM351 | H | 12 | 0.86 | 0.001 |
| LYM351 | J | 15 | 0.86 | 0.013 |
| LYM351 | F | 3 | 0.86 | 0.013 |
| LYM351 | F | 10 | 0.85 | 0.017 |
| LYM351 | J | 1 | 0.84 | 0.017 |
| LYM351 | F | 2 | 0.84 | 0.018 |
| LYM351 | A | 7 | 0.84 | 0.018 |
| LYM351 | J | 16 | 0.84 | 0.019 |
| LYM351 | F | 17 | 0.84 | 0.019 |
| LYM351 | H | 4 | 0.83 | 0.003 |
| LYM351 | H | 16 | 0.83 | 0.003 |
| LYM351 | F | 11 | 0.83 | 0.020 |
| LYM351 | J | 12 | 0.83 | 0.021 |
| LYM351 | J | 11 | 0.83 | 0.022 |
| LYM351 | H | 10 | 0.81 | 0.004 |
| LYM351 | F | 9 | 0.81 | 0.027 |
| LYM351 | H | 15 | 0.81 | 0.005 |
| LYM351 | H | 7 | 0.81 | 0.005 |
| LYM351 | E | 15 | 0.81 | 0.009 |
| LYM351 | F | 6 | 0.80 | 0.029 |
| LYM351 | H | 5 | 0.80 | 0.005 |
| LYM351 | A | 15 | 0.80 | 0.031 |
| LYM351 | H | 1 | 0.80 | 0.005 |
| LYM351 | E | 16 | 0.80 | 0.010 |
| LYM351 | J | 1 | 0.79 | 0.033 |
| LYM351 | F | 4 | 0.79 | 0.034 |
| LYM351 | F | 13 | 0.79 | 0.035 |
| LYM351 | A | 16 | 0.79 | 0.035 |
| LYM351 | H | 2 | 0.78 | 0.007 |
| LYM351 | A | 3 | 0.77 | 0.042 |
| LYM351 | A | 6 | 0.77 | 0.043 |
| LYM351 | J | 11 | 0.77 | 0.044 |
| LYM351 | J | 7 | 0.77 | 0.045 |
| LYM351 | E | 7 | 0.75 | 0.019 |
| LYM351 | J | 6 | 0.75 | 0.051 |
| LYM351 | E | 2 | 0.75 | 0.019 |
| LYM351 | J | 15 | 0.75 | 0.051 |
| LYM351 | E | 17 | 0.75 | 0.020 |
| LYM351 | H | 13 | 0.75 | 0.013 |
| LYM351 | J | 3 | 0.75 | 0.055 |
| LYM351 | A | 17 | 0.74 | 0.056 |
| LYM351 | F | 5 | 0.74 | 0.058 |
| LYM351 | J | 2 | 0.73 | 0.062 |
| LYM351 | A | 2 | 0.73 | 0.063 |
| LYM351 | J | 6 | 0.72 | 0.065 |
| LYM351 | A | 4 | 0.72 | 0.070 |
| LYM351 | A | 1 | 0.72 | 0.071 |
| LYM351 | E | 3 | 0.71 | 0.031 |
| LYM351 | H | 9 | 0.71 | 0.021 |
| LYM351 | H | 17 | 0.71 | 0.021 |
| LYM351 | E | 4 | 0.71 | 0.033 |
| LYM351 | J | 17 | 0.70 | 0.077 |
| LYM352 | A | 7 | 0.79 | 0.036 |
| LYM352 | A | 3 | 0.77 | 0.042 |
| LYM352 | A | 15 | 0.76 | 0.049 |
| LYM352 | A | 17 | 0.76 | 0.049 |
| LYM352 | A | 2 | 0.72 | 0.067 |
| LYM352 | A | 16 | 0.71 | 0.071 |
| LYM352 | A | 4 | 0.70 | 0.079 |
| LYM354 | F | 13 | 0.90 | 0.006 |
| LYM354 | J | 13 | 0.88 | 0.008 |
| LYM354 | F | 5 | 0.86 | 0.013 |
| LYM354 | F | 9 | 0.86 | 0.014 |
| LYM354 | J | 3 | 0.85 | 0.015 |
| LYM354 | F | 10 | 0.83 | 0.020 |
| LYM354 | J | 10 | 0.81 | 0.027 |
| LYM354 | J | 12 | 0.81 | 0.029 |
| LYM354 | J | 2 | 0.79 | 0.034 |

TABLE 31-continued

Correlation between the expression level of selected genes of some embodiments of the invention in various tissues and the phenotypic performance under normal conditions across maize varieties

| Gene | Exp | Cor | R | P |
|---|---|---|---|---|
| LYM354 | F | 11 | 0.79 | 0.035 |
| LYM354 | F | 12 | 0.78 | 0.039 |
| LYM354 | J | 9 | 0.78 | 0.039 |
| LYM354 | J | 5 | 0.77 | 0.045 |
| LYM354 | J | 11 | 0.77 | 0.045 |
| LYM354 | F | 3 | 0.73 | 0.062 |
| LYM355 | A | 4 | 0.71 | 0.072 |
| LYM355 | D | 18 | −0.82 | 0.013 |
| LYM355 | D | 18 | −0.83 | 0.011 |
| LYM356 | D | 3 | −0.73 | 0.038 |
| LYM356 | D | 2 | −0.84 | 0.009 |
| LYM359 | D | 1 | 0.88 | 0.004 |
| LYM359 | D | 8 | 0.88 | 0.004 |
| LYM359 | D | 18 | 0.85 | 0.008 |
| LYM359 | D | 7 | 0.83 | 0.010 |
| LYM359 | D | 15 | 0.83 | 0.011 |
| LYM359 | D | 16 | 0.78 | 0.022 |
| LYM359 | D | 11 | 0.75 | 0.034 |
| LYM359 | D | 9 | 0.71 | 0.050 |
| LYM359 | D | 2 | 0.70 | 0.052 |
| LYM359 | F | 8 | −0.79 | 0.060 |
| LYM360 | A | 7 | 0.93 | 0.002 |
| LYM360 | A | 3 | 0.93 | 0.003 |
| LYM360 | F | 12 | 0.92 | 0.004 |
| LYM360 | A | 2 | 0.91 | 0.004 |
| LYM360 | A | 15 | 0.91 | 0.004 |
| LYM360 | J | 3 | 0.90 | 0.005 |
| LYM360 | A | 12 | 0.90 | 0.006 |
| LYM360 | F | 13 | 0.89 | 0.007 |
| LYM360 | F | 7 | 0.89 | 0.007 |
| LYM360 | F | 10 | 0.89 | 0.008 |
| LYM360 | A | 16 | 0.88 | 0.009 |
| LYM360 | F | 2 | 0.88 | 0.009 |
| LYM360 | A | 17 | 0.88 | 0.009 |
| LYM360 | F | 16 | 0.86 | 0.012 |
| LYM360 | J | 13 | 0.86 | 0.013 |
| LYM360 | F | 3 | 0.86 | 0.013 |
| LYM360 | H | 10 | 0.85 | 0.002 |
| LYM360 | F | 15 | 0.85 | 0.016 |
| LYM360 | J | 12 | 0.84 | 0.017 |
| LYM360 | A | 10 | 0.84 | 0.018 |
| LYM360 | J | 10 | 0.84 | 0.018 |
| LYM360 | F | 5 | 0.83 | 0.021 |
| LYM360 | H | 13 | 0.82 | 0.003 |
| LYM360 | F | 9 | 0.82 | 0.023 |
| LYM360 | H | 12 | 0.82 | 0.004 |
| LYM360 | A | 13 | 0.82 | 0.025 |
| LYM360 | F | 11 | 0.82 | 0.025 |
| LYM360 | H | 5 | 0.81 | 0.004 |
| LYM360 | A | 4 | 0.81 | 0.028 |
| LYM360 | E | 4 | 0.81 | 0.008 |
| LYM360 | J | 2 | 0.80 | 0.029 |
| LYM360 | J | 15 | 0.80 | 0.032 |
| LYM360 | H | 16 | 0.79 | 0.006 |
| LYM360 | J | 7 | 0.79 | 0.035 |
| LYM360 | A | 11 | 0.78 | 0.039 |
| LYM360 | H | 15 | 0.78 | 0.008 |
| LYM360 | J | 17 | 0.77 | 0.042 |
| LYM360 | J | 16 | 0.77 | 0.042 |
| LYM360 | E | 16 | 0.76 | 0.017 |
| LYM360 | F | 17 | 0.76 | 0.047 |
| LYM360 | F | 4 | 0.76 | 0.048 |
| LYM360 | H | 7 | 0.76 | 0.011 |
| LYM360 | A | 9 | 0.74 | 0.055 |
| LYM360 | E | 15 | 0.74 | 0.023 |
| LYM360 | J | 9 | 0.73 | 0.060 |
| LYM360 | H | 2 | 0.73 | 0.016 |
| LYM360 | F | 1 | 0.73 | 0.065 |
| LYM360 | F | 6 | 0.72 | 0.069 |
| LYM360 | J | 11 | 0.71 | 0.072 |
| LYM360 | H | 17 | 0.71 | 0.021 |
| LYM360 | H | 4 | 0.71 | 0.022 |
| LYM360 | A | 6 | 0.70 | 0.077 |
| LYM360 | A | 1 | 0.70 | 0.078 |
| LYM360 | J | 5 | 0.70 | 0.079 |
| LYM360 | A | 5 | 0.70 | 0.080 |
| LYM361 | J | 16 | 0.97 | 0.000 |
| LYM361 | J | 15 | 0.95 | 0.001 |
| LYM361 | J | 7 | 0.95 | 0.001 |
| LYM361 | A | 15 | 0.94 | 0.002 |
| LYM361 | A | 16 | 0.94 | 0.002 |
| LYM361 | F | 16 | 0.94 | 0.002 |
| LYM361 | J | 12 | 0.93 | 0.003 |
| LYM361 | A | 4 | 0.92 | 0.003 |
| LYM361 | J | 10 | 0.92 | 0.003 |
| LYM361 | A | 7 | 0.90 | 0.006 |
| LYM361 | F | 10 | 0.89 | 0.007 |
| LYM361 | A | 17 | 0.88 | 0.009 |
| LYM361 | J | 4 | 0.87 | 0.010 |
| LYM361 | F | 7 | 0.87 | 0.011 |
| LYM361 | J | 17 | 0.87 | 0.011 |
| LYM361 | F | 15 | 0.86 | 0.012 |
| LYM361 | J | 13 | 0.86 | 0.013 |
| LYM361 | F | 12 | 0.85 | 0.016 |
| LYM361 | A | 12 | 0.84 | 0.017 |
| LYM361 | A | 10 | 0.84 | 0.019 |
| LYM361 | F | 6 | 0.84 | 0.019 |
| LYM361 | F | 13 | 0.83 | 0.020 |
| LYM361 | J | 3 | 0.82 | 0.023 |
| LYM361 | F | 5 | 0.82 | 0.024 |
| LYM361 | F | 9 | 0.82 | 0.025 |
| LYM361 | J | 2 | 0.80 | 0.031 |
| LYM361 | J | 9 | 0.79 | 0.034 |
| LYM361 | J | 5 | 0.79 | 0.035 |
| LYM361 | J | 6 | 0.77 | 0.042 |
| LYM361 | J | 1 | 0.77 | 0.045 |
| LYM361 | A | 1 | 0.76 | 0.049 |
| LYM361 | F | 1 | 0.75 | 0.052 |
| LYM361 | F | 4 | 0.75 | 0.054 |
| LYM361 | J | 11 | 0.73 | 0.061 |
| LYM361 | A | 13 | 0.73 | 0.065 |
| LYM361 | F | 17 | 0.70 | 0.077 |
| LYM361 | F | 11 | 0.70 | 0.078 |
| LYM362 | A | 17 | 0.97 | 0.000 |
| LYM362 | A | 15 | 0.96 | 0.001 |
| LYM362 | A | 4 | 0.95 | 0.001 |
| LYM362 | A | 7 | 0.90 | 0.005 |
| LYM362 | A | 12 | 0.90 | 0.005 |
| LYM362 | A | 16 | 0.90 | 0.006 |
| LYM362 | H | 17 | 0.89 | 0.001 |
| LYM362 | H | 15 | 0.87 | 0.001 |
| LYM362 | A | 10 | 0.87 | 0.012 |
| LYM362 | A | 2 | 0.86 | 0.013 |
| LYM362 | H | 12 | 0.85 | 0.002 |
| LYM362 | H | 16 | 0.84 | 0.003 |
| LYM362 | H | 10 | 0.83 | 0.003 |
| LYM362 | A | 1 | 0.82 | 0.025 |
| LYM362 | E | 17 | 0.81 | 0.008 |
| LYM362 | H | 7 | 0.81 | 0.004 |
| LYM362 | H | 4 | 0.78 | 0.008 |
| LYM362 | E | 4 | 0.78 | 0.014 |
| LYM362 | A | 13 | 0.77 | 0.044 |
| LYM362 | A | 3 | 0.76 | 0.046 |
| LYM362 | H | 13 | 0.74 | 0.014 |
| LYM362 | H | 3 | 0.73 | 0.017 |
| LYM362 | F | 17 | 0.72 | 0.066 |
| LYM362 | H | 2 | 0.70 | 0.024 |
| LYM364 | A | 16 | 0.87 | 0.010 |
| LYM364 | A | 15 | 0.87 | 0.011 |
| LYM364 | A | 16 | 0.85 | 0.015 |
| LYM364 | A | 15 | 0.85 | 0.016 |
| LYM364 | A | 10 | 0.83 | 0.021 |
| LYM364 | A | 7 | 0.83 | 0.021 |
| LYM364 | A | 17 | 0.82 | 0.024 |
| LYM364 | A | 10 | 0.80 | 0.031 |
| LYM364 | A | 7 | 0.80 | 0.032 |
| LYM364 | A | 4 | 0.79 | 0.033 |
| LYM364 | A | 12 | 0.79 | 0.033 |

TABLE 31-continued

Correlation between the expression level of selected genes of some embodiments of the invention in various tissues and the phenotypic performance under normal conditions across maize varieties

| Gene | Exp | Cor | R | P |
|---|---|---|---|---|
| LYM364 | A | 17 | 0.79 | 0.035 |
| LYM364 | A | 12 | 0.79 | 0.036 |
| LYM364 | A | 13 | 0.77 | 0.042 |
| LYM364 | A | 3 | 0.74 | 0.055 |
| LYM364 | A | 13 | 0.71 | 0.072 |
| LYM366 | B | 17 | 0.74 | 0.092 |
| LYM366 | A | 1 | −0.71 | 0.075 |
| LYM366 | A | 13 | −0.77 | 0.041 |
| LYM366 | A | 10 | −0.85 | 0.016 |
| LYM366 | A | 3 | −0.86 | 0.013 |
| LYM366 | A | 2 | −0.87 | 0.012 |
| LYM366 | A | 12 | −0.89 | 0.007 |
| LYM366 | A | 4 | −0.90 | 0.006 |
| LYM366 | A | 16 | −0.91 | 0.005 |
| LYM366 | A | 7 | −0.93 | 0.003 |
| LYM366 | A | 15 | −0.97 | 0.000 |
| LYM366 | A | 17 | −0.98 | 0.000 |
| LYM368 | F | 15 | 0.98 | 0.000 |
| LYM368 | F | 17 | 0.97 | 0.000 |
| LYM368 | F | 15 | 0.97 | 0.000 |
| LYM368 | A | 15 | 0.96 | 0.000 |
| LYM368 | A | 17 | 0.96 | 0.001 |
| LYM368 | F | 17 | 0.96 | 0.001 |
| LYM368 | A | 17 | 0.95 | 0.001 |
| LYM368 | F | 15 | 0.95 | 0.001 |
| LYM368 | F | 16 | 0.95 | 0.001 |
| LYM368 | A | 17 | 0.95 | 0.001 |
| LYM368 | E | 17 | 0.94 | 0.000 |
| LYM368 | J | 4 | 0.94 | 0.002 |
| LYM368 | A | 7 | 0.94 | 0.002 |
| LYM368 | E | 17 | 0.94 | 0.000 |
| LYM368 | F | 17 | 0.94 | 0.002 |
| LYM368 | H | 15 | 0.94 | 0.000 |
| LYM368 | F | 7 | 0.93 | 0.002 |
| LYM368 | J | 4 | 0.93 | 0.002 |
| LYM368 | J | 17 | 0.93 | 0.002 |
| LYM368 | J | 4 | 0.93 | 0.002 |
| LYM368 | J | 17 | 0.93 | 0.002 |
| LYM368 | J | 17 | 0.93 | 0.003 |
| LYM368 | A | 4 | 0.93 | 0.003 |
| LYM368 | A | 15 | 0.93 | 0.003 |
| LYM368 | F | 12 | 0.93 | 0.003 |
| LYM368 | H | 17 | 0.93 | 0.000 |
| LYM368 | F | 16 | 0.92 | 0.003 |
| LYM368 | F | 10 | 0.92 | 0.003 |
| LYM368 | A | 4 | 0.92 | 0.003 |
| LYM368 | H | 15 | 0.92 | 0.000 |
| LYM368 | H | 17 | 0.92 | 0.000 |
| LYM368 | F | 7 | 0.91 | 0.004 |
| LYM368 | E | 15 | 0.91 | 0.001 |
| LYM368 | A | 16 | 0.91 | 0.004 |
| LYM368 | H | 15 | 0.91 | 0.000 |
| LYM368 | J | 15 | 0.90 | 0.005 |
| LYM368 | J | 15 | 0.90 | 0.005 |
| LYM368 | H | 17 | 0.90 | 0.000 |
| LYM368 | E | 15 | 0.90 | 0.001 |
| LYM368 | E | 15 | 0.90 | 0.001 |
| LYM368 | A | 7 | 0.90 | 0.006 |
| LYM368 | H | 7 | 0.89 | 0.000 |
| LYM368 | H | 16 | 0.89 | 0.001 |
| LYM368 | F | 16 | 0.89 | 0.007 |
| LYM368 | E | 4 | 0.89 | 0.001 |
| LYM368 | J | 15 | 0.89 | 0.007 |
| LYM368 | E | 17 | 0.89 | 0.001 |
| LYM368 | H | 16 | 0.89 | 0.001 |
| LYM368 | F | 7 | 0.89 | 0.008 |
| LYM368 | F | 12 | 0.89 | 0.008 |
| LYM368 | E | 16 | 0.89 | 0.002 |
| LYM368 | F | 4 | 0.88 | 0.009 |
| LYM368 | E | 4 | 0.87 | 0.002 |
| LYM368 | E | 7 | 0.87 | 0.002 |
| LYM368 | E | 16 | 0.87 | 0.002 |
| LYM368 | F | 10 | 0.87 | 0.011 |
| LYM368 | F | 4 | 0.87 | 0.011 |
| LYM368 | H | 10 | 0.86 | 0.001 |
| LYM368 | A | 12 | 0.86 | 0.013 |
| LYM368 | A | 16 | 0.86 | 0.013 |
| LYM368 | A | 15 | 0.86 | 0.013 |
| LYM368 | F | 3 | 0.86 | 0.013 |
| LYM368 | E | 7 | 0.86 | 0.003 |
| LYM368 | E | 4 | 0.86 | 0.003 |
| LYM368 | H | 10 | 0.86 | 0.002 |
| LYM368 | H | 16 | 0.86 | 0.002 |
| LYM368 | F | 13 | 0.85 | 0.014 |
| LYM368 | F | 12 | 0.85 | 0.014 |
| LYM368 | H | 7 | 0.85 | 0.002 |
| LYM368 | A | 2 | 0.85 | 0.015 |
| LYM368 | E | 12 | 0.85 | 0.004 |
| LYM368 | H | 12 | 0.85 | 0.002 |
| LYM368 | F | 4 | 0.85 | 0.017 |
| LYM368 | H | 7 | 0.84 | 0.002 |
| LYM368 | E | 16 | 0.84 | 0.004 |
| LYM368 | J | 7 | 0.84 | 0.018 |
| LYM368 | J | 16 | 0.84 | 0.018 |
| LYM368 | J | 16 | 0.84 | 0.018 |
| LYM368 | E | 10 | 0.84 | 0.005 |
| LYM368 | E | 7 | 0.84 | 0.005 |
| LYM368 | J | 7 | 0.83 | 0.020 |
| LYM368 | E | 10 | 0.83 | 0.005 |
| LYM368 | F | 10 | 0.83 | 0.021 |
| LYM368 | A | 2 | 0.83 | 0.021 |
| LYM368 | H | 10 | 0.83 | 0.003 |
| LYM368 | A | 3 | 0.83 | 0.022 |
| LYM368 | F | 2 | 0.82 | 0.023 |
| LYM368 | F | 3 | 0.82 | 0.023 |
| LYM368 | A | 12 | 0.82 | 0.023 |
| LYM368 | H | 12 | 0.82 | 0.004 |
| LYM368 | E | 12 | 0.82 | 0.007 |
| LYM368 | E | 2 | 0.82 | 0.007 |
| LYM368 | J | 16 | 0.82 | 0.025 |
| LYM368 | E | 10 | 0.81 | 0.007 |
| LYM368 | J | 7 | 0.81 | 0.026 |
| LYM368 | A | 4 | 0.81 | 0.026 |
| LYM368 | A | 10 | 0.81 | 0.027 |
| LYM368 | F | 3 | 0.81 | 0.027 |
| LYM368 | E | 12 | 0.81 | 0.009 |
| LYM368 | H | 12 | 0.80 | 0.005 |
| LYM368 | A | 3 | 0.80 | 0.029 |
| LYM368 | A | 7 | 0.80 | 0.030 |
| LYM368 | F | 2 | 0.80 | 0.031 |
| LYM368 | A | 2 | 0.80 | 0.032 |
| LYM368 | A | 3 | 0.79 | 0.034 |
| LYM368 | H | 13 | 0.79 | 0.006 |
| LYM368 | F | 2 | 0.78 | 0.038 |
| LYM368 | A | 1 | 0.78 | 0.038 |
| LYM368 | F | 13 | 0.78 | 0.038 |
| LYM368 | E | 2 | 0.78 | 0.013 |
| LYM368 | H | 13 | 0.77 | 0.009 |
| LYM368 | F | 9 | 0.77 | 0.044 |
| LYM368 | E | 2 | 0.77 | 0.016 |
| LYM368 | H | 4 | 0.76 | 0.011 |
| LYM368 | E | 3 | 0.76 | 0.018 |
| LYM368 | H | 3 | 0.76 | 0.012 |
| LYM368 | A | 10 | 0.76 | 0.050 |
| LYM368 | A | 16 | 0.75 | 0.050 |
| LYM368 | J | 12 | 0.75 | 0.051 |
| LYM368 | E | 13 | 0.75 | 0.020 |
| LYM368 | H | 2 | 0.75 | 0.013 |
| LYM368 | J | 12 | 0.75 | 0.053 |
| LYM368 | H | 4 | 0.75 | 0.013 |
| LYM368 | A | 12 | 0.75 | 0.053 |
| LYM368 | F | 5 | 0.75 | 0.053 |
| LYM368 | H | 4 | 0.74 | 0.014 |
| LYM368 | F | 1 | 0.74 | 0.058 |
| LYM368 | H | 13 | 0.74 | 0.015 |
| LYM368 | F | 13 | 0.74 | 0.059 |
| LYM368 | J | 12 | 0.73 | 0.061 |
| LYM368 | E | 13 | 0.73 | 0.026 |

TABLE 31-continued

Correlation between the expression level of selected genes of some embodiments of the invention in various tissues and the phenotypic performance under normal conditions across maize varieties

| Gene | Exp | Cor | R | P |
|---|---|---|---|---|
| LYM368 | H | 1 | 0.73 | 0.017 |
| LYM368 | H | 3 | 0.73 | 0.017 |
| LYM368 | H | 9 | 0.72 | 0.018 |
| LYM368 | H | 3 | 0.72 | 0.019 |
| LYM368 | A | 13 | 0.72 | 0.071 |
| LYM368 | F | 11 | 0.71 | 0.072 |
| LYM368 | E | 13 | 0.71 | 0.032 |
| LYM368 | J | 10 | 0.71 | 0.073 |
| LYM368 | A | 1 | 0.71 | 0.075 |
| LYM368 | E | 3 | 0.70 | 0.034 |
| LYM368 | H | 2 | 0.70 | 0.023 |
| LYM368 | J | 10 | 0.70 | 0.079 |
| LYM369 | J | 17 | 0.81 | 0.026 |
| LYM369 | J | 15 | 0.79 | 0.035 |
| LYM369 | J | 4 | 0.77 | 0.044 |
| LYM369 | J | 1 | 0.75 | 0.053 |
| LYM369 | J | 7 | 0.72 | 0.066 |
| LYM369 | J | 16 | 0.70 | 0.077 |
| LYM369 | E | 10 | -0.72 | 0.027 |
| LYM369 | E | 4 | -0.73 | 0.026 |
| LYM369 | D | 16 | -0.74 | 0.035 |
| LYM369 | D | 16 | -0.74 | 0.035 |
| LYM369 | E | 3 | -0.76 | 0.017 |
| LYM369 | D | 1 | -0.76 | 0.028 |
| LYM369 | E | 12 | -0.76 | 0.017 |
| LYM369 | D | 1 | -0.77 | 0.024 |
| LYM369 | D | 18 | -0.79 | 0.019 |
| LYM369 | D | 18 | -0.80 | 0.016 |
| LYM369 | E | 2 | -0.82 | 0.007 |
| LYM369 | E | 16 | -0.84 | 0.005 |
| LYM369 | E | 3 | -0.85 | 0.004 |
| LYM369 | E | 7 | -0.86 | 0.003 |
| LYM369 | E | 15 | -0.89 | 0.001 |
| LYM369 | E | 17 | -0.91 | 0.001 |
| LYM370 | E | 3 | -0.74 | 0.022 |
| LYM370 | E | 10 | -0.77 | 0.016 |
| LYM370 | E | 2 | -0.79 | 0.011 |
| LYM370 | F | 2 | -0.80 | 0.029 |
| LYM370 | E | 12 | -0.82 | 0.007 |
| LYM370 | E | 16 | -0.85 | 0.004 |
| LYM370 | E | 7 | -0.86 | 0.003 |
| LYM370 | E | 4 | -0.89 | 0.001 |
| LYM370 | E | 15 | -0.90 | 0.001 |
| LYM370 | E | 17 | -0.94 | 0.000 |
| LYM372 | H | 15 | 0.93 | 0.000 |
| LYM372 | J | 17 | 0.92 | 0.003 |
| LYM372 | A | 15 | 0.91 | 0.004 |
| LYM372 | H | 16 | 0.91 | 0.000 |
| LYM372 | A | 4 | 0.91 | 0.005 |
| LYM372 | H | 7 | 0.90 | 0.000 |
| LYM372 | A | 16 | 0.89 | 0.007 |
| LYM372 | H | 17 | 0.89 | 0.001 |
| LYM372 | A | 17 | 0.89 | 0.008 |
| LYM372 | F | 17 | 0.87 | 0.012 |
| LYM372 | F | 4 | 0.86 | 0.013 |
| LYM372 | A | 7 | 0.86 | 0.013 |
| LYM372 | H | 12 | 0.85 | 0.002 |
| LYM372 | H | 10 | 0.85 | 0.002 |
| LYM372 | F | 15 | 0.85 | 0.016 |
| LYM372 | J | 15 | 0.84 | 0.018 |
| LYM372 | J | 4 | 0.82 | 0.025 |
| LYM372 | F | 16 | 0.81 | 0.028 |
| LYM372 | A | 12 | 0.80 | 0.032 |
| LYM372 | H | 4 | 0.79 | 0.006 |
| LYM372 | A | 10 | 0.79 | 0.036 |
| LYM372 | E | 17 | 0.78 | 0.012 |
| LYM372 | F | 7 | 0.77 | 0.042 |
| LYM372 | H | 3 | 0.77 | 0.009 |
| LYM372 | H | 13 | 0.77 | 0.010 |
| LYM372 | J | 16 | 0.75 | 0.051 |
| LYM372 | E | 15 | 0.75 | 0.020 |
| LYM372 | J | 7 | 0.74 | 0.057 |
| LYM372 | E | 4 | 0.73 | 0.026 |
| LYM372 | H | 2 | 0.73 | 0.017 |
| LYM372 | E | 16 | 0.72 | 0.028 |
| LYM372 | F | 12 | 0.72 | 0.069 |
| LYM372 | E | 2 | 0.71 | 0.031 |
| LYM372 | F | 10 | 0.71 | 0.077 |
| LYM372 | E | 7 | 0.70 | 0.035 |
| LYM374 | F | 16 | 0.92 | 0.003 |
| LYM374 | B | 17 | 0.92 | 0.010 |
| LYM374 | B | 17 | 0.91 | 0.011 |
| LYM374 | F | 7 | 0.90 | 0.006 |
| LYM374 | F | 15 | 0.88 | 0.009 |
| LYM374 | F | 16 | 0.88 | 0.009 |
| LYM374 | F | 6 | 0.88 | 0.010 |
| LYM374 | H | 10 | 0.87 | 0.001 |
| LYM374 | F | 15 | 0.86 | 0.014 |
| LYM374 | H | 15 | 0.84 | 0.002 |
| LYM374 | J | 17 | 0.84 | 0.019 |
| LYM374 | H | 12 | 0.83 | 0.003 |
| LYM374 | H | 16 | 0.83 | 0.003 |
| LYM374 | F | 10 | 0.83 | 0.021 |
| LYM374 | H | 4 | 0.82 | 0.003 |
| LYM374 | F | 10 | 0.82 | 0.023 |
| LYM374 | F | 7 | 0.82 | 0.025 |
| LYM374 | F | 12 | 0.81 | 0.027 |
| LYM374 | H | 17 | 0.80 | 0.005 |
| LYM374 | F | 12 | 0.79 | 0.034 |
| LYM374 | F | 3 | 0.79 | 0.034 |
| LYM374 | F | 9 | 0.79 | 0.035 |
| LYM374 | H | 10 | 0.79 | 0.007 |
| LYM374 | F | 1 | 0.79 | 0.036 |
| LYM374 | H | 7 | 0.78 | 0.008 |
| LYM374 | J | 15 | 0.78 | 0.040 |
| LYM374 | H | 5 | 0.78 | 0.008 |
| LYM374 | F | 13 | 0.77 | 0.044 |
| LYM374 | H | 13 | 0.76 | 0.010 |
| LYM374 | F | 11 | 0.76 | 0.049 |
| LYM374 | J | 4 | 0.75 | 0.050 |
| LYM374 | F | 1 | 0.75 | 0.051 |
| LYM374 | J | 2 | 0.75 | 0.052 |
| LYM374 | F | 17 | 0.75 | 0.052 |
| LYM374 | F | 17 | 0.75 | 0.053 |
| LYM374 | F | 4 | 0.74 | 0.055 |
| LYM374 | H | 4 | 0.74 | 0.014 |
| LYM374 | H | 1 | 0.74 | 0.015 |
| LYM374 | F | 13 | 0.73 | 0.060 |
| LYM374 | F | 9 | 0.73 | 0.061 |
| LYM374 | H | 15 | 0.73 | 0.016 |
| LYM374 | F | 5 | 0.72 | 0.067 |
| LYM374 | H | 16 | 0.72 | 0.019 |
| LYM374 | F | 4 | 0.72 | 0.069 |
| LYM374 | J | 1 | 0.72 | 0.069 |
| LYM374 | F | 5 | 0.72 | 0.071 |
| LYM374 | H | 12 | 0.71 | 0.021 |
| LYM374 | J | 7 | 0.70 | 0.078 |
| LYM374 | H | 17 | 0.70 | 0.024 |
| LYM374 | B | 6 | -0.75 | 0.087 |
| LYM374 | B | 6 | -0.76 | 0.078 |
| LYM376 | F | 12 | 0.94 | 0.002 |
| LYM376 | F | 17 | 0.93 | 0.002 |
| LYM376 | F | 15 | 0.93 | 0.002 |
| LYM376 | F | 3 | 0.93 | 0.002 |
| LYM376 | F | 17 | 0.93 | 0.002 |
| LYM376 | F | 2 | 0.92 | 0.003 |
| LYM376 | F | 10 | 0.92 | 0.004 |
| LYM376 | F | 2 | 0.90 | 0.005 |
| LYM376 | F | 7 | 0.90 | 0.006 |
| LYM376 | F | 12 | 0.89 | 0.006 |
| LYM376 | F | 13 | 0.89 | 0.007 |
| LYM376 | F | 15 | 0.89 | 0.007 |
| LYM376 | F | 16 | 0.87 | 0.010 |
| LYM376 | F | 3 | 0.87 | 0.012 |
| LYM376 | F | 10 | 0.86 | 0.013 |
| LYM376 | A | 12 | 0.84 | 0.017 |
| LYM376 | A | 10 | 0.83 | 0.021 |
| LYM376 | F | 7 | 0.83 | 0.021 |

TABLE 31-continued

Correlation between the expression level of selected genes of some embodiments of the invention in various tissues and the phenotypic performance under normal conditions across maize varieties

| Gene | Exp | Cor | R | P |
|---|---|---|---|---|
| LYM376 | F | 13 | 0.83 | 0.022 |
| LYM376 | H | 17 | 0.82 | 0.003 |
| LYM376 | A | 2 | 0.81 | 0.028 |
| LYM376 | A | 13 | 0.81 | 0.029 |
| LYM376 | F | 16 | 0.80 | 0.030 |
| LYM376 | F | 9 | 0.77 | 0.041 |
| LYM376 | F | 4 | 0.77 | 0.042 |
| LYM376 | A | 5 | 0.77 | 0.043 |
| LYM376 | F | 4 | 0.76 | 0.046 |
| LYM376 | A | 15 | 0.76 | 0.048 |
| LYM376 | E | 13 | 0.76 | 0.018 |
| LYM376 | F | 11 | 0.76 | 0.048 |
| LYM376 | F | 5 | 0.75 | 0.050 |
| LYM376 | A | 17 | 0.75 | 0.053 |
| LYM376 | J | 13 | 0.74 | 0.058 |
| LYM376 | H | 17 | 0.73 | 0.016 |
| LYM376 | J | 2 | 0.73 | 0.061 |
| LYM376 | J | 3 | 0.73 | 0.061 |
| LYM376 | J | 12 | 0.73 | 0.064 |
| LYM376 | A | 1 | 0.72 | 0.070 |
| LYM376 | A | 7 | 0.71 | 0.073 |
| LYM376 | J | 10 | 0.71 | 0.073 |
| LYM376 | A | 16 | 0.71 | 0.075 |
| LYM376 | E | 10 | 0.70 | 0.034 |
| LYM376 | A | 4 | 0.70 | 0.079 |
| LYM376 | J | 18 | −0.71 | 0.073 |
| LYM377 | A | 17 | 0.98 | 0.000 |
| LYM377 | A | 15 | 0.97 | 0.000 |
| LYM377 | A | 17 | 0.96 | 0.001 |
| LYM377 | A | 15 | 0.96 | 0.001 |
| LYM377 | A | 7 | 0.93 | 0.002 |
| LYM377 | A | 7 | 0.93 | 0.002 |
| LYM377 | A | 16 | 0.92 | 0.004 |
| LYM377 | A | 4 | 0.91 | 0.005 |
| LYM377 | A | 3 | 0.90 | 0.005 |
| LYM377 | A | 16 | 0.90 | 0.005 |
| LYM377 | A | 12 | 0.90 | 0.006 |
| LYM377 | A | 2 | 0.88 | 0.009 |
| LYM377 | A | 12 | 0.88 | 0.009 |
| LYM377 | A | 10 | 0.86 | 0.013 |
| LYM377 | A | 4 | 0.85 | 0.014 |
| LYM377 | A | 3 | 0.85 | 0.016 |
| LYM377 | A | 2 | 0.84 | 0.017 |
| LYM377 | A | 10 | 0.84 | 0.018 |
| LYM377 | F | 15 | 0.84 | 0.019 |
| LYM377 | F | 16 | 0.83 | 0.020 |
| LYM377 | F | 15 | 0.83 | 0.021 |
| LYM377 | J | 13 | 0.83 | 0.021 |
| LYM377 | F | 7 | 0.83 | 0.022 |
| LYM377 | F | 16 | 0.83 | 0.022 |
| LYM377 | F | 7 | 0.82 | 0.023 |
| LYM377 | J | 13 | 0.81 | 0.026 |
| LYM377 | F | 12 | 0.81 | 0.027 |
| LYM377 | F | 17 | 0.81 | 0.029 |
| LYM377 | A | 13 | 0.80 | 0.030 |
| LYM377 | F | 10 | 0.80 | 0.032 |
| LYM377 | J | 10 | 0.80 | 0.032 |
| LYM377 | H | 13 | 0.80 | 0.006 |
| LYM377 | F | 17 | 0.80 | 0.032 |
| LYM377 | F | 12 | 0.79 | 0.033 |
| LYM377 | H | 13 | 0.79 | 0.006 |
| LYM377 | J | 10 | 0.79 | 0.034 |
| LYM377 | F | 4 | 0.78 | 0.037 |
| LYM377 | H | 10 | 0.78 | 0.007 |
| LYM377 | H | 10 | 0.78 | 0.008 |
| LYM377 | F | 3 | 0.77 | 0.041 |
| LYM377 | F | 10 | 0.77 | 0.044 |
| LYM377 | E | 12 | 0.76 | 0.018 |
| LYM377 | F | 13 | 0.76 | 0.049 |
| LYM377 | J | 12 | 0.76 | 0.049 |
| LYM377 | F | 4 | 0.75 | 0.050 |
| LYM377 | A | 13 | 0.75 | 0.051 |
| LYM377 | F | 3 | 0.75 | 0.052 |
| LYM377 | J | 12 | 0.75 | 0.053 |
| LYM377 | J | 5 | 0.74 | 0.056 |
| LYM377 | J | 16 | 0.73 | 0.061 |
| LYM377 | A | 1 | 0.73 | 0.062 |
| LYM377 | H | 5 | 0.73 | 0.018 |
| LYM377 | J | 5 | 0.72 | 0.065 |
| LYM377 | F | 13 | 0.72 | 0.067 |
| LYM377 | J | 9 | 0.72 | 0.067 |
| LYM377 | H | 5 | 0.72 | 0.019 |
| LYM377 | J | 9 | 0.71 | 0.077 |
| LYM377 | F | 2 | 0.70 | 0.077 |
| LYM377 | F | 2 | 0.70 | 0.077 |
| LYM378 | F | 9 | 0.88 | 0.010 |
| LYM378 | F | 11 | 0.87 | 0.010 |
| LYM378 | F | 6 | 0.87 | 0.011 |
| LYM378 | F | 5 | 0.85 | 0.015 |
| LYM378 | F | 1 | 0.76 | 0.046 |
| LYM378 | F | 13 | 0.74 | 0.059 |
| LYM378 | G | 1 | −0.71 | 0.047 |
| LYM378 | G | 6 | −0.72 | 0.044 |
| LYM378 | G | 16 | −0.80 | 0.018 |
| LYM379 | D | 15 | 0.75 | 0.031 |
| LYM379 | D | 1 | 0.75 | 0.033 |
| LYM380 | E | 15 | −0.71 | 0.033 |
| LYM380 | E | 16 | −0.71 | 0.033 |
| LYM380 | E | 1 | −0.72 | 0.028 |
| LYM380 | E | 4 | −0.74 | 0.022 |
| LYM380 | E | 16 | −0.74 | 0.022 |
| LYM380 | B | 7 | −0.75 | 0.087 |
| LYM380 | E | 4 | −0.76 | 0.018 |
| LYM380 | B | 7 | −0.76 | 0.081 |
| LYM380 | E | 1 | −0.76 | 0.018 |
| LYM382 | F | 2 | 0.95 | 0.001 |
| LYM382 | F | 2 | 0.92 | 0.003 |
| LYM382 | F | 2 | 0.92 | 0.004 |
| LYM382 | F | 3 | 0.88 | 0.009 |
| LYM382 | F | 17 | 0.87 | 0.010 |
| LYM382 | F | 3 | 0.86 | 0.013 |
| LYM382 | F | 17 | 0.85 | 0.016 |
| LYM382 | F | 3 | 0.83 | 0.020 |
| LYM382 | F | 17 | 0.83 | 0.022 |
| LYM382 | G | 1 | 0.80 | 0.017 |
| LYM382 | F | 12 | 0.79 | 0.034 |
| LYM382 | F | 15 | 0.79 | 0.036 |
| LYM382 | F | 15 | 0.78 | 0.040 |
| LYM382 | F | 12 | 0.77 | 0.042 |
| LYM382 | F | 7 | 0.77 | 0.045 |
| LYM382 | G | 1 | 0.76 | 0.030 |
| LYM382 | F | 12 | 0.74 | 0.058 |
| LYM382 | F | 7 | 0.73 | 0.060 |
| LYM382 | F | 15 | 0.73 | 0.063 |
| LYM382 | F | 11 | 0.72 | 0.069 |
| LYM382 | F | 10 | 0.71 | 0.072 |
| LYM382 | F | 13 | 0.70 | 0.077 |
| LYM382 | G | 16 | 0.70 | 0.052 |
| LYM382 | J | 11 | −0.70 | 0.079 |
| LYM382 | D | 10 | −0.70 | 0.051 |
| LYM382 | D | 13 | −0.70 | 0.051 |
| LYM382 | J | 5 | −0.71 | 0.077 |
| LYM382 | A | 9 | −0.71 | 0.077 |
| LYM382 | D | 12 | −0.71 | 0.050 |
| LYM382 | J | 5 | −0.71 | 0.075 |
| LYM382 | A | 9 | −0.71 | 0.075 |
| LYM382 | J | 11 | −0.71 | 0.072 |
| LYM382 | J | 6 | −0.72 | 0.070 |
| LYM382 | J | 6 | −0.72 | 0.069 |
| LYM382 | J | 6 | −0.72 | 0.068 |
| LYM382 | J | 5 | −0.72 | 0.067 |
| LYM382 | D | 13 | −0.72 | 0.042 |
| LYM382 | J | 9 | −0.73 | 0.063 |
| LYM382 | J | 9 | −0.73 | 0.063 |
| LYM382 | J | 4 | −0.73 | 0.063 |
| LYM382 | D | 12 | −0.73 | 0.039 |
| LYM382 | A | 1 | −0.73 | 0.061 |
| LYM382 | D | 10 | −0.73 | 0.039 |

TABLE 31-continued

Correlation between the expression level of selected genes of some embodiments of the invention in various tissues and the phenotypic performance under normal conditions across maize varieties

| Gene | Exp | Cor | R | P |
|---|---|---|---|---|
| LYM382 | D | 11 | −0.73 | 0.039 |
| LYM382 | D | 16 | −0.74 | 0.035 |
| LYM382 | A | 1 | −0.74 | 0.055 |
| LYM382 | J | 9 | −0.74 | 0.055 |
| LYM382 | J | 4 | −0.76 | 0.049 |
| LYM382 | D | 16 | −0.76 | 0.030 |
| LYM382 | D | 11 | −0.76 | 0.029 |
| LYM382 | D | 5 | −0.77 | 0.027 |
| LYM382 | A | 1 | −0.77 | 0.044 |
| LYM382 | J | 4 | −0.77 | 0.042 |
| LYM382 | D | 5 | −0.77 | 0.024 |
| LYM382 | J | 2 | −0.77 | 0.041 |
| LYM382 | A | 13 | −0.79 | 0.035 |
| LYM382 | J | 2 | −0.79 | 0.035 |
| LYM382 | A | 13 | −0.79 | 0.034 |
| LYM382 | J | 17 | −0.79 | 0.033 |
| LYM382 | A | 13 | −0.79 | 0.033 |
| LYM382 | D | 9 | −0.80 | 0.018 |
| LYM382 | J | 2 | −0.80 | 0.032 |
| LYM382 | D | 18 | −0.80 | 0.016 |
| LYM382 | D | 7 | −0.81 | 0.014 |
| LYM382 | D | 9 | −0.82 | 0.013 |
| LYM382 | D | 18 | −0.82 | 0.013 |
| LYM382 | J | 13 | −0.82 | 0.023 |
| LYM382 | J | 13 | −0.82 | 0.023 |
| LYM382 | J | 17 | −0.83 | 0.021 |
| LYM382 | J | 17 | −0.83 | 0.021 |
| LYM382 | J | 10 | −0.84 | 0.018 |
| LYM382 | J | 13 | −0.84 | 0.018 |
| LYM382 | D | 7 | −0.84 | 0.009 |
| LYM382 | A | 3 | −0.85 | 0.016 |
| LYM382 | J | 3 | −0.85 | 0.015 |
| LYM382 | J | 10 | −0.85 | 0.015 |
| LYM382 | J | 15 | −0.85 | 0.014 |
| LYM382 | J | 12 | −0.85 | 0.014 |
| LYM382 | J | 3 | −0.86 | 0.014 |
| LYM382 | A | 3 | −0.86 | 0.013 |
| LYM382 | A | 2 | −0.86 | 0.013 |
| LYM382 | A | 2 | −0.86 | 0.013 |
| LYM382 | A | 3 | −0.86 | 0.013 |
| LYM382 | J | 16 | −0.86 | 0.013 |
| LYM382 | A | 2 | −0.86 | 0.013 |
| LYM382 | J | 10 | −0.86 | 0.012 |
| LYM382 | A | 10 | −0.87 | 0.012 |
| LYM382 | A | 10 | −0.87 | 0.012 |
| LYM382 | A | 10 | −0.87 | 0.011 |
| LYM382 | J | 7 | −0.87 | 0.011 |
| LYM382 | J | 3 | −0.87 | 0.011 |
| LYM382 | J | 12 | −0.87 | 0.011 |
| LYM382 | J | 12 | −0.88 | 0.009 |
| LYM382 | J | 15 | −0.88 | 0.008 |
| LYM382 | J | 15 | −0.89 | 0.008 |
| LYM382 | J | 16 | −0.89 | 0.008 |
| LYM382 | J | 16 | −0.89 | 0.008 |
| LYM382 | J | 7 | −0.89 | 0.007 |
| LYM382 | J | 7 | −0.89 | 0.007 |
| LYM382 | A | 12 | −0.91 | 0.005 |
| LYM382 | A | 4 | −0.91 | 0.005 |
| LYM382 | A | 12 | −0.91 | 0.005 |
| LYM382 | A | 12 | −0.91 | 0.005 |
| LYM382 | A | 4 | −0.91 | 0.004 |
| LYM382 | A | 4 | −0.93 | 0.003 |
| LYM382 | A | 16 | −0.93 | 0.002 |
| LYM382 | A | 16 | −0.93 | 0.002 |
| LYM382 | A | 16 | −0.94 | 0.002 |
| LYM382 | A | 7 | −0.95 | 0.001 |
| LYM382 | A | 7 | −0.95 | 0.001 |
| LYM382 | A | 17 | −0.95 | 0.001 |
| LYM382 | A | 17 | −0.95 | 0.001 |
| LYM382 | A | 17 | −0.96 | 0.001 |
| LYM382 | A | 7 | −0.96 | 0.001 |
| LYM382 | A | 15 | −0.97 | 0.000 |
| LYM382 | A | 15 | −0.97 | 0.000 |
| LYM382 | A | 15 | −0.98 | 0.000 |
| LYM383 | F | 9 | 0.88 | 0.009 |
| LYM383 | F | 11 | 0.88 | 0.009 |
| LYM383 | F | 5 | 0.86 | 0.013 |
| LYM383 | F | 6 | 0.85 | 0.017 |
| LYM383 | F | 1 | 0.77 | 0.042 |
| LYM383 | F | 13 | 0.74 | 0.056 |
| LYM383 | E | 12 | −0.71 | 0.034 |
| LYM383 | E | 15 | −0.71 | 0.032 |
| LYM383 | E | 13 | −0.72 | 0.029 |
| LYM383 | E | 10 | −0.75 | 0.021 |
| LYM383 | E | 17 | −0.75 | 0.020 |
| LYM384 | J | 16 | 0.93 | 0.002 |
| LYM384 | J | 15 | 0.92 | 0.003 |
| LYM384 | J | 10 | 0.91 | 0.004 |
| LYM384 | J | 12 | 0.90 | 0.006 |
| LYM384 | J | 7 | 0.89 | 0.008 |
| LYM384 | J | 4 | 0.88 | 0.008 |
| LYM384 | J | 17 | 0.85 | 0.015 |
| LYM384 | J | 13 | 0.83 | 0.021 |
| LYM384 | J | 5 | 0.78 | 0.040 |
| LYM384 | J | 1 | 0.74 | 0.055 |
| LYM384 | J | 9 | 0.73 | 0.060 |
| LYM384 | J | 2 | 0.72 | 0.069 |
| LYM384 | J | 3 | 0.70 | 0.078 |
| LYM384 | D | 7 | −0.72 | 0.042 |
| LYM384 | D | 8 | −0.74 | 0.038 |
| LYM384 | D | 18 | −0.88 | 0.004 |
| LYM385 | A | 5 | 0.94 | 0.001 |
| LYM385 | A | 1 | 0.94 | 0.002 |
| LYM385 | A | 9 | 0.94 | 0.002 |
| LYM385 | A | 6 | 0.89 | 0.007 |
| LYM385 | A | 11 | 0.89 | 0.008 |
| LYM385 | A | 16 | 0.88 | 0.008 |
| LYM385 | F | 6 | 0.88 | 0.010 |
| LYM385 | A | 10 | 0.88 | 0.010 |
| LYM385 | F | 16 | 0.87 | 0.011 |
| LYM385 | J | 1 | 0.87 | 0.011 |
| LYM385 | J | 5 | 0.87 | 0.012 |
| LYM385 | A | 13 | 0.86 | 0.012 |
| LYM385 | A | 7 | 0.86 | 0.013 |
| LYM385 | A | 12 | 0.86 | 0.014 |
| LYM385 | F | 1 | 0.86 | 0.014 |
| LYM385 | F | 5 | 0.85 | 0.017 |
| LYM385 | F | 7 | 0.82 | 0.024 |
| LYM385 | F | 10 | 0.81 | 0.027 |
| LYM385 | F | 9 | 0.81 | 0.028 |
| LYM385 | J | 9 | 0.80 | 0.030 |
| LYM385 | F | 12 | 0.78 | 0.037 |
| LYM385 | A | 15 | 0.78 | 0.038 |
| LYM385 | E | 4 | 0.77 | 0.016 |
| LYM385 | E | 12 | 0.76 | 0.017 |
| LYM385 | F | 13 | 0.76 | 0.047 |
| LYM385 | J | 11 | 0.76 | 0.047 |
| LYM385 | F | 15 | 0.76 | 0.049 |
| LYM385 | F | 4 | 0.75 | 0.050 |
| LYM385 | J | 13 | 0.73 | 0.060 |
| LYM385 | J | 12 | 0.73 | 0.063 |
| LYM385 | J | 10 | 0.73 | 0.064 |
| LYM385 | A | 2 | 0.71 | 0.071 |
| LYM385 | F | 11 | 0.71 | 0.071 |
| LYM385 | H | 5 | 0.71 | 0.023 |
| LYM386 | B | 17 | 0.91 | 0.011 |
| LYM386 | G | 10 | 0.83 | 0.012 |
| LYM386 | H | 13 | 0.79 | 0.007 |
| LYM386 | G | 16 | 0.79 | 0.021 |
| LYM386 | H | 13 | 0.78 | 0.007 |
| LYM386 | H | 9 | 0.77 | 0.009 |
| LYM386 | H | 11 | 0.76 | 0.011 |
| LYM386 | G | 15 | 0.75 | 0.032 |
| LYM386 | G | 5 | 0.75 | 0.033 |
| LYM386 | G | 16 | 0.74 | 0.036 |
| LYM386 | G | 13 | 0.73 | 0.038 |
| LYM386 | H | 5 | 0.73 | 0.016 |
| LYM386 | H | 5 | 0.73 | 0.016 |

TABLE 31-continued

Correlation between the expression level of selected genes of some embodiments of the invention in various tissues and the phenotypic performance under normal conditions across maize varieties

| Gene | Exp | Cor | R | P |
|---|---|---|---|---|
| LYM386 | H | 12 | 0.72 | 0.020 |
| LYM386 | G | 9 | 0.72 | 0.046 |
| LYM386 | H | 10 | 0.71 | 0.020 |
| LYM386 | H | 9 | 0.71 | 0.021 |
| LYM386 | G | 10 | 0.71 | 0.047 |
| LYM387 | J | 15 | 0.94 | 0.002 |
| LYM387 | J | 16 | 0.91 | 0.004 |
| LYM387 | J | 17 | 0.91 | 0.005 |
| LYM387 | J | 10 | 0.91 | 0.005 |
| LYM387 | J | 12 | 0.90 | 0.005 |
| LYM387 | J | 7 | 0.89 | 0.007 |
| LYM387 | J | 13 | 0.85 | 0.017 |
| LYM387 | J | 3 | 0.83 | 0.021 |
| LYM387 | J | 16 | 0.83 | 0.022 |
| LYM387 | J | 3 | 0.82 | 0.024 |
| LYM387 | J | 10 | 0.82 | 0.025 |
| LYM387 | J | 4 | 0.81 | 0.026 |
| LYM387 | J | 13 | 0.81 | 0.026 |
| LYM387 | J | 7 | 0.81 | 0.028 |
| LYM387 | J | 12 | 0.79 | 0.033 |
| LYM387 | J | 15 | 0.79 | 0.034 |
| LYM387 | F | 6 | 0.79 | 0.035 |
| LYM387 | J | 2 | 0.78 | 0.039 |
| LYM387 | J | 6 | 0.75 | 0.050 |
| LYM387 | J | 9 | 0.74 | 0.058 |
| LYM387 | J | 9 | 0.73 | 0.064 |
| LYM387 | J | 5 | 0.72 | 0.065 |

Table 31. Provided are the correlations (R) between the expression levels yield improving genes and their homologs in various tissues [Expression (Exp) sets] and the phenotypic performance [yield, biomass, growth rate and/or vigor components (Correlation vector (Cor))] under normal conditions across maize varieties. P = p value.

Example 8

Gene Cloning and Generation of Binary Vectors for Plant Expression

To validate their role in improving plant yield, oil content, seed yield, biomass, growth rate, fiber yield, fiber quality, ABST, NUE and/or vigor, selected genes were over-expressed in plants, as follows.

Cloning Strategy

Selected genes from those listed in Examples 1-7 hereinabove were cloned into binary vectors for the generation of transgenic plants. For cloning, the full-length open reading frame (ORF) was first identified. In case of ORF-EST clusters and in some cases already published mRNA sequences were analyzed to identify the entire open reading frame by comparing the results of several translation algorithms to known proteins from other plant species. To clone the full-length cDNAs, reverse transcription (RT) followed by polymerase chain reaction (PCR; RT-PCR) was performed on total RNA extracted from leaves, flowers, siliques or other plant tissues, growing under normal and different treated conditions. Total RNA was extracted as described in "GENERAL EXPERIMENTAL AND BIOINFORMATICS METHODS" above. Production of cDNA and PCR amplification was performed using standard protocols described elsewhere (Sambrook J., E. F. Fritsch, and T. Maniatis. 1989. Molecular Cloning. A Laboratory Manual., 2nd Ed. Cold Spring Harbor Laboratory Press, New York.) which are well known to those skilled in the art. PCR products are purified using PCR purification kit (Qiagen). In case where the entire coding sequence was not found, RACE kit from Invitrogen (RACE=Rapid A mplification of cDNA Ends) was used to access the full cDNA transcript of the gene from the RNA samples described above. RACE products were cloned into high copy vector followed by sequencing or directly sequenced.

The information from the RACE procedure was used for cloning of the full length ORF of the corresponding genes.

In case genomic DNA was cloned, the genes were amplified by direct PCR on genomic DNA extracted from leaf tissue using the DNAeasy kit (Qiagen Cat. No. 69104).

Usually, 2 sets of primers were synthesized for the amplification of each gene from a cDNA or a genomic sequence; an external set of primers and an internal set (nested PCR primers). When needed (e.g., when the first PCR reaction does not result in a satisfactory product for sequencing), an additional primer (or two) of the nested PCR primers were used.

To facilitate cloning of the cDNAs/genomic sequences, a 8-12 bp extension was added to the 5' of each primer. The primer extension includes an endonuclease restriction site. The restriction sites were selected using two parameters: (a). The site does not exist in the cDNA sequence; and (b). The restriction sites in the forward and reverse primers were designed such that the digested cDNA was inserted in the sense formation into the binary vector utilized for transformation.

Each digested PCR product was inserted into a high copy vector pUC19 (New England BioLabs Inc], or into plasmids originating from this vector. In some cases the undigested PCR product was inserted into pCR-Blunt II-TOPO (Invitrogen).

Sequencing of the amplified PCR products was performed, using ABI 377 sequencer (Amersham Biosciences Inc). In some cases, after confirming the sequences of the cloned genes, the cloned cDNA was introduced into a modified pGI binary vector containing the At6669 promoter via digestion with appropriate restriction endonucleases. In any case the insert was followed by single copy of the NOS terminator (SEQ ID NO:8092). The digested products and the linearized plasmid vector are ligated using T4 DNA ligase enzyme (Roche, Switzerland).

High copy plasmids containing the cloned genes were digested with the restriction endonucleases (New England BioLabs Inc) according to the sites designed in the primers and cloned into binary vectors as shown in Table 32, below.

Several DNA sequences of the selected genes were synthesized by a commercial supplier GeneArt [Hypertext Transfer Protocol://World Wide Web (dot) geneart (dot) com/]. Synthetic DNA was designed in silico. Suitable restriction enzymes sites were added to the cloned sequences at the 5' end and at the 3' end to enable later cloning into the pQFNc binary vector downstream of the At6669 promoter (SEQ ID NO: 4668).

Binary vectors used for cloning: The plasmid pPI is constructed by inserting a synthetic poly-(A) signal sequence, originating from pGL3 basic plasmid vector (Promega, Acc No U47295; by 4658-4811) into the HindIII restriction site of the binary vector pBI101.3 (Clontech, Acc. No. U12640). pGI (pBXYN) is similar to pPI, but the original gene in the backbone, the GUS gene, is replaced by the GUS-Intron gene followed by the NOS terminator (SEQ ID NO:4664) (Vancanneyt. G, et al MGG 220, 245-50, 1990). pGI was used in the past to clone the polynucleotide sequences, initially under the control of 35S promoter [Odell, J T, et al. Nature 313, 810-812 (28 Feb. 1985); SEQ ID NO:4666].

Figure 2:
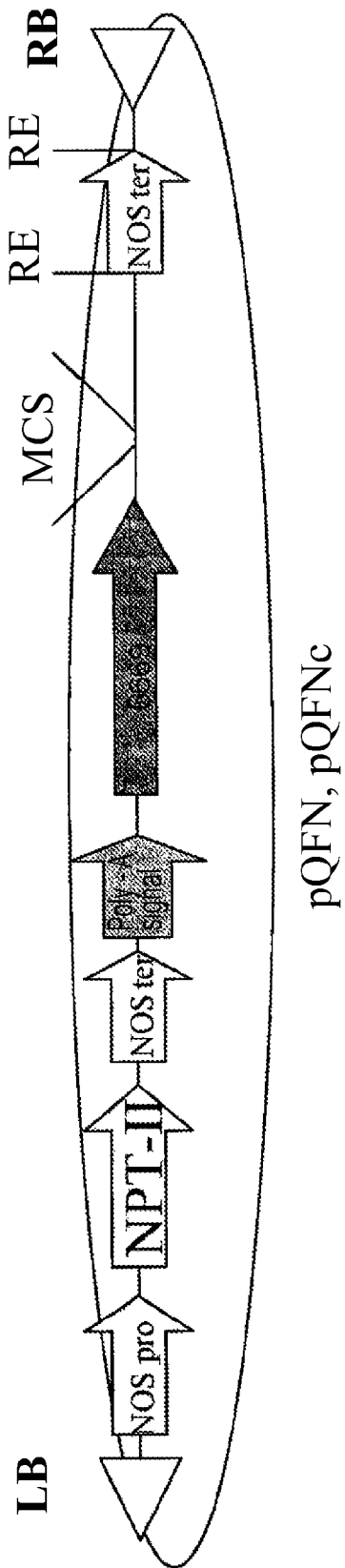
FIG. 2 is a schematic illustration of the modified pGI binary plasmid containing the new At6669 promoter (SEQ ID NO:4668) (pQFN or pQFNc) used for expressing the isolated polynucleotide sequences of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); GUSintron—the GUS reporter gene (coding sequence and intron). The isolated polynucleotide sequences of the invention were cloned into the MCS of the vector.
Figure 4:
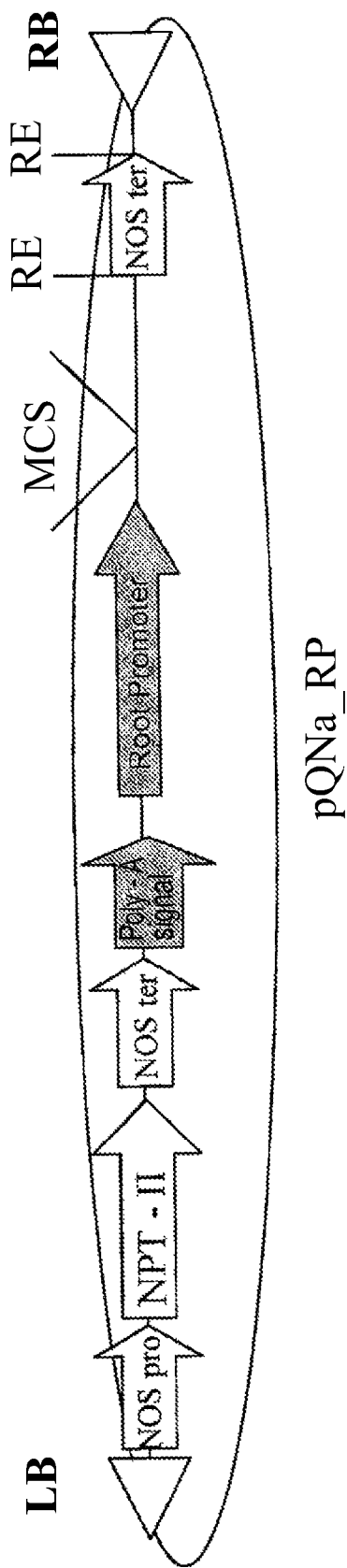
FIG. 4 is a schematic illustration of the modified pGI binary plasmid containing the Root Promoter (pQNa_RP) used for expressing the isolated polynucleotide sequences of the invention. RB—T-DNA right border; LB—T-DNA left border; NOS pro=nopaline synthase promoter; NPT-II=neomycin phosphotransferase gene; NOS ter=nopaline synthase terminator; Poly-A signal (polyadenylation signal); The isolated polynucleotide sequences according to some embodiments of the invention were cloned into the MCS of the vector.
Figure 5:
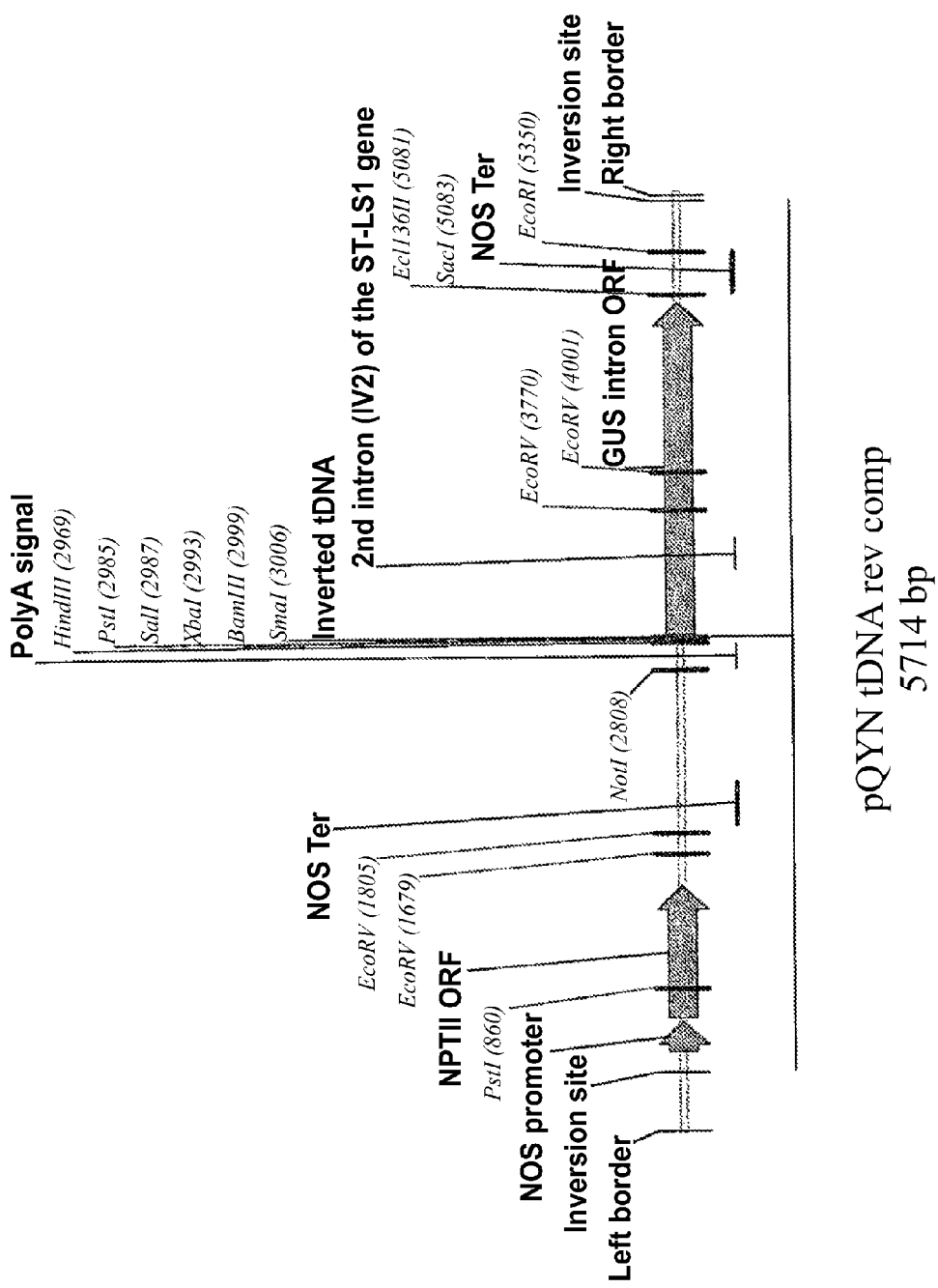
FIG. 5 is a schematic illustration of the pQYN plasmid.
Figure 6:
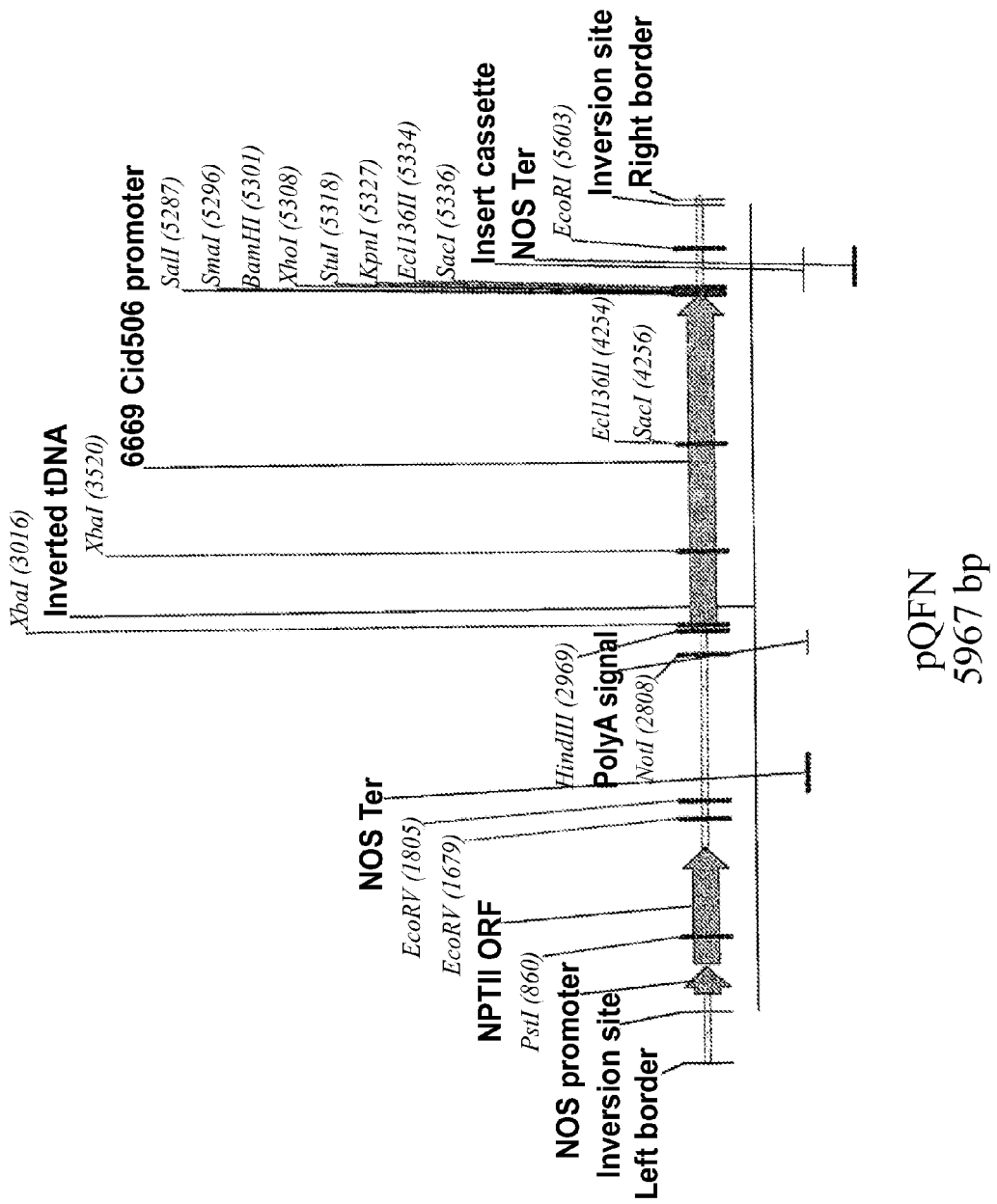
FIG. 6 is a schematic illustration of the pQFN plasmid.
Figure 7:
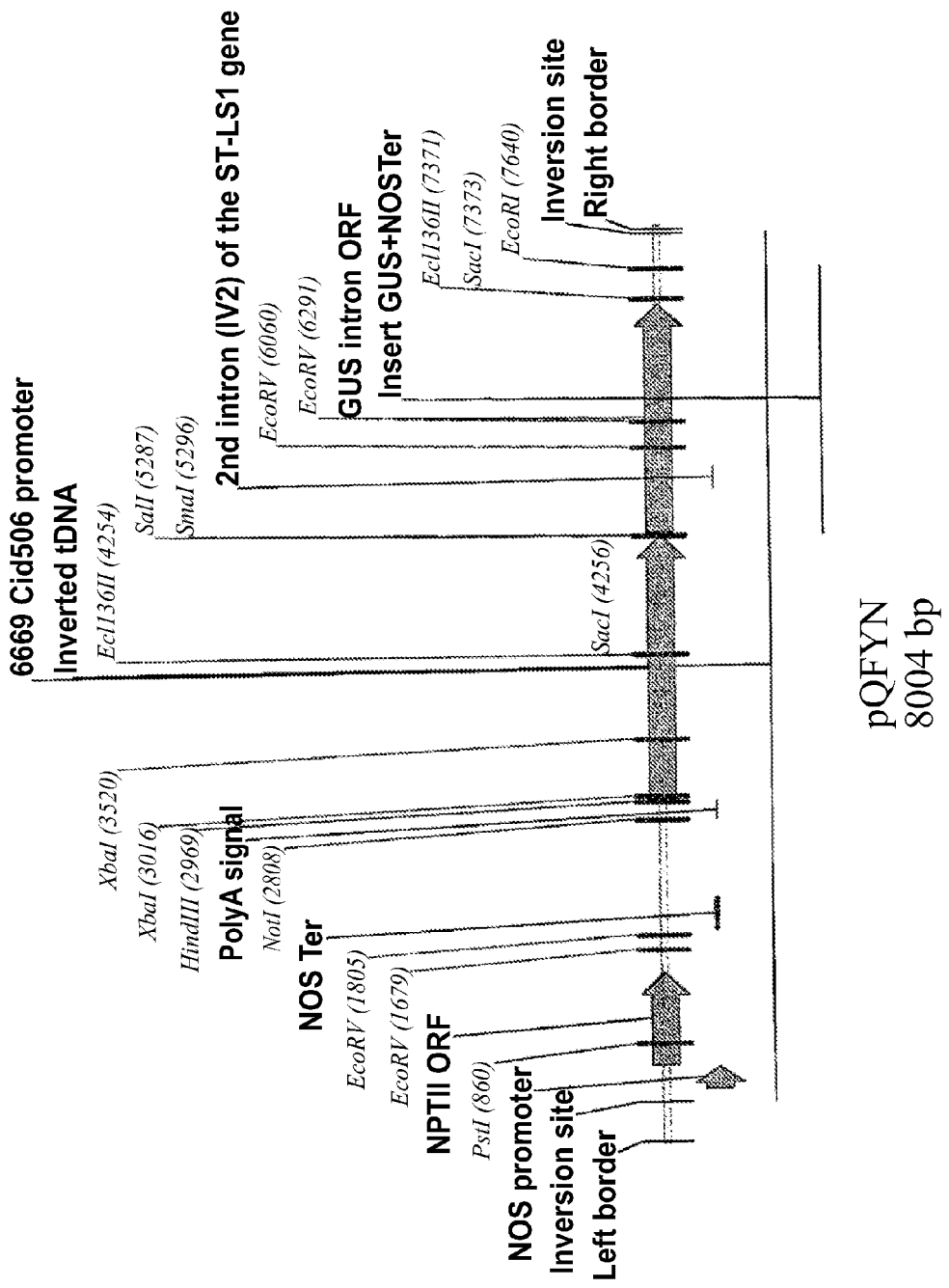
FIG. 7 is a schematic illustration of the pQFYN plasmid.
Figure 8:
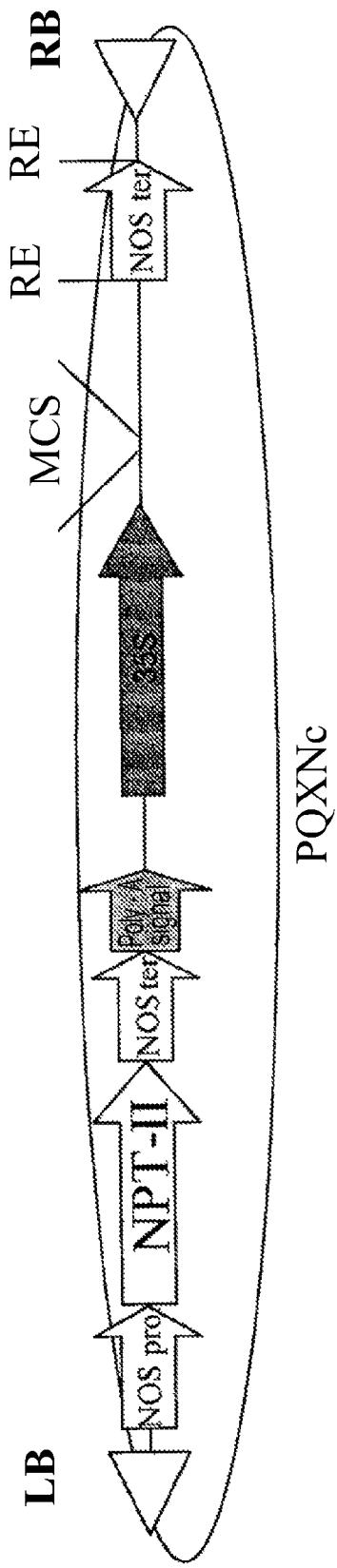
FIG. 8 is a schematic illustration of pQXNc plasmid, which is a modified pGI binary plasmid used for expressing the isolated polynucleotide sequences of some embodiments of the invention. RB—T-DNA right border; LB—T-DNA left border; NOS pro=nopaline synthase promoter; NPT-II=neomycin phosphotransferase gene; NOS ter=nopaline synthase terminator; RE=any restriction enzyme; Poly-A signal (polyadenylation signal); 35S—the 35S promoter (SEQ ID NO:4666). The isolated polynucleotide sequences of some embodiments of the invention were cloned into the MCS (Multiple cloning site) of the vector.

The modified pGI vectors [pQXNc (FIG. 8); or pQFN (FIG. 2), pQFNc (FIG. 2) or pQYN_6669 (FIG. 1)] are modified versions of the pGI vector in which the cassette is inverted between the left and right borders so the gene and its corresponding promoter are close to the right border and the NPTII gene is close to the left border.

At6669, the *Arabidopsis thaliana* promoter sequence (SEQ ID NO:4668) was inserted in the modified pGI binary vector, upstream to the cloned genes, followed by DNA ligation and binary plasmid extraction from positive *E. coli* colonies, as described above.

Colonies were analyzed by PCR using the primers covering the insert which were designed to span the introduced promoter and gene. Positive plasmids were identified, isolated and sequenced.

Genes which were cloned by the present inventors are provided in Table 32 below.

TABLE 32

Genes cloned in High copy number plasmids

| Gene Name | High copy plasmid | Organism | Primers used SEQ ID NOs: | Polyn. SEQ ID NO: | Polyp. SEQ ID NO: |
|---|---|---|---|---|---|
| LYM297 | Topo B | ARABIDOPSIS Arabidopsis thaliana Kondara | 4670, 4805, 4909, 5042 | 2 | 482 |
| LYM337 | | | | 203 | — |
| LYM425 | | | | 206 | — |
| LYM428 | | | | 208 | — |
| LYM434 | | | | 213 | — |
| LYM46 | | | | 289 | 481 |
| LYM298 | pUC19c | ARABIDOPSIS Arabidopsis thaliana Columbia wt | 4806, 5043 | 290 | 483 |
| LYM299 | pUC19c | ARABIDOPSIS Arabidopsis thaliana Columbia wt | 4671, 4807, 4910, 5044 | 291 | 484 |
| LYM300 | pUC19c | BARLEY Hordeum vulgare L. Manit | 4808, 5045 | 292 | 485 |
| LYM301 | pUC19c | BARLEY Hordeum vulgare L. Manit | 4672, 4809, 4911, 5046 | 293 | 486 |
| LYM302 | Topo B | BARLEY Hordeum vulgare L. Manit | 4810, 5047 | 294 | 487 |
| LYM303 | pUC19c | BARLEY Hordeum vulgare L. Manit | 4673, 4811, 4912, 5048 | 295 | 728 |
| LYM305 | pUC19c | BARLEY Hordeum vulgare L. Manit | 4674, 4812, 4913, 4913 | 296 | 729 |
| LYM306 | pUC19c | BARLEY Hordeum vulgare L. Manit | 4675, 4675, 4914, 5049 | 297 | 491 |
| LYM308 | pUC19c | BARLEY Hordeum vulgare L. Spontaneum | 4676, 4676, 4915, 4915 | 298 | 493 |
| LYM309 | pUC19c | BARLEY Hordeum vulgare L. Manit | 4677, 4813, 4916, 5050 | 299 | 494 |
| LYM310 | pUC19c | BARLEY Hordeum vulgare L. Manit | 4678, 4814, 4678, 5051 | 300 | 495 |
| LYM312 | pUC19c | BARLEY Hordeum vulgare L. Spontaneum | 4679, 4815, 4917, 5052 | 301 | 730 |
| LYM313 | pUC19c | BARLEY Hordeum vulgare L. Manit | 4680, 4816, 4918, 5053 | 302 | 497 |
| LYM314 | pUC19c | BARLEY Hordeum vulgare L. Spontaneum | 4681, 4919 | 303 | 498 |
| LYM315 | | | | 304 | 499 |
| LYM316 | | | | 305 | 500 |
| LYM317 | Topo B | BARLEY Hordeum vulgare L. Manit | 4682, 4682, 4920, 4920 | 306 | 501 |
| LYM318 | pUC19c | BARLEY Hordeum vulgare L. Manit | 4683, 4817, 4921, 5054 | 307 | 502 |
| LYM319 | pUC19c | BARLEY Hordeum vulgare L. Manit | 4818, 5055 | 308 | 503 |
| LYM320 | pUC19c | BARLEY Hordeum vulgare L. Manit | 4819, 5056 | 309 | 731 |
| LYM321 | pUC19c | BARLEY Hordeum vulgare L. Manit | 4684, 4684, 4922, 5057 | 310 | 732 |
| LYM322 | pUC19c | BARLEY Hordeum vulgare L. Manit | 4685, 4685, 4923, 5058 | 311 | 733 |
| LYM323 | pUC19c | BARLEY Hordeum vulgare L. Manit | 4820, 5059 | 312 | 734 |
| LYM324 | pUC19c | BARLEY Hordeum vulgare L. Spontaneum | 4686, 4924 | 313 | 735 |
| LYM327 | pUC19c | BARLEY Hordeum vulgare L. Manit | 4687, 4821, 4925, 5060 | 314 | 736 |
| LYM328 | pUC19c | BARLEY Hordeum vulgare L. Manit | 4688, 4822, 4926, 4926 | 315 | 737 |
| LYM329 | pUC19c | BARLEY Hordeum vulgare L. Manit | 4823, 5061 | 316 | 738 |
| LYM330 | pUC19c | BARLEY Hordeum vulgare L. Manit | 4824, 5062 | 317 | 739 |
| LYM331 | pUC19c | BARLEY Hordeum vulgare L. Manit | 4689, 4927 | 318 | 740 |
| LYM332 | pUC19c | BARLEY Hordeum vulgare L. Manit | 4690, 4825, 4928, 5063 | 319 | 741 |
| LYM333 | | | | 320 | 516 |
| LYM334 | pUC19c | BARLEY Hordeum vulgare L. Manit | 4691, 4826, 4929, 5064 | 321 | 517 |
| LYM335 | | | | 322 | 518 |
| LYM336 | pUC19c | BARLEY Hordeum vulgare L. Manit | 4827, 5065 | 323 | 742 |
| LYM338 | pUC19c | BARLEY Hordeum vulgare L. Spontaneum | 4828, 5066 | 324 | 693 |
| LYM339 | pUC19c | BARLEY Hordeum vulgare L. Manit | 4692, 4829, 4930, 5067 | 325 | 743 |
| LYM340 | pUC19c | BRACHYPODIUM Brachypodiums distachyon ND | 4693, 4830, 4931, 5068 | 326 | 744 |
| LYM341 | Topo B | BRACHYPODIUM Brachypodiums distachyon ND | 4694, 4932 | 327 | 523 |
| LYM343 | pUC19c | WHEAT Triticum aestivum L. | 4695, 4933 | 328 | 745 |
| LYM344 | directly to binary | COTTON Gossypium barbadense Pima | 4696, 4831, 4934, 5069 | 329 | 746 |
| LYM345 | Topo B | COTTON Gossypium barbadense Pima | 4697, 4697, 4935, 5070 | 330 | 747 |
| LYM346 | pUC19c | MAIZE Zea mays L. B73 | 4698, 4832, 4936, 5071 | 331 | 748 |
| LYM348 | pUC19c | MAIZE Zea mays L. B73 | 4699, 4833, 4937, 5072 | 332 | 749 |
| LYM349 | pUC19c | MAIZE Zea mays L. B73 | 4700, 4700, 4938, 4938 | 333 | 530 |
| LYM350 | | | | 334 | 531 |
| LYM351 | pUC19c | MAIZE Zea mays L. B73 | 4701, 4834, 4939, 5073 | 335 | 532 |
| LYM352 | | | | 336 | 533 |
| LYM353 | pUC19c | WHEAT Triticum aestivum L. ND | 4702, 4835, 4940, 5074 | 337 | 750 |
| LYM354 | pUC19c | MAIZE Zea mays L. B73 | 4703, 4836, 4941, 5075 | 338 | 751 |
| LYM355 | Topo B | MAIZE Zea mays L. B73 | 4704, 4704, 4942, 5076 | 339 | 752 |
| LYM356 | pUC19c | MAIZE Zea mays L. B73 | 4705, 4837, 4943, 5077 | 340 | 537 |
| LYM357 | | | | 341 | 538 |
| LYM359 | Topo B | MAIZE Zea mays L. B73 | 4706, 4838, 4944, 5078 | 342 | 539 |
| LYM360 | | | | 343 | 540 |
| LYM361 | directly to binary | MAIZE Zea mays L. B73 | 4707, 4839, 4945, 5079 | 344 | 541 |
| LYM362 | pUC19c | MAIZE Zea mays L. B73 | 4708, 4840, 4946, 4946 | 345 | 542 |
| LYM363 | Topo B | MAIZE Zea mays L. B73 | 4709, 4841, 4947, 5080 | 346 | 753 |

TABLE 32-continued

Genes cloned in High copy number plasmids

| Gene Name | High copy plasmid | Organism | Primers used SEQ ID NOs: | Polyn. SEQ ID NO: | Polyp. SEQ ID NO: |
|---|---|---|---|---|---|
| LYM364 | pUC19c | MAIZE *Zea mays* L. B73 | 4710, 4842, 4948, 5081 | 347 | 754 |
| LYM365 | pUC19c | MAIZE *Zea mays* L. B73 | 4711, 4711, 4949, 5082 | 348 | 545 |
| LYM366 | pUC19c | MAIZE *Zea mays* L. B73 | 4712, 4843, 4950, 5083 | 349 | 755 |
| LYM367 | Topo B | MAIZE *Zea mays* L. B73 | 4713, 4951 | 350 | 756 |
| LYM369 | pUC19c | MAIZE *Zea mays* L. B73 | 4714, 4844, 4952, 5084 | 351 | 757 |
| LYM370 | Topo B | MAIZE *Zea mays* L. B73 | 4715, 4845, 4953, 5085 | 352 | 758 |
| LYM371 | Topo B | MAIZE *Zea mays* L. B73 | 4716, 4846, 4954, 5086 | 353 | 759 |
| LYM372 | pUC19c | MAIZE *Zea mays* L. B73 | 4717, 4847, 4955, 5087 | 354 | 760 |
| LYM373 | pUC19c | MAIZE *Zea mays* L. B73 | 4718, 4848, 4956, 5088 | 355 | 761 |
| LYM374 | pUC19c | MAIZE *Zea mays* L. B73 | 4719, 4849, 4957, 4957 | 356 | 554 |
| LYM375 | directly to binary | MAIZE *Zea mays* L. B73 | 4720, 4850, 4958, 5089 | 357 | 762 |
| LYM376 | pUC19c | MAIZE *Zea mays* L. B73 | 4721, 4851, 4959, 5090 | 358 | 556 |
| LYM377 | pUC19c | MAIZE *Zea mays* L. B73 | 4722, 4852, 4960, 5091 | 359 | 557 |
| LYM378 | pUC19c | MAIZE *Zea mays* L. B73 | 4723, 4723, 4961, 5092 | 360 | 558 |
| LYM379 | | | | 361 | 559 |
| LYM380 | Topo B | MAIZE *Zea mays* L. B73 | 4724, 4853, 4962, 5093 | 362 | 560 |
| LYM381 | Topo B | MAIZE *Zea mays* L. B73 | 4725, 4725, 4963, 4963 | 363 | 763 |
| LYM382 | pUC19c | MAIZE *Zea mays* L. B73 | 4726, 4854, 4964, 4964 | 364 | 764 |
| LYM384 | | | | 365 | 564 |
| LYM385 | pUC19c | MAIZE *Zea mays* L. B73 | 4727, 4855, 4965, 5094 | 366 | 765 |
| LYM386 | | | | 367 | 566 |
| LYM387 | pUC19c | MAIZE *Zea mays* L. B73 | 4728, 4856, 4966, 5095 | 368 | 766 |
| LYM388 | pUC19c | MAIZE *Zea mays* L. B73 | 4729, 4857, 4967, 4967 | 369 | 568 |
| LYM389 | | | | 370 | 569 |
| LYM390 | pUC19c | RICE *Oryza sativa* L. *Indica* TEBBONET | 4730, 4858, 4968, 5096 | 371 | 570 |
| LYM391 | | | | 372 | 571 |
| LYM392 | | | | 373 | 572 |
| LYM393 | pUC19c | RICE *Oryza sativa* L. *Indica* TEBBONET | 4731, 4859, 4969, 5097 | 374 | 573 |
| LYM394 | | | | 375 | 574 |
| LYM395 | | | | 376 | 575 |
| LYM396 | pUC19c | RICE *Oryza sativa* L. *Indica* TEBBONET | 4732, 4732, 4970, 5098 | 377 | 576 |
| LYM398 | | | | 378 | 578 |
| LYM399 | pUC19c | RICE *Oryza sativa* L. *Indica* TEBBONET | 4733, 4860, 4971, 5099 | 379 | 579 |
| LYM400 | | | | 380 | 580 |
| LYM401 | pUC19c | RICE *Oryza sativa* L. *Indica* TEBBONET | 4734, 4972 | 381 | 767 |
| LYM402 | | | | 382 | 582 |
| LYM403 | | | | 383 | 583 |
| LYM404 | Topo B | RICE *Oryza sativa* L. *Indica* TEBBONET | 4735, 4861, 4973, 5100 | 384 | 584 |
| LYM405 | | | | 385 | 585 |
| LYM406 | Topo B | RICE *Oryza sativa* L. *Indica* TEBBONET | 4736, 4862, 4974, 5101 | 386 | 586 |
| LYM407 | Topo B | RICE *Oryza sativa* L. *Indica* TEBBONET | 4863, 5102 | 387 | 587 |
| LYM409 | pUC19c | RICE *Oryza sativa* L. *Indica* TEBBONET | 4737, 4864, 4975, 5103 | 388 | 589 |
| LYM410 | Topo B | RICE *Oryza sativa* L. *Indica* TEBBONET | 4738, 4976 | 389 | 768 |
| LYM413 | Topo B | RICE *Oryza sativa* L. *Indica* TEBBONET | 4865, 5104 | 390 | 593 |
| LYM414 | pUC19c | RICE *Oryza sativa* L. *Indica* TEBBONET | 4739, 4977 | 391 | 769 |
| LYM415 | pUC19c | RICE *Oryza sativa* L. *Indica* TEBBONET | 4740, 4740, 4978, 5105 | 392 | 595 |
| LYM416 | pUC19c | RICE *Oryza sativa* L. *Indica* TEBBONET | 4741, 4741, 4979, 5106 | 393 | 596 |
| LYM417 | | | | 394 | 597 |
| LYM418 | Topo B | RICE *Oryza sativa* L. *Indica* TEBBONET | 4742, 4866, 4980, 5107 | 395 | 598 |
| LYM419 | pUC19c | SORGHUM *Sorghum bicolor* ND | 4743, 4981 | 396 | 599 |
| LYM421 | | | | 397 | 600 |
| LYM423 | pUC19c | SORGHUM *Sorghum bicolor* ND | 4800, 4907, 5037, 5037 | 398 | 601 |
| LYM424 | Topo B | SORGHUM *Sorghum bicolor* ND | 4744, 4867, 4982, 4982 | 399 | 770 |
| LYM427 | | | | 400 | 603 |
| LYM433 | pUC19c | SORGHUM *Sorghum bicolor* ND | 4745, 4868, 4983, 5108 | 401 | 604 |
| LYM435 | pUC19c | SORGHUM *Sorghum bicolor* ND | 4746, 4984 | 402 | 605 |
| LYM436 | Topo B | SORGHUM *Sorghum bicolor* ND | 4747, 4985 | 403 | 606 |
| LYM437 | Topo B | SORGHUM *Sorghum bicolor* ND | 4748, 4869, 4986, 5109 | 404 | 607 |
| LYM438 | pUC19c | SORGHUM *Sorghum bicolor* ND | 4870, 5110 | 405 | 608 |
| LYM439 | | | | 406 | 609 |
| LYM440 | Topo B | SORGHUM *Sorghum bicolor* ND | 4749, 4749, 4987, 5111 | 407 | 610 |
| LYM441 | pUC19c | SORGHUM *Sorghum bicolor* ND | 4750, 4871, 4988, 5112 | 408 | 771 |
| LYM442 | Topo B | SORGHUM *Sorghum bicolor* ND | 4751, 4872, 4989, 5113 | 409 | 612 |
| LYM443 | pUC19c | SORGHUM *Sorghum bicolor* ND | 4752, 4873, 4990, 5114 | 410 | 613 |
| LYM444 | pUC19c | SORGHUM *Sorghum bicolor* ND | 4753, 4753, 4991, 4991 | 411 | 772 |
| LYM445 | pUC19c | SORGHUM *Sorghum bicolor* ND | 4754, 4992 | 412 | 773 |
| LYM446 | pUC19c | SORGHUM *Sorghum bicolor* ND | 4755, 4755, 4993, 5115 | 413 | 616 |
| LYM447 | pUC19c | SORGHUM *Sorghum bicolor* ND | 4756, 4874, 4994, 4994 | 414 | 617 |
| LYM448 | pUC19c | SORGHUM *Sorghum bicolor* ND | 4757, 4995 | 415 | 618 |
| LYM449 | Topo B | SORGHUM *Sorghum bicolor* ND | 4875, 5116 | 416 | 619 |
| LYM450 | | | | 417 | 620 |
| LYM451 | pUC19c | SORGHUM *Sorghum bicolor* ND | 4758, 4876, 4996, 5117 | 418 | 621 |
| LYM452 | | | | 419 | 622 |
| LYM453 | pUC19c | SORGHUM *Sorghum bicolor* ND | 4759, 4877, 4997, 5118 | 420 | 774 |

TABLE 32-continued

Genes cloned in High copy number plasmids

| Gene Name | High copy plasmid | Organism | Primers used SEQ ID NOs: | Polyn. SEQ ID NO: | Polyp. SEQ ID NO: |
|---|---|---|---|---|---|
| LYM454 | pUC19c | SORGHUM Sorghum bicolor ND | 4760, 4760, 4998, 4998 | 421 | 624 |
| LYM455 | Topo B | SORGHUM Sorghum bicolor ND | 4761, 4999 | 422 | 625 |
| LYM456 | pUC19c | SORGHUM Sorghum bicolor ND | 4878, 5119 | 423 | 626 |
| LYM457 | | | | 424 | 627 |
| LYM458 | Topo B | SORGHUM Sorghum bicolor ND | 4879, 5120 | 425 | 628 |
| LYM460 | pUC19c | SORGHUM Sorghum bicolor ND | 4762, 4880, 5000, 5121 | 426 | 775 |
| LYM461 | Topo B | SORGHUM Sorghum bicolor ND | 4763, 4881, 5001, 5122 | 427 | 630 |
| LYM463 | pUC19c | SORGHUM Sorghum bicolor ND | 4764, 4764, 5002, 5123 | 428 | 776 |
| LYM464 | pUC19c | SORGHUM Sorghum bicolor ND | 4765, 4765, 5003, 5124 | 429 | 632 |
| LYM465 | pUC19c | SORGHUM Sorghum bicolor ND | 4766, 4882, 5004, 5125 | 430 | 777 |
| LYM466 | Topo B | SORGHUM Sorghum bicolor ND | 4767, 4883, 5005, 5126 | 431 | 778 |
| LYM467 | Topo B | SORGHUM Sorghum bicolor ND | 4768, 5006 | 432 | 635 |
| LYM468 | | | | 433 | 636 |
| LYM471 | Topo B | SORGHUM Sorghum bicolor ND | 4769, 4884, 5007, 5127 | 434 | 779 |
| LYM472 | pUC19c | SORGHUM Sorghum bicolor ND | 4770, 5008 | 435 | 780 |
| LYM473 | directly to binary | SORGHUM Sorghum bicolor ND | 4771, 4885, 5009, 5128 | 436 | 639 |
| LYM474 | pUC19c | SORGHUM Sorghum bicolor ND | 4772, 4886, 5010, 5129 | 437 | 640 |
| LYM475 | pUC19c | SORGHUM Sorghum bicolor ND | 4773, 5011 | 438 | 781 |
| LYM476 | pUC19c | SORGHUM Sorghum bicolor ND | 4774, 4774, 5012, 5130 | 439 | 642 |
| LYM477 | pUC19d | SORGHUM Sorghum bicolor ND | 4775, 4887, 5013, 5013 | 440 | 643 |
| LYM478 | | | | 441 | 644 |
| LYM480 | pUC19c | SORGHUM Sorghum bicolor ND | 4776, 4888, 4776, 5131 | 442 | 646 |
| LYM481 | Topo B | SORGHUM Sorghum bicolor ND | 4777, 5014 | 443 | 782 |
| LYM483 | pUC19c | SORGHUM Sorghum bicolor ND | 4778, 4778, 5015, 5132 | 444 | 783 |
| LYM484 | | | | 445 | 649 |
| LYM485 | | | | 446 | 650 |
| LYM486 | Topo B | SORGHUM Sorghum bicolor ND | 4779, 4889, 5016, 5133 | 447 | 651 |
| LYM487 | pUC19c | SORGHUM Sorghum bicolor ND | 4780, 4890, 5017, 5134 | 448 | 652 |
| LYM488 | pUC19c | SORGHUM Sorghum bicolor ND | 4781, 4891, 5018, 5135 | 449 | 784 |
| LYM489 | pUC19c | SORGHUM Sorghum bicolor ND | 4892, 5136 | 450 | 654 |
| LYM490 | | | | 451 | 655 |
| LYM491 | Topo B | SORGHUM Sorghum bicolor ND | 4782, 4893, 5019, 5137 | 452 | 656 |
| LYM492 | pUC19c | SORGHUM Sorghum bicolor ND | 4783, 4783, 5020, 5138 | 453 | 657 |
| LYM493 | Topo B | SORGHUM Sorghum bicolor ND | 4784, 4894, 5021, 5139 | 454 | 785 |
| LYM494 | pUC19c | SORGHUM Sorghum bicolor ND | 4895, 5140 | 455 | 659 |
| LYM495 | pUC19d | SORGHUM Sorghum bicolor ND | 4785, 4785, 5022, 5141 | 456 | 660 |
| LYM496 | Topo B | SORGHUM Sorghum bicolor ND | 4786, 4896, 5023, 5142 | 457 | 786 |
| LYM497 | | | | 458 | 662 |
| LYM498 | Topo B | SORGHUM Sorghum bicolor ND | 4787, 4897, 5024, 5143 | 459 | 663 |
| LYM499 | Topo B | SORGHUM Sorghum bicolor ND | 4788, 4788, 5025, 5144 | 460 | 787 |
| LYM500 | Topo B | SORGHUM Sorghum bicolor ND | 4789, 4898, 5026, 5026 | 461 | 788 |
| LYM501 | Topo B | SORGHUM Sorghum bicolor ND | 4899, 5145 | 462 | 789 |
| LYM502 | pUC19d | SORGHUM Sorghum bicolor ND | 4790, 5027 | 463 | 667 |
| LYM503 | pUC19c | SORGHUM Sorghum bicolor ND | 4791, 4900, 5028, 5146 | 464 | 668 |
| LYM504 | pUC19c | SORGHUM Sorghum bicolor ND | 4792, 4792, 5029, 5029 | 465 | 669 |
| LYM505 | Topo B | SORGHUM Sorghum bicolor ND | 4793, 4901, 5030, 5147 | 466 | 670 |
| LYM506 | Topo B | SORGHUM Sorghum bicolor ND | 4794, 4902, 5031, 5148 | 467 | 671 |
| LYM507 | Topo B | SORGHUM Sorghum bicolor ND | 4903, 5149 | 468 | 672 |
| LYM509 | pUC19c | SORGHUM Sorghum bicolor ND | 4795, 4904, 5032, 5150 | 469 | 674 |
| LYM510 | Topo B | WHEAT Triticum aestivum L. ND | 4796, 4796, 5033, 5151 | 470 | 790 |
| LYM304_H3 | | | | 471 | 676 |
| LYM307_H7 | pUC19c | SORGHUM Sorghum bicolor ND | 4802, 4802, 5039, 5039 | 472 | 791 |
| LYM326_H4 | | | | 473 | 678 |
| LYM368_H4 | pUC19c | SORGHUM Sorghum bicolor ND | 4803, 4908, 5040, 5155 | 474 | 679 |
| LYM397_H2 | Topo B | SORGHUM Sorghum bicolor ND | 4804, 4804, 5041, 5041 | 475 | 792 |
| LYM311 | pUC19c | BARLEY Hordeum vulgare L. Spontaneum | 4905, 5152 | 476 | — |
| LYM325 | pUC19c | BARLEY Hordeum vulgare L. Manit | 4797, 4797, 5034, 5153 | 477 | — |
| LYM420 | Topo B | SORGHUM Sorghum bicolor ND | 4798, 5035 | 478 | — |
| LYM422 | Topo B | SORGHUM Sorghum bicolor ND | 4799, 4906, 5036, 5036 | 479 | — |
| LYM432 | pUC19c | SORGHUM Sorghum bicolor ND | 4801, 4801, 5038, 5154 | 480 | — |

Table 32. Provided are the genes which were cloned in high copy plasmids, along with the primers used for cloning, the organisms from which the genes were cloned and the resulting polynucleotide ("polyn.") and polypeptide ("polyp.") sequences of the cloned genes.

Example 9

Transforming *Agrobacterium Tumefaciens* Cells with Binary Vectors Harboring Putative Genes Each of the binary vectors described in Example 8 above were used to transform *Agrobacterium* cells. Two additional binary constructs, having a GUS/Luciferase reporter gene replacing the selected gene (positioned downstream of the At6669 promoter) were used as negative controls.

The binary vectors were introduced to *Agrobacterium tumefaciens* GV301, or LB4404 competent cells (about $10^9$ cells/mL) by electroporation. The electroporation was performed using a MicroPulser electroporator (Biorad), 0.2 cm cuvettes (Biorad) and EC-2 electroporation program (Biorad). The treated cells were cultured in LB liquid medium at 28° C. for 3 hours, then plated over LB agar supplemented with gentamycin (50 mg/L; for *Agrobacterium* strains GV301) or streptomycin (300 mg/L; for *Agrobacterium* strain LB4404) and kanamycin (50 mg/L) at 28° C. for 48 hours. *Agrobacterium* colonies which developed on the selective media were analyzed by PCR using the primers which were designed to span the inserted sequence in the pPI plasmid. The resulting PCR products were isolated and sequenced as described in Example 8 above, to verify that the correct nucleotide sequences were properly introduced to the *Agrobacterium* cells.

Example 10

Producing Transgenic *Arabidopsis* Plants Expressing Selected Genes According to Some Embodiments of the Invention Materials and Experimental Methods Plant transformation—The *Arabidopsis thaliana* var Columbia ($T_0$ plants) were transformed according to the Floral Dip procedure [Clough S J, Bent A F. (1998) Floral dip: a simplified method for *Agrobacterium*-mediated transformation of *Arabidopsis thaliana*. Plant J. 16(6): 735-43; and Desfeux C, Clough S J, Bent A F. (2000) Female reproductive tissues are the primary targets of *Agrobacterium*-mediated transformation by the *Arabidopsis* floral-dip method. Plant Physiol. 123(3): 895-904] with minor modifications. Briefly, *Arabidopsis thaliana* Columbia (Col0) $T_0$ plants were sown in 250 ml pots filled with wet peat-based growth mix. The pots were covered with aluminum foil and a plastic dome, kept at 4° C. for 3-4 days, then uncovered and incubated in a growth chamber at 18-24° C. under 16/8 hours light/dark cycles. The $T_0$ plants were ready for transformation six days before anthesis.

Single colonies of *Agrobacterium* carrying the binary vectors harboring the yield genes were cultured in LB medium supplemented with kanamycin (50 mg/L) and gentamycin (50 mg/L). The cultures were incubated at 28° C. for 48 hours under vigorous shaking and centrifuged at 4000 rpm for 5 minutes. The pellets comprising *Agrobacterium* cells were resuspended in a transformation medium which contained half-strength (2.15 g/L) Murashige-Skoog (Duchefa); 0.044 µM benzylamino purine (Sigma); 112 µg/L B5 Gambourg vitamins (Sigma); 5% sucrose; and 0.2 ml/L Silwet L-77 (OSI Specialists, CT) in double-distilled water, at pH of 5.7.

Transformation of $T_0$ plants was performed by inverting each plant into an *Agrobacterium* suspension such that the above ground plant tissue was submerged for 3-5 seconds. Each inoculated $T_0$ plant was immediately placed in a plastic tray, then covered with clear plastic dome to maintain humidity and was kept in the dark at room temperature for 18 hours to facilitate infection and transformation. Transformed (transgenic) plants were then uncovered and transferred to a greenhouse for recovery and maturation. The transgenic $T_0$ plants were grown in the greenhouse for 3-5 weeks until siliques were brown and dry, then seeds were harvested from plants and kept at room temperature until sowing.

For generating $T_1$ and $T_2$ transgenic plants harboring the genes, seeds collected from transgenic $T_0$ plants were surface-sterilized by soaking in 70% ethanol for 1 minute, followed by soaking in 5% sodium hypochlorite and 0.05% triton for 5 minutes. The surface-sterilized seeds were thoroughly washed in sterile distilled water then placed on culture plates containing half-strength Murashig-Skoog (Duchefa); 2% sucrose; 0.8% plant agar; 50 mM kanamycin; and 200 mM carbenicylin (Duchefa). The culture plates were incubated at 4° C. for 48 hours then transferred to a growth room at 25° C. for an additional week of incubation. Vital $T_1$ *Arabidopsis* plants were transferred to a fresh culture plates for another week of incubation. Following incubation the $T_1$ plants were removed from culture plates and planted in growth mix contained in 250 ml pots. The transgenic plants were allowed to grow in a greenhouse to maturity. Seeds harvested from $T_1$ plants were cultured and grown to maturity as $T_2$ plants under the same conditions as used for culturing and growing the $T_1$ plants.

Example 11

Evaluation of Transgenic *Arabidopsis* for Seed Yield and Plant Growth Rate Under Normal Conditions in Greenhouse Assays (GH-SM Assays)

Assay 1: Seed yield plant biomass and plant growth rate under normal greenhouse conditions—This assay follows seed yield production, the biomass formation and the rosette area growth of plants grown in the greenhouse at non-limiting nitrogen growth conditions. Transgenic *Arabidopsis* seeds were sown in agar media supplemented with ½ MS medium and a selection agent (Kanamycin). The $T_2$ transgenic seedlings were then transplanted to 1.7 trays filled with peat and perlite in a 1:1 ratio. The trays were irrigated with a solution containing 6 mM inorganic nitrogen in the form of $KNO_3$ with 1 mM $KH_2PO_4$, 1 mM $MgSO_4$, 2 mM $CaCl_2$ and microelements. All plants were grown in the greenhouse until mature seeds. Seeds were harvested, extracted and weight. The remaining plant biomass (the above ground tissue) was also harvested, and weighted immediately or following drying in oven at 50° C. for 24 hours.

Each construct was validated at its $T_2$ generation. Transgenic plants transformed with a construct conformed by an empty vector carrying the At6669 promoter and the selectable marker was used as control.

The plants were analyzed for their overall size, growth rate, flowering, seed yield, 1,000-seed weight, dry matter and harvest index (HI-seed yield/dry matter). Transgenic plants performance was compared to control plants grown in parallel under the same conditions. Mock-transgenic plants expressing the uidA reporter gene (GUS-Intron) or with no gene at all, under the same promoter were used as control.

The experiment was planned in nested randomized plot distribution. For each gene of the invention three to five independent transformation events were analyzed from each construct.

Digital imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) was used for capturing images of plant samples.

The image capturing process was repeated every 2 days starting from day 1 after transplanting till day 15. Same camera, placed in a custom made iron mount, was used for capturing images of larger plants sawn in white tubs in an environmental controlled greenhouse. The tubs are square shape include 1.7 liter trays. During the capture process, the tubs were placed beneath the iron mount, while avoiding direct sun light and casting of shadows.

An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at Hypertext Transfer Protocol://rsbweb (dot) nih (dot)

gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, rosette area, rosette diameter, and leaf blade area.

Vegetative growth rate: the relative growth rate (RGR) of leaf number [formula X (described above)], rosette area (formula XII), plot coverage (formula XIII) and harvest index (formula IV) was calculated with the indicated formulas.

Relative growth rate of rosette area=Regression coefficient of rosette area along time course.  Formula XII:

Relative growth rate of plot coverage=Regression coefficient of plot coverage along time course.  Formula XIII Seeds average weight—At the end of the experiment all seeds were collected. The seeds were scattered on a glass tray and a picture was taken. Using the digital analysis, the number of seeds in each sample was calculated.

Dry weight and seed yield—On about day 80 from sowing, the plants were harvested and left to dry at 30° C. in a drying chamber. The biomass and seed weight of each plot were measured and divided by the number of plants in each plot. Dry weight=total weight of the vegetative portion above ground (excluding roots) after drying at 30° C. in a drying chamber; Seed yield per plant=total seed weight per plant (gr). 1000 seed weight (the weight of 1000 seeds) (gr.).

The harvest index (HI) was calculated using Formula IV as described above.

Oil percentage in seeds—At the end of the experiment all seeds from each plot were collected. Seeds from 3 plots were mixed grounded and then mounted onto the extraction chamber. 210 ml of n-Hexane (Cat No. 080951 Biolab Ltd.) were used as the solvent. The extraction was performed for 30 hours at medium heat 50° C. Once the extraction has ended the n-Hexane was evaporated using the evaporator at 35° C. and vacuum conditions. The process was repeated twice. The information gained from the Soxhlet extractor (Soxhlet, F. Die gewichtsanalytische Bestimmung des Milchfettes, Polytechnisches J. (Dingier's) 1879, 232, 461) was used to create a calibration curve for the Low Resonance NMR. The content of oil of all seed samples was determined using the Low Resonance NMR (MARAN Ultra—Oxford Instrument) and its MultiQuant software package Silique length analysis—On day 50 from sowing, 30 siliques from different plants in each plot were sampled in block A. The chosen siliques were green-yellow in color and were collected from the bottom parts of a grown plant's stem. A digital photograph was taken to determine silique's length.

Statistical analyses—To identify outperforming genes and constructs, results from the independent transformation events tested were analyzed separately. Data was analyzed using Student's t-test and results are considered significant if the p value was less than 0.1. The JMP statistics software package was used (Version 5.2.1, SAS Institute Inc., Cary, N.C., USA).

Tables 33-37 summarize the observed phenotypes of transgenic plants exogenously expressing the gene constructs using the GH-SM Assays.

TABLE 33

Genes showing improved plant performance at Normal growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LYM509 | 62200.4 | 1077.4 | 0.05 | 14 | — | — | — | — | — | — |
| LYM507 | 62272.9 | 1056.9 | 0.28 | 12 | — | — | — | — | — | — |
| LYM500 | 62368.2 | 1053.8 | 0.11 | 12 | — | — | — | — | — | — |
| LYM498 | 62078.2 | 1096.9 | L | 17 | — | — | — | — | — | — |
| LYM496 | 62269.9 | 1006.0 | 0.06 | 7 | — | — | — | — | — | — |
| LYM492 | 62136.6 | 1080.6 | L | 15 | — | — | — | — | — | — |
| LYM492 | 62137.4 | 1063.1 | 0.07 | 13 | — | — | — | — | — | — |
| LYM492 | 62140.2 | 1021.9 | 0.19 | 9 | — | — | — | — | — | — |
| LYM487 | 62151.1 | 1112.9 | 0.25 | 18 | — | — | — | — | — | — |
| LYM477 | 62052.5 | 1048.0 | 0.02 | 11 | — | — | — | — | — | — |
| LYM466 | 62212.2 | 1111.2 | 0.27 | 18 | — | — | — | — | — | — |
| LYM407 | 62142.6 | 1100.6 | 0.01 | 17 | — | — | — | — | — | — |
| LYM407 | 62142.8 | 1008.1 | 0.04 | 7 | — | — | — | — | — | — |
| LYM404 | 62243.12 | 1050.6 | 0.19 | 12 | — | — | — | — | — | — |
| LYM399 | 62085.4 | 1055.0 | 0.01 | 12 | — | — | — | — | — | — |
| LYM382 | 62061.1 | 1024.4 | 0.03 | 9 | — | — | — | — | — | — |
| LYM343 | 62458.2 | 1086.9 | 0.19 | 15 | — | — | — | — | — | — |
| LYM329 | 62419.5 | 1128.1 | 0.19 | 20 | — | — | — | — | — | — |
| LYM323 | 62356.5 | 1008.1 | 0.23 | 7 | — | — | — | — | — | — |
| LYM323 | 62358.4 | 1095.0 | 0.15 | 16 | — | — | — | — | — | — |
| LYM322 | 62334.5 | 1093.8 | L | 16 | — | — | — | — | — | — |
| LYM322 | 62336.1 | 1038.8 | 0.07 | 10 | — | — | — | — | — | — |
| LYM317 | 62251.12 | 1063.3 | 0.19 | 13 | — | — | — | — | — | — |
| LYM302 | 62258.1 | 1133.2 | L | 20 | — | — | — | — | — | — |
| CONT. | — | 941.4 | — | — | — | — | — | — | — | — |
| LYM503 | 61581.5 | — | — | — | — | — | — | 27.2 | 0.09 | −3 |
| LYM493 | 61967.6 | 1190.7 | 0.06 | 15 | 33.6 | 0.08 | −3 | 27.1 | 0.25 | −3 |
| LYM493 | 61969.8 | 1123.4 | 0.09 | 9 | — | — | — | — | — | — |
| LYM480 | 61960.6 | — | — | — | — | — | — | 27.4 | 0.11 | −2 |
| LYM473 | 61786.1 | 1128.1 | 0.25 | 9 | — | — | — | — | — | — |
| LYM456 | 61589.6 | — | — | — | — | — | — | 27.2 | 0.21 | −3 |
| LYM440 | 61936.6 | 1117.5 | 0.23 | 8 | 33.3 | 0.19 | −3 | 26.8 | 0.13 | −4 |
| LYM440 | 61939.6 | — | — | — | 34.0 | 0.24 | −1 | — | — | — |

TABLE 33-continued

Genes showing improved plant performance at Normal growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LYM415 | 61598.5 | 1131.2 | 0.21 | 10 | — | — | — | — | — | — |
| LYM415 | 61602.6 | — | — | — | 34.1 | 0.19 | −1 | — | — | — |
| LYM415 | 61602.8 | — | — | — | 33.6 | 0.26 | −3 | 26.5 | L | −5 |
| LYM409 | 61998.6 | — | — | — | 33.9 | 0.01 | −2 | — | — | — |
| LYM393 | 61610.6 | — | — | — | 32.7 | 0.18 | −5 | 25.6 | 0.10 | −8 |
| LYM380 | 61824.2 | 1206.2 | 0.26 | 17 | — | — | — | — | — | — |
| LYM380 | 61825.2 | 1170.6 | 0.06 | 13 | — | — | — | — | — | — |
| LYM380 | 61825.5 | 1239.4 | 0.10 | 20 | — | — | — | — | — | — |
| LYM380 | 61828.3 | 1164.4 | 0.03 | 13 | — | — | — | — | — | — |
| LYM377 | 61593.5 | — | — | — | — | — | — | 27.1 | 0.01 | −3 |
| LYM377 | 61594.8 | — | — | — | — | — | — | 27.2 | 0.02 | −3 |
| LYM376 | 61835.3 | — | — | — | — | — | — | 27.3 | 0.05 | −2 |
| LYM375 | 61758.3 | — | — | — | 32.8 | 0.22 | −5 | 26.7 | L | −4 |
| LYM366 | 61910.6 | — | — | — | 33.7 | 0.07 | −2 | 27.4 | 0.07 | −2 |
| LYM361 | 61797.1 | — | — | — | 33.9 | 0.25 | −2 | — | — | — |
| LYM346 | 61616.9 | — | — | — | 33.6 | 0.25 | −3 | 26.8 | 0.11 | −4 |
| LYM346 | 61618.4 | — | — | — | 33.8 | 0.02 | −2 | 27.3 | 0.04 | −2 |
| LYM344 | 61788.2 | — | — | — | 31.9 | 0.08 | −7 | 25.1 | 0.02 | −10 |
| LYM344 | 61790.1 | — | — | — | 33.8 | 0.05 | −2 | 26.9 | 0.23 | −4 |
| LYM344 | 61791.1 | — | — | — | 33.7 | L | −2 | 27.2 | 0.02 | −3 |
| LYM334 | 61943.12 | — | — | — | 33.8 | L | −2 | — | — | — |
| LYM327 | 61846.1 | 1130.1 | 0.06 | 10 | — | — | — | 27.0 | 0.21 | −3 |
| LYM327 | 61847.1 | — | — | — | 33.9 | 0.29 | −2 | — | — | — |
| LYM318 | 61623.2 | — | — | — | 33.3 | 0.04 | −3 | 26.6 | 0.19 | −5 |
| LYM318 | 61624.1 | — | — | — | — | — | — | 25.9 | 0.20 | −7 |
| LYM318 | 61625.2 | — | — | — | — | — | — | 27.4 | 0.07 | −2 |
| LYM313 | 61629.1 | — | — | — | 33.7 | 0.07 | −2 | 27.3 | 0.05 | −2 |
| LYM313 | 61631.3 | — | — | — | 33.1 | 0.03 | −4 | 26.0 | 0.26 | −7 |
| LYM310 | 61636.2 | — | — | — | 33.5 | 0.09 | −3 | 27.0 | 0.01 | −3 |
| LYM310 | 61637.4 | — | — | — | 34.0 | 0.24 | −1 | 27.3 | 0.05 | −2 |
| LYM300 | 61749.4 | — | — | — | 33.7 | L | −2 | 27.0 | 0.02 | −3 |
| LYM300 | 61750.3 | — | — | — | 33.7 | 0.07 | −2 | — | — | — |
| LYM300 | 61750.4 | 1152.5 | 0.12 | 12 | — | — | — | — | — | — |
| LYM299 | 61807.4 | — | — | — | 33.6 | 0.20 | −3 | 27.2 | 0.05 | −2 |
| LYM299 | 61808.4 | — | — | — | — | — | — | 27.2 | 0.02 | −3 |
| CONT. | — | 1031.9 | — | — | 34.5 | — | — | 27.9 | — | — |

Table 33. "CONT."—Control; "Ave."—Average; "% Incr." = % increment; "p-val."—p-value, L—p < 0.01. The transgenes were under the transcriptional regulation of the new At6669 promoter (SEQ ID NO: 4668).

TABLE 34

Genes showing improved plant performance at Normal growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LYM509 | 62202.1 | — | — | — | 10.2 | 0.20 | 7 | — | — | — |
| LYM507 | 62272.9 | 2.5 | 0.20 | 9 | 10.5 | 0.14 | 10 | 51.0 | 0.07 | 19 |
| LYM507 | 62273.1 | — | — | — | 9.8 | 0.02 | 2 | — | — | — |
| LYM507 | 62273.12 | 2.5 | 0.09 | 8 | — | — | — | — | — | — |
| LYM506 | 62208.4 | — | — | — | 9.7 | 0.20 | 1 | 46.3 | 0.13 | 8 |
| LYM505 | 62279.5 | — | — | — | 9.8 | 0.05 | 3 | 46.5 | 0.17 | 9 |
| LYM499 | 62098.1 | — | — | — | 9.6 | 0.28 | 1 | — | — | — |
| LYM498 | 62078.2 | — | — | — | 9.9 | 0.17 | 3 | 45.2 | 0.21 | 6 |
| LYM494 | 62414.4 | — | — | — | 9.9 | 0.26 | 4 | — | — | — |
| LYM494 | 62414.5 | 2.8 | 0.13 | 20 | — | — | — | 54.9 | 0.12 | 28 |
| LYM492 | 62136.6 | 2.6 | 0.19 | 11 | — | — | — | 48.1 | 0.08 | 13 |
| LYM489 | 61834.1 | — | — | — | 9.9 | 0.01 | 4 | — | — | — |
| LYM466 | 62212.3 | 2.5 | 0.06 | 8 | — | — | — | 48.5 | L | 13 |
| LYM454 | 62194.2 | — | — | — | 9.6 | 0.28 | 1 | 45.3 | 0.14 | 6 |
| LYM454 | 62198.4 | 2.7 | 0.07 | 16 | — | — | — | 50.4 | 0.19 | 18 |
| LYM438 | 62186.3 | 2.6 | 0.06 | 13 | — | — | — | — | — | — |
| LYM437 | 62406.3 | — | — | — | 9.7 | 0.20 | 1 | — | — | — |
| LYM437 | 62406.4 | 3.0 | L | 29 | 10.2 | 0.28 | 7 | 58.1 | 0.10 | 36 |
| LYM424 | 62284.9 | 2.4 | 0.28 | 5 | — | — | — | — | — | — |
| LYM418 | 62226.1 | — | — | — | 9.9 | 0.17 | 3 | — | — | — |
| LYM407 | 62142.6 | — | — | — | 10.0 | L | 5 | — | — | — |

TABLE 34-continued

Genes showing improved plant performance at Normal growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LYM407 | 62145.1 | — | — | — | 10.0 | L | 5 | — | — | — |
| LYM404 | 62243.12 | — | — | — | 9.7 | 0.20 | 1 | — | — | — |
| LYM404 | 62244.12 | — | — | — | 9.9 | 0.26 | 4 | — | — | — |
| LYM399 | 62085.2 | 2.5 | 0.06 | 8 | 10.1 | 0.08 | 6 | 49.6 | L | 16 |
| LYM387 | 62102.4 | 2.5 | 0.10 | 8 | — | — | — | — | — | — |
| LYM373 | 62159.1 | 2.8 | L | 19 | 10.2 | 0.20 | 7 | 53.1 | 0.01 | 24 |
| LYM356 | 62089.3 | — | — | — | 9.8 | 0.02 | 2 | — | — | — |
| LYM356 | 62092.3 | 2.5 | 0.04 | 9 | 9.9 | 0.26 | 4 | 45.9 | 0.12 | 7 |
| LYM329 | 62417.1 | — | — | — | 10.0 | 0.11 | 5 | — | — | — |
| LYM329 | 62418.3 | 2.5 | 0.18 | 8 | — | — | — | 45.9 | 0.12 | 7 |
| LYM329 | 62419.5 | 2.7 | 0.23 | 17 | 9.7 | 0.20 | 1 | — | — | — |
| LYM323 | 62359.3 | — | — | — | 10.1 | 0.08 | 6 | — | — | — |
| LYM322 | 62332.3 | 2.5 | 0.29 | 7 | 10.1 | L | 6 | — | — | — |
| LYM322 | 62336.1 | 2.9 | L | 26 | — | — | — | 57.1 | 0.06 | 34 |
| LYM317 | 62251.12 | — | — | — | 10.0 | 0.11 | 5 | — | — | — |
| LYM302 | 62258.1 | — | — | — | 9.9 | L | 3 | — | — | — |
| CONT. | — | 2.3 | — | — | 9.5 | — | — | 42.7 | — | — |
| LYM503 | 61581.5 | — | — | — | 11.6 | 0.26 | 2 | — | — | — |
| LYM493 | 61966.4 | — | — | — | 12.4 | L | 10 | — | — | — |
| LYM493 | 61968.8 | — | — | — | 11.6 | 0.17 | 3 | — | — | — |
| LYM493 | 61969.8 | — | — | — | 11.6 | 0.26 | 2 | — | — | — |
| LYM480 | 61961.1 | — | — | — | 11.9 | 0.08 | 6 | — | — | — |
| LYM480 | 61962.8 | — | — | — | 12.3 | 0.02 | 9 | — | — | — |
| LYM473 | 61783.2 | — | — | — | 11.6 | 0.22 | 3 | — | — | — |
| LYM473 | 61784.2 | — | — | — | 11.6 | 0.26 | 2 | — | — | — |
| LYM473 | 61784.3 | — | — | — | 12.1 | 0.09 | 7 | 76.8 | 0.19 | 8 |
| LYM458 | 61812.4 | — | — | — | 12.3 | 0.10 | 9 | 78.6 | 0.24 | 11 |
| LYM458 | 61816.4 | — | — | — | 11.6 | 0.26 | 2 | — | — | — |
| LYM456 | 61588.5 | — | — | — | 11.6 | 0.26 | 2 | — | — | — |
| LYM456 | 61588.7 | — | — | — | 11.8 | 0.05 | 5 | 78.1 | 0.11 | 10 |
| LYM456 | 61589.6 | — | — | — | 11.9 | 0.18 | 5 | — | — | — |
| LYM453 | 61985.4 | 3.8 | 0.19 | 10 | — | — | — | 80.7 | 0.09 | 14 |
| LYM442 | 61978.7 | 3.7 | 0.20 | 7 | — | — | — | 76.4 | 0.21 | 8 |
| LYM442 | 61983.7 | — | — | — | 11.8 | 0.07 | 4 | — | — | — |
| LYM440 | 61936.6 | — | — | — | — | — | — | 76.4 | 0.21 | 7 |
| LYM440 | 61937.6 | 3.6 | 0.26 | 6 | 11.8 | 0.13 | 5 | 78.2 | 0.11 | 10 |
| LYM415 | 61598.5 | 4.1 | L | 18 | — | — | — | 86.6 | 0.04 | 22 |
| LYM415 | 61598.7 | — | — | — | 11.7 | 0.12 | 4 | — | — | — |
| LYM415 | 61602.8 | — | — | — | — | — | — | 75.5 | 0.28 | 6 |
| LYM413 | 61819.3 | — | — | — | 12.1 | L | 7 | — | — | — |
| LYM396 | 61902.8 | — | — | — | 11.7 | 0.23 | 4 | — | — | — |
| LYM393 | 61610.6 | 4.1 | L | 19 | — | — | — | 84.8 | 0.03 | 19 |
| LYM393 | 61610.8 | — | — | — | 11.8 | 0.13 | 5 | — | — | — |
| LYM380 | 61828.3 | 4.0 | 0.13 | 16 | 12.0 | 0.03 | 6 | 85.8 | 0.02 | 21 |
| LYM377 | 61593.5 | — | — | — | — | — | — | 77.0 | 0.30 | 8 |
| LYM377 | 61594.8 | — | — | — | 12.1 | 0.21 | 7 | 82.7 | 0.23 | 16 |
| LYM376 | 61835.2 | — | — | — | 12.3 | 0.29 | 9 | — | — | — |
| LYM376 | 61836.1 | 3.9 | 0.05 | 12 | 11.8 | 0.11 | 4 | 85.9 | L | 21 |
| LYM372 | 62002.1 | — | — | — | — | — | — | 77.6 | 0.26 | 9 |
| LYM366 | 61906.9 | 3.9 | 0.04 | 13 | — | — | — | 78.9 | 0.09 | 11 |
| LYM366 | 61910.6 | — | — | — | 11.7 | 0.23 | 4 | 82.1 | 0.12 | 16 |
| LYM366 | 61910.8 | — | — | — | 11.6 | 0.22 | 3 | — | — | — |
| LYM361 | 61795.1 | — | — | — | 11.6 | 0.17 | 3 | — | — | — |
| LYM361 | 61795.2 | 3.7 | 0.24 | 9 | — | — | — | 81.4 | 0.15 | 15 |
| LYM361 | 61797.1 | — | — | — | 11.7 | 0.12 | 4 | — | — | — |
| LYM354 | 61800.4 | — | — | — | 11.8 | 0.05 | 5 | — | — | — |
| LYM354 | 61804.3 | — | — | — | 12.2 | L | 9 | 80.1 | 0.23 | 13 |
| LYM346 | 61616.15 | — | — | — | 11.6 | 0.26 | 2 | — | — | — |
| LYM344 | 61788.2 | — | — | — | 12.1 | 0.21 | 7 | — | — | — |
| LYM344 | 61788.4 | — | — | — | 12.0 | 0.01 | 6 | — | — | — |
| LYM344 | 61790.1 | 3.7 | 0.21 | 7 | — | — | — | 78.0 | 0.14 | 10 |
| LYM334 | 61943.12 | — | — | — | 11.9 | 0.08 | 6 | — | — | — |
| LYM334 | 61947.7 | — | — | — | 11.9 | 0.18 | 5 | — | — | — |
| LYM330 | 61841.4 | — | — | — | 11.8 | 0.29 | 5 | — | — | — |
| LYM330 | 61842.4 | — | — | — | 11.9 | 0.05 | 5 | — | — | — |
| LYM327 | 61846.1 | 3.9 | 0.04 | 12 | 12.0 | 0.12 | 6 | 84.7 | 0.07 | 19 |
| LYM327 | 61847.1 | — | — | — | 12.1 | 0.21 | 7 | — | — | — |
| LYM320 | 61851.1 | — | — | — | 12.1 | 0.05 | 7 | — | — | — |
| LYM320 | 61854.2 | 4.2 | L | 22 | — | — | — | 92.0 | L | 29 |
| LYM319 | 61920.6 | 3.7 | 0.25 | 6 | — | — | — | — | — | — |
| LYM319 | 61921.5 | — | — | — | 11.6 | 0.26 | 2 | — | — | — |
| LYM318 | 61624.1 | 3.9 | 0.26 | 12 | — | — | — | — | — | — |

TABLE 34-continued

Genes showing improved plant performance at Normal growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LYM313 | 61629.1 | 3.7 | 0.22 | 6 | — | — | — | 75.8 | 0.26 | 7 |
| LYM313 | 61631.3 | 3.8 | 0.09 | 10 | — | — | — | 81.4 | 0.04 | 15 |
| LYM301 | 61913.4 | — | — | — | 11.6 | 0.26 | 2 | — | — | — |
| LYM300 | 61750.3 | — | — | — | 12.2 | 0.17 | 9 | — | — | — |
| LYM300 | 61750.4 | — | — | — | 12.0 | 0.03 | 6 | — | — | — |
| LYM299 | 61807.4 | — | — | — | 11.7 | 0.23 | 4 | — | — | — |
| CONT. | — | 3.4 | — | — | 11.3 | — | — | 71.1 | — | — |

Table 34. "CONT."—Control; "Ave."—Average; "% Incr." = % increment; "p-val."—p-value, L—p < 0.01. The transgenes were under the transcriptional regulation of the new At6669 promoter (SEQ ID NO: 4668).

TABLE 35

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYM507 | 62272.9 | 0.7 | 0.13 | 18 | 6.3 | 0.13 | 19 | — | — | — |
| LYM498 | 62078.2 | 0.7 | 0.28 | 13 | — | — | — | — | — | — |
| LYM494 | 62414.5 | 0.7 | 0.19 | 18 | 6.8 | 0.03 | 29 | 0.4 | 0.02 | 19 |
| LYM492 | 62136.6 | — | — | — | 6.3 | 0.18 | 18 | 0.4 | 0.25 | 10 |
| LYM487 | 62149.1 | 0.8 | 0.07 | 23 | 6.2 | 0.22 | 17 | 0.4 | 0.27 | 10 |
| LYM466 | 62212.3 | — | — | — | 6.1 | 0.21 | 16 | 0.4 | 0.25 | 9 |
| LYM454 | 62194.2 | — | — | — | — | — | — | 0.4 | 0.27 | 8 |
| LYM454 | 62198.4 | — | — | — | 6.3 | 0.11 | 20 | 0.4 | 0.08 | 14 |
| LYM437 | 62406.3 | — | — | — | — | — | — | 0.4 | 0.29 | 8 |
| LYM437 | 62406.4 | — | — | — | 7.2 | L | 36 | 0.4 | L | 22 |
| LYM407 | 62142.2 | 0.7 | 0.22 | 16 | — | — | — | — | — | — |
| LYM407 | 62142.6 | — | — | — | — | — | — | 0.4 | 0.26 | 9 |
| LYM407 | 62142.8 | — | — | — | — | — | — | 0.4 | 0.29 | 9 |
| LYM404 | 62244.12 | 0.7 | 0.28 | 14 | — | — | — | — | — | — |
| LYM399 | 62085.2 | — | — | — | 6.1 | 0.19 | 16 | — | — | — |
| LYM387 | 62102.4 | — | — | — | — | — | — | 0.4 | 0.27 | 8 |
| LYM373 | 62159.1 | 0.8 | 0.04 | 26 | 6.7 | 0.04 | 26 | 0.4 | L | 21 |
| LYM343 | 62458.4 | 0.7 | 0.29 | 15 | — | — | — | — | — | — |
| LYM329 | 62417.1 | 0.7 | 0.28 | 14 | — | — | — | 0.4 | 0.20 | 11 |
| LYM329 | 62418.3 | — | — | — | — | — | — | 0.4 | 0.29 | 8 |
| LYM329 | 62419.5 | — | — | — | 6.4 | 0.14 | 20 | 0.4 | 0.11 | 15 |
| LYM323 | 62359.3 | 0.7 | 0.29 | 12 | — | — | — | — | — | — |
| LYM322 | 62332.3 | — | — | — | 6.0 | 0.27 | 14 | 0.4 | 0.28 | 9 |
| LYM322 | 62336.1 | — | — | — | 7.1 | L | 34 | 0.4 | 0.09 | 13 |
| LYM321 | 62264.12 | 0.8 | 0.03 | 27 | — | — | — | — | — | — |
| CONT. | — | 0.6 | — | — | 5.3 | — | — | 0.4 | — | — |
| LYM493 | 61966.4 | 0.9 | 0.20 | 17 | — | — | — | — | — | — |
| LYM480 | 61961.1 | 0.9 | 0.23 | 16 | — | — | — | — | — | — |
| LYM458 | 61812.4 | 0.9 | 0.21 | 16 | — | — | — | 0.5 | 0.18 | 15 |
| LYM453 | 61985.4 | 0.9 | 0.11 | 21 | — | — | — | — | — | — |
| LYM415 | 61598.5 | — | — | — | 10.7 | 0.16 | 22 | 0.5 | 0.27 | 12 |
| LYM415 | 61602.6 | — | — | — | 10.6 | 0.21 | 21 | 0.5 | 0.08 | 24 |
| LYM393 | 61610.6 | — | — | — | 10.5 | 0.21 | 20 | 0.5 | 0.12 | 17 |
| LYM380 | 61824.2 | 0.9 | 0.18 | 18 | — | — | — | — | — | — |
| LYM380 | 61828.3 | — | — | — | 10.6 | 0.18 | 21 | 0.5 | 0.28 | 12 |
| LYM376 | 61836.1 | — | — | — | 10.7 | 0.17 | 21 | 0.5 | 0.15 | 16 |
| LYM366 | 61910.6 | — | — | — | 10.2 | 0.29 | 16 | — | — | — |
| LYM361 | 61795.2 | — | — | — | — | — | — | 0.5 | 0.13 | 16 |
| LYM344 | 61788.4 | 0.9 | 0.29 | 13 | — | — | — | — | — | — |
| LYM327 | 61846.1 | — | — | — | 10.3 | 0.26 | 17 | — | — | — |
| LYM327 | 61847.1 | 0.9 | 0.28 | 14 | — | — | — | — | — | — |
| LYM320 | 61854.2 | 0.9 | 0.30 | 14 | 11.5 | 0.05 | 31 | 0.5 | 0.15 | 16 |
| LYM318 | 61624.1 | — | — | — | 10.2 | 0.30 | 17 | 0.5 | 0.21 | 14 |
| CONT. | — | 0.8 | — | — | 8.8 | — | — | 0.4 | — | — |

Table 35. "CONT."—Control; "Ave."—Average; "% Incr." = % increment; "p-val."—p-value, L—p < 0.01. RGR = relative growth rate. The transgenes were under the transcriptional regulation of the new At6669 promoter (SEQ ID NO: 4668).

TABLE 36

Genes showing improved plant performance at Normal growth conditions under regulation of At6669 promoter

| Gene Name | Event # | Harvest Index | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYM507 | 62272.9 | — | — | — | 6.4 | 0.07 | 19 | 4.3 | 0.19 | 1 |
| LYM506 | 62208.4 | — | — | — | 5.8 | 0.13 | 8 | 4.2 | 0.29 | 5 |
| LYM505 | 62279.5 | — | — | — | 5.8 | 0.17 | 9 | 4.2 | 0.10 | 5 |
| LYM498 | 62078.2 | — | — | — | 5.7 | 0.21 | 6 | — | — | — |
| LYM494 | 62414.5 | — | — | — | 6.9 | 0.12 | 28 | 4.6 | 0.11 | 15 |
| LYM492 | 62136.6 | — | — | — | 6.0 | 0.08 | 13 | 4.3 | 0.07 | 8 |
| LYM466 | 62212.3 | — | — | — | 6.1 | L | 13 | 4.3 | 0.03 | 8 |
| LYM454 | 62194.2 | — | — | — | 5.7 | 0.14 | 6 | 4.2 | 0.02 | 6 |
| LYM454 | 62198.4 | — | — | — | 6.3 | 0.19 | 18 | 4.4 | 0.01 | 10 |
| LYM438 | 62186.3 | — | — | — | — | — | — | 4.2 | 0.13 | 5 |
| LYM437 | 62406.3 | — | — | — | — | — | — | 4.2 | 0.29 | 4 |
| LYM437 | 62406.4 | — | — | — | 7.3 | 0.10 | 36 | 4.7 | L | 18 |
| LYM424 | 62284.11 | — | — | — | — | — | — | 4.2 | 0.12 | 4 |
| LYM407 | 62145.1 | — | — | — | — | — | — | 4.1 | 0.24 | 3 |
| LYM399 | 62085.2 | — | — | — | 6.2 | L | 16 | 4.3 | 0.03 | 8 |
| LYM387 | 62102.4 | — | — | — | — | — | — | 4.2 | 0.17 | 4 |
| LYM373 | 62159.1 | — | — | — | 6.6 | 0.01 | 24 | 4.5 | L | 13 |
| LYM356 | 62092.3 | — | — | — | 5.7 | 0.12 | 7 | 4.3 | 0.01 | 7 |
| LYM329 | 62418.3 | — | — | — | 5.7 | 0.12 | 7 | 4.3 | 0.02 | 7 |
| LYM322 | 62336.1 | — | — | — | 7.1 | 0.06 | 34 | 4.6 | 0.01 | 14 |
| CONT. | — | — | — | — | 5.3 | — | — | 4.0 | — | — |
| LYM503 | 61584.7 | 0.3 | 0.20 | 17 | — | — | — | — | — | — |
| LYM495 | 61742.2 | 0.3 | 0.20 | 10 | — | — | — | — | — | — |
| LYM495 | 61744.1 | 0.3 | 0.29 | 15 | — | — | — | — | — | — |
| LYM495 | 61744.3 | 0.3 | 0.04 | 18 | — | — | — | — | — | — |
| LYM493 | 61966.4 | 0.3 | 0.29 | 9 | — | — | — | — | — | — |
| LYM493 | 61968.6 | 0.3 | 0.03 | 20 | — | — | — | — | — | — |
| LYM493 | 61969.8 | 0.3 | 0.26 | 12 | — | — | — | — | — | — |
| LYM480 | 61960.6 | 0.3 | 0.29 | 10 | — | — | — | — | — | — |
| LYM473 | 61783.2 | 0.3 | 0.04 | 20 | — | — | — | — | — | — |
| LYM473 | 61784.2 | 0.3 | 0.24 | 11 | — | — | — | — | — | — |
| LYM473 | 61784.3 | — | — | — | 9.6 | 0.19 | 8 | 5.1 | 0.16 | 5 |
| LYM458 | 61812.4 | — | — | — | 9.8 | 0.24 | 11 | 5.3 | 0.13 | 9 |
| LYM458 | 61816.4 | 0.3 | 0.25 | 9 | — | — | — | — | — | — |
| LYM456 | 61588.5 | 0.3 | 0.05 | 16 | — | — | — | — | — | — |
| LYM456 | 61588.7 | — | — | — | 9.8 | 0.11 | 10 | 5.2 | 0.10 | 6 |
| LYM453 | 61985.4 | — | — | — | 10.1 | 0.09 | 14 | 5.1 | 0.27 | 5 |
| LYM442 | 61978.7 | — | — | — | 9.6 | 0.21 | 8 | 5.2 | 0.08 | 7 |
| LYM442 | 61979.6 | 0.3 | 0.05 | 18 | — | — | — | — | — | — |
| LYM440 | 61936.6 | — | — | — | 9.5 | 0.21 | 7 | 5.2 | 0.03 | 8 |
| LYM440 | 61937.6 | — | — | — | 9.8 | 0.11 | 10 | 5.2 | 0.09 | 6 |
| LYM440 | 61939.6 | 0.3 | 0.11 | 14 | — | — | — | — | — | — |
| LYM415 | 61598.5 | — | — | — | 10.8 | 0.04 | 22 | 5.4 | 0.04 | 12 |
| LYM415 | 61602.8 | 0.3 | 0.11 | 14 | 9.4 | 0.28 | 6 | 5.2 | 0.05 | 7 |
| LYM409 | 61997.2 | 0.3 | 0.19 | 17 | — | — | — | — | — | — |
| LYM409 | 61998.6 | 0.3 | 0.21 | 22 | — | — | — | 5.2 | 0.09 | 6 |
| LYM396 | 61900.7 | 0.3 | 0.26 | 9 | — | — | — | — | — | — |
| LYM393 | 61610.6 | — | — | — | 10.6 | 0.03 | 19 | 5.6 | 0.01 | 15 |
| LYM393 | 61610.8 | — | — | — | — | — | — | 5.1 | 0.18 | 4 |
| LYM380 | 61828.3 | — | — | — | 10.7 | 0.02 | 21 | 5.4 | L | 10 |
| LYM377 | 61593.5 | — | — | — | 9.6 | 0.30 | 8 | 5.2 | 0.19 | 6 |
| LYM377 | 61594.1 | 0.3 | 0.17 | 13 | — | — | — | — | — | — |
| LYM377 | 61594.12 | 0.3 | 0.04 | 21 | — | — | — | — | — | — |
| LYM377 | 61594.8 | — | — | — | 10.3 | 0.23 | 16 | 5.4 | 0.25 | 10 |
| LYM376 | 61836.1 | — | — | — | 10.7 | L | 21 | 5.4 | 0.02 | 11 |
| LYM375 | 61754.4 | 0.3 | 0.29 | 12 | — | — | — | — | — | — |
| LYM375 | 61756.1 | 0.3 | 0.03 | 20 | — | — | — | — | — | — |
| LYM372 | 62002.1 | — | — | — | 9.7 | 0.26 | 9 | — | — | — |
| LYM372 | 62003.6 | 0.3 | 0.14 | 22 | — | — | — | — | — | — |
| LYM372 | 62004.2 | 0.3 | 0.12 | 15 | — | — | — | — | — | — |
| LYM366 | 61906.9 | 0.3 | 0.01 | 24 | 9.9 | 0.09 | 11 | 5.2 | 0.05 | 7 |
| LYM366 | 61910.6 | — | — | — | 10.3 | 0.12 | 16 | 5.4 | 0.03 | 12 |
| LYM361 | 61794.3 | 0.3 | 0.25 | 9 | — | — | — | — | — | — |
| LYM361 | 61795.2 | — | — | — | 10.2 | 0.15 | 15 | 5.5 | L | 12 |
| LYM361 | 61795.4 | 0.3 | 0.26 | 11 | — | — | — | — | — | — |
| LYM361 | 61797.1 | — | — | — | — | — | — | 5.2 | 0.26 | 7 |
| LYM354 | 61804.3 | — | — | — | 10.0 | 0.23 | 13 | 5.2 | 0.14 | 6 |
| LYM346 | 61616.16 | 0.3 | 0.06 | 22 | — | — | — | — | — | — |
| LYM346 | 61616.9 | 0.3 | 0.16 | 11 | — | — | — | — | — | — |
| LYM344 | 61788.2 | 0.3 | 0.29 | 8 | — | — | — | — | — | — |
| LYM344 | 61790.1 | — | — | — | 9.8 | 0.14 | 10 | 5.1 | 0.13 | 5 |
| LYM344 | 61790.3 | 0.3 | 0.15 | 13 | — | — | — | — | — | — |

TABLE 36-continued

Genes showing improved plant performance at Normal growth conditions under regulation of At6669 promoter

| Gene Name | Event # | Harvest Index Ave. | Harvest Index P-Val. | Harvest Index % Incr. | Rosette Area [cm²] Ave. | Rosette Area [cm²] P-Val. | Rosette Area [cm²] % Incr. | Rosette Diameter [cm] Ave. | Rosette Diameter [cm] P-Val. | Rosette Diameter [cm] % Incr. |
|---|---|---|---|---|---|---|---|---|---|---|
| LYM334 | 61942.7 | 0.3 | 0.07 | 14 | — | — | — | — | — | — |
| LYM334 | 61943.12 | — | — | — | — | — | — | 5.1 | 0.23 | 4 |
| LYM330 | 61840.1 | 0.3 | 0.08 | 23 | — | — | — | — | — | — |
| LYM330 | 61840.3 | 0.3 | 0.18 | 10 | — | — | — | — | — | — |
| LYM330 | 61842.4 | 0.3 | 0.02 | 21 | — | — | — | — | — | — |
| LYM330 | 61844.3 | 0.3 | 0.29 | 12 | — | — | — | — | — | — |
| LYM327 | 61846.1 | — | — | — | 10.6 | 0.07 | 19 | 5.3 | 0.02 | 9 |
| LYM327 | 61847.1 | 0.3 | 0.19 | 21 | — | — | — | — | — | — |
| LYM320 | 61852.4 | 0.3 | 0.16 | 11 | — | — | — | — | — | — |
| LYM320 | 61854.2 | — | — | — | 11.5 | L | 29 | 5.7 | 0.03 | 16 |
| LYM318 | 61622.2 | 0.3 | 0.21 | 12 | — | — | — | — | — | — |
| LYM318 | 61623.2 | 0.3 | 0.03 | 18 | — | — | — | — | — | — |
| LYM318 | 61624.1 | 0.3 | 0.26 | 8 | — | — | — | 5.3 | 0.23 | 10 |
| LYM313 | 61629.1 | 0.3 | 0.09 | 15 | 9.5 | 0.26 | 7 | 5.1 | 0.11 | 5 |
| LYM313 | 61631.3 | 0.3 | 0.24 | 9 | 10.2 | 0.04 | 15 | 5.3 | 0.19 | 8 |
| LYM310 | 61634.4 | 0.3 | 0.20 | 16 | — | — | — | — | — | — |
| LYM301 | 61916.2 | 0.3 | 0.22 | 25 | — | — | — | — | — | — |
| LYM300 | 61750.3 | — | — | — | — | — | — | 5.1 | 0.23 | 4 |
| LYM300 | 61750.4 | — | — | — | — | — | — | 5.0 | 0.29 | 3 |
| LYM299 | 61806.4 | 0.3 | 0.12 | 19 | — | — | — | — | — | — |
| LYM299 | 61807.3 | 0.3 | 0.29 | 12 | — | — | — | — | — | — |
| LYM299 | 61808.4 | 0.3 | 0.16 | 11 | — | — | — | — | — | — |
| LYM299 | 61809.2 | 0.3 | 0.08 | 15 | — | — | — | — | — | — |
| CONT. | — | 0.2 | — | — | 8.9 | — | — | 4.9 | — | — |

Table 36. "CONT."—Control; "Ave."—Average; "% Incr." = % increment; "p-val."—p-value, L—p < 0.01. The transgenes were under the transcriptional regulation of the new At6669 promoter (SEQ ID NO: 4668).

TABLE 37

Genes showing improved plant performance at Normal growth conditions under regulation of At6669 promoter

| Gene Name | Event # | Seed Yield [mg] Ave. | Seed Yield [mg] P-Val. | Seed Yield [mg] % Incr. | 1000 Seed Weight [mg] Ave. | 1000 Seed Weight [mg] P-Val. | 1000 Seed Weight [mg] % Incr. |
|---|---|---|---|---|---|---|---|
| LYM509 | 62202.1 | 382.3 | 0.03 | 17 | — | — | — |
| LYM506 | 62206.2 | 445.2 | L | 36 | — | — | — |
| LYM466 | 62212.3 | 373.1 | 0.29 | 14 | — | — | — |
| LYM424 | 62284.1 | 413.6 | L | 26 | — | — | — |
| LYM322 | 62334.5 | 437.0 | 0.26 | 34 | — | — | — |
| LYM317 | 62251.12 | 365.1 | 0.19 | 12 | — | — | — |
| LYM302 | 62258.1 | 421.3 | L | 29 | — | — | — |
| CONT. | — | 327.1 | — | — | — | — | — |
| LYM503 | 61584.7 | 281.9 | 0.09 | 16 | — | — | — |
| LYM495 | 61743.2 | 262.8 | 0.30 | 8 | — | — | — |
| LYM495 | 61744.1 | 275.1 | 0.12 | 13 | — | — | — |
| LYM493 | 61966.4 | 263.6 | 0.26 | 8 | — | — | — |
| LYM493 | 61967.6 | 306.8 | 0.28 | 26 | — | — | — |
| LYM493 | 61968.6 | 267.3 | 0.24 | 10 | — | — | — |
| LYM493 | 61969.8 | 298.8 | 0.03 | 23 | — | — | — |
| LYM473 | 61783.2 | 286.4 | 0.04 | 18 | — | — | — |
| LYM473 | 61784.2 | 285.5 | 0.29 | 17 | — | — | — |
| LYM456 | 61588.5 | 279.0 | 0.24 | 14 | — | — | — |
| LYM453 | 61986.6 | — | — | — | 28.7 | 0.01 | 32 |
| LYM442 | 61980.5 | — | — | — | 23.2 | 0.26 | 7 |
| LYM440 | 61937.6 | — | — | — | 24.2 | 0.29 | 11 |
| LYM415 | 61598.5 | — | — | — | 27.9 | 0.28 | 28 |
| LYM413 | 61819.3 | 275.0 | 0.12 | 13 | — | — | — |
| LYM409 | 61997.2 | 282.2 | 0.11 | 16 | — | — | — |
| LYM396 | 61902.7 | — | — | — | 24.6 | 0.05 | 13 |
| LYM380 | 61824.2 | 270.1 | 0.19 | 11 | — | — | — |
| LYM380 | 61828.3 | — | — | — | 25.3 | L | 16 |
| LYM377 | 61593.5 | — | — | — | 22.9 | 0.26 | 5 |
| LYM377 | 61594.1 | 279.0 | 0.07 | 14 | — | — | — |
| LYM376 | 61835.2 | — | — | — | 23.8 | 0.19 | 10 |
| LYM376 | 61836.1 | — | — | — | 23.4 | 0.15 | 8 |
| LYM361 | 61794.3 | — | — | — | 25.0 | 0.21 | 15 |
| LYM354 | 61804.3 | — | — | — | 25.6 | 0.27 | 18 |
| LYM344 | 61788.4 | — | — | — | 26.5 | L | 22 |
| LYM334 | 61942.7 | 284.5 | 0.04 | 17 | — | — | — |
| LYM301 | 61913.4 | — | — | — | 23.6 | 0.07 | 9 |
| LYM300 | 61750.4 | 266.8 | 0.21 | 10 | — | — | — |
| CONT. | — | 243.7 | — | — | 21.8 | — | — |

Table 37. "CONT."—Control; "Ave."—Average; "% Incr." = % increment; "p-val."—p-value, L—p < 0.01. The transgenes were under the transcriptional regulation of the new At6669 promoter (SEQ ID NO: 4668).

Assay 2: Plant performance improvement measured until bolting stage: plant biomass and plant growth rate under normal greenhouse conditions (GH-SB Assays)—This assay follows the plant biomass formation and the rosette area growth of plants grown in the greenhouse under normal growth conditions. Transgenic *Arabidopsis* seeds were sown in agar media supplemented with ½ MS medium and a selection agent (Kanamycin). The T₂ transgenic seedlings were then transplanted to 1.7 trays filled with peat and perlite in a 1:1 ratio. The trays were irrigated with a solution containing of 6 mM inorganic nitrogen in the form of $KNO_3$ with 1 mM $KH_2PO_4$, 1 mM $MgSO_4$, 2 mM $CaCl_2$ and microelements. All plants were grown in the greenhouse until mature seeds. Plant biomass (the above ground tissue) was weight in directly after harvesting the rosette (plant fresh weight [FW]). Following plants were dried in an oven at 50° C. for 48 hours and weighted (plant dry weight [DW]).

Each construct was validated at its T₂ generation. Transgenic plants transformed with a construct conformed by an empty vector carrying the 35S promoter and the selectable marker was used as control.

The plants were analyzed for their overall size, growth rate, fresh weight and dry matter. Transgenic plants performance was compared to control plants grown in parallel under the same conditions. Mock-transgenic plants expressing the uidA reporter gene (GUS-Intron) or with no gene at all, under the same promoter were used as control.

The experiment was planned in nested randomized plot distribution. For each gene of the invention three to five independent transformation events were analyzed from each construct.

Digital imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) was used for capturing images of plant samples.

The image capturing process was repeated every 2 days starting from day 1 after transplanting till day 15. Same camera, placed in a custom made iron mount, was used for capturing images of larger plants sawn in white tubs in an environmental controlled greenhouse. The tubs were square shape include 1.7 liter trays. During the capture process, the tubes were placed beneath the iron mount, while avoiding direct sun light and casting of shadows.

An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at Hypertext Transfer Protocol://rsbweb (dot) nih (dot) gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, rosette area, rosette diameter, and leaf blade area.

Vegetative growth rate: the relative growth rate (RGR) of leaf number (Formula X, described above), rosette area (Formula XII described above) and plot coverage (Formula XIII, described above) were calculated using the indicated formulas.

Plant Fresh and Dry weight—On about day 80 from sowing, the plants were harvested and directly weight for the determination of the plant fresh weight (FW) and left to dry at 50° C. in a drying chamber for about 48 hours before weighting to determine plant dry weight (DW).

Statistical analyses—To identify outperforming genes and constructs, results from the independent transformation events tested were analyzed separately. Data was analyzed using Student's t-test and results are considered significant if the p value was less than 0.1. The JMP statistics software package was used (Version 5.2.1, SAS Institute Inc., Cary, N.C., USA).

Experimental Results:

The genes listed in Tables 38-42 improved plant performance when grown at normal conditions. These genes produced larger plants with a larger photosynthetic area, biomass (fresh weight, dry weight, rosette diameter, rosette area and plot coverage). The genes were cloned under the regulation of a constitutive (At6669; SEQ ID NO:4668). The evaluation of each gene was performed by testing the performance of different number of events. Event with p-value<0.1 was considered statistically significant Tables 38-42 summarize the observed phenotypes of transgenic plants expressing the genes constructs using the GH-SB Assays.

TABLE 38

Genes showing improved plant performance at Normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LYM502 | 62984.2 | — | — | — | 3031.2 | 0.30 | 11 | — | — | — |
| LYM502 | 62984.3 | — | — | — | — | — | — | 10.6 | 0.28 | 7 |
| LYM491 | 62814.1 | — | — | — | 3112.5 | L | 14 | — | — | — |
| LYM490 | 62918.4 | 232.5 | 0.23 | 15 | — | — | — | — | — | — |
| LYM490 | 62920.3 | — | — | — | 3187.5 | 0.25 | 16 | — | — | — |
| LYM490 | 62922.3 | 223.1 | 0.24 | 10 | 2906.2 | 0.09 | 6 | — | — | — |
| LYM484 | 63361.4 | 217.5 | L | 7 | 3118.8 | 0.02 | 14 | 10.2 | 0.23 | 3 |
| LYM484 | 63362.3 | 233.8 | 0.16 | 15 | — | — | — | — | — | — |
| LYM448 | 62802.2 | — | — | — | — | — | — | 10.2 | 0.27 | 2 |
| LYM448 | 62802.6 | — | — | — | 2943.8 | 0.12 | 7 | 10.8 | 0.11 | 8 |
| LYM445 | 62796.4 | 212.5 | 0.08 | 5 | 2937.5 | 0.15 | 7 | — | — | — |
| LYM445 | 62797.2 | 230.0 | 0.11 | 13 | — | — | — | 10.9 | L | 10 |
| LYM445 | 62797.3 | — | — | — | 2856.2 | 0.23 | 4 | — | — | — |
| LYM436 | 62813.4 | 225.0 | 0.24 | 11 | 2931.2 | 0.14 | 7 | — | — | — |
| LYM435 | 62872.1 | — | — | — | 3106.2 | 0.30 | 13 | — | — | — |
| LYM435 | 62875.1 | 216.2 | 0.28 | 7 | — | — | — | 10.6 | 0.02 | 6 |
| LYM432 | 62946.1 | 208.1 | 0.21 | 3 | — | — | — | 11.1 | 0.02 | 11 |
| LYM428 | 63411.2 | — | — | — | 3062.5 | 0.03 | 12 | 11.6 | 0.06 | 16 |
| LYM419 | 62774.5 | — | — | — | 2975.0 | 0.10 | 9 | — | — | — |
| LYM419 | 62778.2 | 223.8 | 0.11 | 10 | 3275.0 | L | 19 | — | — | — |
| LYM414 | 62968.1 | — | — | — | 3062.5 | 0.10 | 12 | 10.6 | 0.28 | 7 |
| LYM414 | 62969.4 | — | — | — | 3237.5 | 0.02 | 18 | — | — | — |
| LYM410 | 62963.2 | 218.8 | 0.23 | 8 | — | — | — | — | — | — |
| LYM401 | 62853.1 | — | — | — | 2925.0 | 0.07 | 7 | — | — | — |
| LYM401 | 62856.1 | — | — | — | 2843.8 | 0.27 | 4 | — | — | — |
| LYM398 | 62886.2 | — | — | — | — | — | — | 10.8 | 0.01 | 8 |
| LYM395 | 62924.2 | 222.5 | L | 10 | — | — | — | — | — | — |
| LYM395 | 62927.1 | 210.0 | 0.11 | 4 | — | — | — | — | — | — |
| LYM395 | 62928.1 | 222.5 | 0.18 | 10 | 3143.8 | L | 15 | 10.6 | 0.02 | 6 |

TABLE 38-continued

Genes showing improved plant performance at Normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LYM394 | 62912.1 | — | — | — | 2968.8 | 0.09 | 8 | — | — | — |
| LYM394 | 62912.2 | — | — | — | 2925.0 | 0.07 | 7 | — | — | — |
| LYM394 | 62913.2 | 222.5 | 0.27 | 10 | — | — | — | 10.4 | 0.29 | 4 |
| LYM389 | 62900.2 | 221.9 | L | 9 | 3131.2 | L | 14 | — | — | — |
| LYM371 | 62847.2 | 216.2 | 0.01 | 7 | — | — | — | — | — | — |
| LYM371 | 62847.3 | 216.9 | 0.10 | 7 | 2918.8 | 0.07 | 6 | — | — | — |
| LYM365 | 62718.5 | — | — | — | 3012.5 | 0.10 | 10 | — | — | — |
| LYM365 | 62721.2 | 212.5 | 0.24 | 5 | — | — | — | 10.5 | 0.20 | 5 |
| LYM352 | 62876.1 | 214.4 | 0.30 | 6 | — | — | — | — | — | — |
| LYM352 | 62876.4 | 208.1 | 0.21 | 3 | — | — | — | — | — | — |
| LYM349 | 63556.3 | 219.4 | 0.25 | 8 | — | — | — | — | — | — |
| LYM349 | 63557.2 | — | — | — | 2971.4 | 0.03 | 8 | — | — | — |
| LYM349 | 63557.3 | — | — | — | 3106.2 | 0.28 | 13 | — | — | — |
| LYM338 | 62949.6 | 220.0 | 0.04 | 9 | 3087.5 | 0.04 | 13 | — | — | — |
| LYM335 | 62895.1 | — | — | — | 3012.5 | 0.02 | 10 | — | — | — |
| LYM335 | 62896.2 | — | — | — | 2968.8 | 0.25 | 8 | 10.2 | 0.16 | 3 |
| LYM333 | 62888.12 | — | — | — | 2857.1 | 0.30 | 4 | — | — | — |
| LYM333 | 62890.1 | 233.8 | 0.09 | 15 | 2856.2 | 0.26 | 4 | — | — | — |
| LYM331 | 62932.2 | 221.2 | 0.03 | 9 | — | — | — | — | — | — |
| LYM331 | 62934.3 | 223.1 | 0.01 | 10 | — | — | — | — | — | — |
| LYM328 | 62728.1 | — | — | — | 3037.5 | 0.08 | 11 | — | — | — |
| LYM328 | 62732.6 | 216.9 | 0.01 | 7 | — | — | — | — | — | — |
| LYM324 | 62973.6 | 216.9 | 0.10 | 7 | 3200.0 | 0.16 | 17 | — | — | — |
| LYM324 | 62975.3 | — | — | — | 3118.8 | 0.11 | 14 | — | — | — |
| LYM316 | 63367.1 | 216.2 | 0.01 | 7 | — | — | — | — | — | — |
| LYM314 | 62859.1 | 209.2 | 0.18 | 3 | — | — | — | — | — | — |
| LYM314 | 62861.3 | — | — | — | 2931.2 | 0.14 | 7 | — | — | — |
| LYM314 | 62862.1 | 215.6 | 0.01 | 6 | 3225.0 | 0.15 | 18 | 10.4 | 0.04 | 5 |
| LYM311 | 62954.5 | 228.1 | 0.18 | 13 | — | — | — | — | — | — |
| LYM311 | 62956.1 | 218.1 | L | 8 | — | — | — | — | — | — |
| LYM311 | 62956.2 | 219.4 | L | 8 | 2900.0 | 0.12 | 6 | — | — | — |
| LYM308 | 63288.5 | 219.4 | 0.19 | 8 | 3075.0 | L | 12 | — | — | — |
| LYM308 | 63290.2 | 216.2 | 0.14 | 7 | — | — | — | — | — | — |
| LYM298 | 62722.1 | — | — | — | — | — | — | 10.3 | 0.26 | 4 |
| LYM345 | 62936.2 | 208.1 | 0.33 | 3 | 2950 | 0.42 | 8 | — | — | — |
| LYM345 | 62936.2 | — | — | — | 2812.5 | 0.42 | 3 | — | — | — |
| LYM457 | 63206.2 | — | — | — | 2968.8 | 0.43 | 8 | — | — | — |
| CONT. | — | 202.7 | — | — | 2741.1 | — | — | 10.0 | — | — |
| LYM510 | 62475.1 | 256.2 | 0.08 | 21 | — | — | — | — | — | — |
| LYM510 | 62478.4 | — | — | — | 3025.0 | L | 7 | 10.6 | 0.09 | 7 |
| LYM501 | 62537.1 | 271.9 | 0.04 | 29 | 3468.8 | L | 23 | — | — | — |
| LYM488 | 62564.7 | 233.8 | 0.24 | 11 | 3131.2 | 0.18 | 11 | — | — | — |
| LYM488 | 62567.3 | 232.5 | 0.04 | 10 | — | — | — | — | — | — |
| LYM481 | 62463.2 | — | — | — | 3050.0 | 0.25 | 8 | — | — | — |
| LYM481 | 62466.3 | 236.9 | 0.14 | 12 | 3100.0 | 0.02 | 10 | — | — | — |
| LYM471 | 62657.1 | — | — | — | — | — | — | 10.2 | 0.07 | 3 |
| LYM471 | 62658.1 | 225.6 | 0.10 | 7 | 3018.8 | 0.01 | 7 | — | — | — |
| LYM471 | 62658.2 | 248.8 | 0.03 | 18 | 3206.2 | L | 14 | 10.7 | L | 8 |
| LYM471 | 62658.4 | — | — | — | 2950.0 | 0.07 | 5 | — | — | — |
| LYM465 | 62338.2 | 233.1 | 0.27 | 10 | — | — | — | — | — | — |
| LYM465 | 62340.2 | 245.0 | L | 16 | 3125.0 | 0.01 | 11 | — | — | — |
| LYM460 | 62423.3 | — | — | — | — | — | — | 10.4 | 0.26 | 5 |
| LYM460 | 62425.1 | 236.2 | 0.06 | 12 | — | — | — | — | — | — |
| LYM455 | 62704.1 | 223.1 | 0.17 | 6 | 2981.2 | 0.08 | 6 | — | — | — |
| LYM455 | 62705.5 | — | — | — | 3443.8 | 0.09 | 22 | 11.2 | L | 14 |
| LYM455 | 62708.5 | — | — | — | — | — | — | 10.1 | 0.27 | 2 |
| LYM451 | 62486.6 | 233.1 | 0.02 | 10 | 3062.5 | 0.23 | 9 | — | — | — |
| LYM451 | 62488.3 | 245.6 | 0.20 | 16 | — | — | — | — | — | — |
| LYM451 | 62488.5 | 223.1 | 0.26 | 6 | 2900.0 | 0.29 | 3 | — | — | — |
| LYM447 | 62683.1 | 220.0 | 0.29 | 4 | — | — | — | 10.1 | 0.27 | 2 |
| LYM447 | 62683.2 | — | — | — | — | — | — | 10.2 | 0.12 | 4 |
| LYM446 | 62492.1 | — | — | — | — | — | — | 10.1 | 0.26 | 2 |
| LYM446 | 62495.1 | 240.0 | 0.10 | 14 | 3231.2 | L | 15 | 10.2 | 0.12 | 4 |
| LYM444 | 62626.1 | 283.1 | 0.29 | 34 | 3181.2 | L | 13 | — | — | — |
| LYM444 | 62627.3 | — | — | — | 3056.2 | 0.26 | 8 | — | — | — |
| LYM444 | 62628.4 | 223.1 | 0.16 | 6 | 3043.8 | L | 8 | — | — | — |
| LYM416 | 62663.1 | — | — | — | 3106.2 | 0.17 | 10 | — | — | — |
| LYM416 | 62663.3 | 225.6 | 0.10 | 7 | — | — | — | — | — | — |
| LYM416 | 62664.2 | — | — | — | 2993.8 | 0.16 | 6 | — | — | — |
| LYM406 | 62562.1 | 223.8 | 0.18 | 6 | 3106.2 | L | 10 | 10.3 | 0.20 | 4 |
| LYM406 | 62562.2 | 244.4 | 0.21 | 16 | 3106.2 | L | 10 | 10.1 | 0.26 | 2 |
| LYM390 | 62472.1 | 231.2 | 0.19 | 9 | 2900.0 | 0.24 | 3 | — | — | — |

TABLE 38-continued

Genes showing improved plant performance at Normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LYM388 | 62540.1 | 362.5 | 0.16 | 72 | 3525.0 | 0.15 | 25 | 10.1 | 0.26 | 2 |
| LYM378 | 62698.1 | — | — | — | 2906.2 | 0.19 | 3 | — | — | — |
| LYM374 | 62505.2 | — | — | — | — | — | — | 10.8 | 0.05 | 9 |
| LYM369 | 62548.4 | — | — | — | 3056.2 | 0.18 | 8 | — | — | — |
| LYM369 | 62548.5 | 253.7 | L | 20 | — | — | — | — | — | — |
| LYM369 | 62550.1 | — | — | — | 3000.0 | 0.18 | 6 | — | — | — |
| LYM362 | 62344.6 | — | — | — | 2981.2 | 0.03 | 6 | 10.1 | 0.27 | 2 |
| LYM362 | 62347.2 | — | — | — | — | — | — | 10.1 | 0.26 | 2 |
| LYM362 | 62349.4 | 246.2 | 0.18 | 17 | 3137.5 | 0.16 | 11 | — | — | — |
| LYM359 | 62326.1 | 257.5 | L | 22 | 3225.0 | L | 14 | — | — | — |
| LYM359 | 62326.4 | — | — | — | 3006.2 | 0.09 | 7 | 10.1 | 0.27 | 2 |
| LYM359 | 62329.1 | 227.5 | 0.07 | 8 | 3037.5 | L | 8 | — | — | — |
| LYM355 | 62450.4 | — | — | — | 2943.8 | 0.08 | 4 | — | — | — |
| LYM355 | 62450.6 | 251.9 | 0.03 | 19 | 3225.0 | L | 14 | — | — | — |
| LYM355 | 62451.2 | 228.8 | 0.23 | 8 | — | — | — | — | — | — |
| LYM355 | 62451.3 | — | — | — | — | — | — | 10.1 | 0.27 | 2 |
| LYM355 | 62451.4 | — | — | — | 2925.0 | 0.13 | 4 | — | — | — |
| LYM353 | 62675.4 | — | — | — | 3025.0 | 0.09 | 7 | — | — | — |
| LYM353 | 62677.1 | 330.6 | 0.14 | 56 | — | — | — | — | — | — |
| LYM353 | 62677.5 | — | — | — | 3325.0 | 0.04 | 18 | — | — | — |
| LYM353 | 62677.6 | 223.1 | 0.19 | 6 | 2931.2 | 0.10 | 4 | 10.3 | 0.02 | 4 |
| LYM351 | 62529.2 | 233.1 | 0.06 | 10 | 3262.5 | L | 16 | — | — | — |
| LYM351 | 62530.3 | 243.1 | L | 15 | 3137.5 | L | 11 | 11.1 | 0.07 | 12 |
| LYM341 | 62480.2 | — | — | — | 2887.5 | 0.29 | 2 | — | — | — |
| LYM341 | 62484.1 | — | — | — | 3075.0 | 0.14 | 9 | 11.1 | 0.07 | 12 |
| LYM340 | 62652.1 | — | — | — | 3031.2 | L | 7 | — | — | — |
| LYM340 | 62653.4 | 231.9 | 0.20 | 10 | 3031.2 | 0.25 | 7 | 10.1 | 0.11 | 2 |
| LYM339 | 62671.2 | — | — | — | 2993.8 | 0.27 | 6 | — | — | — |
| LYM339 | 62671.3 | 265.0 | 0.02 | 25 | 3162.5 | 0.12 | 12 | — | — | — |
| LYM332 | 62554.3 | — | — | — | 2993.8 | 0.02 | 6 | 10.5 | L | 6 |
| LYM332 | 62554.7 | — | — | — | — | — | — | 10.1 | 0.27 | 2 |
| LYM332 | 62555.2 | 228.1 | 0.06 | 8 | 2956.2 | 0.18 | 5 | — | — | — |
| LYM332 | 62556.2 | — | — | — | 2900.0 | 0.29 | 3 | — | — | — |
| LYM325 | 62689.2 | 260.6 | 0.20 | 23 | 3037.5 | 0.02 | 8 | — | — | — |
| LYM325 | 62689.3 | 228.8 | 0.28 | 8 | — | — | — | — | — | — |
| LYM325 | 62690.1 | — | — | — | — | — | — | 10.1 | 0.11 | 2 |
| LYM325 | 62690.6 | — | — | — | 3156.2 | 0.30 | 12 | 10.2 | 0.07 | 3 |
| LYM306 | 62433.1 | 240.0 | 0.17 | 14 | 3137.5 | 0.19 | 11 | 10.1 | 0.27 | 2 |
| LYM305 | 62518.1 | 228.1 | 0.13 | 8 | 2993.8 | 0.03 | 6 | — | — | — |
| LYM305 | 62519.4 | — | — | — | 2975.0 | 0.06 | 5 | — | — | — |
| LYM303 | 62523.1 | — | — | — | — | — | — | 10.2 | 0.07 | 3 |
| LYM303 | 62525.3 | — | — | — | — | — | — | 10.1 | 0.11 | 2 |
| LYM303 | 62526.4 | 226.9 | 0.08 | 7 | — | — | — | — | — | — |
| LYM441 | 62361.2 | 223.7 | 0.41 | 6 | 293 | 0.48 | 4 | — | — | — |
| CONT. | — | 211.4 | — | — | 2821.7 | — | — | 9.9 | — | — |
| LYM503 | 61581.6 | — | — | — | — | — | — | 11.9 | 0.03 | 5 |
| LYM503 | 61584.1 | — | — | — | — | — | — | 12.0 | 0.02 | 6 |
| LYM503 | 61584.7 | — | — | — | — | — | — | 11.9 | L | 6 |
| LYM495 | 61744.1 | 331.9 | 0.24 | 7 | 3200.0 | 0.25 | 9 | — | — | — |
| LYM493 | 61969.12 | — | — | — | — | — | — | 11.6 | 0.14 | 3 |
| LYM480 | 61962.8 | — | — | — | — | — | — | 12.1 | L | 7 |
| LYM474 | 61977.6 | — | — | — | 3543.8 | 0.20 | 21 | — | — | — |
| LYM473 | 61783.2 | 369.4 | 0.14 | 19 | 3575.0 | 0.07 | 22 | — | — | — |
| LYM473 | 61783.4 | — | — | — | 3462.5 | 0.06 | 18 | — | — | — |
| LYM456 | 61587.8 | — | — | — | — | — | — | 11.7 | 0.03 | 4 |
| LYM456 | 61589.4 | 356.2 | 0.12 | 15 | 3762.5 | L | 29 | — | — | — |
| LYM456 | 61590.8 | 350.0 | 0.07 | 13 | 3756.2 | 0.02 | 28 | 11.9 | 0.03 | 5 |
| LYM453 | 61984.7 | — | — | — | 3218.8 | 0.26 | 10 | — | — | — |
| LYM453 | 61984.9 | — | — | — | 3450.0 | 0.05 | 18 | — | — | — |
| LYM453 | 61986.6 | 404.4 | 0.27 | 31 | 4112.5 | 0.14 | 41 | — | — | — |
| LYM453 | 61988.6 | 333.1 | 0.28 | 8 | 3700.0 | 0.05 | 26 | — | — | — |
| LYM442 | 61978.7 | — | — | — | 3216.1 | 0.24 | 10 | — | — | — |
| LYM442 | 61979.6 | — | — | — | 3583.9 | 0.04 | 22 | — | — | — |
| LYM442 | 61980.5 | 331.9 | 0.23 | 7 | 3512.5 | 0.04 | 20 | — | — | — |
| LYM442 | 61983.7 | 346.4 | 0.07 | 12 | 3371.4 | 0.10 | 15 | — | — | — |
| LYM440 | 61936.6 | 350.6 | 0.19 | 13 | 3750.0 | 0.08 | 28 | — | — | — |
| LYM440 | 61937.6 | — | — | — | 3556.2 | 0.04 | 22 | — | — | — |
| LYM440 | 61937.8 | — | — | — | 3425.0 | 0.06 | 17 | — | — | — |
| LYM440 | 61939.6 | — | — | — | 3337.5 | 0.11 | 14 | — | — | — |
| LYM415 | 61598.5 | — | — | — | — | — | — | 12.1 | 0.24 | 7 |
| LYM415 | 61598.7 | — | — | — | 3318.8 | 0.15 | 13 | — | — | — |
| LYM415 | 61600.5 | 361.9 | 0.02 | 17 | 3850.0 | 0.01 | 32 | — | — | — |

TABLE 38-continued

Genes showing improved plant performance at Normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LYM415 | 61602.6 | — | — | — | 3462.5 | 0.19 | 18 | 11.8 | L | 5 |
| LYM415 | 61602.8 | — | — | — | 3318.8 | 0.25 | 13 | — | — | — |
| LYM413 | 61821.1 | — | — | — | 3281.2 | 0.25 | 12 | — | — | — |
| LYM413 | 61823.1 | 348.4 | 0.06 | 12 | 3723.2 | L | 27 | — | — | — |
| LYM409 | 61998.2 | 406.2 | L | 31 | 4082.1 | L | 39 | — | — | — |
| LYM409 | 61998.6 | 403.8 | L | 30 | 4303.6 | L | 47 | — | — | — |
| LYM409 | 61999.2 | 353.1 | 0.08 | 14 | 3650.0 | 0.05 | 25 | — | — | — |
| LYM409 | 61999.3 | 380.0 | L | 23 | 3931.2 | 0.01 | 34 | 11.7 | 0.03 | 4 |
| LYM409 | 61999.5 | 370.0 | L | 19 | 3706.2 | L | 27 | — | — | — |
| LYM396 | 61900.1 | 380.6 | L | 23 | 3943.8 | 0.05 | 35 | — | — | — |
| LYM396 | 61901.1 | 341.2 | 0.11 | 10 | — | — | — | — | — | — |
| LYM396 | 61902.7 | 348.7 | 0.05 | 13 | 3465.2 | 0.17 | 18 | — | — | — |
| LYM393 | 61610.6 | 413.1 | 0.13 | 33 | 4218.8 | L | 44 | — | — | — |
| LYM393 | 61610.8 | 391.2 | 0.25 | 26 | 4031.2 | L | 38 | — | — | — |
| LYM393 | 61614.6 | — | — | — | 3925.0 | 0.16 | 34 | — | — | — |
| LYM393 | 61614.9 | 366.9 | 0.02 | 18 | 3825.0 | 0.04 | 31 | — | — | — |
| LYM380 | 61824.2 | 404.9 | 0.16 | 31 | 4128.6 | 0.03 | 41 | 11.8 | 0.07 | 4 |
| LYM380 | 61825.4 | — | — | — | 3693.8 | 0.17 | 26 | — | — | — |
| LYM380 | 61825.5 | 378.1 | L | 22 | 3906.2 | L | 33 | — | — | — |
| LYM380 | 61828.3 | 431.9 | 0.14 | 39 | 4231.2 | 0.06 | 45 | 11.9 | 0.03 | 5 |
| LYM380 | 61828.5 | 388.1 | L | 25 | 4156.2 | L | 42 | — | — | — |
| LYM377 | 61592.5 | 419.4 | L | 35 | 4375.0 | L | 49 | 12.0 | 0.02 | 6 |
| LYM377 | 61594.1 | 400.0 | L | 29 | 4156.2 | L | 42 | 11.6 | 0.11 | 2 |
| LYM377 | 61594.12 | 355.6 | 0.04 | 15 | 3531.2 | 0.10 | 21 | — | — | — |
| LYM377 | 61594.8 | 386.2 | 0.03 | 25 | 3931.2 | L | 34 | — | — | — |
| LYM376 | 61835.2 | 393.1 | L | 27 | 4250.0 | L | 45 | — | — | — |
| LYM376 | 61835.3 | — | — | — | — | — | — | 11.5 | 0.17 | 2 |
| LYM376 | 61836.1 | 359.4 | 0.21 | 16 | 3468.8 | 0.23 | 19 | — | — | — |
| LYM376 | 61837.1 | 366.9 | 0.01 | 18 | 3768.8 | 0.03 | 29 | — | — | — |
| LYM375 | 61754.4 | 351.2 | 0.04 | 13 | 3312.5 | 0.21 | 13 | — | — | — |
| LYM375 | 61756.1 | 403.8 | 0.03 | 30 | 4331.2 | 0.02 | 48 | 12.3 | L | 9 |
| LYM375 | 61758.1 | 353.8 | 0.04 | 14 | 3468.8 | 0.04 | 19 | — | — | — |
| LYM372 | 62003.2 | — | — | — | 3375.0 | 0.08 | 15 | — | — | — |
| LYM372 | 62003.6 | 354.4 | 0.04 | 14 | 3431.2 | 0.08 | 17 | — | — | — |
| LYM366 | 61906.15 | 379.4 | L | 22 | 4006.2 | 0.07 | 37 | — | — | — |
| LYM366 | 61906.9 | — | — | — | 3737.5 | 0.24 | 28 | 11.6 | 0.04 | 3 |
| LYM366 | 61910.6 | 407.5 | 0.02 | 32 | 4218.8 | 0.02 | 44 | — | — | — |
| LYM366 | 61910.7 | — | — | — | 3462.5 | 0.19 | 18 | — | — | — |
| LYM361 | 61795.1 | 429.4 | 0.20 | 39 | 4168.8 | 0.19 | 42 | — | — | — |
| LYM361 | 61795.2 | 378.1 | L | 22 | 3862.5 | L | 32 | — | — | — |
| LYM361 | 61796.4 | 386.8 | L | 25 | 3993.8 | L | 36 | — | — | — |
| LYM361 | 61797.1 | 361.9 | 0.02 | 17 | 3543.8 | 0.03 | 21 | — | — | — |
| LYM354 | 61800.4 | 390.6 | 0.22 | 26 | 3987.5 | L | 36 | 11.9 | L | 6 |
| LYM354 | 61801.3 | 407.5 | L | 32 | 4187.5 | L | 43 | — | — | — |
| LYM354 | 61803.4 | 370.0 | 0.02 | 19 | 3837.5 | 0.11 | 31 | — | — | — |
| LYM354 | 61804.3 | 400.0 | 0.07 | 29 | 4037.5 | L | 38 | — | — | — |
| LYM354 | 61804.4 | 404.4 | 0.01 | 31 | 4181.2 | 0.10 | 43 | — | — | — |
| LYM346 | 61616.15 | 373.3 | 0.10 | 20 | 3792.9 | 0.04 | 30 | — | — | — |
| LYM346 | 61616.16 | 383.1 | L | 24 | 3987.5 | 0.06 | 36 | — | — | — |
| LYM346 | 61617.9 | 418.8 | 0.01 | 35 | 4350.0 | L | 49 | — | — | — |
| LYM346 | 61618.4 | 371.2 | 0.11 | 20 | 3693.8 | L | 26 | — | — | — |
| LYM344 | 61788.2 | 359.9 | 0.18 | 16 | 3638.4 | 0.02 | 24 | — | — | — |
| LYM344 | 61788.4 | 370.0 | 0.24 | 19 | 3727.7 | 0.16 | 27 | 11.6 | 0.14 | 3 |
| LYM344 | 61790.1 | 413.8 | L | 34 | 4031.2 | L | 38 | — | — | — |
| LYM344 | 61790.3 | 395.0 | 0.02 | 27 | 3943.8 | 0.07 | 35 | 11.9 | 0.25 | 6 |
| LYM344 | 61791.1 | 355.6 | 0.03 | 15 | 3993.8 | 0.02 | 36 | — | — | — |
| LYM334 | 61942.6 | 358.1 | 0.16 | 16 | 3762.5 | 0.02 | 29 | — | — | — |
| LYM334 | 61942.7 | — | — | — | 3550.0 | 0.02 | 21 | — | — | — |
| LYM334 | 61942.8 | 387.5 | 0.01 | 25 | 3868.8 | L | 32 | — | — | — |
| LYM334 | 61943.12 | 361.2 | 0.15 | 17 | 3950.0 | L | 35 | — | — | — |
| LYM334 | 61947.7 | 391.9 | 0.24 | 26 | 3841.2 | 0.02 | 31 | — | — | — |
| LYM330 | 61840.1 | 383.1 | 0.26 | 24 | 4013.4 | 0.09 | 37 | 11.8 | 0.27 | 4 |
| LYM330 | 61841.4 | — | — | — | 3487.5 | 0.27 | 19 | — | — | — |
| LYM330 | 61842.4 | 374.7 | L | 21 | 3872.3 | 0.21 | 32 | — | — | — |
| LYM330 | 61844.3 | 362.1 | 0.04 | 17 | 3818.8 | 0.03 | 30 | — | — | — |
| LYM327 | 61846.1 | 384.4 | L | 24 | 4000.0 | 0.04 | 37 | — | — | — |
| LYM327 | 61846.3 | 341.2 | 0.23 | 10 | — | — | — | — | — | — |
| LYM327 | 61847.1 | 366.3 | 0.01 | 18 | 3586.6 | 0.09 | 23 | — | — | — |
| LYM327 | 61849.1 | — | — | — | 3471.4 | 0.04 | 19 | — | — | — |
| LYM320 | 61851.2 | — | — | — | 3700.0 | 0.16 | 26 | — | — | — |
| LYM320 | 61852.4 | 371.2 | L | 20 | 3956.2 | L | 35 | — | — | — |
| LYM320 | 61853.2 | 341.2 | 0.14 | 10 | 3431.2 | 0.07 | 17 | — | — | — |

TABLE 38-continued

Genes showing improved plant performance at Normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LYM320 | 61854.2 | 352.5 | 0.17 | 14 | 3693.8 | 0.10 | 26 | — | — | — |
| LYM319 | 61918.5 | 393.1 | 0.05 | 27 | 4206.2 | L | 44 | 11.6 | 0.11 | 2 |
| LYM319 | 61920.6 | — | — | — | 3587.5 | 0.19 | 23 | — | — | — |
| LYM319 | 61920.7 | 362.5 | 0.06 | 17 | 4018.8 | L | 37 | — | — | — |
| LYM319 | 61921.5 | 380.0 | 0.01 | 23 | 3825.0 | L | 31 | — | — | — |
| LYM319 | 61921.7 | 353.1 | 0.07 | 14 | 3762.5 | 0.02 | 29 | — | — | — |
| LYM318 | 61623.3 | 354.0 | 0.06 | 14 | 3569.6 | 0.02 | 22 | — | — | — |
| LYM318 | 61625.4 | — | — | — | 3642.9 | 0.24 | 24 | — | — | — |
| LYM318 | 61625.6 | 377.2 | 0.02 | 22 | 3817.9 | 0.15 | 30 | — | — | — |
| LYM313 | 61628.2 | 386.0 | L | 25 | 4128.6 | L | 41 | — | — | — |
| LYM313 | 61629.1 | — | — | — | 3668.8 | 0.26 | 25 | 12.0 | 0.28 | 6 |
| LYM313 | 61630.1 | — | — | — | 3437.5 | 0.08 | 17 | — | — | — |
| LYM313 | 61630.2 | 383.1 | 0.05 | 24 | 4025.0 | L | 38 | 11.6 | 0.11 | 2 |
| LYM313 | 61631.3 | 372.1 | L | 20 | 3779.2 | L | 29 | — | — | — |
| LYM310 | 61634.4 | 333.8 | 0.24 | 8 | 3337.5 | 0.17 | 14 | — | — | — |
| LYM310 | 61636.2 | 343.3 | 0.08 | 11 | 3573.2 | 0.02 | 22 | — | — | — |
| LYM310 | 61637.2 | 357.5 | 0.05 | 15 | 3712.5 | 0.01 | 27 | — | — | — |
| LYM310 | 61637.4 | 388.1 | 0.01 | 25 | 4112.5 | L | 41 | — | — | — |
| LYM310 | 61638.4 | 398.8 | L | 29 | 4206.2 | L | 44 | — | — | — |
| LYM301 | 61912.3 | 357.5 | 0.02 | 15 | 3743.8 | 0.02 | 28 | — | — | — |
| LYM301 | 61913.3 | 375.0 | 0.02 | 21 | 3793.8 | L | 30 | 11.6 | 0.14 | 3 |
| LYM301 | 61914.1 | 377.6 | 0.14 | 22 | 3808.9 | 0.07 | 30 | 11.6 | 0.14 | 3 |
| LYM301 | 61914.2 | 384.4 | 0.01 | 24 | 3856.2 | 0.01 | 32 | — | — | — |
| LYM301 | 61916.2 | 381.0 | L | 23 | 4017.9 | L | 37 | — | — | — |
| LYM300 | 61748.4 | 331.0 | 0.28 | 7 | 3487.5 | 0.12 | 19 | — | — | — |
| LYM300 | 61749.4 | 360.6 | 0.24 | 16 | 3606.2 | 0.12 | 23 | — | — | — |
| LYM300 | 61750.3 | 373.8 | 0.07 | 21 | 3931.2 | L | 34 | — | — | — |
| LYM300 | 61750.4 | 377.5 | 0.15 | 22 | 3950.0 | L | 35 | — | — | — |
| LYM300 | 61752.3 | 383.1 | L | 24 | 3900.0 | L | 33 | 11.6 | 0.14 | 3 |
| LYM299 | 61806.2 | 368.1 | L | 19 | 3756.2 | 0.03 | 28 | — | — | — |
| LYM299 | 61806.4 | 435.6 | L | 41 | 4587.5 | L | 57 | — | — | — |
| LYM299 | 61807.4 | 399.4 | 0.04 | 29 | 4000.0 | 0.20 | 37 | — | — | — |
| LYM299 | 61808.4 | 386.9 | L | 25 | 4075.0 | L | 39 | — | — | — |
| LYM299 | 61809.2 | 367.5 | 0.01 | 19 | 3937.5 | L | 35 | — | — | — |
| CONT. | — | 309.8 | — | — | 2926.6 | — | — | 11.3 | — | — |
| LYM509 | 62203.4 | 370.4 | 0.20 | 18 | — | — | — | — | — | — |
| LYM507 | 62273.12 | — | — | — | 3343.8 | 0.12 | 11 | — | — | — |
| LYM500 | 62367.4 | — | — | — | — | — | — | 9.6 | 0.10 | 3 |
| LYM499 | 62096.1 | — | — | — | 3250.0 | 0.06 | 8 | — | — | — |
| LYM499 | 62096.2 | — | — | — | — | — | — | 9.9 | 0.21 | 6 |
| LYM498 | 62078.6 | — | — | — | — | — | — | 9.6 | 0.10 | 3 |
| LYM498 | 62079.2 | 380.6 | 0.12 | 21 | 3500.0 | L | 17 | — | — | — |
| LYM494 | 62411.4 | — | — | — | 3500.0 | 0.29 | 17 | — | — | — |
| LYM494 | 62414.5 | — | — | — | 3537.5 | 0.09 | 18 | — | — | — |
| LYM492 | 62136.6 | 409.4 | 0.05 | 31 | 4506.2 | 0.03 | 50 | 9.9 | 0.21 | 6 |
| LYM492 | 62137.4 | — | — | — | — | — | — | 9.6 | 0.20 | 3 |
| LYM492 | 62141.1 | 379.4 | 0.08 | 21 | 4093.8 | L | 36 | — | — | — |
| LYM489 | 61833.1 | 337.5 | 0.26 | 8 | — | — | — | — | — | — |
| LYM489 | 61834.1 | 362.2 | 0.09 | 16 | 4037.5 | L | 34 | — | — | — |
| LYM487 | 62151.3 | — | — | — | — | — | — | 9.6 | 0.20 | 3 |
| LYM477 | 62052.5 | 390.4 | 0.19 | 25 | 4600.0 | 0.09 | 53 | — | — | — |
| LYM477 | 62053.4 | 388.8 | L | 24 | 4181.2 | 0.02 | 39 | — | — | — |
| LYM464 | 62064.2 | 408.6 | L | 30 | 4457.1 | L | 48 | — | — | — |
| LYM461 | 62219.8 | 369.6 | 0.19 | 18 | 3172.6 | 0.20 | 6 | — | — | — |
| LYM454 | 62194.2 | 394.4 | 0.05 | 26 | 4243.8 | L | 41 | — | — | — |
| LYM454 | 62196.4 | 348.1 | 0.14 | 11 | 3268.8 | 0.23 | 9 | — | — | — |
| LYM437 | 62406.3 | 383.8 | 0.18 | 22 | 4250.0 | L | 42 | 9.9 | 0.04 | 6 |
| LYM424 | 62285.12 | 438.3 | 0.19 | 40 | 4854.2 | 0.04 | 62 | — | — | — |
| LYM424 | 62288.9 | — | — | — | 3350.0 | 0.01 | 12 | — | — | — |
| LYM418 | 62227.2 | — | — | — | 3518.8 | 0.03 | 17 | — | — | — |
| LYM418 | 62228.4 | — | — | — | 3781.2 | 0.24 | 26 | — | — | — |
| LYM407 | 62142.2 | — | — | — | 3568.8 | 0.17 | 19 | 9.8 | 0.02 | 5 |
| LYM407 | 62142.6 | 392.6 | 0.25 | 25 | 3489.3 | 0.25 | 16 | — | — | — |
| LYM407 | 62145.1 | 409.4 | 0.11 | 31 | 4325.0 | L | 44 | — | — | — |
| LYM407 | 62145.2 | 388.8 | 0.21 | 24 | 4206.2 | L | 40 | — | — | — |
| LYM404 | 62244.12 | — | — | — | 3156.2 | 0.24 | 5 | — | — | — |
| LYM399 | 62086.3 | — | — | — | 3906.2 | L | 30 | — | — | — |
| LYM382 | 62059.2 | 359.4 | 0.29 | 15 | 4243.8 | L | 41 | 9.8 | 0.09 | 5 |
| LYM382 | 62061.2 | 371.5 | 0.21 | 18 | 3482.1 | 0.08 | 16 | — | — | — |
| LYM363 | 62071.1 | 425.4 | 0.15 | 36 | — | — | — | — | — | — |
| LYM323 | 62356.5 | — | — | — | — | — | — | 9.6 | 0.10 | 3 |
| LYM323 | 62358.4 | 413.8 | 0.06 | 32 | 3844.6 | L | 28 | — | — | — |

TABLE 38-continued

Genes showing improved plant performance at Normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LYM322 | 62334.5 | — | — | — | — | — | — | 9.8 | 0.15 | 5 |
| LYM322 | 62336.1 | — | — | — | — | — | — | 9.7 | 0.07 | 4 |
| LYM321 | 62264.12 | 400.0 | 0.20 | 28 | 3625.0 | L | 21 | 9.9 | 0.04 | 6 |
| LYM317 | 62251.12 | — | — | — | — | — | — | 9.8 | 0.15 | 5 |
| LYM302 | 62257.11 | 384.4 | 0.22 | 23 | 4131.2 | 0.10 | 38 | 9.8 | 0.02 | 5 |
| CONT. | — | 313.5 | — | — | 3003.4 | — | — | 9.3 | — | — |

Table 38. "CONT."—Control; "Ave."—Average; "% Incr." = % increment; "p-val."—p-value, L—p < 0.01. The transgenes were under the transcriptional regulation of the new At6669 promoter (SEQ ID NO: 4668).

TABLE 39

Genes showing improved plant performance at Normal growth conditions under regulation of At6669 promoter

| Gene Name | Event # | Plot Coverage [cm$^2$] | | | Rosette Area [cm$^2$] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYM490 | 62918.4 | — | — | — | — | — | — | 4.7 | 0.10 | 5 |
| LYM490 | 62922.3 | 61.1 | 0.09 | 11 | 7.6 | 0.09 | 11 | 4.8 | 0.02 | 8 |
| LYM484 | 63361.4 | 60.2 | 0.14 | 9 | 7.5 | 0.14 | 9 | 4.6 | 0.20 | 4 |
| LYM445 | 62796.4 | 64.2 | 0.04 | 17 | 8.0 | 0.04 | 17 | 4.8 | 0.02 | 8 |
| LYM435 | 62872.1 | 59.7 | 0.23 | 8 | 7.5 | 0.23 | 8 | 4.7 | 0.14 | 5 |
| LYM435 | 62875.1 | 67.7 | 0.24 | 23 | 8.5 | 0.24 | 23 | 4.9 | 0.21 | 9 |
| LYM428 | 63411.2 | 71.7 | 0.05 | 30 | 9.0 | 0.05 | 30 | 5.2 | 0.03 | 16 |
| LYM419 | 62775.1 | 60.9 | 0.22 | 11 | 7.6 | 0.22 | 11 | 4.7 | 0.06 | 6 |
| LYM419 | 62778.2 | — | — | — | — | — | — | 4.8 | 0.05 | 8 |
| LYM414 | 62968.1 | 64.6 | 0.02 | 17 | 8.1 | 0.02 | 17 | 4.8 | 0.04 | 9 |
| LYM410 | 62963.2 | — | — | — | — | — | — | 4.6 | 0.25 | 3 |
| LYM395 | 62928.1 | 61.1 | 0.29 | 11 | 7.6 | 0.29 | 11 | — | — | — |
| LYM394 | 62913.2 | 59.4 | 0.20 | 8 | 7.4 | 0.20 | 8 | 4.6 | 0.19 | 4 |
| LYM365 | 62721.2 | — | — | — | — | — | — | 4.6 | 0.27 | 4 |
| LYM333 | 62890.1 | 62.6 | 0.26 | 14 | 7.8 | 0.26 | 14 | 4.8 | 0.07 | 8 |
| LYM324 | 62975.3 | 62.8 | 0.20 | 14 | 7.9 | 0.20 | 14 | 4.7 | 0.25 | 6 |
| LYM308 | 63288.5 | 62.2 | 0.29 | 13 | 7.8 | 0.29 | 13 | 4.8 | 0.24 | 8 |
| CONT. | — | 55.1 | — | — | 6.9 | — | — | 4.5 | — | — |
| LYM510 | 62475.1 | 55.9 | L | 15 | 7.0 | L | 15 | 4.7 | L | 9 |
| LYM510 | 62478.3 | 52.6 | 0.10 | 9 | 6.6 | 0.10 | 9 | 4.4 | 0.13 | 4 |
| LYM510 | 62478.4 | 51.4 | 0.17 | 6 | 6.4 | 0.17 | 6 | 4.4 | 0.20 | 3 |
| LYM501 | 62535.2 | 54.4 | 0.27 | 12 | 6.8 | 0.27 | 12 | 4.7 | 0.19 | 9 |
| LYM501 | 62537.1 | 62.4 | L | 29 | 7.8 | L | 29 | 5.1 | L | 18 |
| LYM488 | 62564.6 | 52.4 | 0.19 | 8 | 6.5 | 0.19 | 8 | 4.5 | 0.24 | 5 |
| LYM488 | 62566.1 | 50.4 | 0.18 | 4 | 6.3 | 0.18 | 4 | 4.4 | 0.18 | 3 |
| LYM486 | 62371.6 | — | — | — | — | — | — | 4.4 | 0.26 | 3 |
| LYM481 | 62463.2 | 53.2 | 0.03 | 10 | 6.7 | 0.03 | 10 | — | — | — |
| LYM481 | 62466.3 | 53.2 | 0.06 | 10 | 6.6 | 0.06 | 10 | 4.6 | 0.11 | 7 |
| LYM471 | 62658.1 | 54.3 | 0.01 | 12 | 6.8 | 0.01 | 12 | 4.6 | 0.05 | 7 |
| LYM471 | 62658.2 | 61.8 | 0.13 | 27 | 7.7 | 0.13 | 27 | 5.0 | L | 15 |
| LYM471 | 62659.5 | — | — | — | — | — | — | 4.5 | 0.23 | 5 |
| LYM465 | 62340.2 | 53.3 | L | 10 | 6.7 | L | 10 | 4.6 | 0.02 | 7 |
| LYM465 | 62342.4 | 58.7 | 0.23 | 21 | 7.3 | 0.23 | 21 | 4.6 | 0.09 | 7 |
| LYM460 | 62425.1 | — | — | — | — | — | — | 4.7 | 0.24 | 9 |
| LYM455 | 62705.5 | 65.2 | L | 34 | 8.2 | L | 34 | 4.9 | 0.02 | 14 |
| LYM451 | 62486.2 | 51.2 | 0.20 | 5 | 6.4 | 0.20 | 5 | 4.4 | 0.29 | 2 |
| LYM451 | 62488.3 | 59.2 | L | 22 | 7.4 | L | 22 | 4.8 | L | 12 |
| LYM451 | 62488.5 | 52.8 | 0.07 | 9 | 6.6 | 0.07 | 9 | 4.5 | 0.08 | 4 |
| LYM446 | 62495.1 | 58.6 | 0.01 | 21 | 7.3 | 0.01 | 21 | 4.8 | L | 12 |
| LYM444 | 62626.1 | — | — | — | — | — | — | 4.5 | 0.06 | 5 |
| LYM444 | 62628.4 | 54.5 | 0.16 | 12 | 6.8 | 0.16 | 12 | 4.7 | L | 9 |
| LYM416 | 62663.1 | 55.2 | L | 14 | 6.9 | L | 14 | 4.7 | 0.02 | 9 |
| LYM406 | 62562.1 | — | — | — | — | — | — | 4.5 | 0.08 | 4 |
| LYM406 | 62562.2 | 54.9 | 0.08 | 13 | 6.9 | 0.08 | 13 | 4.6 | 0.02 | 6 |
| LYM388 | 62540.3 | — | — | — | — | — | — | 4.5 | 0.09 | 4 |
| LYM388 | 62543.1 | — | — | — | — | — | — | 4.6 | 0.09 | 6 |
| LYM369 | 62548.4 | — | — | — | — | — | — | 4.5 | 0.28 | 4 |
| LYM369 | 62550.1 | 51.0 | 0.08 | 5 | 6.4 | 0.08 | 5 | 4.6 | 0.01 | 7 |
| LYM364 | 62694.1 | 56.9 | 0.25 | 17 | 7.1 | 0.25 | 17 | — | — | — |
| LYM362 | 62344.6 | — | — | — | — | — | — | 4.6 | 0.02 | 7 |
| LYM362 | 62349.4 | 57.9 | 0.22 | 20 | 7.2 | 0.22 | 20 | 4.7 | 0.21 | 9 |

TABLE 39-continued

Genes showing improved plant performance at Normal growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYM359 | 62329.1 | 60.7 | 0.02 | 25 | 7.6 | 0.02 | 25 | 4.9 | L | 15 |
| LYM355 | 62450.6 | 57.5 | 0.13 | 19 | 7.2 | 0.13 | 19 | 4.8 | L | 12 |
| LYM355 | 62451.2 | 52.3 | 0.30 | 8 | 6.5 | 0.30 | 8 | 4.5 | 0.27 | 5 |
| LYM355 | 62451.3 | 54.0 | 0.25 | 11 | 6.7 | 0.25 | 11 | 4.5 | 0.27 | 6 |
| LYM355 | 62451.4 | 54.5 | 0.14 | 12 | 6.8 | 0.14 | 12 | 4.5 | 0.08 | 5 |
| LYM353 | 62675.4 | 58.4 | L | 20 | 7.3 | L | 20 | 4.8 | 0.03 | 11 |
| LYM353 | 62677.5 | 50.9 | 0.10 | 5 | 6.4 | 0.10 | 5 | 4.5 | 0.10 | 6 |
| LYM353 | 62677.6 | 53.9 | 0.13 | 11 | 6.7 | 0.13 | 11 | 4.5 | 0.06 | 5 |
| LYM351 | 62529.2 | 61.7 | L | 27 | 7.7 | L | 27 | 4.9 | L | 14 |
| LYM351 | 62530.3 | 64.9 | L | 34 | 8.1 | L | 34 | 4.9 | L | 14 |
| LYM341 | 62484.1 | 60.9 | 0.06 | 26 | 7.6 | 0.06 | 26 | 4.8 | L | 11 |
| LYM340 | 62653.4 | 52.7 | 0.05 | 9 | 6.6 | 0.05 | 9 | 4.5 | 0.15 | 4 |
| LYM339 | 62671.2 | 57.1 | 0.11 | 18 | 7.1 | 0.11 | 18 | 4.7 | L | 9 |
| LYM339 | 62671.3 | 56.1 | L | 16 | 7.0 | L | 16 | 4.6 | 0.10 | 7 |
| LYM332 | 62554.3 | 62.2 | L | 28 | 7.8 | L | 28 | 4.8 | L | 13 |
| LYM325 | 62689.2 | 52.5 | 0.22 | 8 | 6.6 | 0.22 | 8 | 4.5 | 0.04 | 5 |
| LYM325 | 62690.1 | 52.7 | 0.03 | 9 | 6.6 | 0.03 | 9 | — | — | — |
| LYM306 | 62433.1 | 58.5 | L | 21 | 7.3 | L | 21 | 4.8 | L | 12 |
| LYM305 | 62518.1 | 57.1 | 0.04 | 18 | 7.1 | 0.04 | 18 | 4.6 | L | 8 |
| LYM305 | 62519.4 | 62.7 | 0.09 | 29 | 7.8 | 0.09 | 29 | 4.8 | L | 13 |
| LYM303 | 62523.1 | 56.1 | 0.17 | 16 | 7.0 | 0.17 | 16 | 4.6 | 0.01 | 8 |
| CONT. | — | 48.5 | — | — | 6.1 | — | — | 4.3 | — | — |
| LYM503 | 61584.7 | — | — | — | — | — | — | 4.7 | 0.20 | 9 |
| LYM495 | 61742.2 | 66.1 | 0.09 | 10 | 8.3 | 0.13 | 8 | 4.6 | 0.05 | 6 |
| LYM495 | 61744.1 | 73.7 | 0.24 | 23 | 9.2 | 0.26 | 20 | 4.9 | 0.21 | 13 |
| LYM493 | 61969.12 | 73.4 | 0.24 | 22 | 9.2 | 0.27 | 20 | 4.9 | 0.26 | 14 |
| LYM480 | 61961.12 | — | — | — | — | — | — | 4.5 | 0.06 | 4 |
| LYM480 | 61962.7 | — | — | — | — | — | — | 4.5 | 0.02 | 5 |
| LYM474 | 61975.8 | — | — | — | — | — | — | 4.5 | 0.03 | 4 |
| LYM474 | 61976.8 | — | — | — | — | — | — | 4.7 | L | 8 |
| LYM473 | 61783.2 | — | — | — | — | — | — | 4.9 | 0.22 | 14 |
| LYM458 | 61816.4 | 66.5 | 0.11 | 10 | 8.3 | 0.16 | 9 | 4.7 | 0.03 | 9 |
| LYM456 | 61587.8 | 65.5 | 0.03 | 9 | 8.2 | 0.06 | 7 | 4.6 | 0.04 | 6 |
| LYM456 | 61588.5 | — | — | — | — | — | — | 4.7 | 0.25 | 9 |
| LYM456 | 61588.7 | 74.9 | 0.29 | 24 | — | — | — | — | — | — |
| LYM456 | 61590.8 | 66.4 | 0.01 | 10 | 8.3 | 0.02 | 8 | 4.7 | L | 9 |
| LYM453 | 61986.6 | 90.5 | 0.04 | 50 | 11.3 | 0.04 | 48 | 5.6 | 0.10 | 30 |
| LYM453 | 61988.6 | 81.4 | L | 35 | 10.2 | L | 33 | 5.2 | L | 20 |
| LYM442 | 61980.5 | — | — | — | — | — | — | 4.8 | 0.26 | 11 |
| LYM440 | 61936.6 | — | — | — | — | — | — | 5.0 | 0.21 | 15 |
| LYM440 | 61937.6 | 73.8 | 0.15 | 23 | 9.2 | 0.17 | 21 | 4.9 | 0.03 | 14 |
| LYM440 | 61937.8 | 63.1 | 0.15 | 5 | — | — | — | 4.6 | 0.01 | 7 |
| LYM415 | 61598.5 | 73.0 | L | 21 | 9.1 | L | 19 | 4.8 | 0.08 | 11 |
| LYM415 | 61600.5 | — | — | — | — | — | — | 4.9 | 0.29 | 14 |
| LYM415 | 61602.6 | 69.5 | 0.20 | 15 | 8.7 | 0.23 | 14 | 4.9 | L | 13 |
| LYM409 | 61998.2 | — | — | — | — | — | — | 5.3 | 0.30 | 22 |
| LYM409 | 61998.6 | 76.0 | 0.18 | 26 | 9.5 | 0.20 | 24 | 5.1 | 0.15 | 19 |
| LYM409 | 61999.2 | 78.7 | 0.15 | 31 | 9.8 | 0.16 | 29 | 5.1 | 0.18 | 18 |
| LYM409 | 61999.3 | 74.8 | 0.28 | 24 | — | — | — | 5.0 | 0.24 | 15 |
| LYM409 | 61999.5 | 68.9 | L | 15 | 8.6 | L | 13 | 4.8 | L | 12 |
| LYM396 | 61900.1 | 72.8 | L | 21 | 9.1 | L | 19 | 5.0 | L | 16 |
| LYM396 | 61900.12 | 66.7 | 0.30 | 11 | — | — | — | 4.7 | L | 9 |
| LYM396 | 61901.1 | — | — | — | — | — | — | 4.5 | 0.12 | 4 |
| LYM396 | 61901.7 | 65.0 | 0.27 | 8 | — | — | — | 4.7 | 0.07 | 8 |
| LYM396 | 61902.7 | — | — | — | — | — | — | 4.9 | 0.29 | 12 |
| LYM393 | 61610.6 | 80.6 | 0.10 | 34 | 10.1 | 0.10 | 32 | 5.2 | 0.02 | 19 |
| LYM393 | 61610.8 | 80.5 | 0.21 | 34 | 10.1 | 0.22 | 31 | 5.1 | 0.18 | 17 |
| LYM393 | 61614.9 | 76.1 | L | 26 | 9.5 | L | 24 | 5.1 | L | 17 |
| LYM380 | 61825.4 | — | — | — | — | — | — | 4.8 | 0.20 | 12 |
| LYM380 | 61825.5 | 64.1 | 0.24 | 7 | — | — | — | 4.8 | 0.01 | 10 |
| LYM380 | 61828.3 | 88.0 | 0.18 | 46 | 11.0 | 0.19 | 44 | 5.3 | 0.22 | 22 |
| LYM380 | 61828.5 | 69.1 | 0.18 | 15 | 8.6 | 0.21 | 13 | 4.9 | 0.19 | 14 |
| LYM377 | 61592.5 | 96.2 | 0.13 | 60 | 12.0 | 0.14 | 57 | 5.6 | 0.10 | 30 |
| LYM377 | 61594.1 | 89.9 | 0.13 | 49 | 11.2 | 0.13 | 47 | 5.4 | 0.14 | 25 |
| LYM377 | 61594.12 | 70.5 | L | 17 | 8.8 | L | 15 | 4.8 | L | 11 |
| LYM377 | 61594.8 | 83.2 | 0.16 | 38 | 10.4 | 0.16 | 36 | 5.2 | 0.17 | 21 |
| LYM376 | 61835.2 | 80.4 | 0.30 | 34 | — | — | — | 5.2 | 0.27 | 19 |
| LYM376 | 61835.3 | 67.2 | 0.19 | 12 | 8.4 | 0.24 | 10 | — | — | — |
| LYM376 | 61836.1 | — | — | — | — | — | — | 4.6 | 0.15 | 7 |
| LYM376 | 61837.1 | 73.9 | 0.01 | 23 | 9.2 | 0.02 | 21 | 5.0 | L | 15 |
| LYM376 | 61839.4 | 78.5 | 0.17 | 30 | 9.8 | 0.18 | 28 | 5.0 | 0.19 | 15 |
| LYM375 | 61754.4 | 65.1 | 0.23 | 8 | — | — | — | 4.6 | 0.14 | 5 |

TABLE 39-continued

Genes showing improved plant performance at Normal growth conditions under regulation of At6669 promoter

| Gene Name | Event # | Plot Coverage [cm²] Ave. | P-Val. | % Incr. | Rosette Area [cm²] Ave. | P-Val. | % Incr. | Rosette Diameter [cm] Ave. | P-Val. | % Incr. |
|---|---|---|---|---|---|---|---|---|---|---|
| LYM375 | 61755.4 | — | — | — | — | — | — | 4.5 | 0.30 | 3 |
| LYM375 | 61756.1 | 91.7 | 0.11 | 52 | 11.5 | 0.12 | 50 | 5.6 | 0.15 | 30 |
| LYM375 | 61758.1 | 67.9 | L | 13 | 8.5 | L | 11 | 4.6 | 0.08 | 7 |
| LYM372 | 62002.1 | 75.2 | 0.01 | 25 | 9.4 | 0.01 | 23 | 5.0 | L | 15 |
| LYM372 | 62003.2 | — | — | — | — | — | — | 4.5 | 0.11 | 4 |
| LYM372 | 62003.6 | 67.5 | L | 12 | 8.4 | 0.01 | 10 | 4.7 | 0.21 | 9 |
| LYM372 | 62006.4 | 66.5 | 0.27 | 11 | — | — | — | 4.6 | 0.03 | 7 |
| LYM366 | 61906.15 | 74.4 | L | 24 | 9.3 | L | 22 | 5.0 | L | 17 |
| LYM366 | 61906.9 | 77.6 | L | 29 | 9.7 | L | 27 | 5.0 | 0.06 | 16 |
| LYM366 | 61910.6 | 89.7 | 0.10 | 49 | 11.2 | 0.10 | 47 | 5.6 | L | 30 |
| LYM366 | 61910.8 | 70.4 | L | 17 | 8.8 | L | 15 | 4.8 | L | 12 |
| LYM361 | 61795.1 | 76.5 | 0.23 | 27 | 9.6 | 0.24 | 25 | 5.0 | 0.14 | 16 |
| LYM361 | 61795.2 | 73.2 | 0.15 | 22 | 9.2 | 0.17 | 20 | 4.9 | 0.01 | 14 |
| LYM361 | 61797.1 | 75.5 | L | 26 | 9.4 | L | 23 | 5.0 | L | 16 |
| LYM354 | 61800.4 | 79.8 | 0.06 | 33 | 10.0 | 0.07 | 30 | 5.2 | 0.10 | 19 |
| LYM354 | 61801.3 | 85.4 | 0.27 | 42 | 10.7 | 0.29 | 40 | — | — | — |
| LYM354 | 61803.4 | 79.8 | 0.02 | 33 | 10.0 | 0.02 | 30 | 5.2 | 0.02 | 20 |
| LYM354 | 61804.3 | 84.0 | 0.19 | 40 | 10.5 | 0.20 | 37 | 5.3 | 0.05 | 23 |
| LYM354 | 61804.4 | 88.4 | 0.15 | 47 | 11.1 | 0.15 | 45 | 5.4 | 0.10 | 25 |
| LYM346 | 61616.15 | 71.2 | L | 18 | 9.5 | 0.16 | 25 | 5.1 | 0.18 | 18 |
| LYM346 | 61616.16 | 83.1 | 0.12 | 38 | 10.4 | 0.13 | 36 | 5.2 | 0.17 | 20 |
| LYM346 | 61616.9 | 75.3 | 0.10 | 25 | 9.4 | 0.11 | 23 | 5.1 | L | 17 |
| LYM346 | 61617.9 | 105.6 | 0.13 | 75 | 13.2 | 0.13 | 73 | 5.8 | 0.06 | 35 |
| LYM346 | 61618.4 | 69.0 | L | 15 | 8.6 | L | 13 | 4.7 | L | 9 |
| LYM344 | 61788.2 | 78.2 | 0.26 | 30 | 9.8 | 0.27 | 28 | 5.1 | 0.10 | 17 |
| LYM344 | 61788.4 | 80.4 | 0.09 | 34 | 10.1 | 0.10 | 31 | 5.2 | 0.06 | 19 |
| LYM344 | 61790.1 | 84.1 | L | 40 | 10.5 | L | 37 | 5.3 | L | 23 |
| LYM344 | 61790.3 | 72.9 | 0.26 | 21 | 9.1 | 0.29 | 19 | 4.9 | 0.06 | 13 |
| LYM334 | 61942.6 | 68.7 | 0.17 | 14 | 8.6 | 0.21 | 12 | 4.9 | 0.15 | 13 |
| LYM334 | 61942.7 | 72.8 | 0.10 | 21 | 9.1 | 0.11 | 19 | 4.9 | L | 13 |
| LYM334 | 61942.8 | 78.1 | 0.25 | 30 | 9.8 | 0.27 | 28 | 5.0 | 0.21 | 15 |
| LYM334 | 61943.12 | 74.7 | 0.04 | 24 | 9.3 | 0.04 | 22 | 5.0 | 0.01 | 16 |
| LYM334 | 61947.7 | 68.7 | 0.18 | 14 | 8.6 | 0.22 | 12 | 4.7 | 0.08 | 9 |
| LYM330 | 61840.1 | 82.7 | 0.11 | 37 | 10.3 | 0.11 | 35 | 5.3 | 0.02 | 23 |
| LYM330 | 61841.4 | 71.1 | 0.21 | 18 | 8.9 | 0.23 | 16 | 4.9 | 0.02 | 14 |
| LYM330 | 61842.4 | 73.6 | 0.21 | 22 | 9.2 | 0.23 | 20 | 4.9 | 0.23 | 14 |
| LYM330 | 61844.3 | — | — | — | — | — | — | 4.8 | 0.23 | 11 |
| LYM327 | 61846.1 | 86.9 | 0.02 | 44 | 10.9 | 0.02 | 42 | 5.3 | L | 23 |
| LYM327 | 61846.3 | 71.5 | 0.15 | 19 | 8.9 | 0.17 | 17 | 4.7 | 0.02 | 9 |
| LYM327 | 61848.2 | — | — | — | — | — | — | 4.6 | 0.01 | 5 |
| LYM320 | 61851.2 | 74.8 | 0.12 | 24 | 9.4 | 0.13 | 22 | 4.9 | 0.17 | 13 |
| LYM320 | 61852.4 | 80.9 | L | 34 | 10.1 | L | 32 | 5.3 | L | 21 |
| LYM320 | 61853.2 | 70.7 | L | 18 | 8.8 | 0.01 | 16 | 4.9 | L | 14 |
| LYM320 | 61854.2 | 75.1 | 0.04 | 25 | 9.4 | 0.05 | 23 | 5.0 | 0.02 | 16 |
| LYM319 | 61918.5 | 78.9 | 0.05 | 31 | 9.9 | 0.06 | 29 | 5.0 | 0.10 | 16 |
| LYM319 | 61920.6 | — | — | — | — | — | — | 5.0 | 0.21 | 15 |
| LYM319 | 61920.7 | 64.8 | 0.20 | 8 | 8.1 | 0.29 | 6 | 4.7 | 0.21 | 10 |
| LYM319 | 61921.5 | 78.8 | 0.10 | 31 | 9.9 | 0.11 | 29 | 5.0 | 0.14 | 16 |
| LYM319 | 61921.7 | — | — | — | — | — | — | 4.6 | L | 7 |
| LYM318 | 61622.2 | 70.6 | 0.29 | 17 | — | — | — | 4.9 | 0.20 | 14 |
| LYM318 | 61623.2 | 68.3 | 0.26 | 14 | — | — | — | 4.8 | 0.04 | 11 |
| LYM318 | 61623.3 | 65.4 | 0.18 | 9 | 8.2 | 0.25 | 7 | 4.6 | 0.03 | 7 |
| LYM313 | 61628.2 | 78.0 | 0.06 | 30 | 9.8 | 0.06 | 28 | 5.1 | L | 18 |
| LYM313 | 61629.1 | 71.0 | 0.08 | 18 | 8.9 | 0.10 | 16 | 4.9 | 0.01 | 12 |
| LYM313 | 61630.1 | — | — | — | — | — | — | 5.1 | 0.30 | 17 |
| LYM313 | 61630.2 | 80.2 | L | 33 | 10.0 | L | 31 | 5.1 | L | 18 |
| LYM313 | 61631.3 | 71.1 | 0.25 | 18 | 8.9 | 0.28 | 16 | 4.8 | 0.12 | 12 |
| LYM310 | 61634.4 | 70.2 | L | 17 | 8.8 | L | 15 | 4.8 | L | 12 |
| LYM310 | 61637.2 | 75.4 | L | 25 | 9.4 | L | 23 | 5.1 | L | 17 |
| LYM310 | 61637.4 | 86.4 | L | 44 | 10.8 | L | 41 | 5.4 | L | 26 |
| LYM310 | 61638.4 | 83.3 | L | 38 | 10.4 | L | 36 | 5.3 | L | 22 |
| LYM301 | 61912.3 | 74.4 | 0.23 | 24 | 9.3 | 0.24 | 22 | 5.1 | 0.15 | 19 |
| LYM301 | 61913.3 | 76.1 | 0.15 | 27 | 9.5 | 0.17 | 24 | 5.0 | 0.02 | 16 |
| LYM301 | 61914.1 | 80.1 | 0.02 | 33 | 10.0 | 0.03 | 31 | 5.3 | L | 21 |
| LYM301 | 61914.2 | 72.1 | L | 20 | 9.0 | L | 18 | 4.8 | L | 10 |
| LYM301 | 61916.2 | — | — | — | — | — | — | 4.7 | 0.05 | 9 |
| LYM300 | 61749.4 | 74.7 | L | 24 | 9.3 | L | 22 | 5.0 | L | 16 |
| LYM300 | 61750.3 | 77.3 | 0.06 | 28 | 9.7 | 0.07 | 26 | 5.2 | 0.05 | 19 |
| LYM300 | 61750.4 | — | — | — | — | — | — | 5.3 | 0.23 | 22 |
| LYM300 | 61752.3 | 79.5 | 0.04 | 32 | 9.9 | 0.04 | 30 | 5.1 | 0.07 | 18 |
| LYM299 | 61806.2 | 75.4 | 0.07 | 25 | 9.4 | 0.08 | 23 | 5.1 | 0.03 | 19 |
| LYM299 | 61806.4 | 87.1 | 0.05 | 45 | 10.9 | 0.06 | 42 | 5.4 | L | 25 |

TABLE 39-continued

Genes showing improved plant performance at Normal growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYM299 | 61807.4 | 73.1 | 0.09 | 21 | 9.1 | 0.10 | 19 | 5.0 | 0.07 | 15 |
| LYM299 | 61808.4 | 74.7 | 0.29 | 24 | — | — | — | 4.9 | 0.15 | 13 |
| LYM299 | 61809.2 | 78.2 | L | 30 | 9.8 | L | 28 | 5.2 | 0.08 | 21 |
| CONT. | — | 60.2 | — | — | 7.6 | — | — | 4.3 | — | — |
| LYM507 | 62272.9 | 36.5 | 0.26 | 4 | — | — | — | — | — | — |
| LYM507 | 62273.12 | 39.3 | L | 12 | 4.9 | 0.03 | 10 | 4.0 | 0.18 | 3 |
| LYM507 | 62275.5 | 42.6 | 0.20 | 21 | 5.3 | 0.22 | 19 | 4.1 | 0.05 | 7 |
| LYM505 | 62278.6 | 38.7 | 0.02 | 10 | 4.8 | 0.07 | 8 | — | — | — |
| LYM505 | 62279.5 | 44.8 | 0.09 | 27 | 5.6 | 0.08 | 25 | 4.2 | 0.10 | 9 |
| LYM500 | 62365.1 | 43.4 | L | 23 | 5.4 | L | 21 | 4.2 | 0.01 | 8 |
| LYM499 | 62096.2 | 43.4 | 0.09 | 23 | 5.4 | 0.09 | 21 | 4.2 | 0.12 | 9 |
| LYM498 | 62078.2 | 38.6 | 0.11 | 10 | 4.8 | 0.17 | 8 | 4.1 | 0.28 | 5 |
| LYM498 | 62078.4 | 37.0 | 0.16 | 5 | — | — | — | — | — | — |
| LYM494 | 62413.4 | 39.1 | 0.30 | 11 | — | — | — | — | — | — |
| LYM494 | 62414.5 | 38.3 | 0.09 | 9 | 4.8 | 0.18 | 7 | — | — | — |
| LYM489 | 61833.3 | 43.1 | L | 22 | 5.4 | L | 20 | 4.1 | 0.01 | 7 |
| LYM466 | 62214.7 | 37.3 | 0.09 | 6 | 4.7 | 0.28 | 4 | — | — | — |
| LYM464 | 62068.2 | 36.9 | 0.18 | 5 | — | — | — | — | — | — |
| LYM461 | 62219.2 | 37.9 | 0.13 | 8 | 4.7 | 0.25 | 6 | — | — | — |
| LYM454 | 62196.4 | — | — | — | — | — | — | 4.1 | 0.14 | 6 |
| LYM438 | 62185.4 | 37.7 | 0.23 | 7 | — | — | — | — | — | — |
| LYM437 | 62406.3 | 37.3 | 0.14 | 6 | — | — | — | — | — | — |
| LYM437 | 62406.6 | — | — | — | — | — | — | 4.1 | 0.05 | 6 |
| LYM404 | 62244.1 | 36.8 | 0.25 | 5 | — | — | — | — | — | — |
| LYM404 | 62246.12 | — | — | — | — | — | — | 4.0 | 0.27 | 4 |
| LYM387 | 62102.4 | 38.6 | 0.02 | 10 | 4.8 | 0.08 | 8 | — | — | — |
| LYM363 | 62071.1 | 40.5 | L | 15 | 5.1 | L | 13 | 4.0 | 0.25 | 5 |
| LYM348 | 62190.2 | 37.6 | 0.30 | 7 | — | — | — | — | — | — |
| LYM343 | 62458.4 | 40.8 | 0.23 | 16 | 5.1 | 0.25 | 14 | — | — | — |
| LYM323 | 62356.5 | 37.3 | 0.09 | 6 | 4.7 | 0.28 | 4 | — | — | — |
| LYM322 | 62332.2 | 41.1 | 0.27 | 17 | 5.1 | 0.30 | 15 | 4.1 | 0.21 | 6 |
| LYM322 | 62334.5 | 44.2 | 0.23 | 26 | 5.5 | 0.24 | 24 | 4.2 | 0.27 | 9 |
| LYM322 | 62336.1 | 43.8 | 0.12 | 24 | 5.5 | 0.12 | 22 | 4.2 | 0.17 | 9 |
| LYM321 | 62262.12 | 44.3 | 0.10 | 26 | 5.5 | 0.10 | 24 | 4.4 | L | 13 |
| LYM321 | 62264.12 | 40.8 | 0.07 | 16 | 5.1 | 0.08 | 14 | 3.9 | 0.30 | 3 |
| LYM317 | 62252.11 | 42.3 | 0.29 | 20 | — | — | — | — | — | — |
| CONT. | — | 35.2 | — | — | 4.5 | — | — | 3.8 | — | — |

Table 39. "CONT."—Control; "Ave."—Average; "% Incr." = % increment; "p-val."—p-value, L—p < 0.01. The transgenes were under the transcriptional regulation of the new At6669 promoter (SEQ ID NO: 4668).

TABLE 40

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYM445 | 62796.4 | — | — | — | 8.3 | 0.29 | 16 | — | — | — |
| LYM445 | 62797.2 | 0.7 | 0.23 | 18 | — | — | — | — | — | — |
| LYM436 | 62812.4 | 0.7 | 0.25 | 18 | — | — | — | — | — | — |
| LYM435 | 62875.1 | — | — | — | 8.8 | 0.15 | 23 | — | — | — |
| LYM432 | 62946.1 | 0.8 | 0.07 | 29 | — | — | — | — | — | — |
| LYM428 | 63411.2 | 0.8 | 0.08 | 29 | 9.4 | 0.05 | 31 | 0.5 | 0.09 | 17 |
| LYM419 | 62778.2 | — | — | — | — | — | — | 0.5 | 0.24 | 12 |
| LYM414 | 62968.1 | — | — | — | 8.4 | 0.26 | 18 | 0.5 | 0.27 | 11 |
| LYM410 | 62964.2 | 0.7 | 0.26 | 19 | — | — | — | — | — | — |
| LYM398 | 62886.2 | 0.8 | 0.20 | 21 | — | — | — | — | — | — |
| LYM394 | 62913.2 | 0.8 | 0.20 | 22 | — | — | — | — | — | — |
| LYM365 | 62721.2 | 0.8 | 0.23 | 20 | — | — | — | — | — | — |
| CONT. | — | 0.6 | — | — | 7.1 | — | — | 0.4 | — | — |
| LYM510 | 62475.1 | — | — | — | 7.2 | 0.14 | 15 | 0.4 | 0.25 | 7 |
| LYM501 | 62535.2 | — | — | — | 7.1 | 0.24 | 12 | 0.4 | 0.15 | 9 |
| LYM501 | 62537.1 | — | — | — | 8.1 | 0.01 | 29 | 0.5 | L | 21 |
| LYM488 | 62564.6 | — | — | — | — | — | — | 0.4 | 0.25 | 7 |
| LYM488 | 62566.1 | — | — | — | — | — | — | 0.4 | 0.28 | 7 |
| LYM471 | 62657.1 | 0.7 | 0.15 | 17 | — | — | — | — | — | — |

TABLE 40-continued

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYM471 | 62658.1 | — | — | — | 7.0 | 0.28 | 11 | — | — | — |
| LYM471 | 62658.2 | 0.8 | 0.05 | 23 | 8.1 | 0.01 | 29 | 0.5 | L | 20 |
| LYM465 | 62340.2 | — | — | — | — | — | — | 0.4 | 0.09 | 11 |
| LYM465 | 62342.4 | — | — | — | 7.6 | 0.05 | 21 | 0.4 | 0.22 | 8 |
| LYM460 | 62423.3 | — | — | — | — | — | — | 0.4 | 0.25 | 8 |
| LYM460 | 62425.1 | — | — | — | — | — | — | 0.4 | 0.09 | 11 |
| LYM455 | 62704.2 | 0.7 | 0.24 | 16 | — | — | — | — | — | — |
| LYM455 | 62705.5 | 0.8 | 0.03 | 28 | 8.5 | L | 36 | 0.5 | L | 18 |
| LYM455 | 62708.5 | 0.7 | 0.26 | 14 | 7.0 | 0.26 | 12 | — | — | — |
| LYM451 | 62486.6 | 0.7 | 0.21 | 17 | — | — | — | — | — | — |
| LYM451 | 62488.3 | — | — | — | 7.7 | 0.04 | 22 | 0.4 | 0.01 | 16 |
| LYM447 | 62683.1 | 0.7 | 0.22 | 14 | — | — | — | — | — | — |
| LYM446 | 62495.1 | — | — | — | 7.6 | 0.05 | 21 | 0.4 | 0.11 | 10 |
| LYM444 | 62628.4 | — | — | — | 7.0 | 0.25 | 12 | 0.4 | 0.15 | 9 |
| LYM416 | 62663.1 | — | — | — | 7.1 | 0.18 | 14 | 0.4 | 0.14 | 9 |
| LYM406 | 62562.1 | — | — | — | — | — | — | 0.4 | 0.21 | 8 |
| LYM406 | 62562.2 | — | — | — | 7.1 | 0.18 | 14 | 0.4 | 0.10 | 10 |
| LYM388 | 62540.3 | — | — | — | — | — | — | 0.4 | 0.18 | 8 |
| LYM388 | 62543.1 | — | — | — | — | — | — | 0.4 | 0.19 | 8 |
| LYM374 | 62505.2 | 0.7 | 0.18 | 16 | — | — | — | — | — | — |
| LYM364 | 62694.1 | — | — | — | 7.4 | 0.10 | 18 | 0.4 | 0.20 | 9 |
| LYM362 | 62344.6 | — | — | — | — | — | — | 0.4 | 0.25 | 7 |
| LYM362 | 62349.4 | — | — | — | 7.5 | 0.07 | 19 | 0.4 | 0.12 | 10 |
| LYM359 | 62329.1 | — | — | — | 7.9 | 0.01 | 26 | 0.4 | 0.01 | 16 |
| LYM355 | 62450.6 | — | — | — | 7.5 | 0.07 | 20 | 0.4 | 0.02 | 15 |
| LYM355 | 62451.4 | — | — | — | 7.1 | 0.21 | 13 | — | — | — |
| LYM353 | 62675.4 | — | — | — | 7.6 | 0.05 | 21 | 0.4 | 0.04 | 13 |
| LYM353 | 62677.5 | — | — | — | — | — | — | 0.4 | 0.25 | 7 |
| LYM353 | 62677.6 | — | — | — | 7.0 | 0.29 | 11 | — | — | — |
| LYM351 | 62529.2 | — | — | — | 7.9 | 0.01 | 27 | 0.4 | 0.04 | 13 |
| LYM351 | 62530.3 | 0.8 | 0.07 | 22 | 8.4 | L | 34 | 0.4 | 0.03 | 14 |
| LYM341 | 62484.1 | 0.8 | 0.07 | 22 | 7.9 | 0.02 | 25 | 0.4 | 0.10 | 10 |
| LYM339 | 62671.2 | — | — | — | 7.3 | 0.11 | 17 | 0.4 | 0.19 | 8 |
| LYM339 | 62671.3 | — | — | — | 7.2 | 0.15 | 15 | — | — | — |
| LYM332 | 62554.3 | — | — | — | 8.0 | L | 28 | 0.4 | 0.06 | 11 |
| LYM325 | 62689.2 | — | — | — | — | — | — | 0.4 | 0.19 | 8 |
| LYM306 | 62433.1 | — | — | — | 7.5 | 0.06 | 20 | 0.4 | 0.04 | 13 |
| LYM305 | 62518.1 | — | — | — | 7.4 | 0.10 | 18 | 0.4 | 0.24 | 7 |
| LYM305 | 62519.4 | — | — | — | 8.1 | L | 29 | 0.4 | 0.03 | 13 |
| LYM303 | 62523.1 | — | — | — | 7.3 | 0.12 | 17 | 0.4 | 0.17 | 9 |
| CONT. | — | 0.6 | — | — | 6.3 | — | — | 0.4 | — | — |
| LYM503 | 61581.5 | 0.8 | 0.21 | 12 | — | — | — | — | — | — |
| LYM503 | 61581.6 | — | — | — | 8.1 | 0.28 | 13 | 0.4 | 0.27 | 10 |
| LYM503 | 61584.1 | 0.8 | 0.30 | 10 | — | — | — | 0.4 | 0.12 | 17 |
| LYM503 | 61584.7 | 0.8 | 0.09 | 16 | — | — | — | — | — | — |
| LYM495 | 61744.1 | — | — | — | 8.8 | 0.06 | 23 | 0.4 | 0.08 | 17 |
| LYM493 | 61966.4 | — | — | — | — | — | — | 0.4 | 0.22 | 12 |
| LYM493 | 61969.12 | — | — | — | 8.9 | 0.06 | 24 | 0.4 | 0.03 | 22 |
| LYM493 | 61969.8 | — | — | — | — | — | — | 0.4 | 0.27 | 11 |
| LYM480 | 61960.6 | — | — | — | — | — | — | 0.4 | 0.28 | 10 |
| LYM480 | 61962.7 | — | — | — | — | — | — | 0.4 | 0.29 | 10 |
| LYM474 | 61975.8 | — | — | — | — | — | — | 0.4 | 0.28 | 10 |
| LYM474 | 61976.8 | — | — | — | — | — | — | 0.4 | 0.18 | 12 |
| LYM473 | 61783.2 | — | — | — | 9.1 | 0.04 | 28 | 0.4 | 0.01 | 28 |
| LYM473 | 61783.4 | — | — | — | — | — | — | 0.4 | 0.01 | 25 |
| LYM458 | 61812.4 | — | — | — | — | — | — | 0.4 | 0.09 | 17 |
| LYM458 | 61813.3 | — | — | — | — | — | — | 0.4 | 0.08 | 16 |
| LYM458 | 61814.1 | — | — | — | 8.5 | 0.14 | 19 | 0.4 | 0.17 | 14 |
| LYM458 | 61816.4 | — | — | — | 8.1 | 0.27 | 14 | 0.4 | 0.05 | 19 |
| LYM456 | 61587.8 | 0.8 | 0.28 | 10 | — | — | — | 0.4 | 0.29 | 10 |
| LYM456 | 61588.5 | — | — | — | — | — | — | 0.4 | 0.15 | 14 |
| LYM456 | 61588.7 | 0.8 | 0.25 | 11 | 9.1 | 0.04 | 27 | 0.4 | 0.04 | 22 |
| LYM456 | 61589.4 | — | — | — | 8.2 | 0.24 | 15 | 0.4 | 0.23 | 12 |
| LYM456 | 61590.8 | — | — | — | — | — | — | 0.4 | 0.12 | 14 |
| LYM453 | 61984.7 | — | — | — | — | — | — | 0.4 | 0.04 | 20 |
| LYM453 | 61986.6 | — | — | — | 11.0 | L | 53 | 0.5 | L | 40 |
| LYM453 | 61988.6 | — | — | — | 9.9 | L | 39 | 0.4 | L | 33 |
| LYM442 | 61980.5 | — | — | — | 8.3 | 0.19 | 17 | 0.4 | L | 28 |
| LYM440 | 61936.6 | — | — | — | 9.0 | 0.05 | 26 | 0.4 | 0.03 | 22 |
| LYM440 | 61937.6 | — | — | — | 8.9 | 0.05 | 25 | 0.4 | 0.02 | 22 |
| LYM440 | 61937.8 | — | — | — | — | — | — | 0.4 | 0.11 | 15 |

TABLE 40-continued

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYM415 | 61598.5 | 0.8 | 0.05 | 19 | 8.7 | 0.08 | 22 | 0.4 | 0.22 | 11 |
| LYM415 | 61598.7 | — | — | — | — | — | — | 0.4 | 0.24 | 12 |
| LYM415 | 61600.5 | — | — | — | 8.3 | 0.17 | 17 | 0.4 | 0.03 | 22 |
| LYM415 | 61602.6 | — | — | — | 8.3 | 0.16 | 17 | 0.4 | 0.05 | 18 |
| LYM415 | 61602.8 | — | — | — | — | — | — | 0.4 | 0.06 | 19 |
| LYM409 | 61998.2 | — | — | — | 10.4 | L | 46 | 0.4 | 0.01 | 30 |
| LYM409 | 61998.6 | — | — | — | 9.3 | 0.02 | 31 | 0.4 | L | 36 |
| LYM409 | 61999.2 | — | — | — | 9.5 | 0.01 | 33 | 0.4 | L | 29 |
| LYM409 | 61999.3 | — | — | — | 9.1 | 0.05 | 27 | 0.4 | 0.02 | 26 |
| LYM409 | 61999.5 | — | — | — | 8.3 | 0.18 | 17 | 0.4 | 0.07 | 18 |
| LYM396 | 61900.1 | — | — | — | 8.8 | 0.06 | 24 | 0.4 | L | 27 |
| LYM396 | 61900.12 | — | — | — | 8.1 | 0.25 | 14 | 0.4 | 0.05 | 19 |
| LYM396 | 61901.1 | — | — | — | — | — | — | 0.4 | 0.21 | 12 |
| LYM396 | 61901.7 | — | — | — | — | — | — | 0.4 | 0.02 | 23 |
| LYM396 | 61902.7 | — | — | — | 8.8 | 0.08 | 24 | 0.4 | 0.01 | 26 |
| LYM393 | 61610.6 | — | — | — | 9.9 | L | 38 | 0.4 | L | 29 |
| LYM393 | 61610.8 | — | — | — | 9.6 | L | 35 | 0.4 | 0.02 | 23 |
| LYM393 | 61613.7 | — | — | — | — | — | — | 0.4 | 0.25 | 10 |
| LYM393 | 61614.9 | — | — | — | 9.1 | 0.03 | 28 | 0.4 | L | 26 |
| LYM380 | 61824.2 | — | — | — | 9.0 | 0.07 | 26 | 0.4 | 0.05 | 22 |
| LYM380 | 61825.4 | — | — | — | — | — | — | 0.4 | L | 26 |
| LYM380 | 61825.5 | 0.8 | 0.30 | 11 | — | — | — | 0.4 | 0.01 | 25 |
| LYM380 | 61828.3 | — | — | — | 10.8 | L | 52 | 0.4 | L | 36 |
| LYM380 | 61828.5 | — | — | — | 8.5 | 0.12 | 20 | 0.4 | L | 32 |
| LYM377 | 61592.5 | 0.8 | 0.22 | 11 | 11.9 | L | 66 | 0.5 | L | 46 |
| LYM377 | 61594.1 | — | — | — | 10.8 | L | 52 | 0.4 | L | 32 |
| LYM377 | 61594.12 | — | — | — | 8.5 | 0.11 | 19 | 0.4 | 0.06 | 17 |
| LYM377 | 61594.8 | — | — | — | 10.1 | L | 41 | 0.4 | L | 30 |
| LYM376 | 61835.2 | — | — | — | 9.7 | 0.02 | 35 | 0.4 | 0.01 | 30 |
| LYM376 | 61835.3 | 0.8 | 0.25 | 11 | 8.1 | 0.27 | 13 | — | — | — |
| LYM376 | 61836.1 | — | — | — | — | — | — | 0.4 | 0.16 | 14 |
| LYM376 | 61837.1 | — | — | — | 8.8 | 0.06 | 23 | 0.4 | 0.03 | 20 |
| LYM376 | 61839.4 | — | — | — | 9.3 | 0.02 | 31 | 0.4 | 0.08 | 17 |
| LYM375 | 61756.1 | 0.9 | 0.01 | 22 | 11.2 | L | 57 | 0.5 | L | 44 |
| LYM375 | 61758.1 | — | — | — | 8.3 | 0.16 | 16 | 0.4 | 0.10 | 16 |
| LYM372 | 62002.1 | — | — | — | 9.0 | 0.03 | 27 | 0.4 | 0.03 | 20 |
| LYM372 | 62003.6 | — | — | — | 8.1 | 0.26 | 14 | 0.4 | 0.21 | 12 |
| LYM372 | 62006.4 | — | — | — | — | — | — | 0.4 | 0.11 | 14 |
| LYM366 | 61906.15 | — | — | — | 9.0 | 0.04 | 26 | 0.4 | L | 30 |
| LYM366 | 61906.9 | — | — | — | 9.4 | 0.01 | 32 | 0.4 | 0.03 | 22 |
| LYM366 | 61910.6 | — | — | — | 11.1 | L | 56 | 0.5 | L | 53 |
| LYM366 | 61910.7 | — | — | — | 8.5 | 0.16 | 19 | 0.4 | 0.07 | 19 |
| LYM366 | 61910.8 | — | — | — | 8.5 | 0.14 | 18 | 0.4 | 0.08 | 17 |
| LYM361 | 61794.3 | — | — | — | 9.2 | 0.04 | 29 | 0.4 | 0.03 | 24 |
| LYM361 | 61795.1 | — | — | — | 9.2 | 0.03 | 29 | 0.4 | 0.02 | 24 |
| LYM361 | 61795.2 | — | — | — | 8.8 | 0.08 | 23 | 0.4 | 0.13 | 16 |
| LYM361 | 61796.4 | — | — | — | 8.8 | 0.12 | 23 | 0.4 | 0.04 | 25 |
| LYM361 | 61797.1 | — | — | — | 9.1 | 0.03 | 27 | 0.4 | 0.05 | 19 |
| LYM354 | 61800.4 | 0.8 | 0.06 | 17 | 9.8 | L | 38 | 0.4 | L | 33 |
| LYM354 | 61801.3 | — | — | — | 10.4 | L | 46 | 0.4 | L | 34 |
| LYM354 | 61803.4 | — | — | — | 9.7 | L | 37 | 0.4 | L | 32 |
| LYM354 | 61804.3 | — | — | — | 10.1 | L | 42 | 0.4 | L | 33 |
| LYM354 | 61804.4 | — | — | — | 10.7 | L | 49 | 0.4 | L | 36 |
| LYM346 | 61616.15 | — | — | — | 8.7 | 0.06 | 23 | 0.4 | L | 29 |
| LYM346 | 61616.16 | — | — | — | 10.0 | L | 40 | 0.4 | 0.01 | 27 |
| LYM346 | 61616.9 | — | — | — | 9.2 | 0.03 | 28 | 0.4 | L | 28 |
| LYM346 | 61617.9 | — | — | — | 13.0 | L | 83 | 0.5 | L | 52 |
| LYM346 | 61618.4 | — | — | — | 8.4 | 0.15 | 18 | 0.4 | 0.04 | 19 |
| LYM344 | 61788.2 | — | — | — | 9.4 | 0.02 | 32 | 0.4 | 0.03 | 23 |
| LYM344 | 61788.4 | — | — | — | 9.8 | L | 37 | 0.4 | L | 32 |
| LYM344 | 61790.1 | — | — | — | 10.1 | L | 41 | 0.4 | L | 30 |
| LYM344 | 61790.3 | 0.8 | 0.27 | 12 | 9.0 | 0.05 | 26 | 0.4 | L | 26 |
| LYM344 | 61791.1 | — | — | — | 8.2 | 0.23 | 15 | 0.4 | 0.04 | 23 |
| LYM334 | 61942.6 | — | — | — | 8.4 | 0.15 | 18 | 0.4 | L | 28 |
| LYM334 | 61942.7 | — | — | — | 8.5 | 0.13 | 19 | 0.4 | 0.04 | 19 |
| LYM334 | 61942.8 | — | — | — | 9.4 | 0.02 | 32 | 0.4 | 0.03 | 22 |
| LYM334 | 61943.12 | — | — | — | 9.0 | 0.04 | 26 | 0.4 | L | 26 |
| LYM334 | 61947.7 | — | — | — | 8.3 | 0.21 | 17 | 0.4 | 0.07 | 18 |
| LYM330 | 61840.1 | — | — | — | 10.1 | L | 41 | 0.4 | L | 36 |
| LYM330 | 61841.4 | — | — | — | 8.5 | 0.13 | 19 | 0.4 | 0.03 | 21 |
| LYM330 | 61842.4 | — | — | — | 8.9 | 0.06 | 25 | 0.4 | 0.05 | 20 |

TABLE 40-continued

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYM330 | 61844.3 | — | — | — | 8.3 | 0.21 | 16 | 0.4 | 0.21 | 14 |
| LYM327 | 61846.1 | — | — | — | 10.5 | L | 48 | 0.4 | L | 37 |
| LYM327 | 61846.3 | — | — | — | 8.5 | 0.12 | 20 | 0.4 | 0.14 | 14 |
| LYM327 | 61847.1 | 0.8 | 0.29 | 9 | 8.2 | 0.24 | 15 | — | — | — |
| LYM327 | 61848.2 | — | — | — | — | — | — | 0.4 | 0.16 | 13 |
| LYM320 | 61851.2 | — | — | — | 8.9 | 0.05 | 24 | 0.4 | 0.08 | 16 |
| LYM320 | 61852.4 | — | — | — | 9.8 | L | 38 | 0.4 | L | 37 |
| LYM320 | 61853.2 | — | — | — | 8.6 | 0.10 | 20 | 0.4 | L | 28 |
| LYM320 | 61854.2 | — | — | — | 9.1 | 0.03 | 27 | 0.4 | L | 27 |
| LYM319 | 61918.5 | — | — | — | 9.5 | 0.01 | 34 | 0.4 | 0.01 | 26 |
| LYM319 | 61920.6 | — | — | — | 8.9 | 0.07 | 25 | 0.4 | L | 29 |
| LYM319 | 61920.7 | — | — | — | — | — | — | 0.4 | L | 27 |
| LYM319 | 61921.5 | — | — | — | 9.6 | 0.01 | 35 | 0.4 | L | 29 |
| LYM319 | 61921.7 | — | — | — | — | — | — | 0.4 | 0.06 | 19 |
| LYM318 | 61622.2 | — | — | — | 8.6 | 0.12 | 20 | 0.4 | 0.01 | 27 |
| LYM318 | 61623.2 | — | — | — | 8.2 | 0.24 | 15 | 0.4 | 0.05 | 20 |
| LYM318 | 61623.3 | — | — | — | — | — | — | 0.4 | 0.06 | 18 |
| LYM318 | 61625.4 | — | — | — | — | — | — | 0.4 | 0.24 | 14 |
| LYM318 | 61625.6 | — | — | — | — | — | — | 0.4 | 0.06 | 23 |
| LYM313 | 61628.2 | — | — | — | 9.5 | 0.01 | 33 | 0.4 | L | 28 |
| LYM313 | 61629.1 | — | — | — | 8.5 | 0.13 | 19 | 0.4 | 0.04 | 19 |
| LYM313 | 61630.1 | — | — | — | 9.0 | 0.06 | 26 | 0.4 | 0.02 | 25 |
| LYM313 | 61630.2 | — | — | — | 9.8 | L | 37 | 0.4 | L | 26 |
| LYM313 | 61631.3 | — | — | — | 8.6 | 0.11 | 21 | 0.4 | 0.06 | 19 |
| LYM310 | 61634.4 | — | — | — | 8.4 | 0.15 | 18 | 0.4 | 0.03 | 21 |
| LYM310 | 61637.2 | — | — | — | 9.1 | 0.03 | 27 | 0.4 | L | 25 |
| LYM310 | 61637.4 | — | — | — | 10.6 | L | 49 | 0.5 | L | 40 |
| LYM310 | 61638.4 | — | — | — | 10.1 | L | 41 | 0.4 | L | 29 |
| LYM301 | 61912.3 | — | — | — | 9.2 | 0.03 | 29 | 0.5 | L | 37 |
| LYM301 | 61913.3 | — | — | — | 9.4 | 0.02 | 31 | 0.4 | L | 28 |
| LYM301 | 61914.1 | — | — | — | 9.9 | L | 38 | 0.5 | L | 38 |
| LYM301 | 61914.2 | — | — | — | 8.8 | 0.09 | 23 | 0.4 | 0.05 | 20 |
| LYM301 | 61916.2 | — | — | — | — | — | — | 0.4 | 0.01 | 24 |
| LYM300 | 61748.4 | 0.8 | 0.29 | 12 | — | — | — | — | — | — |
| LYM300 | 61749.4 | — | — | — | 9.0 | 0.04 | 25 | 0.4 | 0.02 | 24 |
| LYM300 | 61750.3 | — | — | — | 9.4 | 0.01 | 31 | 0.4 | L | 27 |
| LYM300 | 61750.4 | 0.8 | 0.18 | 13 | 9.4 | 0.03 | 32 | 0.5 | L | 38 |
| LYM300 | 61752.3 | — | — | — | 9.6 | 0.01 | 34 | 0.4 | 0.01 | 24 |
| LYM299 | 61806.2 | — | — | — | 9.2 | 0.02 | 29 | 0.4 | L | 34 |
| LYM299 | 61806.4 | — | — | — | 10.6 | L | 49 | 0.5 | L | 37 |
| LYM299 | 61807.4 | — | — | — | 8.8 | 0.07 | 23 | 0.4 | 0.04 | 20 |
| LYM299 | 61808.4 | — | — | — | 9.0 | 0.05 | 26 | 0.4 | 0.03 | 21 |
| LYM299 | 61809.2 | — | — | — | 9.6 | L | 34 | 0.4 | L | 36 |
| CONT. | — | 0.7 | — | — | 7.1 | — | — | 0.3 | — | — |
| LYM509 | 62202.1 | — | — | — | 5.2 | 0.24 | 18 | — | — | — |
| LYM507 | 62275.5 | — | — | — | 5.3 | 0.15 | 21 | — | — | — |
| LYM505 | 62279.5 | — | — | — | 5.7 | 0.05 | 29 | — | — | — |
| LYM500 | 62365.1 | — | — | — | 5.5 | 0.09 | 25 | — | — | — |
| LYM499 | 62096.2 | — | — | — | 5.6 | 0.08 | 26 | — | — | — |
| LYM489 | 61833.3 | — | — | — | 5.5 | 0.10 | 24 | — | — | — |
| LYM407 | 62142.2 | 0.7 | 0.26 | 19 | — | — | — | — | — | — |
| LYM363 | 62071.1 | — | — | — | 5.2 | 0.21 | 18 | — | — | — |
| LYM343 | 62458.4 | — | — | — | 5.1 | 0.25 | 16 | — | — | — |
| LYM322 | 62332.2 | — | — | — | 5.2 | 0.19 | 18 | — | — | — |
| LYM322 | 62334.5 | — | — | — | 5.6 | 0.07 | 27 | — | — | — |
| LYM322 | 62336.1 | — | — | — | 5.6 | 0.07 | 26 | — | — | — |
| LYM321 | 62262.12 | — | — | — | 5.7 | 0.05 | 29 | 0.4 | 0.08 | 19 |
| LYM321 | 62264.12 | — | — | — | 5.1 | 0.25 | 16 | — | — | — |
| LYM317 | 62252.11 | — | — | — | 5.4 | 0.13 | 22 | — | — | — |
| CONT. | — | 0.6 | — | — | 4.4 | — | — | 0.3 | — | — |

Table 40. "CONT."—Control; "Ave."—Average; "% Incr." = % increment; "p-val."—p-value, L—p < 0.01.
The transgenes were under the transcriptional regulation of the new At6669 promoter (SEQ ID NO: 4668).

TABLE 41

Genes showing improved plant performance at Normal growth conditions under regulation of At6669 promoter

| Gene Name | Event # | Blade Relative Area TP2 | | | Blade Relative Area TP3 | | | Blade Relative Area TP4 | | |
|---|---|---|---|---|---|---|---|---|---|---|
| | | Ave. | P-Val. | % Incr. | Ave. | P-Val. | % Incr. | Ave. | P-Val. | % Incr. |
| LYM370 | 62350.2 | — | — | — | — | — | — | 87.93 | 0.32 | 1 |
| LYM370 | 62351.1 | — | — | — | 91.8 | 0.09 | 3 | 89.52 | 0.24 | 3 |
| LYM370 | 62351.3 | 88.81 | 0.23 | 3 | — | — | — | — | — | — |
| LYM370 | 62351.4 | 88.75 | 0.03 | 3 | 91.66 | 0.01 | 3 | 89.26 | 0.01 | 3 |
| LYM441 | 62361.3 | 89.67 | 0.1 | 4 | — | — | — | — | — | — |
| LYM441 | 62364.1 | — | — | — | 90 | 0.14 | 1 | — | — | — |
| LYM441 | 62364.2 | 89.14 | 0.13 | 3 | 92 | 0.03 | 3 | 89.14 | 0.02 | 3 |
| LYM443 | 62498.5 | — | — | — | 91 | 0.04 | 2 | 88.33 | 0.36 | 2 |
| LYM443 | 62501.1 | — | — | — | 92 | L | 3 | 88.91 | 0.02 | 2 |
| LYM443 | 62502.2 | — | — | — | 91 | L | 3 | 89.91 | L | 3 |
| CONTROL | — | 86.46 | — | — | 89 | — | — | 86.94 | — | — |
| LYM345 | 62937.2 | 92.42 | 0.17 | 1 | — | — | — | — | — | — |
| LYM345 | 62938.4 | — | — | — | 92 | 0.5 | 1 | — | — | — |
| LYM345 | 62938.6 | 93.25 | 0.33 | 2 | 93 | 0 | 3 | 89.98 | 0.6 | 1 |
| LYM345 | 62940.1 | 93.49 | 0.26 | 2 | 93.74 | 0.14 | 3 | 90.89 | 0.11 | 2 |
| LYM405 | 63205.2 | — | — | — | 92.7 | 0.24 | 2 | 91.01 | 0.3 | 2 |
| LYM405 | 63205.4 | 93.15 | 0.3 | 2 | 93.17 | 0.14 | 2 | — | — | — |
| LYM405 | 63206.2 | 93.47 | 0.03 | 2 | 93.39 | 0.03 | 3 | 90.67 | 0.04 | 2 |
| LYM405 | 63209.1 | — | — | — | 93 | 0.01 | 2 | 91.28 | 0.19 | 2 |
| LYM457 | 62906.1 | — | — | — | 91.99 | 0.2 | 1 | — | — | — |
| LYM457 | 62906.3 | 92.31 | 0.08 | 1 | 92.06 | 0.16 | 1 | — | — | — |
| LYM457 | 62907.4 | 92.89 | 0.38 | 1 | 92.65 | 0.3 | 2 | 90.38 | 0.35 | 1 |
| LYM457 | 62910.1 | — | — | — | 92.36 | 0.15 | 2 | 90.39 | 0.45 | 1 |
| CONTROL | — | 91.68 | — | — | 90.94 | — | 0 | 89.18 | — | — |

Table 41. "CONT."—Control; "Ave."—Average; "% Incr." = % increment; "p-val."—p-value, L—p < 0.01. The transgenes were under the transcriptional regulation of the new At6669 promoter (SEQ ID NO: 4668).

TABLE 42

Genes showing improved plant performance at Normal growth conditions under regulation of At6669 promoter

| Gene Name | Event # | Petiole Relative Area TP2 | | | Petiole Relative Area TP3 | | | Petiole Relative Area TP4 | | |
|---|---|---|---|---|---|---|---|---|---|---|
| | | Ave. | P-Val. | % Incr. | Ave. | P-Val. | % Incr. | Ave. | P-Val. | % Incr. |
| LYM370 | 62350.2 | 15.56 | 0.28 | 15 | — | — | — | — | — | — |
| LYM370 | 62353.4 | — | — | — | 12.84 | 0.11 | 18 | 14.78 | 0.04 | 13 |
| LYM441 | 62360.2 | 14.96 | 0.44 | 11 | 11.92 | 0.29 | 9 | — | — | — |
| LYM443 | 62498.3 | 15.49 | 0.05 | 14 | 12.49 | 0.3 | 14 | — | — | — |
| LYM443 | 62498.4 | — | — | — | — | — | — | 14.01 | 0.35 | 7 |
| CONTROL | — | 13.54 | — | — | 10.92 | — | — | 13.06 | — | — |
| LYM345 | 62937.2 | — | — | — | — | — | — | 12.25 | 0.07 | 13 |
| LYM405 | 63209.3 | 10.1 | 0.6 | 21 | — | — | — | — | — | — |
| LYM457 | 62907.5 | 9.25 | 0.21 | 11 | 10.96 | 0.23 | 21 | — | — | — |
| CONTROL | — | 8.32 | — | — | 9.06 | — | — | 10.82 | — | — |

Table 42. "CONT."—Control; "Ave."—Average; "% Incr." = % increment; "p-val."—p-value, L—p < 0.01. The transgenes were under the transcriptional regulation of the new At6669 promoter (SEQ ID NO: 4668).

Example 12

Evaluating Transgenic *Arabidopsis* Under Normal Conditions Using In Vitro Assays Tissue Culture T2 and T1 Plants, TC-T2 and TC-T1 Assays Surface sterilized seeds were sown in basal media [50% Murashige-Skoog medium (MS) supplemented with 0.8% plant agar as solidifying agent] in the presence of Kanamycin (used as a selecting agent). After sowing, plates were transferred for 2-3 days for stratification at 4° C. and then grown at 25° C. under 12-hour light 12-hour dark daily cycles for 7 to 10 days. At this time point, seedlings randomly chosen were carefully transferred to plates containing ½ MS media (15 mM N). For experiments performed in $T_2$ lines, each plate contained 5 seedlings of the same transgenic event, and 3-4 different plates (replicates) for each event. For each polynucleotide of the invention at least four-five independent transformation events were analyzed from each construct. For experiments performed in $T_1$ lines, each plate contained 5 seedlings of 5 independent transgenic events and 3-4 different plates (replicates) were planted. In total, for $T_1$ lines, 20 independent events were evaluated. Plants expressing the polynucleotides of the invention were compared to the average measurement of the control plants (empty vector or GUS reporter gene under the same promoter) used in the same experiment.

Digital imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) and located in a darkroom, was used for capturing images of plantlets sawn in agar plates.

The image capturing process was repeated every 3-4 days starting at day 1 till day 10 (see for example the images in FIGS. 3A-F). An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at Hypertext Transfer Protocol://rsbweb (dot) nih (dot) gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Seedling analysis—Using the digital analysis seedling data was calculated, including leaf area, root coverage and root length.

The relative growth rate for the various seedling parameters was calculated according to the following formulas XIV, VI (described above) and XV.

Relative growth rate of leaf area=Regression coefficient of leaf area along time course.  Formula XIV:

Relative growth rate of root length=Regression coefficient of root length along time course.  Formula XV:

At the end of the experiment, plantlets were removed from the media and weighed for the determination of plant fresh weight. Plantlets were then dried for 24 hours at 60° C., and weighed again to measure plant dry weight for later statistical analysis. The fresh and dry weights are provided for each *Arabidopsis* plant. Growth rate was determined by comparing the leaf area coverage, root coverage and root length, between each couple of sequential photographs, and results were used to resolve the effect of the gene introduced on plant vigor under optimal conditions. Similarly, the effect of the gene introduced on biomass accumulation, under optimal conditions, was determined by comparing the plants' fresh and dry weight to that of control plants (containing an empty vector or the GUS reporter gene under the same promoter). From every construct created, 3-5 independent transformation events were examined in replicates.

Statistical analyses—To identify genes conferring significantly improved plant vigor or enlarged root architecture, the results obtained from the transgenic plants were compared to those obtained from control plants. To identify outperforming genes and constructs, results from the independent transformation events tested were analyzed separately. To evaluate the effect of a gene event over a control the data was analyzed by Student's t-test and the p value was calculated. Results were considered significant if p≤0.1. The JMP statistics software package was used (Version 5.2.1, SAS Institute Inc., Cary, N.C., USA).

Experimental Results:

Tables 43-45 summarize the observed phenotypes of transgenic plants expressing the gene constructs using the TC-T2 Assays.

The genes presented in Table 43 showed a significant improvement as they produced larger plant biomass (plant fresh and dry weight) in T2 generation when grown under normal growth conditions, compared to control plants. The genes were cloned under the regulation of a constitutive promoter (At6669, SEQ ID NO:4668). The evaluation of each gene was carried out by testing the performance of different number of events. Some of the genes were evaluated in more than one tissue culture assay. The results obtained in these second experiments were significantly positive as well.

TABLE 43

Genes showing improved plant performance at Normal growth conditions under regulation of At6669 promoter

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LYM490 | 62920.3 | 5.7 | 0.04 | 41 | 105.8 | 0.21 | 23 |
| LYM448 | 62802.2 | 5.2 | 0.05 | 30 | 102.5 | 0.30 | 19 |
| LYM448 | 62805.2 | 5.2 | 0.02 | 29 | 103.2 | 0.19 | 20 |
| LYM435 | 62872.1 | 7.6 | 0.04 | 88 | 156.9 | 0.06 | 82 |
| LYM419 | 62775.1 | — | — | — | 100.9 | 0.11 | 17 |
| LYM419 | 62778.1 | 6.7 | 0.05 | 67 | 139.3 | 0.03 | 62 |
| LYM401 | 62854.1 | 7.0 | 0.05 | 75 | 133.6 | 0.09 | 55 |
| LYM401 | 62856.1 | 6.0 | 0.09 | 50 | 124.1 | 0.13 | 44 |
| LYM401 | 62856.4 | 4.5 | 0.17 | 13 | — | — | — |
| LYM401 | 62857.5 | 5.8 | 0.04 | 45 | 121.5 | 0.11 | 41 |
| LYM395 | 62924.2 | 4.8 | 0.24 | 19 | — | — | — |
| LYM395 | 62927.2 | — | — | — | 102.0 | 0.09 | 18 |
| LYM395 | 62928.1 | 4.7 | 0.29 | 16 | — | — | — |
| LYM371 | 62847.1 | — | — | — | 123.9 | 0.03 | 44 |
| LYM371 | 62847.2 | 6.2 | L | 54 | 130.6 | 0.04 | 51 |
| LYM371 | 62851.2 | 5.9 | 0.17 | 45 | 148.7 | 0.09 | 73 |
| LYM367 | 62735.5 | — | — | — | 109.4 | 0.04 | 27 |
| LYM367 | 62737.2 | 5.5 | 0.07 | 38 | 111.0 | L | 29 |
| LYM367 | 62739.2 | 8.2 | 0.08 | 104 | 161.0 | 0.11 | 87 |
| LYM352 | 62880.3 | 5.6 | 0.17 | 40 | — | — | — |
| LYM352 | 62881.2 | 6.3 | 0.13 | 57 | 122.2 | 0.25 | 42 |
| LYM328 | 62731.1 | 4.5 | 0.21 | 11 | — | — | — |
| LYM328 | 62732.7 | — | — | — | 111.6 | 0.01 | 29 |
| LYM314 | 62859.1 | — | — | — | 94.2 | 0.22 | 9 |
| LYM314 | 62862.1 | 5.8 | 0.21 | 43 | 137.8 | 0.07 | 60 |
| CONT. | — | 4.0 | — | — | 86.2 | — | — |
| LYM504 | 63308.5 | 3.1 | 0.19 | 16 | — | — | — |
| LYM504 | 63309.1 | 4.2 | L | 56 | 76.3 | L | 34 |
| LYM504 | 63309.3 | 3.5 | 0.01 | 30 | — | — | — |
| LYM483 | 63629.1 | 3.7 | 0.07 | 36 | 91.0 | 0.16 | 59 |
| LYM483 | 63629.2 | 4.5 | L | 65 | 79.2 | L | 39 |
| LYM467 | 63564.2 | 3.8 | 0.08 | 38 | 69.8 | 0.27 | 22 |
| LYM467 | 63564.3 | 3.8 | 0.02 | 39 | — | — | — |
| LYM467 | 63565.1 | 4.2 | 0.02 | 55 | 67.8 | 0.02 | 19 |
| LYM467 | 63565.4 | 3.0 | 0.25 | 11 | — | — | — |
| LYM463 | 63108.2 | 5.2 | L | 91 | 87.0 | L | 52 |
| LYM463 | 63110.9 | 3.6 | 0.05 | 34 | — | — | — |
| LYM463 | 63111.12 | 3.7 | L | 35 | 63.3 | 0.13 | 11 |
| LYM463 | 63112.13 | 3.1 | 0.26 | 15 | — | — | — |
| LYM463 | 63113.2 | 3.6 | 0.15 | 32 | — | — | — |
| LYM450 | 63126.2 | 4.4 | L | 63 | 74.6 | L | 31 |
| LYM450 | 63127.9 | 4.0 | 0.05 | 49 | 71.4 | 0.04 | 25 |
| LYM450 | 63128.1 | — | — | — | 65.3 | 0.25 | 14 |
| LYM450 | 63130.4 | 3.9 | 0.08 | 43 | 78.3 | 0.25 | 37 |
| LYM433 | 63300.3 | 3.8 | 0.09 | 40 | 69.6 | 0.06 | 22 |
| LYM433 | 63300.4 | 4.5 | 0.05 | 64 | 81.2 | 0.03 | 42 |
| LYM433 | 63301.2 | 4.3 | L | 60 | 74.1 | 0.04 | 30 |
| LYM433 | 63301.3 | 3.3 | 0.06 | 23 | 78.9 | 0.22 | 38 |
| LYM433 | 63302.1 | 4.3 | L | 60 | 84.7 | 0.12 | 48 |
| LYM425 | 63132.9 | 4.1 | 0.03 | 52 | 73.9 | 0.05 | 29 |
| LYM425 | 63133.2 | 3.2 | 0.03 | 18 | — | — | — |
| LYM425 | 63134.2 | 5.0 | 0.06 | 83 | 89.7 | 0.03 | 57 |
| LYM423 | 62981.12 | 3.2 | 0.15 | 20 | — | — | — |
| LYM423 | 63056.3 | 3.7 | 0.04 | 37 | — | — | — |
| LYM423 | 63058.2 | 4.0 | 0.02 | 47 | 70.5 | 0.09 | 24 |
| LYM422 | 63313.3 | 4.2 | 0.06 | 54 | — | — | — |
| LYM403 | 63621.3 | 3.9 | 0.19 | 42 | 69.6 | 0.20 | 22 |
| LYM403 | 63624.4 | 3.3 | 0.09 | 21 | 69.0 | 0.09 | 21 |
| LYM392 | 63324.2 | 4.1 | 0.02 | 51 | 77.6 | 0.14 | 36 |
| LYM392 | 63326.2 | 3.7 | 0.10 | 37 | — | — | — |
| LYM392 | 63328.4 | 4.6 | L | 69 | 87.8 | 0.09 | 54 |
| LYM381 | 63550.2 | 3.2 | 0.13 | 17 | — | — | — |
| LYM381 | 63550.4 | 4.0 | L | 46 | — | — | — |

TABLE 43-continued

Genes showing improved plant performance at Normal growth conditions under regulation of At6669 promoter

| Gene Name | Event # | Dry Weight [mg] Ave. | P-Val. | % Incr. | Fresh Weight [mg] Ave. | P-Val. | % Incr. |
|---|---|---|---|---|---|---|---|
| LYM381 | 63552.1 | 3.5 | 0.01 | 30 | — | — | — |
| LYM336 | 63068.2 | 3.3 | 0.01 | 21 | — | — | — |
| LYM336 | 63071.2 | 4.1 | L | 50 | 71.5 | 0.04 | 25 |
| LYM336 | 63072.1 | 3.8 | 0.10 | 40 | 74.0 | 0.18 | 30 |
| LYM336 | 63073.2 | 4.8 | 0.03 | 76 | 81.8 | 0.03 | 43 |
| LYM336 | 63073.4 | 4.0 | 0.17 | 47 | 77.0 | L | 35 |
| CONT. | — | 2.7 | — | — | 57.1 | — | — |
| LYM495 | 61742.2 | 6.1 | L | 100 | 103.1 | L | 81 |
| LYM495 | 61743.2 | 3.9 | 0.23 | 27 | — | — | — |
| LYM495 | 61744.1 | 4.1 | 0.15 | 34 | 74.6 | 0.13 | 31 |
| LYM495 | 61744.3 | 5.1 | 0.04 | 68 | 89.9 | 0.03 | 58 |
| LYM495 | 61746.2 | 4.0 | 0.09 | 32 | 65.2 | 0.29 | 15 |
| LYM475 | 63096.13 | 4.2 | 0.04 | 36 | 73.2 | 0.10 | 29 |
| LYM475 | 63096.3 | 4.0 | 0.03 | 30 | 69.6 | 0.04 | 22 |
| LYM475 | 63097.4 | 3.7 | 0.26 | 20 | 65.7 | 0.12 | 15 |
| LYM475 | 63098.1 | 5.1 | L | 67 | 77.8 | 0.03 | 37 |
| LYM475 | 63100.1 | 3.7 | 0.13 | 21 | 64.8 | 0.12 | 14 |
| LYM473 | 61783.4 | 6.1 | L | 99 | 104.3 | 0.04 | 83 |
| LYM473 | 61784.3 | 3.8 | 0.11 | 24 | — | — | — |
| LYM473 | 61786.1 | 4.3 | 0.02 | 42 | 68.8 | 0.11 | 21 |
| LYM472 | 63114.2 | 6.6 | L | 117 | 113.8 | 0.01 | 100 |
| LYM472 | 63117.5 | 4.5 | 0.01 | 48 | 73.7 | L | 30 |
| LYM472 | 63117.6 | 4.8 | 0.03 | 57 | 78.1 | L | 37 |
| LYM472 | 63118.8 | 4.8 | 0.05 | 57 | 90.0 | 0.05 | 58 |
| LYM458 | 61812.2 | 4.1 | 0.13 | 35 | 66.4 | 0.15 | 17 |
| LYM458 | 61814.1 | 8.0 | 0.01 | 162 | 134.3 | 0.01 | 136 |
| LYM413 | 61819.2 | 6.0 | 0.03 | 97 | 98.7 | 0.05 | 74 |
| LYM413 | 61819.3 | 4.8 | 0.06 | 56 | 82.7 | 0.05 | 45 |
| LYM413 | 61822.3 | 5.0 | L | 66 | 87.3 | 0.01 | 54 |
| LYM413 | 61823.1 | 7.1 | L | 134 | 124.4 | L | 119 |
| LYM400 | 63121.22 | 4.1 | L | 34 | 68.1 | 0.07 | 20 |
| LYM400 | 63124.13 | 5.5 | L | 82 | 91.9 | 0.01 | 62 |
| LYM380 | 61824.2 | 8.1 | 0.02 | 167 | 136.1 | 0.02 | 139 |
| LYM380 | 61825.2 | 5.3 | L | 74 | 89.1 | L | 57 |
| LYM380 | 61825.5 | 6.0 | L | 95 | 101.3 | L | 78 |
| LYM380 | 61828.3 | 5.4 | L | 77 | 95.5 | L | 68 |
| LYM376 | 61835.2 | 4.4 | 0.06 | 43 | 80.2 | 0.01 | 41 |
| LYM376 | 61835.3 | 4.3 | L | 41 | 71.7 | 0.06 | 26 |
| LYM376 | 61836.1 | 4.7 | 0.03 | 53 | 82.0 | 0.04 | 44 |
| LYM376 | 61839.4 | 5.5 | 0.05 | 82 | 94.8 | 0.04 | 67 |
| LYM354 | 61804.3 | 5.6 | 0.02 | 85 | 103.9 | 0.04 | 83 |
| LYM354 | 61804.4 | 4.8 | L | 57 | 83.7 | L | 47 |
| LYM344 | 61788.2 | 5.0 | 0.07 | 66 | 88.2 | 0.04 | 55 |
| LYM344 | 61788.4 | 4.6 | 0.05 | 52 | 87.8 | 0.04 | 54 |
| LYM344 | 61790.1 | 4.2 | 0.13 | 38 | 76.2 | 0.11 | 34 |
| LYM344 | 61790.3 | 5.7 | L | 87 | 94.7 | L | 66 |
| LYM330 | 61840.1 | 5.5 | L | 80 | 96.4 | L | 70 |
| LYM330 | 61840.3 | 3.6 | 0.20 | 20 | — | — | — |
| LYM330 | 61841.4 | 4.0 | 0.07 | 33 | 65.1 | 0.16 | 14 |
| LYM330 | 61842.4 | 5.4 | 0.11 | 77 | 85.3 | 0.13 | 50 |
| LYM330 | 61844.3 | 7.2 | 0.09 | 135 | 115.5 | 0.10 | 103 |
| LYM327 | 61846.1 | 8.7 | 0.06 | 186 | 145.6 | 0.05 | 156 |
| LYM327 | 61846.3 | 7.2 | L | 137 | 122.3 | L | 115 |
| LYM327 | 61847.1 | 6.0 | 0.09 | 98 | 104.3 | 0.08 | 83 |
| LYM327 | 61848.2 | 3.9 | 0.10 | 28 | 68.8 | 0.05 | 21 |
| LYM327 | 61849.1 | 5.9 | L | 93 | 95.6 | 0.03 | 68 |
| LYM309 | 63102.3 | 7.1 | L | 132 | 121.1 | L | 113 |
| LYM309 | 63103.27 | 5.1 | 0.02 | 67 | 79.4 | 0.09 | 40 |
| LYM309 | 63104.16 | 7.8 | L | 155 | 137.5 | L | 142 |
| LYM309 | 63104.3 | 4.6 | L | 50 | 76.3 | 0.01 | 34 |
| LYM299 | 61806.4 | 3.5 | 0.28 | 14 | 66.5 | 0.07 | 17 |
| LYM299 | 61807.3 | 6.1 | 0.02 | 100 | 101.7 | 0.04 | 79 |
| LYM299 | 61808.4 | 5.8 | L | 91 | 100.2 | 0.01 | 76 |
| LYM299 | 61809.2 | 6.6 | 0.01 | 116 | 122.8 | L | 116 |
| CONT. | — | 3.1 | — | — | 56.9 | — | — |
| LYM493 | 61966.4 | 5.3 | L | 86 | 103.6 | L | 81 |
| LYM493 | 61967.6 | 3.6 | 0.13 | 24 | 81.5 | 0.02 | 43 |
| LYM493 | 61968.6 | 3.5 | 0.08 | 23 | — | — | — |
| LYM493 | 61968.8 | — | — | — | 74.2 | 0.21 | 30 |
| LYM493 | 61969.8 | 5.2 | L | 81 | 104.7 | L | 83 |
| LYM480 | 61960.6 | 5.8 | 0.02 | 100 | 104.8 | 0.02 | 83 |
| LYM480 | 61961.1 | 5.2 | L | 83 | 103.1 | L | 80 |
| LYM480 | 61962.8 | 5.2 | L | 82 | 87.9 | 0.06 | 54 |
| LYM474 | 61972.5 | 5.2 | 0.09 | 81 | 100.8 | 0.12 | 76 |
| LYM474 | 61977.6 | 3.6 | 0.06 | 25 | 69.8 | 0.11 | 22 |
| LYM453 | 61984.7 | 3.3 | 0.14 | 16 | 71.3 | 0.19 | 25 |
| LYM453 | 61984.9 | 5.5 | 0.05 | 91 | 110.5 | 0.07 | 93 |
| LYM453 | 61985.4 | 6.9 | L | 138 | 131.5 | L | 130 |
| LYM453 | 61986.6 | 5.6 | 0.05 | 96 | 119.1 | 0.01 | 108 |
| LYM442 | 61979.5 | 5.5 | L | 92 | 105.6 | L | 85 |
| LYM442 | 61979.6 | 4.4 | 0.03 | 52 | 80.9 | 0.01 | 42 |
| LYM442 | 61980.5 | 4.0 | L | 40 | 82.4 | L | 44 |
| LYM442 | 61983.7 | 6.8 | L | 137 | 126.8 | L | 122 |
| LYM440 | 61936.6 | 3.8 | L | 31 | 74.0 | 0.06 | 29 |
| LYM440 | 61937.6 | 3.9 | 0.19 | 34 | 84.9 | 0.09 | 49 |
| LYM440 | 61937.8 | 4.7 | 0.03 | 63 | 93.1 | 0.08 | 63 |
| LYM440 | 61939.6 | 5.2 | 0.02 | 83 | 102.4 | L | 79 |
| LYM409 | 61997.1 | — | — | — | 75.1 | 0.26 | 31 |
| LYM409 | 61997.2 | 4.5 | 0.01 | 57 | 86.9 | 0.01 | 52 |
| LYM409 | 61998.2 | — | — | — | 74.8 | 0.18 | 31 |
| LYM409 | 61998.6 | 5.3 | L | 83 | 116.4 | L | 104 |
| LYM409 | 61999.3 | 4.4 | 0.09 | 52 | 72.7 | 0.18 | 27 |
| LYM396 | 61900.7 | 4.3 | L | 50 | 82.1 | L | 44 |
| LYM396 | 61901.1 | 3.5 | 0.17 | 23 | 78.0 | L | 36 |
| LYM396 | 61901.7 | 5.6 | L | 95 | 109.1 | L | 91 |
| LYM396 | 61902.7 | 3.8 | 0.22 | 30 | 80.0 | 0.02 | 40 |
| LYM396 | 61902.8 | — | — | — | 73.0 | 0.06 | 28 |
| LYM372 | 62002.1 | 4.1 | L | 43 | 79.4 | 0.02 | 39 |
| LYM372 | 62003.2 | — | — | — | 65.9 | 0.22 | 15 |
| LYM372 | 62003.6 | 3.3 | 0.29 | 15 | — | — | — |
| LYM372 | 62004.2 | 3.3 | 0.21 | 16 | 67.4 | 0.08 | 18 |
| LYM372 | 62006.4 | 4.0 | L | 38 | 77.0 | 0.02 | 35 |
| LYM366 | 61906.15 | 5.6 | L | 95 | 106.2 | L | 86 |
| LYM366 | 61910.6 | 3.5 | 0.02 | 23 | — | — | — |
| LYM366 | 61910.7 | 3.9 | 0.22 | 37 | 80.8 | 0.15 | 41 |
| LYM366 | 61910.8 | 3.2 | 0.25 | 11 | — | — | — |
| LYM334 | 61942.6 | 4.1 | 0.01 | 43 | 80.8 | L | 41 |
| LYM334 | 61942.7 | 5.4 | 0.03 | 87 | 109.1 | 0.01 | 91 |
| LYM334 | 61943.12 | 5.4 | 0.01 | 89 | 118.0 | L | 107 |
| LYM334 | 61947.7 | 3.5 | 0.22 | 23 | 70.4 | 0.10 | 23 |
| LYM319 | 61920.6 | — | — | — | 66.0 | 0.17 | 16 |
| LYM319 | 61921.5 | 3.8 | 0.03 | 32 | 73.5 | 0.04 | 29 |
| LYM301 | 61913.4 | 3.5 | 0.25 | 21 | 66.1 | 0.15 | 16 |
| LYM301 | 61914.1 | 3.8 | 0.14 | 31 | 71.3 | 0.24 | 25 |
| LYM301 | 61916.2 | 3.3 | 0.20 | 14 | — | — | — |
| CONT. | — | 2.9 | — | — | 57.1 | — | — |
| LYM483 | 63625.2 | 5.3 | 0.07 | 40 | 102.4 | 0.01 | 30 |
| LYM483 | 63626.7 | 4.7 | 0.07 | 23 | — | — | — |
| LYM467 | 63563.3 | — | — | — | 93.8 | 0.26 | 19 |
| LYM467 | 63564.3 | 5.8 | 0.02 | 54 | 110.3 | 0.14 | 40 |
| LYM467 | 63565.4 | 4.6 | 0.17 | 21 | 97.0 | 0.27 | 23 |
| LYM463 | 63113.2 | 5.9 | 0.03 | 55 | 129.0 | L | 63 |
| LYM450 | 63126.2 | 4.6 | 0.19 | 22 | 97.0 | 0.09 | 23 |
| LYM450 | 63127.9 | 4.8 | 0.08 | 26 | 99.7 | 0.10 | 26 |
| LYM433 | 63300.3 | 4.9 | 0.01 | 29 | 103.7 | 0.18 | 31 |
| LYM433 | 63300.4 | 5.9 | L | 55 | 118.7 | L | 50 |
| LYM433 | 63301.3 | 5.7 | L | 50 | 102.1 | 0.02 | 29 |
| LYM425 | 63132.9 | 4.9 | 0.17 | 30 | 96.0 | 0.20 | 22 |
| LYM425 | 63133.2 | — | — | — | 96.7 | 0.15 | 22 |
| LYM425 | 63136.4 | — | — | — | 92.2 | 0.15 | 17 |
| LYM423 | 62981.11 | — | — | — | 109.3 | 0.28 | 38 |
| LYM423 | 62981.12 | 5.2 | 0.05 | 36 | — | — | — |
| LYM403 | 63620.4 | 6.8 | 0.10 | 78 | 141.2 | 0.16 | 79 |
| LYM403 | 63621.3 | 5.0 | 0.08 | 31 | 98.3 | 0.10 | 24 |
| LYM403 | 63621.4 | 6.0 | L | 57 | 100.1 | 0.04 | 27 |
| LYM403 | 63624.3 | — | — | — | 95.7 | 0.12 | 21 |
| LYM403 | 63624.4 | — | — | — | 114.1 | 0.13 | 44 |
| LYM392 | 63324.2 | 6.3 | L | 66 | 124.2 | 0.03 | 57 |
| LYM392 | 63328.6 | 4.6 | 0.26 | 21 | 96.1 | 0.17 | 22 |
| LYM381 | 63550.2 | 4.4 | 0.22 | 17 | — | — | — |
| LYM381 | 63551.2 | 4.4 | 0.18 | 16 | 94.0 | 0.26 | 19 |
| LYM336 | 63068.2 | 5.6 | 0.01 | 48 | 115.1 | 0.08 | 46 |
| LYM336 | 63071.2 | 5.9 | 0.01 | 55 | 104.0 | 0.03 | 32 |
| LYM336 | 63072.1 | 5.0 | 0.06 | 31 | — | — | — |

TABLE 43-continued

Genes showing improved plant performance at Normal growth conditions under regulation of At6669 promoter

| Gene Name | Event # | Dry Weight [mg] Ave. | P-Val. | % Incr. | Fresh Weight [mg] Ave. | P-Val. | % Incr. |
|---|---|---|---|---|---|---|---|
| CONT. | — | 3.8 | — | — | 79.0 | — | — |
| LYM475 | 63096.13 | 5.6 | 0.08 | 57 | — | — | — |
| LYM475 | 63097.16 | 6.0 | 0.04 | 67 | 111.1 | 0.27 | 23 |
| LYM475 | 63100.1 | 5.9 | 0.13 | 64 | — | — | — |
| LYM472 | 63114.2 | 5.3 | L | 49 | — | — | — |
| LYM472 | 63114.4 | 4.2 | 0.30 | 17 | — | — | — |
| LYM472 | 63117.5 | 5.8 | L | 63 | — | — | — |
| LYM472 | 63117.6 | 5.3 | 0.04 | 50 | — | — | — |
| LYM472 | 63118.8 | 4.3 | 0.19 | 21 | — | — | — |
| LYM439 | 63752.3 | 5.1 | 0.09 | 42 | — | — | — |
| LYM439 | 63754.3 | 5.8 | 0.21 | 62 | 121.6 | 0.22 | 34 |
| LYM427 | 63772.1 | 5.3 | 0.14 | 48 | — | — | — |
| LYM427 | 63774.1 | 4.1 | 0.22 | 15 | — | — | — |
| LYM402 | 63778.2 | 4.6 | 0.22 | 29 | — | — | — |
| LYM402 | 63778.4 | 4.6 | 0.03 | 29 | — | — | — |
| LYM402 | 63780.1 | 6.4 | 0.02 | 79 | 135.3 | 0.29 | 49 |
| LYM400 | 63121.21 | 5.8 | L | 61 | 116.9 | 0.22 | 29 |
| LYM400 | 63121.22 | 5.0 | 0.10 | 41 | — | — | — |
| LYM400 | 63122.3 | 6.6 | 0.01 | 83 | 136.6 | 0.09 | 51 |
| LYM400 | 63124.13 | 5.8 | 0.27 | 61 | — | — | — |
| LYM386 | 63391.2 | 4.8 | 0.05 | 34 | — | — | — |
| LYM386 | 63391.3 | 5.7 | 0.05 | 59 | — | — | — |
| LYM386 | 63393.3 | 5.3 | 0.11 | 48 | — | — | — |
| LYM386 | 63393.6 | 4.2 | 0.09 | 19 | — | — | — |
| LYM385 | 63654.1 | 4.8 | 0.02 | 34 | — | — | — |
| LYM385 | 63658.3 | 5.4 | 0.02 | 52 | — | — | — |
| LYM384 | 63138.13 | 8.0 | 0.08 | 123 | 145.9 | 0.13 | 61 |
| LYM384 | 63139.14 | 6.7 | 0.03 | 87 | 131.2 | 0.07 | 45 |
| LYM384 | 63139.5 | 5.3 | 0.13 | 50 | — | — | — |
| LYM337 | 63787.1 | 6.0 | 0.07 | 66 | — | — | — |
| LYM337 | 63788.2 | 4.4 | 0.27 | 24 | — | — | — |
| LYM337 | 63788.3 | 10.2 | L | 187 | 184.9 | 0.02 | 104 |
| LYM312 | 63145.1 | 8.1 | 0.02 | 126 | 152.9 | 0.17 | 69 |
| LYM312 | 63198.2 | 5.4 | 0.07 | 50 | — | — | — |
| LYM312 | 63198.4 | 4.2 | 0.29 | 17 | — | — | — |
| LYM312 | 63201.1 | 5.2 | L | 46 | — | — | — |
| LYM312 | 63201.4 | 7.3 | 0.04 | 105 | 131.3 | 0.09 | 45 |
| LYM309 | 63102.3 | 4.7 | 0.03 | 31 | — | — | — |
| LYM309 | 63103.27 | 4.7 | 0.20 | 31 | — | — | — |
| LYM309 | 63104.16 | 5.4 | L | 52 | — | — | — |
| LYM309 | 63104.3 | 6.4 | 0.02 | 78 | — | — | — |
| CONT. | — | 3.6 | — | — | 90.5 | — | — |

Table 43.
"CONT."—Control;
"Ave."—Average;
"% Incr." = % increment;
"p-val."—p-value,
L—p < 0.01.
The transgenes were under the transcriptional regulation of the new At6669 promoter (SEQ ID NO: 4668).

The genes presented in Tables 44 and 45 showed a significant improvement in plant performance since they produced a larger leaf biomass (leaf area) and root biomass (root length and root coverage) (Table 44) and a higher relative growth rate of leaf area, root coverage and root length (Table 45) when grown under normal growth conditions, compared to control plants. Plants producing larger root biomass have better possibilities to absorb larger amount of nitrogen from soil. Plants producing larger leaf biomass have better ability to produce assimilates. The genes were cloned under the regulation of a constitutive promoter (At6669). The evaluation of each gene was performed by testing the performance of different number of events. Some of the genes were evaluated in more than one tissue culture assay. This second experiment confirmed the significant increment in leaf and root performance. Event with p-value<0.1 was considered statistically significant.

TABLE 44

Genes showing improved plant performance at Normal growth conditions under regulation of At6669 promoter

| Gene Name | Event # | Leaf Area [cm²] Ave. | P-Val. | % Incr. | Roots Coverage [cm²] Ave. | P-Val. | % Incr. | Roots Length [cm²] Ave. | P-Val. | % Incr. |
|---|---|---|---|---|---|---|---|---|---|---|
| LYM490 | 62920.3 | 0.5 | 0.15 | 23 | — | — | — | — | — | — |
| LYM448 | 62802.2 | 0.5 | 0.02 | 34 | — | — | — | — | — | — |
| LYM448 | 62805.2 | 0.5 | 0.22 | 25 | — | — | — | — | — | — |
| LYM445 | 62797.2 | 0.5 | 0.12 | 29 | — | — | — | — | — | — |
| LYM445 | 62798.3 | 0.4 | 0.30 | 7 | — | — | — | — | — | — |
| LYM445 | 62799.2 | — | — | — | — | — | — | 7.3 | 0.04 | 14 |
| LYM435 | 62872.1 | 0.5 | 0.07 | 41 | — | — | — | — | — | — |
| LYM435 | 62875.1 | 0.4 | 0.04 | 16 | — | — | — | 6.9 | 0.28 | 6 |
| LYM419 | 62775.1 | 0.4 | 0.23 | 12 | — | — | — | — | — | — |
| LYM419 | 62775.3 | — | — | — | — | — | — | 6.9 | 0.24 | 8 |
| LYM419 | 62778.1 | 0.6 | L | 65 | — | — | — | — | — | — |
| LYM401 | 62854.1 | 0.5 | 0.07 | 33 | — | — | — | — | — | — |
| LYM401 | 62856.1 | 0.5 | 0.01 | 29 | — | — | — | — | — | — |
| LYM401 | 62857.5 | 0.5 | L | 40 | — | — | — | — | — | — |
| LYM371 | 62847.1 | 0.5 | 0.06 | 26 | — | — | — | — | — | — |
| LYM371 | 62847.2 | 0.5 | 0.12 | 23 | — | — | — | — | — | — |
| LYM371 | 62851.2 | 0.5 | 0.15 | 41 | — | — | — | — | — | — |
| LYM367 | 62735.5 | 0.5 | 0.23 | 21 | — | — | — | — | — | — |
| LYM367 | 62737.2 | 0.4 | 0.13 | 13 | — | — | — | — | — | — |
| LYM367 | 62739.2 | 0.6 | 0.10 | 52 | — | — | — | — | — | — |
| LYM352 | 62876.2 | — | — | — | — | — | — | 7.0 | 0.16 | 9 |
| LYM352 | 62881.2 | 0.5 | 0.21 | 22 | 7.7 | 0.16 | 30 | — | — | — |
| LYM328 | 62732.7 | 0.4 | 0.19 | 13 | — | — | — | 6.9 | 0.23 | 7 |

TABLE 44-continued

Genes showing improved plant performance at Normal growth conditions under regulation of At6669 promoter

| Gene Name | Event # | Leaf Area [cm²] | | | Roots Coverage [cm²] | | | Roots Length [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LYM314 | 62859.1 | 0.4 | 0.27 | 10 | — | — | — | — | — | — |
| LYM314 | 62859.4 | — | — | — | — | — | — | 7.3 | 0.08 | 13 |
| LYM314 | 62862.1 | 0.5 | 0.07 | 38 | — | — | — | — | — | — |
| CONT. | — | 0.4 | — | — | 5.9 | — | — | 6.5 | — | — |
| LYM504 | 63308.3 | — | — | — | 4.4 | 0.20 | 7 | 5.9 | 0.15 | 6 |
| LYM504 | 63309.1 | 0.4 | 0.22 | 20 | 5.4 | 0.05 | 34 | — | — | — |
| LYM504 | 63309.3 | 0.4 | 0.13 | 27 | 4.8 | 0.26 | 17 | 6.2 | 0.03 | 10 |
| LYM483 | 63625.2 | — | — | — | — | — | — | 6.6 | L | 17 |
| LYM483 | 63626.6 | — | — | — | 5.1 | 0.04 | 24 | 6.6 | L | 19 |
| LYM483 | 63629.1 | — | — | — | 7.1 | 0.01 | 75 | 6.8 | 0.08 | 21 |
| LYM483 | 63629.2 | 0.4 | 0.27 | 31 | 6.2 | 0.05 | 52 | 6.2 | 0.09 | 11 |
| LYM467 | 63563.3 | 0.4 | 0.07 | 24 | — | — | — | — | — | — |
| LYM467 | 63564.2 | — | — | — | 5.3 | 0.04 | 29 | 6.2 | 0.04 | 10 |
| LYM467 | 63564.3 | — | — | — | 6.8 | 0.01 | 68 | 7.1 | L | 27 |
| LYM467 | 63565.1 | — | — | — | 4.7 | 0.22 | 16 | — | — | — |
| LYM463 | 63108.2 | 0.5 | L | 59 | 6.1 | L | 51 | — | — | — |
| LYM463 | 63111.12 | — | — | — | 5.6 | 0.06 | 37 | 6.3 | 0.01 | 12 |
| LYM450 | 63126.2 | 0.4 | 0.06 | 31 | 6.1 | L | 49 | 6.6 | L | 18 |
| LYM450 | 63127.9 | — | — | — | 5.4 | 0.03 | 32 | 6.0 | 0.06 | 7 |
| LYM450 | 63128.1 | — | — | — | 4.6 | 0.09 | 13 | 6.2 | L | 10 |
| LYM450 | 63129.2 | — | — | — | 5.2 | 0.15 | 28 | 6.3 | 0.11 | 12 |
| LYM450 | 63130.4 | — | — | — | 5.1 | 0.10 | 25 | 6.2 | 0.08 | 11 |
| LYM433 | 63300.3 | — | — | — | 6.5 | 0.06 | 60 | 7.0 | L | 25 |
| LYM433 | 63300.4 | — | — | — | 5.4 | 0.23 | 32 | 6.1 | 0.17 | 9 |
| LYM433 | 63301.2 | 0.4 | L | 38 | 6.8 | L | 66 | 6.8 | L | 21 |
| LYM433 | 63301.3 | — | — | — | 5.2 | 0.12 | 27 | — | — | — |
| LYM433 | 63302.1 | 0.5 | 0.04 | 52 | 5.8 | 0.10 | 44 | 5.9 | 0.25 | 5 |
| LYM425 | 63132.9 | 0.4 | 0.24 | 24 | — | — | — | — | — | — |
| LYM425 | 63133.2 | — | — | — | 5.4 | 0.05 | 32 | 6.4 | 0.03 | 15 |
| LYM425 | 63134.2 | 0.4 | 0.15 | 44 | 6.3 | 0.03 | 55 | 6.7 | L | 19 |
| LYM425 | 63135.1 | 0.4 | 0.08 | 24 | 5.1 | L | 25 | 7.1 | L | 26 |
| LYM423 | 62981.11 | — | — | — | 5.2 | 0.03 | 27 | 6.5 | 0.06 | 15 |
| LYM423 | 62981.12 | — | — | — | 5.1 | 0.09 | 26 | 6.2 | 0.13 | 11 |
| LYM423 | 63056.2 | 0.4 | 0.11 | 21 | — | — | — | — | — | — |
| LYM423 | 63056.3 | — | — | — | 6.1 | L | 50 | 6.5 | L | 15 |
| LYM423 | 63058.2 | 0.4 | 0.28 | 21 | 5.1 | 0.04 | 24 | — | — | — |
| LYM422 | 63313.3 | 0.4 | 0.08 | 41 | 5.8 | 0.02 | 43 | — | — | — |
| LYM422 | 63315.3 | — | — | — | 5.0 | L | 24 | 6.1 | 0.02 | 8 |
| LYM403 | 63621.3 | 0.5 | 0.03 | 61 | 7.0 | L | 73 | 6.8 | L | 22 |
| LYM403 | 63624.4 | — | — | — | 5.2 | 0.10 | 29 | — | — | — |
| LYM392 | 63324.2 | — | — | — | 8.3 | L | 103 | 6.8 | 0.02 | 21 |
| LYM392 | 63326.2 | 0.4 | 0.29 | 16 | 5.3 | L | 30 | 6.0 | 0.09 | 7 |
| LYM392 | 63328.4 | 0.5 | L | 65 | 6.0 | 0.03 | 47 | 5.9 | 0.06 | 6 |
| LYM392 | 63328.6 | 0.4 | 0.05 | 29 | 5.6 | 0.04 | 37 | 6.7 | 0.06 | 19 |
| LYM381 | 63550.2 | — | — | — | 5.2 | 0.11 | 28 | 6.6 | 0.05 | 19 |
| LYM381 | 63550.4 | 0.4 | 0.28 | 22 | 6.6 | L | 62 | 6.9 | L | 24 |
| LYM381 | 63551.2 | — | — | — | 4.5 | 0.09 | 12 | 6.5 | L | 16 |
| LYM381 | 63552.1 | 0.5 | L | 55 | 5.1 | 0.03 | 25 | — | — | — |
| LYM336 | 63068.2 | 0.4 | 0.04 | 29 | 4.5 | 0.19 | 10 | — | — | — |
| LYM336 | 63071.2 | — | — | — | 5.9 | 0.05 | 44 | — | — | — |
| LYM336 | 63073.2 | — | — | — | 5.4 | L | 33 | — | — | — |
| LYM336 | 63073.4 | — | — | — | 7.6 | 0.03 | 87 | 7.1 | L | 27 |
| CONT. | — | 0.3 | — | — | 4.1 | — | — | 5.6 | — | — |
| LYM495 | 61742.2 | 0.5 | L | 51 | 6.3 | 0.14 | 26 | — | — | — |
| LYM495 | 61743.2 | 0.4 | 0.18 | 11 | — | — | — | 6.9 | 0.25 | 4 |
| LYM495 | 61744.3 | 0.5 | 0.03 | 40 | 6.2 | 0.10 | 24 | — | — | — |
| LYM475 | 63096.13 | 0.4 | 0.23 | 15 | — | — | — | — | — | — |
| LYM475 | 63097.4 | 0.4 | 0.24 | 8 | — | — | — | — | — | — |
| LYM475 | 63098.1 | 0.5 | L | 25 | 6.0 | 0.15 | 21 | — | — | — |
| LYM475 | 63100.1 | 0.4 | 0.04 | 21 | 7.0 | L | 39 | 7.5 | L | 13 |
| LYM473 | 61783.4 | 0.6 | L | 72 | — | — | — | — | — | — |
| LYM473 | 61784.2 | — | — | — | 5.5 | 0.30 | 10 | — | — | — |
| LYM473 | 61784.3 | — | — | — | — | — | — | 7.0 | 0.21 | 6 |
| LYM473 | 61786.1 | 0.4 | 0.04 | 14 | — | — | — | — | — | — |
| LYM472 | 63114.2 | 0.6 | L | 67 | 6.4 | 0.12 | 27 | — | — | — |
| LYM472 | 63117.5 | 0.4 | 0.02 | 24 | 5.8 | 0.25 | 16 | — | — | — |
| LYM472 | 63117.6 | 0.4 | L | 22 | 5.9 | 0.12 | 18 | — | — | — |
| LYM472 | 63118.8 | 0.5 | 0.01 | 47 | — | — | — | — | — | — |
| LYM458 | 61812.2 | 0.5 | L | 27 | — | — | — | — | — | — |
| LYM458 | 61814.1 | 0.7 | 0.04 | 94 | — | — | — | — | — | — |
| LYM458 | 61814.3 | — | — | — | — | — | — | 7.1 | 0.10 | 7 |

TABLE 44-continued

Genes showing improved plant performance at Normal growth conditions under regulation of At6669 promoter

| Gene Name | Event # | Leaf Area [cm²] | | | Roots Coverage [cm²] | | | Roots Length [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LYM413 | 61819.2 | 0.5 | 0.03 | 52 | — | — | — | — | — | — |
| LYM413 | 61819.3 | 0.5 | 0.03 | 44 | — | — | — | — | — | — |
| LYM413 | 61822.3 | 0.4 | 0.12 | 22 | — | — | — | — | — | — |
| LYM413 | 61823.1 | 0.6 | 0.02 | 63 | — | — | — | — | — | — |
| LYM400 | 63121.22 | 0.4 | 0.08 | 25 | 6.4 | 0.02 | 28 | 7.2 | L | 9 |
| LYM400 | 63123.6 | — | — | — | 5.9 | 0.20 | 17 | — | — | — |
| LYM400 | 63124.13 | 0.6 | 0.01 | 61 | — | — | — | — | — | — |
| LYM380 | 61824.2 | 0.6 | 0.02 | 59 | 7.8 | 0.05 | 56 | — | — | — |
| LYM380 | 61825.2 | 0.4 | 0.13 | 16 | — | — | — | — | — | — |
| LYM380 | 61825.5 | 0.5 | 0.08 | 27 | 7.4 | 0.04 | 47 | — | — | — |
| LYM380 | 61828.3 | 0.5 | 0.04 | 29 | — | — | — | — | — | — |
| LYM380 | 61828.5 | — | — | — | 6.0 | 0.22 | 21 | — | — | — |
| LYM376 | 61835.2 | 0.5 | L | 41 | — | — | — | — | — | — |
| LYM376 | 61835.3 | 0.4 | 0.12 | 14 | 7.1 | 0.01 | 43 | 7.6 | 0.05 | 14 |
| LYM376 | 61836.1 | 0.4 | 0.29 | 20 | — | — | — | — | — | — |
| LYM376 | 61839.4 | 0.5 | 0.12 | 46 | — | — | — | — | — | — |
| LYM354 | 61800.2 | 0.4 | 0.10 | 17 | 5.8 | 0.16 | 17 | 7.0 | 0.13 | 6 |
| LYM354 | 61804.3 | 0.6 | 0.03 | 69 | 7.4 | L | 47 | 7.5 | 0.02 | 13 |
| LYM354 | 61804.4 | 0.5 | 0.08 | 32 | 7.5 | L | 51 | 7.2 | 0.04 | 8 |
| LYM344 | 61788.2 | 0.5 | L | 52 | — | — | — | — | — | — |
| LYM344 | 61788.4 | 0.6 | 0.01 | 55 | 6.4 | L | 28 | 7.0 | 0.13 | 6 |
| LYM344 | 61790.1 | 0.5 | 0.17 | 26 | 6.5 | 0.19 | 29 | — | — | — |
| LYM344 | 61790.3 | 0.5 | 0.09 | 33 | — | — | — | — | — | — |
| LYM330 | 61840.1 | 0.6 | L | 58 | 7.0 | 0.02 | 39 | — | — | — |
| LYM330 | 61841.4 | 0.4 | 0.17 | 14 | 6.7 | 0.05 | 34 | 7.4 | 0.05 | 11 |
| LYM330 | 61842.4 | 0.5 | 0.06 | 50 | 7.2 | 0.07 | 44 | 7.2 | 0.08 | 8 |
| LYM330 | 61844.3 | 0.7 | 0.06 | 82 | — | — | — | — | — | — |
| LYM327 | 61846.1 | 0.7 | 0.05 | 97 | 7.8 | 0.15 | 57 | — | — | — |
| LYM327 | 61846.3 | 0.7 | 0.01 | 91 | 6.8 | L | 37 | — | — | — |
| LYM327 | 61847.1 | 0.5 | 0.02 | 51 | 6.2 | 0.18 | 25 | — | — | — |
| LYM327 | 61848.2 | 0.4 | L | 22 | — | — | — | — | — | — |
| LYM327 | 61849.1 | 0.5 | L | 50 | 7.5 | 0.02 | 51 | 7.4 | L | 12 |
| LYM309 | 63102.3 | 0.7 | L | 85 | 5.6 | 0.26 | 13 | — | — | — |
| LYM309 | 63103.21 | — | — | — | 6.0 | 0.04 | 20 | 7.3 | 0.02 | 9 |
| LYM309 | 63103.27 | 0.6 | 0.04 | 57 | — | — | — | — | — | — |
| LYM309 | 63104.16 | 0.7 | L | 97 | 6.9 | L | 38 | — | — | — |
| LYM309 | 63104.3 | 0.5 | L | 41 | — | — | — | — | — | — |
| LYM299 | 61806.4 | — | — | — | 6.0 | 0.04 | 20 | 7.0 | 0.10 | 5 |
| LYM299 | 61807.3 | 0.6 | 0.03 | 53 | — | — | — | — | — | — |
| LYM299 | 61808.4 | 0.5 | 0.01 | 41 | — | — | — | — | — | — |
| LYM299 | 61809.2 | 0.7 | L | 86 | 5.6 | 0.27 | 12 | — | — | — |
| CONT. | — | 0.4 | — | — | 5.0 | — | — | 6.6 | — | — |
| LYM493 | 61966.4 | 0.4 | 0.04 | 56 | 5.9 | 0.11 | 48 | — | — | — |
| LYM493 | 61968.6 | — | — | — | 4.4 | 0.21 | 11 | — | — | — |
| LYM493 | 61969.8 | 0.4 | L | 61 | 6.2 | 0.03 | 56 | 6.4 | 0.03 | 11 |
| LYM480 | 61960.6 | 0.4 | L | 60 | 4.6 | 0.29 | 16 | — | — | — |
| LYM480 | 61961.1 | 0.4 | L | 52 | 4.6 | 0.22 | 16 | — | — | — |
| LYM480 | 61961.12 | 0.3 | 0.10 | 13 | — | — | — | — | — | — |
| LYM480 | 61962.7 | — | — | — | 4.7 | 0.05 | 17 | 6.2 | 0.15 | 7 |
| LYM480 | 61962.8 | 0.4 | L | 61 | 6.0 | 0.02 | 49 | 6.4 | 0.06 | 11 |
| LYM474 | 61972.5 | — | — | — | 4.5 | 0.19 | 12 | — | — | — |
| LYM474 | 61975.7 | — | — | — | 5.2 | 0.08 | 30 | — | — | — |
| LYM474 | 61977.6 | 0.3 | 0.09 | 14 | — | — | — | — | — | — |
| LYM453 | 61984.9 | 0.4 | 0.28 | 29 | 6.0 | 0.20 | 51 | 6.3 | 0.21 | 10 |
| LYM453 | 61985.4 | 0.4 | 0.03 | 63 | 6.3 | L | 58 | — | — | — |
| LYM453 | 61986.6 | 0.6 | L | 101 | 7.5 | L | 89 | 6.2 | 0.13 | 7 |
| LYM453 | 61988.6 | 0.3 | L | 23 | — | — | — | — | — | — |
| LYM442 | 61979.5 | 0.4 | 0.13 | 34 | 6.5 | L | 62 | 6.6 | 0.01 | 13 |
| LYM442 | 61979.6 | 0.4 | L | 29 | — | — | — | — | — | — |
| LYM442 | 61980.5 | 0.3 | 0.06 | 13 | 4.9 | 0.02 | 22 | — | — | — |
| LYM442 | 61983.7 | 0.5 | L | 97 | 7.3 | L | 82 | 6.5 | 0.12 | 12 |
| LYM440 | 61936.6 | 0.3 | 0.10 | 13 | — | — | — | — | — | — |
| LYM440 | 61937.6 | 0.4 | L | 37 | 5.3 | L | 32 | — | — | — |
| LYM440 | 61937.8 | 0.4 | 0.12 | 28 | 6.1 | L | 53 | 6.2 | 0.18 | 7 |
| LYM440 | 61939.6 | 0.4 | 0.05 | 55 | 5.8 | 0.08 | 44 | — | — | — |
| LYM409 | 61997.2 | — | — | — | 5.6 | 0.06 | 39 | — | — | — |
| LYM409 | 61998.6 | 0.4 | L | 63 | 7.9 | L | 98 | 7.0 | L | 21 |
| LYM409 | 61999.3 | 0.4 | 0.28 | 33 | — | — | — | — | — | — |
| LYM396 | 61900.7 | 0.4 | 0.04 | 32 | 5.2 | 0.21 | 30 | — | — | — |
| LYM396 | 61901.7 | 0.5 | 0.02 | 73 | 7.2 | L | 79 | 6.8 | L | 18 |
| LYM396 | 61902.8 | 0.3 | 0.05 | 15 | 5.3 | 0.11 | 33 | — | — | — |

TABLE 44-continued

Genes showing improved plant performance at Normal growth conditions under regulation of At6669 promoter

| Gene Name | Event # | Leaf Area [cm²] | | | Roots Coverage [cm²] | | | Roots Length [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LYM372 | 62002.1 | 0.3 | 0.07 | 27 | — | — | — | — | — | — |
| LYM372 | 62003.2 | 0.3 | 0.09 | 12 | 4.9 | 0.08 | 22 | — | — | — |
| LYM372 | 62006.4 | — | — | — | 5.4 | L | 36 | 6.1 | 0.22 | 6 |
| LYM366 | 61906.15 | 0.4 | 0.13 | 49 | 5.2 | 0.02 | 30 | — | — | — |
| LYM366 | 61906.9 | 0.3 | 0.13 | 22 | 4.8 | 0.09 | 20 | — | — | — |
| LYM334 | 61942.6 | — | — | — | 4.4 | 0.18 | 9 | — | — | — |
| LYM334 | 61942.7 | 0.4 | 0.02 | 41 | 6.2 | 0.04 | 56 | 6.5 | 0.16 | 13 |
| LYM334 | 61943.12 | 0.4 | 0.03 | 42 | 4.8 | 0.04 | 19 | — | — | — |
| LYM334 | 61947.7 | 0.4 | L | 35 | 5.3 | 0.10 | 33 | — | — | — |
| LYM319 | 61920.6 | 0.3 | 0.13 | 22 | — | — | — | — | — | — |
| LYM301 | 61913.4 | 0.4 | 0.08 | 32 | 4.8 | 0.12 | 20 | 6.3 | 0.12 | 9 |
| LYM301 | 61916.4 | — | — | — | — | — | — | 6.2 | 0.17 | 8 |
| CONT. | — | 0.3 | — | — | 4.0 | — | — | 5.8 | — | — |
| LYM504 | 63308.3 | 0.4 | L | 35 | 6.2 | 0.01 | 27 | — | — | — |
| LYM504 | 63309.3 | 0.4 | 0.18 | 12 | 5.9 | 0.02 | 20 | 7.1 | L | 21 |
| LYM483 | 63625.2 | 0.4 | 0.02 | 26 | 6.6 | 0.10 | 34 | 6.7 | L | 13 |
| LYM483 | 63626.6 | 0.4 | 0.04 | 15 | 6.1 | 0.07 | 23 | 6.9 | 0.03 | 17 |
| LYM483 | 63626.7 | 0.4 | 0.14 | 22 | — | — | — | 6.4 | 0.13 | 9 |
| LYM483 | 63629.1 | — | — | — | — | — | — | 6.5 | 0.12 | 11 |
| LYM467 | 63563.3 | — | — | — | 6.1 | 0.03 | 23 | 6.3 | 0.28 | 6 |
| LYM467 | 63564.2 | 0.5 | 0.01 | 37 | 5.7 | 0.26 | 16 | — | — | — |
| LYM467 | 63564.3 | 0.5 | L | 54 | 8.1 | L | 64 | 7.1 | L | 20 |
| LYM467 | 63565.4 | 0.5 | 0.02 | 40 | — | — | — | — | — | — |
| LYM463 | 63108.2 | 0.4 | 0.03 | 33 | — | — | — | — | — | — |
| LYM463 | 63110.9 | 0.4 | 0.20 | 21 | — | — | — | — | — | — |
| LYM463 | 63111.12 | 0.4 | L | 27 | 7.0 | 0.05 | 41 | 6.9 | 0.02 | 17 |
| LYM463 | 63113.2 | 0.5 | 0.03 | 58 | — | — | — | — | — | — |
| LYM450 | 63127.9 | 0.4 | L | 33 | 5.8 | 0.03 | 17 | 6.1 | 0.26 | 4 |
| LYM450 | 63128.1 | 0.4 | 0.06 | 15 | 7.1 | 0.06 | 44 | 6.7 | L | 13 |
| LYM433 | 63300.3 | 0.4 | 0.03 | 21 | 6.7 | 0.01 | 35 | 6.8 | 0.10 | 16 |
| LYM433 | 63300.4 | 0.5 | L | 41 | 8.3 | L | 68 | 7.1 | L | 21 |
| LYM433 | 63301.3 | 0.4 | 0.02 | 23 | 7.2 | L | 46 | 6.8 | L | 15 |
| LYM425 | 63132.9 | 0.4 | 0.12 | 31 | 5.8 | 0.29 | 18 | — | — | — |
| LYM425 | 63133.2 | 0.4 | 0.01 | 19 | 6.6 | 0.03 | 33 | 6.3 | 0.15 | 7 |
| LYM425 | 63134.2 | — | — | — | — | — | — | 6.4 | 0.21 | 9 |
| LYM425 | 63135.1 | — | — | — | — | — | — | 6.6 | 0.12 | 13 |
| LYM423 | 62981.11 | — | — | — | — | — | — | 6.5 | 0.26 | 10 |
| LYM423 | 63056.3 | 0.4 | 0.20 | 9 | — | — | — | 6.2 | 0.12 | 5 |
| LYM422 | 63314.3 | 0.4 | 0.18 | 14 | 6.1 | L | 24 | 6.6 | L | 12 |
| LYM422 | 63315.4 | 0.4 | 0.14 | 11 | 6.3 | 0.03 | 28 | 6.9 | 0.03 | 18 |
| LYM403 | 63620.4 | 0.5 | 0.07 | 36 | 6.1 | 0.21 | 24 | 6.2 | 0.30 | 5 |
| LYM403 | 63621.3 | 0.5 | L | 37 | — | — | — | — | — | — |
| LYM403 | 63621.4 | 0.4 | 0.06 | 25 | 7.1 | 0.03 | 43 | — | — | — |
| LYM403 | 63624.3 | 0.4 | L | 29 | — | — | — | 6.4 | 0.02 | 8 |
| LYM403 | 63624.4 | 0.4 | 0.07 | 20 | 6.1 | 0.04 | 24 | — | — | — |
| LYM392 | 63324.2 | 0.5 | L | 48 | — | — | — | — | — | — |
| LYM392 | 63326.2 | 0.4 | 0.08 | 16 | 5.5 | 0.29 | 12 | 6.4 | 0.03 | 9 |
| LYM392 | 63328.3 | — | — | — | 5.7 | 0.14 | 15 | 6.4 | 0.10 | 9 |
| LYM392 | 63328.6 | 0.4 | 0.10 | 20 | — | — | — | — | — | — |
| LYM381 | 63551.2 | 0.5 | L | 45 | 5.9 | 0.27 | 20 | 6.4 | 0.28 | 8 |
| LYM336 | 63068.2 | 0.4 | L | 33 | — | — | — | — | — | — |
| LYM336 | 63071.2 | 0.5 | L | 43 | 6.1 | L | 23 | 6.5 | 0.01 | 10 |
| LYM336 | 63073.2 | 0.4 | 0.18 | 23 | — | — | — | — | — | — |
| CONT. | — | 0.3 | — | — | 4.9 | — | — | 5.9 | — | — |
| LYM475 | 63096.13 | 0.5 | 0.12 | 17 | 7.6 | 0.20 | 18 | — | — | — |
| LYM475 | 63097.16 | 0.6 | L | 24 | 8.0 | L | 23 | — | — | — |
| LYM475 | 63098.1 | 0.5 | 0.25 | 12 | — | — | — | — | — | — |
| LYM475 | 63100.1 | 0.6 | 0.12 | 26 | — | — | — | — | — | — |
| LYM472 | 63114.2 | 0.6 | 0.02 | 23 | 7.2 | 0.08 | 12 | — | — | — |
| LYM472 | 63117.5 | 0.7 | L | 52 | — | — | — | — | — | — |
| LYM472 | 63117.6 | 0.6 | 0.07 | 32 | 7.5 | 0.10 | 16 | 7.2 | 0.08 | 4 |
| LYM439 | 63752.3 | 0.5 | 0.20 | 13 | — | — | — | — | — | — |
| LYM439 | 63752.5 | — | — | — | — | — | — | 7.4 | 0.08 | 7 |
| LYM439 | 63754.3 | 0.6 | 0.03 | 24 | 7.9 | L | 22 | 7.3 | 0.13 | 5 |
| LYM427 | 63772.1 | 0.5 | 0.17 | 15 | 7.6 | 0.23 | 18 | — | — | — |
| LYM402 | 63778.2 | 0.5 | 0.26 | 14 | 6.9 | 0.24 | 6 | — | — | — |
| LYM402 | 63778.4 | 0.5 | 0.07 | 21 | 7.3 | 0.08 | 14 | 7.5 | 0.08 | 9 |
| LYM402 | 63780.1 | 0.7 | 0.19 | 47 | — | — | — | — | — | — |
| LYM400 | 63121.21 | 0.6 | L | 40 | — | — | — | — | — | — |
| LYM400 | 63121.22 | 0.6 | 0.12 | 24 | — | — | — | — | — | — |
| LYM400 | 63122.3 | 0.6 | 0.01 | 36 | 9.2 | 0.03 | 43 | 7.3 | 0.25 | 5 |

TABLE 44-continued

Genes showing improved plant performance at Normal growth conditions under regulation of At6669 promoter

| Gene Name | Event # | Leaf Area [cm²] | | | Roots Coverage [cm²] | | | Roots Length [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LYM400 | 63124.13 | 0.6 | 0.15 | 39 | — | — | — | — | — | — |
| LYM386 | 63391.2 | 0.6 | 0.04 | 28 | — | — | — | — | — | — |
| LYM386 | 63391.3 | 0.6 | 0.07 | 42 | — | — | — | — | — | — |
| LYM386 | 63393.3 | 0.5 | 0.28 | 17 | 8.6 | 0.05 | 33 | 7.5 | 0.02 | 9 |
| LYM385 | 63654.1 | 0.5 | 0.05 | 21 | 7.5 | 0.02 | 16 | — | — | — |
| LYM385 | 63658.1 | — | — | — | 7.8 | 0.01 | 21 | — | — | — |
| LYM385 | 63658.3 | 0.6 | 0.03 | 42 | 7.8 | 0.02 | 22 | 7.4 | 0.10 | 7 |
| LYM384 | 63138.13 | 0.7 | 0.06 | 63 | 8.0 | 0.11 | 24 | — | — | — |
| LYM384 | 63139.14 | 0.7 | 0.02 | 47 | 8.7 | 0.02 | 35 | 7.7 | 0.08 | 12 |
| LYM384 | 63139.5 | 0.6 | 0.17 | 25 | 7.6 | 0.21 | 18 | — | — | — |
| LYM337 | 63787.1 | 0.6 | 0.07 | 23 | — | — | — | — | — | — |
| LYM337 | 63787.5 | — | — | — | 7.9 | 0.05 | 22 | 7.6 | L | 9 |
| LYM337 | 63788.3 | 0.8 | L | 82 | 8.9 | 0.02 | 39 | — | — | — |
| LYM312 | 63145.1 | 0.8 | 0.01 | 73 | — | — | — | — | — | — |
| LYM312 | 63198.2 | 0.6 | 0.02 | 38 | — | — | — | — | — | — |
| LYM312 | 63201.1 | 0.6 | 0.04 | 37 | — | — | — | — | — | — |
| LYM312 | 63201.4 | 0.7 | 0.06 | 59 | 7.9 | 0.26 | 22 | — | — | — |
| LYM309 | 63102.3 | 0.6 | L | 24 | — | — | — | — | — | — |
| LYM309 | 63103.27 | 0.6 | L | 35 | 7.0 | 0.19 | 8 | — | — | — |
| LYM309 | 63104.16 | 0.6 | 0.02 | 24 | — | — | — | — | — | — |
| LYM309 | 63104.3 | 0.7 | L | 47 | 7.3 | 0.13 | 13 | — | — | — |
| CONT. | — | 0.5 | — | — | 6.4 | — | — | 6.9 | — | — |

Table 44.
"CONT."—Control;
"Ave."—Average;
"% Incr." = % increment;
"p-val."—p-value,
L—p < 0.01.

TABLE 45

Genes showing improved plant performance at Normal growth conditions under regulation of At6669 promoter

| Gene Name | Event # | RGR Of Leaf Area | | | RGR Of Root Coverage | | | RGR Of Roots Length | | |
|---|---|---|---|---|---|---|---|---|---|---|
| | | Ave. | P-Val. | % Incr. | Ave. | P-Val. | % Incr. | Ave. | P-Val. | % Incr. |
| LYM490 | 62920.3 | 0.0 | 0.15 | 21 | — | — | — | — | — | — |
| LYM448 | 62802.2 | 0.1 | 0.01 | 33 | — | — | — | — | — | — |
| LYM445 | 62797.2 | 0.0 | 0.09 | 26 | — | — | — | — | — | — |
| LYM435 | 62872.1 | 0.1 | 0.01 | 38 | — | — | — | — | — | — |
| LYM435 | 62875.1 | 0.0 | 0.28 | 12 | — | — | — | — | — | — |
| LYM419 | 62775.3 | — | — | — | — | — | — | 0.7 | 0.30 | 12 |
| LYM419 | 62778.1 | 0.1 | L | 77 | — | — | — | — | — | — |
| LYM401 | 62854.1 | 0.1 | 0.03 | 31 | — | — | — | — | — | — |
| LYM401 | 62856.1 | 0.0 | 0.04 | 25 | — | — | — | — | — | — |
| LYM401 | 62857.5 | 0.1 | L | 43 | — | — | — | — | — | — |
| LYM371 | 62847.1 | 0.0 | 0.05 | 25 | — | — | — | — | — | — |
| LYM371 | 62847.2 | 0.0 | 0.26 | 15 | — | — | — | — | — | — |
| LYM371 | 62851.2 | 0.1 | 0.03 | 43 | — | — | — | — | — | — |
| LYM367 | 62735.5 | 0.0 | 0.21 | 18 | — | — | — | — | — | — |
| LYM367 | 62737.2 | 0.0 | 0.08 | 20 | — | — | — | — | — | — |
| LYM367 | 62739.2 | 0.1 | 0.02 | 50 | — | — | — | — | — | — |
| LYM352 | 62881.2 | 0.0 | 0.24 | 17 | — | — | — | — | — | — |
| LYM314 | 62859.4 | — | — | — | — | — | — | 0.7 | 0.11 | 19 |
| LYM314 | 62862.1 | 0.1 | 0.03 | 35 | — | — | — | — | — | — |
| CONT. | — | 0.0 | — | — | — | — | — | 0.6 | — | — |
| LYM504 | 63309.1 | 0.0 | 0.26 | 23 | — | — | — | — | — | — |
| LYM504 | 63309.3 | — | — | — | — | — | — | 0.6 | L | 20 |
| LYM483 | 63625.2 | — | — | — | — | — | — | 0.6 | L | 22 |
| LYM483 | 63626.6 | — | — | — | — | — | — | 0.5 | L | 19 |
| LYM483 | 63629.1 | 0.0 | 0.18 | 29 | — | — | — | 0.6 | L | 28 |
| LYM483 | 63629.2 | 0.0 | 0.11 | 39 | — | — | — | 0.6 | L | 23 |
| LYM467 | 63564.2 | — | — | — | — | — | — | 0.5 | 0.12 | 11 |
| LYM467 | 63564.3 | — | — | — | — | — | — | 0.6 | L | 23 |

TABLE 45-continued

Genes showing improved plant performance at Normal growth conditions under regulation of At6669 promoter

| Gene Name | Event # | RGR Of Leaf Area | | | RGR Of Root Coverage | | | RGR Of Roots Length | | |
|---|---|---|---|---|---|---|---|---|---|---|
| | | Ave. | P-Val. | % Incr. | Ave. | P-Val. | % Incr. | Ave. | P-Val. | % Incr. |
| LYM467 | 63565.4 | — | — | — | — | — | — | 0.5 | 0.21 | 10 |
| LYM463 | 63108.2 | 0.1 | L | 72 | — | — | — | 0.5 | 0.28 | 8 |
| LYM463 | 63111.12 | — | — | — | — | — | — | 0.5 | 0.04 | 14 |
| LYM450 | 63126.2 | 0.0 | 0.03 | 43 | — | — | — | 0.6 | L | 28 |
| LYM450 | 63128.1 | — | — | — | — | — | — | 0.5 | 0.01 | 16 |
| LYM450 | 63130.4 | — | — | — | — | — | — | 0.5 | 0.22 | 9 |
| LYM433 | 63300.3 | — | — | — | — | — | — | 0.6 | L | 36 |
| LYM433 | 63300.4 | 0.0 | 0.28 | 25 | — | — | — | 0.5 | 0.24 | 10 |
| LYM433 | 63301.2 | 0.0 | 0.02 | 45 | — | — | — | 0.6 | L | 21 |
| LYM433 | 63302.1 | 0.0 | 0.01 | 58 | — | — | — | 0.6 | L | 23 |
| LYM425 | 63132.9 | 0.0 | 0.15 | 30 | — | — | — | — | — | — |
| LYM425 | 63133.2 | — | — | — | — | — | — | 0.5 | 0.02 | 17 |
| LYM425 | 63134.2 | 0.0 | 0.08 | 45 | — | — | — | 0.5 | 0.01 | 17 |
| LYM425 | 63135.1 | 0.0 | 0.15 | 27 | — | — | — | 0.6 | L | 27 |
| LYM423 | 62981.11 | — | — | — | — | — | — | 0.6 | L | 26 |
| LYM423 | 62981.12 | — | — | — | — | — | — | 0.5 | 0.07 | 15 |
| LYM423 | 63056.2 | 0.0 | 0.27 | 20 | — | — | — | — | — | — |
| LYM423 | 63056.3 | — | — | — | — | — | — | 0.5 | 0.03 | 14 |
| LYM423 | 63058.2 | 0.0 | 0.22 | 25 | — | — | — | 0.5 | 0.09 | 11 |
| LYM422 | 63313.3 | 0.0 | 0.09 | 37 | — | — | — | 0.5 | 0.12 | 17 |
| LYM422 | 63315.3 | — | — | — | — | — | — | 0.5 | 0.09 | 10 |
| LYM403 | 63621.3 | 0.0 | 0.01 | 62 | — | — | — | 0.6 | L | 28 |
| LYM403 | 63624.3 | — | — | — | — | — | — | 0.5 | 0.02 | 16 |
| LYM403 | 63624.4 | — | — | — | — | — | — | 0.5 | 0.05 | 17 |
| LYM392 | 63324.2 | — | — | — | — | — | — | 0.6 | L | 29 |
| LYM392 | 63326.2 | — | — | — | — | — | — | 0.5 | 0.12 | 11 |
| LYM392 | 63328.4 | 0.1 | L | 79 | — | — | — | 0.6 | L | 24 |
| LYM392 | 63328.6 | 0.0 | 0.08 | 34 | — | — | — | 0.6 | L | 28 |
| LYM381 | 63550.2 | — | — | — | — | — | — | 0.6 | L | 25 |
| LYM381 | 63550.4 | — | — | — | — | — | — | 0.6 | L | 25 |
| LYM381 | 63551.2 | — | — | — | — | — | — | 0.5 | L | 19 |
| LYM381 | 63552.1 | 0.0 | L | 54 | — | — | — | 0.5 | 0.23 | 8 |
| LYM336 | 63068.2 | 0.0 | 0.09 | 31 | — | — | — | 0.5 | 0.21 | 12 |
| LYM336 | 63073.2 | 0.0 | 0.21 | 33 | — | — | — | — | — | — |
| LYM336 | 63073.4 | — | — | — | — | — | — | 0.6 | L | 33 |
| CONT. | — | 0.0 | — | — | — | — | — | 0.5 | — | — |
| LYM495 | 61742.2 | 0.1 | L | 52 | — | — | — | — | — | — |
| LYM495 | 61744.1 | 0.0 | 0.22 | 15 | — | — | — | — | — | — |
| LYM495 | 61744.3 | 0.1 | L | 39 | — | — | — | — | — | — |
| LYM475 | 63096.13 | 0.0 | 0.15 | 16 | — | — | — | — | — | — |
| LYM475 | 63098.1 | 0.0 | 0.01 | 24 | — | — | — | — | — | — |
| LYM475 | 63100.1 | 0.0 | 0.05 | 20 | — | — | — | 0.7 | 0.02 | 16 |
| LYM473 | 61783.4 | 0.1 | L | 67 | — | — | — | — | — | — |
| LYM473 | 61786.1 | 0.0 | 0.06 | 17 | — | — | — | — | — | — |
| LYM472 | 63114.2 | 0.1 | L | 63 | — | — | — | — | — | — |
| LYM472 | 63117.5 | 0.0 | 0.03 | 22 | — | — | — | — | — | — |
| LYM472 | 63117.6 | 0.0 | 0.21 | 12 | — | — | — | — | — | — |
| LYM472 | 63118.8 | 0.1 | L | 47 | — | — | — | — | — | — |
| LYM458 | 61812.2 | 0.0 | 0.02 | 22 | — | — | — | — | — | — |
| LYM458 | 61814.1 | 0.1 | L | 90 | — | — | — | — | — | — |
| LYM413 | 61819.2 | 0.1 | L | 43 | — | — | — | — | — | — |
| LYM413 | 61819.3 | 0.0 | 0.02 | 30 | — | — | — | — | — | — |
| LYM413 | 61822.3 | 0.0 | 0.03 | 25 | — | — | — | — | — | — |
| LYM413 | 61823.1 | 0.1 | L | 68 | — | — | — | — | — | — |
| LYM400 | 63121.22 | 0.0 | 0.02 | 26 | — | — | — | 0.6 | 0.25 | 8 |
| LYM400 | 63124.13 | 0.1 | L | 59 | — | — | — | — | — | — |
| LYM380 | 61824.2 | 0.1 | L | 61 | — | — | — | — | — | — |
| LYM380 | 61825.2 | 0.0 | 0.23 | 12 | — | — | — | — | — | — |
| LYM380 | 61825.5 | 0.0 | 0.04 | 24 | — | — | — | — | — | — |
| LYM380 | 61828.3 | 0.0 | 0.02 | 26 | — | — | — | — | — | — |
| LYM376 | 61835.2 | 0.0 | L | 33 | — | — | — | — | — | — |
| LYM376 | 61835.3 | 0.0 | 0.14 | 15 | — | — | — | 0.6 | 0.12 | 13 |
| LYM376 | 61836.1 | 0.0 | 0.19 | 20 | — | — | — | — | — | — |
| LYM376 | 61839.4 | 0.1 | 0.04 | 40 | — | — | — | — | — | — |
| LYM354 | 61800.2 | 0.0 | 0.05 | 20 | — | — | — | 0.6 | 0.06 | 13 |
| LYM354 | 61804.3 | 0.1 | L | 58 | — | — | — | — | — | — |
| LYM354 | 61804.4 | 0.0 | 0.02 | 29 | — | — | — | 0.6 | 0.26 | 8 |
| LYM344 | 61788.2 | 0.1 | L | 47 | — | — | — | — | — | — |
| LYM344 | 61788.4 | 0.1 | L | 46 | — | — | — | — | — | — |

TABLE 45-continued

Genes showing improved plant performance at Normal growth conditions under regulation of At6669 promoter

| Gene Name | Event # | RGR Of Leaf Area | | | RGR Of Root Coverage | | | RGR Of Roots Length | | |
|---|---|---|---|---|---|---|---|---|---|---|
| | | Ave. | P-Val. | % Incr. | Ave. | P-Val. | % Incr. | Ave. | P-Val. | % Incr. |
| LYM344 | 61790.1 | 0.0 | 0.04 | 28 | — | — | — | — | — | — |
| LYM344 | 61790.3 | 0.0 | L | 37 | — | — | — | — | — | — |
| LYM330 | 61840.1 | 0.1 | L | 56 | — | — | — | — | — | — |
| LYM330 | 61841.4 | 0.0 | 0.13 | 15 | — | — | — | — | — | — |
| LYM330 | 61842.4 | 0.1 | L | 47 | — | — | — | — | — | — |
| LYM330 | 61844.3 | 0.1 | L | 77 | — | — | — | — | — | — |
| LYM327 | 61846.1 | 0.1 | L | 85 | — | — | — | — | — | — |
| LYM327 | 61846.3 | 0.1 | L | 88 | — | — | — | — | — | — |
| LYM327 | 61847.1 | 0.1 | L | 51 | — | — | — | — | — | — |
| LYM327 | 61848.2 | 0.0 | 0.03 | 20 | — | — | — | — | — | — |
| LYM327 | 61849.1 | 0.1 | L | 43 | — | — | — | 0.7 | 0.03 | 15 |
| LYM309 | 63102.3 | 0.1 | L | 82 | — | — | — | — | — | — |
| LYM309 | 63103.21 | — | — | — | — | — | — | 0.6 | 0.22 | 8 |
| LYM309 | 63103.27 | 0.1 | L | 50 | — | — | — | — | — | — |
| LYM309 | 63104.16 | 0.1 | L | 91 | — | — | — | — | — | — |
| LYM309 | 63104.3 | 0.1 | L | 44 | — | — | — | — | — | — |
| LYM299 | 61807.3 | 0.1 | L | 58 | — | — | — | — | — | — |
| LYM299 | 61808.4 | 0.1 | L | 40 | — | — | — | — | — | — |
| LYM299 | 61809.2 | 0.1 | L | 91 | — | — | — | — | — | — |
| CONT. | — | 0.0 | — | — | — | — | — | 0.6 | — | — |
| LYM493 | 61966.4 | 0.0 | L | 64 | — | — | — | — | — | — |
| LYM493 | 61969.8 | 0.0 | L | 69 | — | — | — | 0.6 | 0.12 | 16 |
| LYM480 | 61960.6 | 0.0 | L | 65 | — | — | — | — | — | — |
| LYM480 | 61961.1 | 0.0 | L | 62 | — | — | — | — | — | — |
| LYM480 | 61961.12 | 0.0 | 0.13 | 19 | — | — | — | — | — | — |
| LYM480 | 61962.8 | 0.0 | L | 66 | — | — | — | — | — | — |
| LYM474 | 61977.6 | 0.0 | 0.17 | 18 | — | — | — | — | — | — |
| LYM453 | 61984.7 | 0.0 | 0.18 | 18 | — | — | — | — | — | — |
| LYM453 | 61984.9 | 0.0 | 0.08 | 30 | — | — | — | 0.6 | 0.10 | 27 |
| LYM453 | 61985.4 | 0.0 | L | 64 | — | — | — | — | — | — |
| LYM453 | 61986.6 | 0.1 | L | 113 | — | — | — | 0.6 | 0.04 | 20 |
| LYM453 | 61988.6 | 0.0 | 0.06 | 24 | — | — | — | — | — | — |
| LYM442 | 61979.5 | 0.0 | 0.05 | 34 | — | — | — | 0.6 | 0.03 | 22 |
| LYM442 | 61979.6 | 0.0 | L | 39 | — | — | — | — | — | — |
| LYM442 | 61980.5 | 0.0 | 0.15 | 18 | — | — | — | — | — | — |
| LYM442 | 61983.7 | 0.1 | L | 110 | — | — | — | 0.6 | 0.14 | 17 |
| LYM440 | 61937.6 | 0.0 | L | 40 | — | — | — | — | — | — |
| LYM440 | 61937.8 | 0.0 | 0.15 | 26 | — | — | — | — | — | — |
| LYM440 | 61939.6 | 0.0 | L | 57 | — | — | — | — | — | — |
| LYM409 | 61997.1 | 0.0 | 0.15 | 28 | — | — | — | — | — | — |
| LYM409 | 61998.6 | 0.0 | L | 61 | — | — | — | 0.6 | 0.05 | 20 |
| LYM409 | 61999.3 | 0.0 | 0.10 | 31 | — | — | — | — | — | — |
| LYM396 | 61900.7 | 0.0 | L | 41 | — | — | — | — | — | — |
| LYM396 | 61901.7 | 0.0 | L | 86 | — | — | — | 0.6 | 0.01 | 25 |
| LYM396 | 61902.8 | 0.0 | 0.09 | 21 | — | — | — | — | — | — |
| LYM372 | 62002.1 | 0.0 | 0.02 | 37 | — | — | — | — | — | — |
| LYM372 | 62003.2 | 0.0 | 0.19 | 16 | — | — | — | — | — | — |
| LYM372 | 62006.4 | — | — | — | — | — | — | 0.6 | 0.20 | 13 |
| LYM366 | 61906.15 | 0.0 | 0.02 | 55 | — | — | — | — | — | — |
| LYM366 | 61906.9 | 0.0 | 0.10 | 24 | — | — | — | — | — | — |
| LYM334 | 61942.6 | 0.0 | 0.26 | 19 | — | — | — | 0.6 | 0.29 | 12 |
| LYM334 | 61942.7 | 0.0 | L | 42 | — | — | — | 0.6 | 0.16 | 17 |
| LYM334 | 61943.12 | 0.0 | L | 42 | — | — | — | — | — | — |
| LYM334 | 61947.7 | 0.0 | L | 36 | — | — | — | — | — | — |
| LYM319 | 61920.6 | 0.0 | 0.07 | 25 | — | — | — | — | — | — |
| LYM301 | 61913.4 | 0.0 | 0.05 | 31 | — | — | — | — | — | — |
| CONT. | — | 0.0 | — | — | — | — | — | 0.5 | — | — |
| LYM504 | 63307.1 | 0.0 | 0.28 | 13 | — | — | — | — | — | — |
| LYM504 | 63308.3 | 0.0 | L | 45 | — | — | — | — | — | — |
| LYM504 | 63309.1 | — | — | — | — | — | — | 0.6 | 0.21 | 12 |
| LYM504 | 63309.3 | — | — | — | — | — | — | 0.7 | L | 28 |
| LYM483 | 63625.2 | 0.0 | L | 32 | — | — | — | 0.6 | 0.12 | 11 |
| LYM483 | 63626.6 | 0.0 | 0.12 | 17 | — | — | — | 0.6 | 0.01 | 22 |
| LYM483 | 63626.7 | 0.0 | 0.07 | 26 | — | — | — | 0.6 | 0.07 | 13 |
| LYM483 | 63629.1 | — | — | — | — | — | — | 0.6 | 0.04 | 16 |
| LYM467 | 63563.3 | — | — | — | — | — | — | 0.6 | 0.28 | 8 |
| LYM467 | 63564.2 | 0.0 | L | 35 | — | — | — | — | — | — |
| LYM467 | 63564.3 | 0.1 | L | 54 | — | — | — | 0.6 | 0.06 | 14 |
| LYM467 | 63565.1 | 0.0 | 0.29 | 16 | — | — | — | — | — | — |
| LYM467 | 63565.4 | 0.0 | L | 44 | — | — | — | — | — | — |
| LYM463 | 63108.2 | 0.0 | L | 46 | — | — | — | — | — | — |

TABLE 45-continued

Genes showing improved plant performance at Normal growth conditions under regulation of At6669 promoter

| Gene Name | Event # | RGR Of Leaf Area | | | RGR Of Root Coverage | | | RGR Of Roots Length | | |
|---|---|---|---|---|---|---|---|---|---|---|
| | | Ave. | P-Val. | % Incr. | Ave. | P-Val. | % Incr. | Ave. | P-Val. | % Incr. |
| LYM463 | 63110.9 | 0.0 | 0.16 | 21 | — | — | — | — | — | — |
| LYM463 | 63111.12 | 0.0 | L | 37 | — | — | — | 0.6 | L | 23 |
| LYM463 | 63113.2 | 0.1 | L | 58 | — | — | — | — | — | — |
| LYM450 | 63126.2 | 0.0 | 0.17 | 19 | — | — | — | — | — | — |
| LYM450 | 63127.9 | 0.0 | L | 42 | — | — | — | — | — | — |
| LYM450 | 63128.1 | 0.0 | 0.02 | 28 | — | — | — | 0.6 | 0.11 | 11 |
| LYM433 | 63300.3 | 0.0 | 0.05 | 23 | — | — | — | 0.6 | 0.12 | 13 |
| LYM433 | 63300.4 | 0.0 | L | 49 | — | — | — | 0.6 | L | 22 |
| LYM433 | 63301.3 | 0.0 | L | 34 | — | — | — | 0.6 | L | 21 |
| LYM433 | 63302.1 | — | — | — | — | — | — | 0.6 | 0.09 | 14 |
| LYM425 | 63132.9 | 0.0 | 0.02 | 37 | — | — | — | 0.6 | 0.13 | 14 |
| LYM425 | 63133.2 | 0.0 | 0.04 | 24 | — | — | — | — | — | — |
| LYM425 | 63134.2 | 0.0 | 0.17 | 18 | — | — | — | 0.6 | 0.04 | 18 |
| LYM425 | 63135.1 | — | — | — | — | — | — | 0.6 | 0.06 | 17 |
| LYM423 | 62981.11 | — | — | — | — | — | — | 0.6 | 0.20 | 11 |
| LYM422 | 63314.3 | 0.0 | 0.09 | 22 | — | — | — | 0.6 | 0.04 | 16 |
| LYM422 | 63315.4 | 0.0 | 0.21 | 14 | — | — | — | 0.6 | 0.10 | 15 |
| LYM403 | 63620.4 | 0.0 | L | 41 | — | — | — | — | — | — |
| LYM403 | 63621.3 | 0.0 | L | 39 | — | — | — | — | — | — |
| LYM403 | 63621.4 | 0.0 | 0.03 | 30 | — | — | — | — | — | — |
| LYM403 | 63624.3 | 0.0 | 0.02 | 28 | — | — | — | 0.6 | 0.16 | 9 |
| LYM403 | 63624.4 | 0.0 | 0.08 | 22 | — | — | — | 0.6 | 0.18 | 11 |
| LYM392 | 63324.2 | 0.1 | L | 57 | — | — | — | — | — | — |
| LYM392 | 63326.2 | 0.0 | 0.07 | 21 | — | — | — | 0.6 | 0.29 | 7 |
| LYM392 | 63328.3 | — | — | — | — | — | — | 0.6 | 0.04 | 14 |
| LYM392 | 63328.4 | 0.0 | 0.29 | 12 | — | — | — | — | — | — |
| LYM392 | 63328.6 | 0.0 | 0.10 | 21 | — | — | — | — | — | — |
| LYM381 | 63550.3 | — | — | — | — | — | — | 0.6 | 0.07 | 14 |
| LYM381 | 63551.2 | 0.0 | L | 44 | — | — | — | — | — | — |
| LYM336 | 63068.2 | 0.0 | L | 38 | — | — | — | — | — | — |
| LYM336 | 63071.2 | 0.0 | L | 49 | — | — | — | 0.6 | 0.17 | 9 |
| LYM336 | 63073.2 | 0.0 | 0.06 | 28 | — | — | — | — | — | — |
| CONT. | — | 0.0 | — | — | — | — | — | 0.5 | — | — |
| LYM475 | 63096.13 | 0.0 | 0.21 | 14 | — | — | — | — | — | — |
| LYM475 | 63097.16 | 0.1 | 0.02 | 24 | — | — | — | — | — | — |
| LYM475 | 63100.1 | 0.1 | 0.28 | 14 | — | — | — | — | — | — |
| LYM472 | 63114.2 | 0.1 | 0.03 | 23 | — | — | — | — | — | — |
| LYM472 | 63117.5 | 0.1 | L | 36 | — | — | — | — | — | — |
| LYM472 | 63117.6 | 0.1 | 0.03 | 28 | — | — | — | — | — | — |
| LYM439 | 63752.3 | 0.1 | 0.10 | 18 | — | — | — | — | — | — |
| LYM439 | 63753.1 | — | — | — | — | — | — | 0.6 | 0.20 | 8 |
| LYM439 | 63754.3 | 0.1 | 0.03 | 24 | — | — | — | 0.6 | 0.10 | 11 |
| LYM402 | 63778.2 | 0.1 | 0.23 | 14 | — | — | — | — | — | — |
| LYM402 | 63778.4 | 0.1 | 0.17 | 16 | — | — | — | 0.6 | 0.13 | 10 |
| LYM402 | 63780.1 | 0.1 | 0.03 | 39 | — | — | — | — | — | — |
| LYM400 | 63121.21 | 0.1 | 0.01 | 27 | — | — | — | — | — | — |
| LYM400 | 63121.22 | 0.1 | 0.17 | 19 | — | — | — | — | — | — |
| LYM400 | 63122.3 | 0.1 | L | 41 | — | — | — | 0.6 | 0.16 | 11 |
| LYM400 | 63124.13 | 0.1 | 0.05 | 39 | — | — | — | — | — | — |
| LYM386 | 63391.2 | 0.1 | 0.04 | 24 | — | — | — | — | — | — |
| LYM386 | 63391.3 | 0.1 | 0.02 | 37 | — | — | — | — | — | — |
| LYM386 | 63393.3 | — | — | — | — | — | — | 0.6 | 0.08 | 11 |
| LYM385 | 63654.1 | 0.1 | 0.03 | 23 | — | — | — | — | — | — |
| LYM385 | 63658.3 | 0.1 | 0.01 | 35 | — | — | — | — | — | — |
| LYM384 | 63138.13 | 0.1 | L | 60 | — | — | — | — | — | — |
| LYM384 | 63139.14 | 0.1 | L | 43 | — | — | — | 0.6 | 0.14 | 11 |
| LYM384 | 63139.5 | 0.1 | 0.15 | 22 | — | — | — | 0.6 | 0.29 | 6 |
| LYM337 | 63787.1 | 0.1 | 0.04 | 24 | — | — | — | 0.6 | 0.21 | 10 |
| LYM337 | 63787.5 | — | — | — | — | — | — | 0.7 | 0.01 | 14 |
| LYM337 | 63788.2 | — | — | — | — | — | — | 0.7 | 0.04 | 12 |
| LYM337 | 63788.3 | 0.1 | L | 81 | — | — | — | — | — | — |
| LYM312 | 63145.1 | 0.1 | L | 70 | — | — | — | — | — | — |
| LYM312 | 63198.2 | 0.1 | L | 32 | — | — | — | — | — | — |
| LYM312 | 63201.1 | 0.1 | 0.04 | 26 | — | — | — | — | — | — |
| LYM312 | 63201.4 | 0.1 | L | 54 | — | — | — | — | — | — |
| LYM309 | 63102.3 | 0.0 | 0.15 | 13 | — | — | — | — | — | — |
| LYM309 | 63103.27 | 0.1 | 0.02 | 26 | — | — | — | — | — | — |
| LYM309 | 63104.16 | 0.1 | 0.06 | 20 | — | — | — | — | — | — |

TABLE 45-continued

Genes showing improved plant performance at Normal growth conditions under regulation of At6669 promoter

| Gene Name | Event # | RGR Of Leaf Area | | | RGR Of Root Coverage | | | RGR Of Roots Length | | |
|---|---|---|---|---|---|---|---|---|---|---|
| | | Ave. | P-Val. | % Incr. | Ave. | P-Val. | % Incr. | Ave. | P-Val. | % Incr. |
| LYM309 | 63104.3 | 0.1 | L | 46 | — | — | — | — | — | — |
| CONT. | — | 0.0 | — | — | — | — | — | 0.6 | — | — |

Table 45.
"CONT."—Control;
"Ave."—Average;
"% Incr." = % increment;
"p-val."—p-value,
L—p < 0.01.
The transgenes were under the transcriptional regulation of the new At6669 promoter (SEQ ID NO: 4668).

Results from T1 Plants

The genes presented in Tables 46-48 showed a significant improvement in plant biomass and root development since they produced a higher biomass (dry and fresh weight, Table 46), a larger leaf and root biomass (leaf area, root length and root coverage) (Table 47), and a higher relative growth rate of leaf area, root coverage and root length (Table 48) when grown under normal growth conditions, compared to control plants. Plants producing larger root biomass have better possibilities to absorb larger amount of nitrogen from soil. Plants producing larger leaf biomass has better ability to produce assimilates). The genes were cloned under the regulation of a constitutive promoter (At6669; SEQ ID NO:4668). The evaluation of each gene was performed by testing the performance of different number of events. Some of the genes were evaluated in more than one tissue culture assay. This second experiment confirmed the significant increment in leaf and root performance. Event with p-value<0.1 was considered statistically significant.

Tables 46-48 summarize the observed phenotypes of transgenic plants expressing the gene constructs using the TC-T1 Assays.

TABLE 46

Genes showing improved plant performance at Normal growth conditions under regulation of A6669 promoter

| | Dry Weight [mg] | | | Fresh Weight [mg] | | |
|---|---|---|---|---|---|---|
| Gene Name | Ave. | P-Val. | % Incr. | Ave. | P-Val. | % Incr. |
| LYM452 | 7.1 | 0.26 | 22 | — | — | — |
| LYM449 | 7.1 | 0.03 | 22 | 140.3 | 0.04 | 22 |
| LYM379 | 6.6 | 0.30 | 14 | — | — | — |
| CONT. | 5.8 | — | — | 115.3 | — | — |
| LYM433 | 8.0 | 0.13 | 21 | — | — | — |
| LYM427 | 8.3 | 0.07 | 25 | — | — | — |
| LYM368_H4 | 8.4 | 0.13 | 27 | 190.5 | 0.25 | 51 |
| LYM337 | 9.1 | 0.13 | 36 | 151.3 | 0.21 | 20 |
| LYM297 | 8.4 | 0.13 | 27 | — | — | — |
| CONT. | 6.6 | — | — | 125.9 | — | — |

Table 46.
"CONT."—Control;
"Ave."—Average;
"% Incr." = % increment;
"p-val."—p-value,
L—p < 0.01.
The transgenes were under the transcriptional regulation of the new At6669 promoter (SEQ ID NO: 4668).

TABLE 47

Genes showing improved plant performance at Normal growth conditions under regulation of At6669 promoter

| | Leaf Area [cm²] | | | Roots Coverage [cm²] | | | Roots Length [cm²] | | |
|---|---|---|---|---|---|---|---|---|---|
| Gene Name | Ave. | P-Val. | % Incr. | Ave. | P-Val. | % Incr. | Ave. | P-Val. | % Incr. |
| LYM497 | 0.5 | 0.10 | 9 | — | — | — | — | — | — |
| LYM485 | — | — | — | — | — | — | 3.6 | 0.15 | 12 |
| LYM452 | — | — | — | 3.0 | 0.09 | 33 | 3.6 | 0.05 | 12 |
| LYM434 | — | — | — | — | — | — | 3.7 | 0.11 | 14 |
| LYM420 | — | — | — | 2.5 | 0.22 | 14 | 3.6 | 0.12 | 12 |
| LYM397_H2 | 0.5 | 0.18 | 16 | 3.3 | 0.11 | 49 | 3.8 | 0.05 | 19 |
| LYM360 | — | — | — | — | — | — | 3.5 | 0.29 | 10 |
| LYM357 | — | — | — | — | — | — | 3.5 | 0.23 | 9 |
| LYM350 | — | — | — | 2.5 | 0.23 | 13 | 3.4 | 0.22 | 7 |
| CONT. | 0.5 | — | — | 2.2 | — | — | 3.2 | — | — |
| LYM504 | — | — | — | — | — | — | 4.1 | 0.18 | 9 |
| LYM484 | — | — | — | — | — | — | 4.3 | 0.02 | 17 |
| LYM483 | — | — | — | 3.5 | 0.24 | 30 | 4.7 | 0.07 | 26 |
| LYM468 | — | — | — | — | — | — | 4.0 | 0.30 | 7 |
| LYM46 | — | — | — | 3.6 | 0.03 | 35 | 4.4 | L | 19 |
| LYM439 | — | — | — | 4.3 | 0.06 | 61 | 5.0 | 0.01 | 33 |

TABLE 47-continued

Genes showing improved plant performance at Normal growth conditions under regulation of At6669 promoter

| Gene Name | Leaf Area [cm²] | | | Roots Coverage [cm²] | | | Roots Length [cm²] | | |
|---|---|---|---|---|---|---|---|---|---|
| | Ave. | P-Val. | % Incr. | Ave. | P-Val. | % Incr. | Ave. | P-Val. | % Incr. |
| LYM433 | — | — | — | 5.1 | L | 91 | 5.2 | L | 40 |
| LYM428 | — | — | — | 3.9 | 0.18 | 47 | 4.9 | 0.05 | 33 |
| LYM427 | — | — | — | 3.5 | 0.19 | 30 | 4.3 | 0.07 | 14 |
| LYM422 | — | — | — | 3.6 | 0.03 | 35 | 5.0 | L | 34 |
| LYM417 | — | — | — | 4.5 | 0.05 | 67 | 5.0 | L | 33 |
| LYM403 | — | — | — | 3.5 | 0.16 | 31 | 4.7 | L | 26 |
| LYM402 | — | — | — | 4.4 | L | 63 | 5.2 | 0.01 | 40 |
| LYM398 | — | — | — | 3.5 | 0.05 | 31 | 4.8 | L | 29 |
| LYM392 | — | — | — | 3.5 | 0.14 | 29 | 4.1 | 0.25 | 11 |
| LYM391 | — | — | — | 3.8 | 0.01 | 44 | 4.7 | 0.03 | 25 |
| LYM386 | — | — | — | 3.9 | 0.02 | 46 | 4.8 | L | 29 |
| LYM385 | — | — | — | 4.1 | L | 55 | 5.1 | 0.02 | 37 |
| LYM381 | — | — | — | — | — | — | 5.0 | L | 33 |
| LYM349 | — | — | — | 4.7 | 0.04 | 75 | 5.4 | L | 44 |
| LYM337 | — | — | — | 3.9 | 0.04 | 46 | 4.6 | 0.01 | 23 |
| LYM336 | — | — | — | — | — | — | 4.1 | 0.12 | 11 |
| LYM333 | — | — | — | 4.8 | L | 78 | 5.0 | L | 35 |
| LYM308 | — | — | — | 3.7 | 0.05 | 39 | 4.6 | L | 24 |
| LYM307_H7 | — | — | — | 3.2 | 0.26 | 19 | 4.0 | 0.29 | 7 |
| LYM304_H3 | — | — | — | 3.6 | 0.07 | 36 | 4.7 | 0.03 | 27 |
| LYM298 | — | — | — | 3.6 | 0.11 | 36 | 4.9 | L | 30 |
| LYM297 | — | — | — | 4.4 | L | 64 | 5.0 | 0.01 | 35 |
| CONT. | — | — | — | 2.7 | — | — | 3.7 | — | — |
| LYM421 | — | — | — | — | — | — | 3.9 | 0.35 | 7.5 |
| CONT. | — | — | — | — | — | — | 3.5 | — | — |

Table 47.
"CONT."—Control;
"Ave."—Average;
"% Incr." = % increment;
"p-val."—p-value,
L—p < 0.01.
The transgenes were under the transcriptional regulation of the new At6669 promoter (SEQ ID NO: 4668).

TABLE 48

Genes showing improved plant performance at Normal growth conditions under regulation of At6669 promoter

| Gene Name | RGR Of Leaf Area | | | RGR Of Root Coverage | | | RGR Of Roots Length | | |
|---|---|---|---|---|---|---|---|---|---|
| | Ave. | P-Val. | % Incr. | Ave. | P-Val. | % Incr. | Ave. | P-Val. | % Incr. |
| LYM485 | — | — | — | — | — | — | 0.4 | 0.06 | 16 |
| LYM478 | — | — | — | — | — | — | 0.4 | 0.28 | 9 |
| LYM452 | — | — | — | — | — | — | 0.4 | 0.03 | 17 |
| LYM434 | — | — | — | — | — | — | 0.4 | 0.02 | 20 |
| LYM420 | — | — | — | — | — | — | 0.4 | 0.10 | 13 |
| LYM397_H2 | 0.1 | 0.09 | 22 | — | — | — | 0.5 | L | 29 |
| LYM360 | — | — | — | — | — | — | 0.4 | 0.19 | 14 |
| LYM357 | — | — | — | — | — | — | 0.4 | 0.08 | 14 |
| LYM350 | — | — | — | — | — | — | 0.4 | 0.09 | 13 |
| LYM326_H4 | — | — | — | — | — | — | 0.4 | 0.13 | 13 |
| LYM315 | — | — | — | — | — | — | 0.4 | 0.21 | 11 |
| CONT. | 0.1 | — | — | — | — | — | 0.4 | — | — |
| LYM484 | — | — | — | — | — | — | 0.5 | 0.07 | 17 |
| LYM483 | — | — | — | — | — | — | 0.5 | 0.01 | 28 |
| LYM46 | — | — | — | — | — | — | 0.5 | 0.01 | 23 |
| LYM439 | — | — | — | — | — | — | 0.6 | L | 36 |
| LYM433 | — | — | — | — | — | — | 0.6 | L | 43 |
| LYM428 | — | — | — | — | — | — | 0.6 | L | 36 |
| LYM427 | — | — | — | — | — | — | 0.5 | 0.12 | 14 |
| LYM422 | — | — | — | — | — | — | 0.6 | L | 36 |
| LYM417 | — | — | — | — | — | — | 0.6 | L | 35 |
| LYM403 | — | — | — | — | — | — | 0.5 | L | 28 |
| LYM402 | — | — | — | — | — | — | 0.6 | L | 44 |
| LYM398 | — | — | — | — | — | — | 0.5 | L | 30 |

TABLE 48-continued

Genes showing improved plant performance at Normal growth conditions under regulation of At6669 promoter

| Gene Name | RGR Of Leaf Area | | | RGR Of Root Coverage | | | RGR Of Roots Length | | |
|---|---|---|---|---|---|---|---|---|---|
| | Ave. | P-Val. | % Incr. | Ave. | P-Val. | % Incr. | Ave. | P-Val. | % Incr. |
| LYM392 | — | — | — | — | — | — | 0.5 | 0.28 | 11 |
| LYM391 | — | — | — | — | — | — | 0.5 | L | 27 |
| LYM386 | — | — | — | — | — | — | 0.5 | L | 31 |
| LYM385 | — | — | — | — | — | — | 0.6 | L | 39 |
| LYM381 | — | — | — | — | — | — | 0.6 | L | 36 |
| LYM349 | — | — | — | — | — | — | 0.6 | L | 48 |
| LYM337 | 0.1 | 0.15 | 33 | — | — | — | 0.5 | 0.02 | 22 |
| LYM336 | — | — | — | — | — | — | 0.5 | 0.22 | 13 |
| LYM333 | — | — | — | — | — | — | 0.6 | L | 37 |
| LYM312 | — | — | — | — | — | — | 0.5 | 0.21 | 13 |
| LYM308 | — | — | — | — | — | — | 0.5 | L | 26 |
| LYM304_H3 | — | — | — | — | — | — | 0.5 | L | 28 |
| LYM298 | — | — | — | — | — | — | 0.6 | L | 35 |
| LYM297 | — | — | — | — | — | — | 0.6 | L | 38 |
| CONT. | 0.1 | — | — | — | — | — | 0.4 | — | — |

Table 48.
"CONT."—Control;
"Ave."—Average;
"% Incr." = % increment;
"p-val."—p-value,
L—p < 0.01.
The transgenes were under the transcriptional regulation of the new At6669 promoter (SEQ ID NO: 4668).

These results demonstrate that the polynucleotides of the invention are capable of improving yield and additional valuable important agricultural traits such as increase of biomass, abiotic stress tolerance, nitrogen use efficiency, yield, vigor, fiber yield and/or quality. Thus, transformed plants showing improved fresh and dry weight demonstrate the gene capacity to improve biomass a key trait of crops for forage and plant productivity; transformed plants showing improvement of seed yield demonstrate the genes capacity to improve plant productivity; transformed plants showing improvement of plot coverage and rosette diameter demonstrate the genes capacity to improve plant drought resistance as they reduce the loss of soil water by simple evaporation and reduce the competition with weeds; hence reduce the need to use herbicides to control weeds. Transformed plants showing improvement of relative growth rate of various organs (leaf and root) demonstrate the gene capacity to promote plant growth and hence shortening the needed growth period and/or alternatively improving the utilization of available nutrients and water leading to increase of land productivity; Transformed plants showing improvement of organ number as demonstrated by the leaf number parameter exhibit a potential to improve biomass yield important for forage crops and improve the plant productivity; Transformed plants showing increased root length and coverage demonstrate the gene capacity to improve drought resistance and better utilization of fertilizers as the roots can reach larger soil volume; Transformed plants showing improvement of leaf petiole relative area and leaf blade area demonstrate the genes capacity to cope with limited light intensities results from increasing the plant population densities and hence improve land productivity.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

SEQUENCE LISTING (5159 sequences)

SEQ ID NO: 1 - DNA, 1904 bp, Hordeum vulgare
aacaaagcaagaaatggaggtagctagcccactactcccggtccaatccaagccggataggtcggcaacggcaatggaggtagctaggtcactgcccccgatccaatccaagccggacaggtcgccaccggcaatggaggtagctagctcaccgtcaccgctgccgctccaatccaagccggacaggtcggcaccggcaatgaaggtagctagctcaccgctccgtgtcccgtccaagccgcacaggtcggggccgggaatggaggtcgctagctcaccgtcaccggtcccggtcccatccaaaccggacagaccggcaccggcaattgaggttcaggtcctaagctcgaagctcgtccggccggctgcgtcgaccgatgccgccgtcgacgctggactcgagtatgtccctctctccgtcttcgacagggcgacgtaccagatccaaatggccattatctacgtctttgcgccgccggccccctccacggccgccctcgagaagggcctggccgcggcgctggccaggtaccgcggcttcgcggggcagctaggggaggcgcccggcggaggtccggccgtgctgctcaatgaccacggcgcgcgcgtcgttgaggcgtatgtggacgccgacctcgtcgacgtggcaccgcccatgcccaagccggagccgctgctgctgcacccgaacctggaggaagggatggacgaggtggtggtgctgcagctcacacggttccgctgcggctccctggccatggggttcacgtccagccacgctgtcgccgacggccgtggcaccagcaacttcctcgtcgcttgggggcgtgccaccaggggagttgacatgggcctcccccccgtgtacaaccacgacgagctcttcaagtcacgttccttgccccgcgtcgagttcgaccaccgcaatcgggagtattacatgccagtgccaccgttgcccaccaacgtcgacgtccatgccaagatcaagaagaacatcgtcatccacaaggcgcatttcaccaaggaccggatagcccgtgtccgtgccagcgcttcggaaggccgcggccgccccttcagccggttccagagcatcctcgcccacctgtggcgcgccaccacgcgcgcaaggggacttcgccacaacgagacctccaagatccgtctgtcggtggacggacgagaccgcctcggcgtgccggccgagtacgccggtaacctcgtcctgtgggcgttcccgcaggccacggccggcgacctgctgaaccggccgctgaagtatgccgcgcagaccattcacgacgaggtggccagggtggccgacgccgagtacttccggtcgttcgtcgacttcacgagctccggcgtcatcgaggaggaagggctggcaccaagcgccgcgttgaacctgagggaagtgctgtgcccggacctggaggtgcatagctggctcaccttcccgttctacgacctcgacttcggcacggggacgccatcgtacatcatgccctcttacttcccgttcgaggggctcatcttcctcatgccatcctacatcggagacggtagcgtcgatgccttcgtacccgtctttcagcataacctcgaggctttcaagcaatgcgtctactccatcgatgatctccatgcatgaaccgtgagatgcatcgagtagcagccaatccatcacaagaatatgcagcacaacacgtacgattcaagttaaattactttcgtgccaaaataagtctccatgccatgcatcaatgcatgcgatgaagctccaaaaataaaactgcatatatatgcatgcatgtgatcgctatatgcggtgcaatagcttgcgtccattccttgttatatatgtgcaatagttccgcgccatatatttttgtttcctt

SEQ ID NO: 2 - DNA, 1993 bp, Arabidopsis thaliana
aaaggatcccttgtcaatgtcgaactcaacgccctgcatcactccctttccggtcaccaagactgccgtagcggcaccagccacggtggtggagggtgtcaacgacgcgaattcaacgcccatctctccctttccggtcaccaagactgccgtagcggcaccagccacggtggtggagggtgtcaacgacgcgagtaggaagagagaaaggccgaagacgtatcgtgattatagagggaggtttatcacagcatctgggacatttacgccgaggtcatcgttgaggaagaggagaggtgacatgtctatgaggcttggaggaggggacttcacgccgcatagcttcacagttaataaaggagaggatataatcaagaggatcatgtccttcactgcaaatggttctcgtgggatcagtgttttgtcagtaaatggtgcggttgctaacgtcacgattctacctcacggttcaagccgcagggtcatgacgtttaaggaggagtatgagatagtatcgctgaccaataatacaatggcgatatctgagagcggaggagtgaaaaataagacaggagggtggcggattactattggtggagctgctggtggacgtgtccatggtggtgctttggctgggagtctcattgcagcaagtccagtccaagttgtgattggaagtttctggccgttgatcacaaatccgcgtcaaaagaggaagtatgtgtccaaagctagggttgctccatccataacaccaaacttggtggcttcctcatccacaggaccggtccaacaaccagagatggttggcccttctcactctcagaagaggaacagtgagtccaacagaactatggttgttctttcagccacaccaccaaacacattggcttcctcatccacaggacaggtccaacaaccagagatggttggcctttctcactctcagaagaggaacaatgagtccaacagaattatggttgttctttcagctacaccaccaaacacattggctttctcatccacaggaccggtccaacaaccagagatggttggcccttctcactctcagaagaggaacaatgagtccaacagaactatggttgttctttcagccacaccaccaaacacattggcttcctcatccacaggaccggtccaacaaccagagatggttggcccttctcactctcagaagaggaacagtgagtccaacagaactatggttgttctttcagccacacaacaaaacaaattggcttcctcatccacaggacaagtccaggaaccagatatgattggcccttatcactctcggcagaggaacgatgagtccaacgatgtgattcttctacccacagttcaatacttactggcttcctcattcactggacaagtccaacgtcaaccagagatgacagacccttcccattctcagaaaaggaatgatgagtcgcaagatgcggttgttccacctgtaatacccaacttattggcttcctcattcactggtcaagtccaacgtcaggcagaaatgacaggcccttctcattctcagaagaggaacaatgagtcccaagctgcggttgttacacctgaaatacctaacttattggcttcctcattcactagacaagtccaacgtcaagcagagatgacaggcccttctcattctcagaagaggaacgatgagtcccaagctgtggttgttcctcctgcaatcccaaatttattggcttcctcattcactggacaagtccaacgtcaagcagagatgacatgcccttctcattctcagaagaggaacgatgagtcccaagctgtggttgttcctcctgcaatcccaaacttattggcttcctcattcaccggaccagagatgataggaccttctcattctgaggagatgaacgatgagtttaacccttctcagtttctgactctagggtggtacagctctacaccggagcaagacaagtaataaggtaccaaa

SEQ ID NO: 3 - DNA, 1591 bp, Arabidopsis thaliana
acacactctgcaacacctctcactcaaatttcattcaccatgttctctctcaaatccttaatctcctcacctttcacacaatccaccactcatggattattcaccaacccgattacccgacccgttaatccattaccacgtaccgtttccttcaccgttaccgcttccatgatacccaaaagatcctcagctaacatgattcccaaaaaccctccggcgaggcaacagctctaccaaccgttccgaccaccgtcatctcccattccaacccaattccgttcactcgactccgccggtaaaatcgaaatcctcgccggtcgaatggctctctggttcgaatacgcacctcttatctcttctctttacaccgatggtttcactcctccaaccatcgaagaactcaccggaatctcaagcatcgaacagaaccgtttaatcgtcggtgcgcaagttcgtgactcaattcttcaatctatccatgaaccggagctcatttctgcgttcgacaccggtggtgcagagcttctatacgaaattcgtctccttagcaccacgcagcgtgttgcagccgccacattcatcattgatcgtaatattgattcgaaaggagcacaggatttggcacgagccatcaaggattatcctaaccgtcgtggagacgttggatggttggattttgattacaacttaccaggagattgtctttcattcttgtattacaggcagagcagagagaataagaatccatcggatcagagaacctcgatgcttctacaagcattgggggttgcagaatcagaaaaggctaagaacaggttgaacacagagctatacggggacaaggaagcagagaaggagaaggagaagaagaagaaggaagaggaagtcaaagctattcggattccagtggtgaggcttaagtttggagaagtagcagaagcgacctcggtggtagttttaccggtttgtaaagcagaggaaggggaaaagaagattcttgaagctccaatggagatcatagccggaggggattttaaggtggttgaggcggagaaaggatggaagagatgggtagtgcttccgtcgtggaacccagtggcagccattgggaaaggcggtgtggcggtttctttcagggatgatagaaaagtgctgccttgggatggaaaggaggagcctttactggtagtggccgatagggtgaggaatgttgtggaggctgatgacgggtattatctcgtggtggctgagaacggacttaagctagagaaaggatcagatttgaaggcgagagaggtgaaggagagtttagggatggttgttttggtggtgaggccgccaagagaagatgatgatgattggcagacaagtcatcagaactgggactgaattaatagaatcaatactcatatgctgtaactgattacggagtcatcatggtcatgtaaaaattttggataaaggtggtaactttttgttctaagatacaatcagaaacagagcaatatttttctctatttgcttttctagttcatgtcttagtgaacaaatcctaccaatcagacctttttggaaactgttttattaaccg

SEQ ID NO: 4 - DNA, 1328 bp, Arabidopsis thaliana
acgccaccgattccaaacgccaaccctctcgagtcttgtctctctccaatcctttccttggccgcataaacgcaaccatcgtcgtcggagctttgatcttcaccgactgaaaagtatgtctgtttccgatgaggaagatgagtgtttcgctcgattcctcgaatcagaagtctcatcggtagaggataaagaagaaacgaaagaacctgaggcaaaacggcaacgtattgagaaaggcgaaacaaaggctctagagaaggatgaagatcaaaaggaaaatggtaacaaagataaaactgatgcaaagagaatagagagtggagttttcaccaatgttcctactgagctgtttcgtcatattctcaagttcttatcttcggaggatcttgtatcatgctccttggtttgtaaatttctcaattttgctgcggctgatgaatccttatggcgtcgcctgtactgtatccggtggggtctaactcttccaagtagaaagttacgtgaatctgcttggaagaagctttatattgatcgtgatgaacaggacatgattgaacttgtcagaacctgtccgtcggatttcaaggagtattacgtacatatgcaagcagcaaagagaagccaagcacctcttccgtcccagatggtggatgaccggataattcttgacaatactgtacttgaacaagtttctctatggaagaaaagcaaaggacttactgataaggctgtcactggccatatttgtttgggaaccaaatgttcataccatcagattgacgacgtgttcatatgcaaagagacgggaaatgttcatgtatgcgatgataactgcaaggaagtaatactgagtccagagggtgacctcatggtgtgtactatctcaggagtttgttctgatactttacttgtacaaactgagccagacgcagatgggtgttatgaggaagaagctgaactagaagctgaagtattcacagataaaagccgattagcccgagcttttgaacttggctacaactgcgatgatgagcaggaactggaacgtaccctgaggttctgctgagcaaaagtctcgaccttttgtccaatttcataaggcctactttctgtaaggtcttctctctctctctctctctgacctgattctgcctgggttctgtggagttgaaatgaatcaaatgtagctcttgttttaatcagtcagctttgtaacgtatacatatatatcattgtatgtgattaacattgtccttaaaaagtgttacacctagtaattacgttccaactttatcagtaaacctattggtaactagtaatttgctccc

SEQ ID NO: 5 - DNA, 582 bp, Hordeum vulgare
cggcacgaggccatcacgcacccaacacctgccagccactgcgagagcgaggagcctagctagacgacggccatggcgatgaggaaggagccactactccttgtggccatgatgctggcgctggtggtggcggcgcgtgcggcgccgtgcgaggtggggcagctgacggtgtgcatgccggcgatcaccaccggggccaagccgagcggtgcgtgctgcgccaacctgggcgcgcagcaggggtgcttctgccagtacgccaaggaccccgcactgggccgctacatcaccagcccacacgcccgcgacaccctcctctcctgcggcctcgccgtcccgcgctgctagctagcctccttccttcccagcatatcatatgtggctcagcctcagctataggtatgtagggtacctccgtccatgacagatgagggactatatctatatgtagcttgagcctagctgagtgcgtgatgcgtcaataaaatgttgggtgatcgatgctgctgcaataaaacaagagatgttgggtgatgatggatgctggaataaaatgacctttcctaccttccaaaaaaaaaa

SEQ ID NO: 6 - DNA, 752 bp, Hordeum vulgare
cggcacgagggaacgatcgcgtcccctttttcccttcctctcctcggcggcggaaggccaactagcgaggaaccctaacaataatccgtagttccgatccgcaaggcctgcgacgatggcggcttccgtccgcgaggcgtcgatgaggatcctgcgtccggcgggtgaggggcttcgccggctcatccacgccccgcagcattccggatccatcagtgtctttggggaaggctaccgcgcaacgcaaatccagcagtcaaaagaggacctgtataatctcatcgctgacgcccaggccaattctgcggcttctcaggaagacaaaatggtgctcaagactctctgcacacatgtcaagcccagaccacatgaccctcaatggcgccggataactactgccaagaaggtgaccaagtggactgcaacatcaattgtgcttgctacttgtgcgatcgctttccctgccttagccaaccgccctgactatcgtgttactactgcatgtgagcagaagacagtggagcaatgcaggctgcctgagagtgtggcccagcaaggggcgcagaagctttagaagcaagtgaagggaagacaaaatacatcttgtttgatggagaagcaagacggatatcagttctattcctgcactatgttagttaggtctcttgaaatatgtctggtcgcattgtaagataatttgtgatgttgctgacatggtatgttatcctttctgcctagtatgtcatgcaaaa

SEQ ID NO: 7 - DNA, 919 bp, Hordeum vulgare
gttgcgcagcctccttcccctcctccccaccccctgttgccatctccaacccaatctttcctctctcaccggtctgcccgacggattccaaaagggatccctcattcgggggaaaagctgttcgccgcggctcccaatctcatccatttcttgtctgttccaggaattttgggaaattttgtgtctttaaaggcaatccagggtctggtcctgagctgtcggggctccatgtctaagtgggaacctgtcacatttgaggaatctcttagctttgttaagcgagtaaaggctcgtgactacttgttatacctgtcactgctcaatgtgctcacccggagtgaccagatccctttggaagcttacaacgagcttttgcttcttttccgggaccacggcgacctgctagaggagctagggaagttcaggcccctcccaaatttcccaagcactgtgtacagacacagctcaatttggatgttcatattcctgatgccctttctgctcctgagccttctcctcgcgtttgagaagcctttggatagattccttctccgacaacccgtcgcgagctgaagatgtgcattacgatgaaatgaccaaacacggaatgcatgattggactgatggtgtctcgtgatatccccgttgaagccgttgccttgttggtggcggatagtatctctgaatctctggaaggacaggctaaaccgattgtgtgggcttgttcaagcttcagtgtgcaattgacaaactaaatgaaagaattttttctacatgcaacattttgcaaagtgaaactggtcctatatatatgagtaacagggaaattgtgtaaagccactttaaacgagcaacgatttctccgcatgtgtctgcttgcagccttgcacatcgccatgaaatttacctggcactattc

SEQ ID NO: 8 - DNA, 877 bp, Hordeum vulgare
cgggctgagggcagcgctatccttccgagcggctccggctccaatccaatccaagcacatctcccggagccggcgtctttgggtgctcggttccaatggcgagctcgacttgttccgatgacaaggttgctcccctggttcagaaacacgcacccgccggaaacccggaggcgcttacgacgacgaagaagaagaagaagaaggtgttgattgcggtgccagaatatgatgtgagaagtgtcctcgcttacaaggatgaacccgtggatttggaggtgcccgactacttgatcagggaaaacccgaaacgggctgcggtcatgttcatgataaaggccaacttggccatgtacaacgagcacaccaaggcacggatgctcgaggagcagagagactttaagcaccaactaaaaaccaagggcagagtcacctacgagctcgaggttgatgaggacgatccgagatttaaagatgaatgcaccaccagctctgctggagcaggacggaggaggcaccgcccgggcgtcatgaaaaagcaagacggacagatcaagaggctaaattaaattattattttatttgatgcaagtcgtatcttcttgggttgtcaagacaagtctttatcaataattactctattagtatgtgatgtgtttggaccaaagcactgctttgagtattttctttaggcgtttgagttgtcaagacaagtctttatcaataattactctattagtatgtgatttgtttggactcaaagcactgctttgagtattttctttaggcgtttaggttgtgaagacaagtctttatcaataattactctattggtatgtgctttgtttggaccaaagcactactttgagtattttcttta

SEQ ID NO: 9 - DNA, 813 bp, Hordeum vulgare
cggcacgagggagaggtggtgtccgtgaatcctgtgtatatgaatgccggcacgccgagccccacgggctttgtgatgaatatgcaaccttcagaagcagaggtgggttttgatctccgccttcctccaaccgaagatattgaacagatagaaagaagaatcaaagaagaatgggcaccagctcataaaaacttgacttaccagctgatgaagaaaggaccagtgagggatgtgacgggacgccccttacttacaccagccaatgcgtcaaacccatggtggtctgtgtttgaacaggctatcatctcttcgggtggaaaactagcaaagccagagatcttatcttcaaccacggacgcccgattcgtgaggcagatgggtgttccagcccttggattttctccaatgataaatactccaatattgcttcacgatcataacgagtttctggaggataaagtgttcctgaggggcatcgaagtgtatcaacatcttatcagagcgctgagctccttcaaaggctgattcgaaataagcacataagttgtaacattattgtattccgatcccatgtaaattaattgtagcgaagctaattcagatgcccgcgatgccacaaccatcatgctccaagccacagataaactggttagggctcatccagtcagaataaactttctctgaaataatggaaatctgctgacggcgatctcagcaggttgatttgtatgtgatgtacatacgaagttacggactgtatataacaagatgatttgtatagtccaccgttggattgatattggagtatttatc

SEQ ID NO: 10 - DNA, 1381 bp, Hordeum vulgare
acccgcaccgcacatcacagccgcccccaacaacagaggccaggccagaccagaccagaccggaccatggtttacggcggagaggaggcgctgatgcggcagtactccatcggcgacgagatcgggcgcagccgcttcgggacggtccgccgctgccactccaacgccacgggggaggcgctggccctgaagaccacgcccaaggcgccgctgcgtgacccgctcgacttggcgctcgcggagcaggagcccaagctgcacctcctcgcctcctccccgccctgcagcccgcacctggtcgcgctccacgccgccttcgacgacgcgaacgccgtccacctcgtcgtcgacctctgcgccggcggggacctcctctcgctcgtctccgcccgcggcggccgcctccccgagcgcgaggccgtcgggctggccgcgcagctcgcgtccgcgctcgccgcctgccaccgccgcggggtcgcgcaccgcgacgtcaagcccgacaacctcctcttcgacgccgccacgagcgtgctcaagctcgccgactttggctccgcggagtggttcggggacgggcggcccatgtcgggcctcgtcggcacgccatactacgtggcgcccgaggtggtcgcctggagggagtacggggagaaggtggacgtgtggagcgccggggtggtgctttacatgatgctctcgggggccgtgcccttctacggcgccaccgcgcccgagatcttcgaggccgtgctccgcggcaacctgcgcttcccgccgcgcgccttcgccggcgtctcgcccgaggccaaggacctgatgcgccgcatgctctgcaaggacgtctcccgcaggttctccaccgaacaagtccttaaggcatcccgtgggatcgcgagctgtggcggggatgcggtcgcgggctgaagaaatcgatggaccaacataatctccacgcgctccatcctcctgtagatagaagatcttctccgcagacgacgacggctcggtctctgcggctctgctctgtttctccggcaaatcggcgatgggccgaagcagcggtggcgccggagttgagttcagtaagtagatcctttactctaggtctagaggtctgtggtgaagctgggattgcagaagctttcacccgagttagcctgaatgtgtgtttgttcgttgtgtttgttatgtgaatctctgtacatgcagttttgttcagtcgtagttgaagaagagagagggttagtagtacctcgtggaacttggtaggcaagctttgttaaagaagaatgaaaatggagcaaaaaatatgtgcatgttcttgtacaaatggagcaaaaaaattctgctttatttaattccagcaactattccctatagc

SEQ ID NO: 11 - DNA, 1579 bp, Hordeum vulgare
ggtggacggcgaagaggaggacgagcatggccgacgggagggatctgggcgacgtggcggccgcggaacccgatcctgatgaagggcagcctgatctggaagaggaaggtgagcttgaagccgccggcggcggcggcggcggcgaggaagaagaggacgtagacgtcgacggcctcgccagcttcctcgaattcgagatcctctccggatccagcgaggaagatcctctcgacctggaggagggcgaggaggagaaggagacgggagtgaacgatgaagcgaagaacggtaagaggaagcaagattcgctgtcggagggagatggcagcggcagcggcagcggcagcgaggacgagcatcagaagagggcgaggaaggagaagggaaaaggaaaggttttgacggaggggccgcctcagattgacacgggcatgttcaccaacgtccccccggagctgttcctgcagatcttcaagttcctctcctcggaggacctcatctcgtgtgcccttgtctgccgcttcatgaacgccgccgcatctgacgagaccctttggcgccgcttgtattgtatgaggtggggcctgtcctctaatgccacctctaacgcgaaactcagggagtgcgcttggaagagcctctatattcagcaagacagagaagatatggttgaattcgtgagatatacccctacagaattcaaagagtactatatccagatgcaggctgcaaaaaggagtcaagcaccccttccctcagaagtgaatgacgacaagattgttcttgataagacagtagctgatcaggtgtctagttggaaaagccgcagaggccttactgatgatgcagtcaaggggcattcttgctccggaagtacttgcttctataagcagattggtgatgcttatatttgtgagaagactggtcgtgtacatgtttgcgatgatgcctgtcgtgaatttgtcttggaccaaactagtgggttacttgtctgtacgatatctgggcactgttttgagaggtttttatgtcctgatgacgagtgggacacttgtgatactgatcagcagcaaggcggtgtgactgatgaagcagagccattcatgggatctggacgatttgcacgtgcttatcagttgggttacagctgtgccgacgagaaggaacttgagtacgctttgcggttctgctgatattctcccggtcatttgatccttcagacctccttcagaccttcactccgtgtgctcgctacacgagagcaagtttttggttggcaagggaaataagatgcaggaagctctatactacactttacttgatctcgacctctggggatgtgcctatgaatgcaaaatcagcagaaatgctggtatgcttttcaatcagtcgagggagctgatatgttgttgtatagtttcctaaattatgagagatgtatcctagtaataaaataaatgcttgaccacttgtaatcctcacaacagtgcccatttgtgggcactgtaacctattcactgaagtagttgaggcatgtattaagttactgtttcttttagcatacaaatcagcaagtgtt

SEQ ID NO: 12 - DNA, 667 bp, Hordeum vulgare
aaataaggagaatccctcttttgttaaggaccgttttccattttccaagttctttacggatacccctcagcctgtgtttactggtgagtccttcgagaaagatatgcatgcagccaacggttgtttcaaacatctttctacgatattccaagagctggaagagtgcagggcttttgagttacttaagtcaacagctgagcgagcaaattatctaatgactaaacaagctaagattgttgccatgacttgtactcatgcagccttgaagagaagagactttcttcaattgggtttcaaatatgataatttactgatggaagaaagtgcacagatattggagatagagacttttataccaactctcctgcaacggcaggaagatggttatgctcgtctcaaacgttgcattttaattggtgatcaccatcagttaccccctgtcgtgaagaatatggcttttcagaagtacagccacatggaccagagtctcttcacaaggtttgttcgccttggtgtcccttatattgaactcaatgctcagggtcgtgccagacctagtattgctcagctttataattggagatacagagaactgggagatctgccttatgtacatgaggaagctatattccataaagctaattctgggttctcttatgagtatcag

SEQ ID NO: 13 - DNA, 996 bp, Hordeum vulgare
tgcattcactactgtcagatttagtaattcaagttatgatgtagtagttccagacttccagtacatcttgccattttgcttttaaaagtataatagattaattgtattctacttcagagttaatttcagttatttgttgttctgcgacatgcaggattgctacctagcactgacaggtcctacccgtgctattgccgtgtcggtggatccttcgtacattgaggtttcactgaaagtgaagggcacaactgaagctgaggatacagatttaagcgatcttgttctgatgtacagaactggatgctgtcctggaagtgttttccctagcaggcttagcacgctggaaattgaatttcgccacattaatcgctcggtggaggccactgtccatataaaagtcattggcgggtcgtggccagatggttttcatggtgaatttagtgctggcatcagtagtagtgacgacctgcaagtcaagttacttgactttgaagatggtggattgcctgtgaatgctgatggcgagatcaaactctcacgccgagtggtctctgttggagttgagagtaacctgaaggtttctgtaagggcacgcccaattaacaaggaccatgctgctgagagcagcgaagcagttttgaaatgtcagagagccggtacaagcccctcgggcatcaagctcagtgttggttcctgtaatatggaagttagtgttgcttggtcctgtttccgtcgagcgtggtgacacgaaactattttaactcgattaatttaatccatgagttatatagtggtgtagcgtagtgcatgccagaaacctgttccaagttatgtagtagtgttgtagtggtattgtggcatttggtctagtggtgtatgccagaaaccttccgactgttgttttgtattacttcctccattctaaaataagtgtcgcttattttgtactccctctgtacctaaataattgtaattgaagagaactagactagtttt

SEQ ID NO: 14 - DNA, 1393 bp, Hordeum vulgare
aagagagtccacggcttcgacaaacttggctccacccgtggcggcctcggtacaatcatgcatccccggggctgcacgaattccgcacgaggctcaggctcaggctcaggcaggaggactccctcatcctcccttatcctcctcttccgcggtcacacttgacattcccggcttcttctgcgtcccccctcgatctggatccacaagaaatcagccctgcgatgaccggcgttggcggcgatgccaagaagagcctgacgcagtggctcggggacaaagggttcgacgaggaggccatcgggcgcatgtccaagcggtgcaggaacctgcccaacctcgacgccggcgaggcctccggcgtctgggactacctcctcaacgacgtcaagatcgagcagcgcaagctgcggtacgtggtcaccaagtgccccaaggtgctcaccatgtccgtcaacgagaagctcatccccacggtccagtgcctcaccacgctgcaggccaagcccggggagatcgcccaggccatcatcaagttcccgcccatactgttccacagcgtggaggagaagctctgccctctcctcgccttcttccagacgctatccatctccgagaagcagctcgccaagctgctcatggttaacccgcgcctcatcagctacagcatccaggccaagttctcccagacggttgacttcctcgtcggccttggcatcgacagggagggcatgatcggcaagatcctgaccaaggagccatacatcatgggatacagcatcgacaaacggctgcgtcctactgccgagttcctcaagtccgcggtcgggttgcagggttcgtatctccagagggtcatcatgaatttccctagtatactgtcgcgagatgtcgacaagactctgcgccccaatttcgtgttcctgcagagcgctggattcagcaaggatcagatcatgaaattggtggctggataccctcctgttctcatcaagagtatcaagcattgcttggagccaagggtgaagttcctggttgaagaaatggggcgggacaagggcgaggtggtagattacccccaattctttcaccatggtctcaagaggagcctggagtaccgccacaagatactcaagcggatgaactcaacgtgcagtctcagtgagatgctcgactgtaatcagaagaagtttgccatgaaatttggtttgatcccagtagcttagggtctgatcttccgtctcttcagttcccatgtagcatgttttatattcaggcgaacgttttatttttgtaccattggtcgtgttgtttcttgaacattttgggcattgagaatccaagtgttttgctttaaccggatgttttccggatgttcagtgcaactgcctctttc

SEQ ID NO: 15 - DNA, 1873 bp, Hordeum vulgare
cggcacgagggtgcgagagcagaggagccggaggttctttctaggttttagcgcgggtgcggcggcgcggtcctgccgttgcgtgttaggtttgccggagcaagcgagcgggatgcccaagggcgacgatgcgctggcgcggaagcgcgggaaggtgcgccggaagcggatgcgcagcagcgagaacgccgtctccacgcgcgtcgccgccatcatcgcctccaagcgccgccgcaagaccggcaagcgccgcggctgcgagggcatgtgcttctccctcccttgccccgaggaccccttcaatgagcgccacggcaagaagcgcaggaccgaagacgccgccgacaccaacgacgaccacgagaagaagaagagcaaggattccaagaagcggccgctggagagggccaccggttctaatgccatacccgtgcggaagaaggagacggaggaggaccgggtggagtatgaccggccgtccaagttcctggtggtctgcctcaacgcgatccgggacggggcggtggcatccgaggaggacggcggcggcatccacgactctgcctcctggggcatggagctctggaagtcctgcgcggcgtccccgccttcggacgtgctcgacaccagccaccggtacgccacccggcagcagacggcgtggctcgtctccacggcctgcgacatcgtcgctaggaaggagaagctcggagtggtcgtctcatgccccttcctcctctacctcgtcccttcccaggaaaaggcggtgcaagtgcgttcaatgtgtaaaccgctgaagtctcttggaatacattcagtgagcttgcatcccggtgcttccattgaacaccagatttctggactaaagagctgtgagcccgagtttcttatatctaccccggagaggctccttgaactggtttcactaaaggcaatcgatatatcgaatgtatcaatgctggtcattgatggactaaagggattcatggaccttaatatcatcaaagaacttcgttctattcgaggtaccatatcaggtgatgcacaggtaactatatttagtggtcaatgtgaccagagtgcggcaacagtggcaagaaatctactacatggaagaattacaaagcttaccacaaatgattctgttgcttctcgaagtgcatttgtaacacagcacgtacacttctgtactaaagaggagaagacatcaaaggttaaggaaattcttgagcatgttttagaaaaccatgctagtaagacagcaaaggttttgctagtagccgcgaatgataatgtagcgcagaaactctcttcatccctcaaactggaaattctcacagtgaatgatggctcgcaaggcagcacctttaccgtatgcagcagcatggggcttatcaatgtacttgtgaaaggctgtgagagcttggcaacatcaggtgtcgaggaatttgagattgtgttggtcgcggacttgcctccatcgtttgacgattatgtcgagatcctcaccaggacagctcgtcacacggttgcaggggaggtgcatgtcatcttctctaagactgatgctactcatgcaaagcccttggctgatgttcttgcaaacagtggacaggcagtgcctaagttgctaagacaattaatggacaagaatcactcctgatagcaatattcatttctacttatgcggttaatcatgatggacgggcagccaaattagcggtccgcaactcttcctgtcaccaagcaattttgtcagcgtccaagtgttttgcctttttcttttccatgcaattcttgtgtgtcgattatctgtcgccttgatgtagcacatttaaattttatgaggaatatacgacaatgcctttcctgt

SEQ ID NO: 16 - DNA, 3303 bp, Hordeum vulgare
agaaagcactcaggggagcgcgtgctccacttctcgccacttttgcccaccaaacgcggctcaaccgccgccgccgccgccgccgccgccgccgccgccggggccttcttcacctcccccgcgggctccggtctctcctcccagttcccacaccagcgagctcggccttcattcctgctctgctcaggttctgtggctttctatgtgtgccttcttcactcaacaatagtctgaaatccgtgccccaaaaacccatgaagaaaatcacaatgttcttgcatcacgcaaacatccagtagcaagttgacgcagcggagtcaccaaaattcttgattctggtatacaccaaccaccgcaaaatccaaaatggcgtccccaaccctaccagttaccctcacatgcctaacactcttagctctcttgtctcttgccatggcggccgataacaacaactccactggcctcatcctcgtaaattgcggagcatcagaccaagaagacgatgatagtggccggacttggggcgaagacactggctccaagttcgcgccgtcattgaaaggagttgcagccaatgctcaacgccaagactcttcgctcccctccacggtcccttttatgactgcacgcatcttcacttcaaactacacatattccttccctgtcaccccgggccgcatgttcctacgcctctacttctatccgactgattatccaaactttgccgcctcagattcctccttcagtgtcagtgtctcgacgccgaatcttgtcctcttggacggcttcaatgcttcgcagacagttcaggcgatcagttctgcctttctggtgcgtgagttctcggtgaatgtttcttcaggcagcaccttggacctcaccttcgccccatcagcacatcagaatggttcctatgcatttgtgaatggcattgagattgttcccacgcctgacatcttcacagcacctgacaccagaactgtcggtgatgacacatctccatacacattcgacaccgccatggccgtccagactatgtaccggctcaatgtcgggggccaaaccatttccccgaaaggcgactcgggcttttaccgctcatggaccaatgacgccccatacatagctggtggctctggcgtaaccttctccaaagatgataatttgaccatcacttatacatccaaagtgcccaagtacacagcaccggctgatgtctatggctcagctcggtcgatggggacaactgcacaggtcaacctgaactacaaccttacatggattttaccggttgatgcggggttcagctacctcctaaggttccatttctgtgagattcagtatcccatcaccaagatcaatcagaggtccttcttcatctacatcaacaaccagacagcacaggagcaaatggatgtcatcgtctggagcggcgggatcggtagaacgacatacacagactatgttaccatggctgttggtgccggtcaggtggacatgtggattgcacttcaccctgatctttcaagtaaaccagagtattttgatgcaatactgaatggtctcgaggtcctcaagctacagaataacggatcaccgaacaatctttctggactcaatcctccacttccgcaaaggccacctgatgccattcccagcgcgccgtctgccggagggaaatctgtcggggctatcgtaggtgcagctgttggtggtttcgcagtgctactggtagcatgttttggcgtttgcatcatctgcaaacggaagaacaacaagaagaagaagatatccaaggaacctggtggtaaatctgaagatggtcactggactcctctcactgagtacagcggatcacgatctactatgtcgggaaacacggccaccaccgggtcgaccctgccgtccaatctctgccgccacttcaccttcgccgagcttcagaccgccaccaaaaattttgaccaggccttcctgctcggcaaaggcgggttcgggaacgtgtacctcggggaggtcgacagtggcaccaaggtggcgatcaagcgctgcaacccgatgtccgagcagggcgtccacgagttccagacggagatcgagatgctgtcccagctccggcaccgccacctggtgtctctcatcggctactgcgaggacaagagcgagatgatcctggtgtacgactacatggcccatggcaccctccgggagcacctctacagcaccaagaacccgccgctctcgtggaagaagcggctcgagatctgcatcggcgccgcccgggggctctactacctgcacaccggcgtgaagcacaccatcatccaccgcgacgtcaagaccaccaacatcctgctcgacgacaagtgggtcgccaaggtctccgacttcgggctgtccaagacgggccccaacatggacgccacccacgtgagcaccgtcgtcaagggcagcttcgggtacctcgacccggagtacttccgccggcagcagctctcggagaagtccgacgtctactccttcggcgtggtgctgttcgaggtgctctgcgcgcggccggccctgagcccgtcgctgcccaaggagcagatcagcctcgccgactgggcgctgcggtgccagaagcaaggcgtgctcggccagatcatcgacccgatgctccaggggaggatcgctccccagtgcttcgtcaagttcacggagacggcggagaaatgcgtggccgaccgcagcgtcgacagaccgtccatgggcgacgtgctctggaatctcgagtttgcgctccagctgcaggagagcgacgaggacaccagcagcctcacggacgggatgctgtcgtcgtcgggcgcgtcgcctctcgtgatgaccagactgcagtccgacgagccgtcgacggacgcaagcaccaccacaacgtccacgaccacgatgagcatgaccggacggagcatcgcgagcgtggactcggatgggctcacgccgagcaccgttttctcgcagctcatgcgtccgggtggcagatgaagttggactctccgcagattcatggtcatggacaacattcttggtccacattcatgttgcaggtgccagtaattagtaattagagtgcgtataatatgatacacgccttatgacaattcaggtacggagccacttattaggactctgtatgtatattgtaccatgtaccagacagacatcatcgtcatagatgtcgccgaggcactggagttgcggttcttactactggttgctggttaatctgaattttttgaatgcaaagccaagatatcccctttt

SEQ ID NO: 17 - DNA, 893 bp, Hordeum vulgare
ctggtggcaagtgacagtgtaacatcacatcacgcagtgacagtatttgccagagcatgaagacgtcctgcttcctggtcgtgcttctgctcgccgtcgccacggggagcaggctctcgctggccgcccgcgaggacggcaccctgggcggcgagctcatcgccaaggccggcaacttcctcacctcggcgggccgcccgggcgcggacggctggcactccgccgcggccgcggaggtggacgcgtcggcgaagaaggcgcacggtcatccggcgggggcgaggaagcggctgaagaaggcgtccgtgagctgcatccccgccgacatgtgccggaggaagaaggtgctgtgcggcaagcggtgctacaagacggcgcacgccgccgccgccgccggcggcctcacccacgtcccctccaaccggtgcgtcgtgaggtgcaagaagtgcgtgcccacctgctagacgcgtgcacgcacgctccttcccttgccgttccgcgttccgtgccgtgccgtgtcgtggtagatccatgcatgttactacgtagctacatttgcaccagttgaataagcaggctggcttcccgcatcatgcatgcatgcaccatgcagtataggtagtgaacgggttctacctctaaggaaacgcgccacaattgtttgccaaaaaaaaaaaaaataaaaaaaaactcggggggggcccggtcccaattcgcctttggggggggatacaatcactggccgcgtttacaacgcgggcggggaaacccgggggtcccaattaattgcttgaggactcccctttgcaggtggggtaaacaaaagcccaccaatcgccttcacattggcaccctatggcgaggaaatggagcctattttgttaaaccggaat

SEQ ID NO: 18 - DNA, 1648 bp, Hordeum vulgare
gaattcggcaccagcaccagaccacaccccaccagctcgccatggctcatggcttgggcatcctcctcctcctcctggcgtcctcgttcgccggctctgccttcgccgccgatgcgacggtgctcagccggaaggccggtgctggcgccattgccggggaggatcccgagctgaaggcggcgccggggaagtacgcggtgatcttcgacgccggaagcacgggcacgcgcgtgcacgtcttccggttcgacaagaagatggagctcgtcgacgtcggcgacgacatcgaggtcttcgccaaggtggagccggggctgagctcgtacgccggacggccgcaggaggccgccaagtccatcacacccctgctggagaaggccaagagcgccgtgcctcgctggctcatgaagaaaacacccgttaaactaggggcgacggctggactcagacttatcggagatgacaaggcagagcaaattcttgaagcagtgagggatgccgtccacagcaagaccaaattccagtacaatcccagttggatcaatgttctcaaggggtctcaggaaggatcttacctatgggttgctctgaattacctgctgggtaaactgggaggagactactccaagacggtggcagtgatcgaccttggaggtgggtccgtgcagatggcatatgccatctcagcgaacgccgcagctgccgctcccacggtgcctcaaggggaggacccatacgtcaccaaagagtacctcaaaggaaaagattacaacgtctacgttcacagctacttgcactacggcgcacaggcttcaagggtagagatcttcaaggccaagaacggaccagtcagctactgcgtgctgcgcggatacgatggcaaatacacctacaacggagagcaatacgacgccatagcagcaccgcaaggagcggcgtacgaaaagtgcagagaggacgtgaccagggcgctgagaatcagcgcgccatgcgcggccaagaactgcaccttcaacggcgcgtggaacggcggcggcggccccggccaggccgagctctacgtcacctccagcttctactacatggcagcagacgtcggcctgatcgacagcgaggcgagcagcgggaagaccacgccggcggcgttcagggccgccgccgaggagatctgcccgatgagcttcctggaggccaaggccgcgtaccccaaggtgcggtccgtggacgcgccctacatctgcatggacctcgtctaccagtactccctgctcgtggacgggttcggcttggagccgaccaaggagatcaccgtggcgcagaaggtgaagcacggggagtacttcatcgaggccgcgtggccgctcggggaggccatcgaggccgtctcgcccaccaagcggctcaacgatgcatgatcttgtacgtacagtattggttgatatgattgctaatccggccctagctcgcgcagtaagggcatctccaatggttgtatgatcatcgttggtaatattgccacatagatgattttgatgacatggcgcataataaaagaagaaagagaatgaaatcgtatgaacttgaagcaacggttcacgcacaagctccgaggcaagcatggttatttcttccatgtttagtggacccg

SEQ ID NO: 19 - DNA, 2325 bp, Hordeum vulgare
gcccgtccgtccgtccccatgccccccgccgcgtgcgccacgccggcggccgcgcgcccgccgctcccggtgtcgcgccgctgcccgcctccgcccccctccgccgcgcacgtgcccgccgcccgccgcccctcctccgccacggcatgccgctgcaccgccggctcctcatcctcccctacggcggcagcggcgtcggcctgggactggacccgctggagccggcacttcgcggaggtggaccaggccgagagctacgcctccgtgctccgcttccagctcgaggaggccgtcgaaggcgaggacttcgccgaggccgccgccctcaagcgcgccctcctcgacgccaccgccggcgacgccgtctcccgcgtcatggccgagctcaagagcgccatcgaggagcagcgctaccaggacgcctccaggctcaccaagctcgccggaaccagcctcgtaggttggtgggtgggatatgccaaggacaccgatgactcgatcgggaggattgtacggataacccctggtgtcgggagatacgtcgccaagagctacagcccaaggcaattgatcactgcatcttcagggagcccactatttgaaatattcctcgtcagagacgaagacgagacgtacacaatgaaggtggtacacttgcgaccgacaaaaggagcttcaagcgcgtcgtcgtccgtgccatcaacagccaccgaagatccagctaaggcagagactgagagttcaccggacagcagtgttttatctgaagccattgcagaggaagcaaacacggataccaaattaaaaggaaatgaagatgtcgaggagaaagcgcaggatactggaagaaccaaggaaagtggcgttgaagggttgaaaagtgttctgaatttttttaagtcccggattcccgagttcaaagttcaagtcataaacgtggaggtgcccgaggaagctgagttagttgcggattcgtcagaagagttagtgcaagatgatgtgaagagcacgtcagagagttcgttggaagagcctgtcgccgaggaattccaggaggaagatgtttccgacggagattcagactcgaacgacgagagtaaggggccggaagtaaagcttttcatcagcggagtagttcataataaagaggaggctggagcaaaatcttatgttcgagttcctgctgaaataaataacctggaaagggactcctttgaactgtacattcctggaaaaggttctgatcgggatctgagtgaaacaaaggccgcgaaacagaaagttgcggatatggccgctaaattggcgtcagagctcatgccctctgatgttgcaaaggcattatggggcaccaccaagagttcctccaagataaataaagaagtccaggagcttttgaagcttacactgagcaaggcccgagtcaagctgactgagaataccattttcaatcggattgttacggactctaatggctcagatccattcaatggtctctatgtaggagcatttagtccgtatggccccgaagttgtacagctccgtcggaagttcggtcactggaatagtactgatgacgtggagtttttcgagtatgttgaagcagttaagttgactggtgatcttagtgtccctgctggacaggtaactttccgtgctaaggttgcgaagggcagtcgtcttgagaatcgtggtgcatacccagaagagtttggtgtgactgctagttataaaggtcaggggagaatagcgcaacctggattcaaaaacccgcggtgggtggatggtgagctgttggtgctcaatggcaagagtgcaatcccgcacattggtggcgccgagctcggtttcctgtacagcgtgcctgagcagagcttcctggttctctttgaccgccttacgcttcccgagtgagcgagatctcgctgatatgagctggttctctcatgggaattccatggagacacaaactggccggccaagtaggttccgcgcggcttctccgtcatcctcatcctcatcctcatccacagagcgagcttcctgaggtagcctggctcctcacaggatccaatcggttcggcatttttgaggatacatagaaagatggcagcctggttcctgggaacatggctggtatattgagctgtcatgtgacgtgctacaacaaaacaaaacttaggctgtcaaacaaggggcgcggttatagacatgtcgggcgcgaccttttcgcgggtttctttcgtttgctcgtttggatgaaaccagttttggtattgccttgatgctacaaaataaaataaaagttgataccatttgtatcct

SEQ ID NO: 20 - DNA, 3484 bp, Hordeum vulgare
ctcccacaccttctccattcttcttcttcttcagttactccactccactccccaccccaagaactccattccatctgcggaggcaaaaaagatccagccggagccggagggcttgctcactagcggccgtccggcgagaggaaccgcccacccgccgggaaggggaaggcacgcggcggagggaggggagatccctgccgccgccgccatggccgacaaggaggccggcaacctggaggccgtcctcaaggaggtcgtcgacctggagaacatccccctggaggaggtgttggacaacctgcggtgcagccgggaggggctcacggcggagcaggcgcagcagcgcctccaaatcttcggcccgaacaagctggaggagaaggaggagagcaagttcctcaagttcctcggcttcatgtggaacccgctctcctgggtcatggaggccgccgccatcatggccatcgccctcgccaacggaggggggaagccgccggactggcaggactttgtgggcatcatcaccctgctcgtcatcaactccaccatcagtttcatcgaggagaacaatgcaggcaacgccgccgccgcgctcatggcccgtctcgcgtccaaagccaagattcttcgcgacggccggtggacggaggaagacgcggccatcctcgtgccaggggacgtcatcagcatcaagctcggagacatcatacccgcagacgcacgcctcctcgagggagaccctctcaagattgatcagtctgccctgaccggagaatcattgccggccaccaaaggcccgggcgacggcatctactccggatcgacggtcaagcaaggcgagatcgaggccgtcgtgatcgcggccggcgttcacacgttcttcggaaaggctgcacaccttgttgactccactaaccaagtgggccattttcagaaggttctgacggccattgggaacttctgcatttgttcgatcgctgtggggatgttcatcgagatcattgtaatgtatcctatccagcacagggcgtaccgccccggaatcgacaacctcttggtccttctcattggaggcattcccatagccatgccaactgtcttatccgtgactatggctatcgggtcacatcgcttgtcccaacagggagctatcacaaagagaatgactgcaatcgaggagatggcgggcatggatgtcctttgcagtgataaaactggaactttgaccctcaataagcttaccgtggacaagagccttgttgaggttttcgaaagagggatcacccaggaccaggtgattctcatggctgctagagcgtctcgaacagaaaaccaagatgctattgatacagcaattgttgggatgctcgctgatccgaaagaggcacgtgctggtattcaagaagttcattttctgccattcaatcctactgacaagagaacggcgctgacatacattgacgctgatggcaaaatgcaccgcgttagtaagggtgcacctgagcagatccttcacctcgctcacaatacatcggagatagagcggagggtccatgctgtgattgacaaatttgcagagcgtggacttcgatcgcttgctgtagcgtatcaggaagtaccagatgggaggaaggaaagccctggtggcccatggcactttgccggtctgatgccactttttgatcctccaaggcatgacagtgctgaaacaatccggagggcacttaaccttggtgttaatgtcaagatgatcacaggtgatcagctcgccattggaaaggaaacagggcgtcgcctggggatgggtacaaacatgtatccttcatccgctctgttggggcagaaaaattcagacgagtccatttctgctttaccagttgacgatctcattgagaaagctgatggttttgccggcgtcttccctgagcacaagtatgagattgtgaaacgcctgcaagcacgaaagcacatctgtggaatgacgggtgacggagtaaatgatgctccagctcttaagaaagcggatattggtattgccgttgctgatgcaactgatgcagccaggagcgcttcggatattgtcctcacagaaccaggcctcagcgtgatcatcagtgctgtgctcaccagccgtgcaattttccagcgtatgaagaactacactatctatgctgtctccatcacaattcgtattgtgcttggatttatgctacttgccctcatctggaatttcgactttccaccgttcatggtcctgatcatagcgattctaaatgatggtaccatcatgactatatcaaaggatcgggtaaaaccatctccactacctgacagctggaagttggctgagatttttacaactggagttatccttggtggttacttggcaataatgacggtcatcttcttctgggctgcgtacaagacaaactttttcccgaggctgtttcacgtcgaaagcctcgagaagacagctcaggacgatttccaaaagctcgcgtctgccatttacctccaagtcagcaccatcagccaagctctgatcttcgtcaccaggtcccgcagctggtcatttgccgagcgccctgggtttctactcgtctttgcattcttcgttgcgcagctgattgctacactgattgcggtgtatgctgactggaagttcgctgcgatcaaaggcatcgggtggggctgggctggcgtcgtgtggctctacaacatcatcacatacttcccgctcgatatcatcaagttcctcatccgatacactctgagcggcaaagcatgggacctcgtcatcgatcaaaggatcgcgttcacaaggaagaaagacttcggtaaggaggagagggagctcaagtgggcgcacgctcagaggaccctccatgggctgcagccgccggacgccaagatgttctcggacaaggggggctacaatgagctgaaccacatggctgaagaggccaagaggagggccgagatcgcaaggttgagggagcttcatacgctcaaagggcacgtggagtccgtcgtcaagctcaagggtctcgacatcgagaccatccagcagtcctacaccgtctgatgatctgcgctgtccacgaagaaaaaaagggggaaattcctaattaaatggctggttaccgacacgagtgaagagtggatctgtgaactcggctactgtaatcgtccgtgtagtgctcgagacataactactgtagtaaaacgttgctcgttggtgatgcagtttggcaccacctaagttatcgcgcatccgttcttcttttgtttgtttttttatgttttcagctagtatgtatattatgtttttccccttcatttttagctcgctaccgacatgtagataaatctagtatggtggcatgtgaccttcttcggtgcatggtcatgaaatgcttccttcctggagtctgtctgctttcagatctgtaggtgtggtttggctcaaatatatttacctgcc

SEQ ID NO: 21 - DNA, 1522 bp, Hordeum vulgare
cggcacgaggcgcagtttctcatcgccccgtccaaaacctttctccttctgtcccgcaaacccccgagagatcacaggatgttcggcttcggtcaccacggccaccatggccagaacccccccgcccacgctccgcccgccgccggcggcaaccagcccaccttcaagatcttctgcaaggccgacgagggctactgcctctccgtccgcgacggcaacgtcgtcctcgccccctccaacccccgcgacgagcaccagcactggttcaaggacatgcgcttcagcacccagatcaaggacgaggagggtaaccccgccttcgccatcgtcaacaaggccactggcctcgccgtcaagcactccctcggccagtcccacccggtgaagctggtgccattcaacccggagttcctcgacgagtccgtgatgtggacggagagcggcgacgtcggcaagggcttccgctgcattcgcatggtgaacaacatccgcctcaacttcgacgccctcaacggcgacaaggaccacggcggcgtgcacgacggcaccaccgtcgtcctctgggagtgggccaagggcgacaaccagagctggaagatcctcccctggggcgaagaggcctacgccggaggcagcgccaacgcaccacgcggcggctcctcagagcccaccgtgcgcatcttctgcaaggccgacgagggcttcagcgccaccgtccgcaacggcaccgtcgtcctcgcacctagcaacccccgtgacgagtaccagcactggttcaaggacatgaggcacagcaaccgcatcaaggacgaggaaggctacccggccttcgccctcatcaacaaggtgacaggcgaggccctcaagcactcccaaggcgagggccaccctgtgaagctggtgccatacaaccccaactaccaggacgagtcggtgttgtggactgagagccgcgacgtgggcgccggcttcaggtgcatccgcatggtgaacaacatctacctcaacttcgacgctctccacggcgacaaggagcacggcggcgtgcgcgacggcacctccctcgtgctgtggaagtggtgcgagggagacaaccagcgctggaagatcctcccctggtaaacgtgtcatgctgctgaagctgcattgatcgccaccgggacacggagttggtagagatcagcctgtgatctgttgccgtgtcggtagaataaaagtcgtgtgcggtcggtggtggtgatgcgtccgtgagtttgtgtgtttagtttctgtcctgtcgttgtgtcctgctaatgcgagtgtaagcatttggcacctgtgcttgtttttcagaccatggatccgtgatgagaacctctgtaccgtggcgtcatccttgcctctatgcgaatggtatttactgtctatctacatcggtgcggatttttggaacctatgtgcaggcttcagccgattaagtaaaaaacaattaaaagtagtaaaaagaatcagaaaatgtgaaacttttatcaaaaaaaaaaaa

SEQ ID NO: 22 - DNA, 1866 bp, Hordeum vulgare
cgcgtccgctccccttctcctgctctccctcccagcggcgggcgcctcgtcggtggcgagcctcgtcggacgcgctcctcggcggcgtcgggtacctccctcctctcactcccgcacccaaaacttaggcaccaacgatactccgcactcccccctgccgccgggatgacagaggacgtgcagatgggcgagcctcagtcggcccctcctcccgccgccgcggcggcgccggccccctccaccctccaacatctgaaggagatcgccgcggtgatcgaggcggggtcgctctcgaaggaggtacgccggatctcccgcgccgtccgcctcaccgtcgccctacgccgccgcctcgccgcccgcgacgtctcggccttcctcgccttcgccctcccggcctccagcgacgcgtacgcccgcctcacccccctcctccccaaggaagatgaagctgagatggatgttgatgcagcagctccaccaactcagatttctatcaagcatggccttcctgagattgaaatatattgttctttgcttgtcctgattttcctcattgatcagaagaaatacgatgaggctaaatcatgcgcaactggaagcattgcccgtctgaagaacttgaacaggagaactgttgatgttttggcttctaggctgtacttctattattcgtatgtgtatgaacttaccaacacccttgctgaaattcgtggtaatctccttgggttacatagaatggcaactttacatcacgatgagcttggtcaggaaaccctgctcaatctgcttctccgcaattacctccactataacttgtatgaccaggcagagaaacttaggtcgaaggcaccacgttttgaagcccattccaaccagcaattctgccggtacctcttctacttggggaaaatcagaacaattcagttggagtacactgatgctaaagaaagcctcctgcaagctgctaggaaggcaccggctgcagctcgtggctttaggattcagtgcaataaatgggctatcatagtaaggctgcttcttggggagatcccagagaggactgttttcatgcagaaaggaatgaaggaagctctgacaccatattttgagcttacaaatgctgtcaggattggcgatttggaactgtttagagctgttgcagacaaatttgcaagcacattcagtgcagacaggactcacaatttgattgtgaggctccgccacaatgtcattcgaactggactacgcaacatcagcatttcatactcgcggatctcccttgctgatattgcgaagaagctaaggctagacactgggaatcctgttgccgatgcggagtgcattgtagccaaggccataagagatggtgctattgatgccaccatagaccatgcaaatggctggatggtgtcgaaagaaactggtgatgtctactcgacaaatgaaccccaggctgcattcaactccaggattgcgttctgcctcaacatgcataatgaagcggtcaaggccatgaggtttcccccgaattctcacaaggagaaggagagcgctgagaagcgccgagaaaggctccagcaggaggaagagctggcaaagcacatggctgaggaggatgacgatgatttttaagttggtccgttttttgaattgttgattttagatccctgaaatcactgaattgtcccctcaagggaggtttgaatcttgtaaactttttacatcttctgtaattctatgttgatcagcacttcattggaccgtaaatgtgttttgagtttatcttttctcttcctcgtcgaaactgggtttgaggatcgctgtaccatttgaacccgccttgtccattcaagacttttgtta

SEQ ID NO: 23 - DNA, 1799 bp, Hordeum vulgare
ccatttcgcccactcccaccttcgtccacacacacacacacgcattccacagccaccagccaccgaaaaagccccaatcccagcaaccacaaacactcacgtgagttcgagcgaggtaagcatagatccgagcgagttcttgcgtcgccaaggtaaggttctctgagtctcaacccctcttcctccctcccctgttcgtccccttgttcacccagcagacagtgaggtctccaggacgttttagatcccgggctccagatctgctctttttttcttctgttttagttgtagtaatcggccaggcgaggttctttttccacacctccttgctcgtcgtgtctagatctaccaccaacgccatctctttttgctgtggccgttgttgatttttctctgcctgttctaggttttggtttggaaaccaggcagctttctttcttgttcatctttccaagaaaacaaaacaaaaaaacaccaaaaaaaatccctagatggctgcagctatagatctgtccggggaggatctggtgagagcactcgagccttttatccgagaggcctctgccccccctccgctccactcccatcctagtcccacctcgccattctccttcccccacgccgcctacagtggttacccgtacggggtgcaggcacaggcccagaccgagctcagcccggcccagatgcactacatccaggcacgcctccacctccagcgccagaccggccagccgggccacctcggcccgcggccccagcccatgaagcccgcttcggcggcagcggccacaccgccgcggccgcagaagctctaccgcggcgttcggcagcgccactggggcaagtgggtggcggagatccgcctcccccgcaaccgcacccgcctctggctcggcaccttcgacaccgccgaggaggcggctctcgcctacgaccaggccgcctaccgcctccgtggcgacgcagcgcgcctcaacttccccgacaacgccgcctcccgcggcccgctccatgcctctgttgacgccaagctccagaccctctgccagaacatcaccgcttccaagaacgccaagaagtccgcctccgtctccgcgtccaccgccgcagccacgtcgtccacccccaccagcaactgctcctcgccgtcctccgacgaggcgtcgtcctcgctcgagtccgccgagtcgtcaccatcacccaccaccaccgcagcagaggttcctgagatgcagcagctcgacttcagcgaggcaccatgggacgaggcagccggcttcgccctcaccaagtacccgtcctatgagatcgactgggactcgctcctcgccaccaattagcacccagttcatcttcgtcagctactactaccagtaccgtcttttagcgtgtcatgatgctaggttaatgggtcgccgcgatgcagatggcattttagacattctgcgccggcctttagcggattagctctaagtctctaatccttgttcattgtgtagacctatgattcgttctctttgtggtagggtttggttagtccctcccggatgactataagccggcgtttttgtgcccggcgtctccggtggtcggtcactggtcagtgactccggccggtgaagtctgtccattgttctagctaggtgctgttccttccgctgctctgcagattgtaacagtgggagacttgtcatgtaaaatcagctcatcaaaaaatcgtgtaatgtggaatattattttgttgttaaatgttccttcttgttctgtaaattccatcgaagtcatcgtttttctct

SEQ ID NO: 24 - DNA, 474 bp, Hordeum vulgare
tcggcacgaggcgacagcttaagcttctgagccttccagtgccggaacagagcagcatataagaatggcatccctgaaggccgtgaagccaaccggacttgaagggcaggccaaggagcctaccaaggttagtgccactaaggggcctgcaaagctcagtaacacggcgaccaagccagcagccgccaagggcggcatcaagaaggctgagtcaaagccacgggagcctaagaagagggtcaagagcaccaagccagcagcagcaaaaaactgacaacggcagcaggagaacggagcttgcatagctatctccatggtgctatgaattatatatgaatcctgcctttcccttcctctgtctcccatgatattgatcatgcctacacagggtgtgcgcacaatccatgtgacgaatattacaaataagacgtgtagttctgccatctgcttcatcttattctcccaaaaaaaaaa

SEQ ID NO: 25 - DNA, 2216 bp, Hordeum vulgare
ccacttcgcgttgccttgcatcgcaaggggaagtaaatcatggcgacaggtcaaattttcccgaaaactacccaagcgctgttctataattataagcaacttcctatccagcggatgcttgattttgacttcctctgtgggagagaaacaccttctgttgctggaatcatcaatcctggttctgatgggttccagaaacttttttttggacaagaagaaattgctattccagttcatcctacaattgaagctgcttgcaatgcacacccaactgcggatgtgtttatcaactttgcatccttccggagtgcagctgcttcttcaatgtcagctttgaagcagccaactatgcgagttgtagccattatagcagaaggagttcctgaatcagatgcaaagcagctaattagttatgcacgtgctaacaacaaggtcatcattggacctgcaacagtcggaggagttcaggctggtgctttcaagattggtgatactgctggaaccattgacaacataattcaatgcaagttgtacaggcccggatcagttggttttgtgtctaaatcgggtggcatgtcaaatgagctgtacaacaccattgcaagagtgactgatggtatttatgaaggaattgcaattggaggagatgttttccctggctcaactctttcagatcacattctgcgttttaataacatacctcaggttaaaatgatggttgttcttggggagcttggaggaagtgacgagtattcgctcgtcgaggccttgaaacaaggaaaggttcagaaacctgttgttgcttgggttagtgggacatgtgcacgtctattcaaatctgaggtccagtttggccatgctggtgcgaagagcggtggtgagttggaatccgcacaagctaagaatcaggcactgagggatgctggggcagttgtccctacttcctttgaagctcttgaaagtgtgattaaggagacattcgagaagctggttgaggaaggaaatattcctcctgtccctgaggttacacctccccccatacctgaggatcttaacactgccatcaaaagtgggaaggtccgggctcccactcacattatctccactatctctgatgatagaggtgaggaaccttgctatgctggtgtgcccatgtctacaattattgaaaggggttatggagttggtgatgttatttctcttttgtggttcaagcgcagccttcctcgttattgtacccaatttattgagatatgcgtcatgctttgtgctgatcatggtccttgtgtatccggtgctcacaattctatagttactgctagggcaggaaaggaccttgtttccagcttggtatctggattgttgacaattggcccccgatttggtggtgcaattgatgacgccgctcggtacttcaaagatgcatatgataggggtcttacgccttatgaatttgttgagggcatgaaaaagaagggaattcgtgtccctgggattggtcacaggatcaaaagcagagacaacagggacaagcgagtgcagcttttacagaaatatgctcacgcacacttcccttcagtcaagtacatggagtacgctgttcaggttgagacctacaccctgtcaaaggccaacaatttggttatgaatgttgacggtgccatcggctcgcttttcttggatcttctttctgggagtggaatgttcagcaagcaagagattgacgagattgtagagatcgggtatcttaatggactctttgtgcttgcacgttcaattggcctaattgggcacacctttgaccagaagaggctcaagcaaccactctatcgtcacccttgggaggatgtcctctacaccaaatgaggcaccatatagtgtattccacctgtgtgtacaccataaaaataaaatcgagcataactgcatagaattcaagatggaactacgcaaggagggatagagaaccattacagatggaagtttgtttcatttttttcattcaaccatgaaagcattagggcatcagatatttgaaaggatacttgatagttgtttcatcttatcatagttggctgttaaatttagttcagacatttggggaatattgtaatgattatgatgctagttccccatcacaaaactctgaattatctattgtcaattttatggtaataaaatatacatgtgttgctgctggatatttcaattgattt

SEQ ID NO: 26 - DNA, 1578 bp, Hordeum vulgare
cggcacgaggcgcacaggcagcaaaggagcaggcaaatctcccgcaatggccgccgctgcatcgtcctcctcccctccggcggccatcacctgccgagcggcggtggcatgggggccggggcaggcgctggtgatggaggacgtggaggtcgccccgccggggcccatggagatccgcgtcaaggtcgtctccacctccatctgccgcagcgacgtcacccagtggcagtccacggcgcagcccgatctgttccccagaattttcggccacgaagcatccggggtggtcgagagcgtcggggaaggggtgaccgagttccaagccggagaccacgcgctcaccgtcttcatcggggagtgcatgagctgcaagcactgcgtgtcggggaaaagcaacatgtgccagaggctcggcctggagaggaagggcgtcatgcacagcgaccagaccacccgcttctccatcggcgggaagcccgtgtaccactactgcgccgtgtcgagcttcagcgagtacgcggtcgttcactcgggctgcgcggtcaaggtcagccccgccatgcccatggacaggatatgcctgctcagctgcggcgcctccgcaggccttggtgcggcttggaatgttgctgatgtatccaagggatcaagtgtagttatatttggtctgggaactgtaggactttcggtcgctcaaggtgctaagctacggggagcttccaagattatcggagtagataccaatcctgataagcaagaaaaggggaaggcttttggcgttacagattttattaatcctgccgaattgaatgaacctgttcagcaggtagtaaaacggcttactgatggaggggctgattactcttttgaatgtgtgggtgatacgggagtagtctcgactgcgttgcaatcatgttctgatggatggggactcactgtaactcttggtgtaccaaaagcaaaaccagaagtttctgctcattatggattgcttctctctggaagaacactgaaggggtctttgtttggaggatggaggccgaaatctgatacacctttgttagtggagaagtacacacacaaggaaatccaaattgatgaccttgtcacacatgatatgccattcagtgacatcaacaaggcgcttgaactgatgctagaaaacaggtgtttgcgatgcgtgattcacatggcaaagtgacaggattgatttatacatcaatgtcatcatacctgtacaattttggtggttttcttatcagtaatttttcacttgatcttgctcctggctcgagttttcatgacatcaacacattgaagctctaacaccactatatctattggtgtctcaccttggaattatggtgttatagttgtcgaggagattacgtatcatactgatattctcttggaattccttatatgccccatgccaagaattattcgtgtaatctaacttcagtgattataatgttgtatgcatgttcggtgcattgtgcagtattgttataatatctgagcttcttgatgggatgaattatgtaaaactgactgttctaaaactgaaaataaaattat

SEQ ID NO: 27 - DNA, 811 bp, Hordeum vulgare
aagtgtagccggcatcctcctctctacagttaatacagtaccatggcccccgccgtgatggcttcgtcggctaccaccgtcgcacccttccaggggctcaagtccacaaccggtctccccgtcagccgccgctccagcgccagcctcggcagcgtcagcaatggcggaaggatcaggtgcatgcaggtgtggccgattgagggtatcaagaagttcgagaccctgtcttacttgccacccctcaccacggaggccctcctgaagcaggttgactacctgatccgctccaagtgggtgccctgcctcgagttcagcaaggttggcttcgtcttccgtgagcacaacagctcccccgggtactacgacggccgatactggacaatgtggaagctgcctatgttcggatgcaccgacgccacacaggtgcttaacgaggtggaggaggtcaagaaggagtaccctgacgcttacgtccgtatcatcggcttcgacaacctgcggcaggtgcagtgcgtcagcttcatcgccttcaggccaccgggttgcgaggagtccggcaaggcataaactacgaggtgaaacaatggcctatgtcgtatgaaggtcttctgtgaacttcacttttgtccatgactctgctttccgactagagcataattttcttctctatgatctgtgtatgtacgagcataggttgtgcagcatatatgcatatgtaaattctagcaccgcctacacatatccaacacctgtgtcatatttatctttacctaataataaagaggctattaattccgtcggaaaaaaaaaa

SEQ ID NO: 28 - DNA, 766 bp, Hordeum vulgare
gtctctccctacgaacgcagcacgcaacgtgttggagaccacggcctagaccttgaaacctagaaaaaaatcccatcgatccagctttgcggcgaggcagccaaccagcgctcatggcggtggaggagataacggagggtgtgaggggcctcaaggtggaggacggcgagggggcggccgctccgcccgccgccgccgccggcggcggcggcggggacgggccgaggcggggcgccaacggcagcagcaaccgcatccaggtgtccaacacgaagaagcccctcttcttctatgtcaacctcgccaagaggtatatgcagcagcacggcgacgtcgagctctccgctctcgggatggccattgcgacagttgtgactgtggcggagattctgaagaacaacggccttgctgttgagaagaagattaggacatccacggtggaaataaacgacgaatcgagaggccgcccattccaaaaggctaagatcgagatagaattggggaagagcgagaaattcgacgagttgatggcctctgctgctgcagatgccgaagaaggcgaggaggaagcctgaagaaccaaacagagccgtggcgaccgcgtccagtcgctatactttgttgtcatcattgttgtttaaaacttggaagaccaatgcgtcgcgtgttcttgtttaacttgtactgtattgtcgtagtgtcagtgtttgtgaactctttggcagatgataaatctgtttcgcatgcatttctttccccgaactgc

SEQ ID NO: 29 - DNA, 730 bp, Hordeum vulgare
gtgtccgtctacaagccgcgctcctacgaggtgctcgtctccgacgccgcccgctccctcgccgccgccatcgacgacggcaggacccgcctcgagatcgagttcccgcctctgcccagcagcatctcctcttacaagggctcttcggacgagttcatcgatgccaacgtccagctcgctctcgctgttgtaagggacctcaagaagctcaaggggactcggtcctgcatagtgtttcctgatcaaccagagaagcgaagggccgcgcagatattcaaaacggctatagatcagatcgagggtatatcaatcggttcattggatgatctgcccaccgggcctgtcgataccttcttcaaatcgataagaattacccttgatttcgatttttctgatgacaacgaagatcgatggaagtctgacgaaccaccacaactatatatctttatcaacagcagcacacgtgaccttgcatctatagagaagtatgtggaccaatttgctgcctctgtacctgccgttctctttaaccttgaactagataccttgcgttctgacttggggcttctgggattccccccgaaagatttgcattaccggtttctttctcagttcaccccagtattttatatcagacagcgtgactactccaaggacaatgcagttactccatacatagtgaactacagtggcgctgttttccgtcatacccagggcgctggcaagtcat

SEQ ID NO: 30 - DNA, 645 bp, Hordeum vulgare
gcgccgggccgtggtttcatggccgccagtacaccaacaatagggttgtcgagctccgttcgcccatatatacccaccctccccgcttggcagctccactgaactcacccacctctcccaccgccaagagcagcagcgaactgcgaattctagctctgaagcagctcaagatcgggcttgccagaagaagcctttctgagtaccatggcggcatcagtagcctgcgccttcttcttcgacgccgagccggtcggcgagcccggcaaccacgcgctggacgcgtgcgcgctctgcaccaagccgctggcgcgcgacagcgacgtcttcatgtacagaggggacacgcccttctgcagcgaggagtgccgccacgagcagatgcacctcgacgccgtctccgccaggcaggccgcccggaggcagcagcggttctcggcgggagcagagtccgggtgtgcgcgccgaggggtatccgtcgggagctgaccggcgagagtggcaggctgcatacgtgcctgacgaagaaaggttattatgcttgagccagcatggtctccgggcaccaagccgccggtgtccgtgcctccgtggctagctgatcgagtagcgcgaggacgaggaggcttgccttgcttgaagaagcac

SEQ ID NO: 31 - DNA, 679 bp, Hordeum vulgare
cgagacttgagaagagtcaagagagctaccgaggaggcacttgcacttgccttctacggcactaccaccagtacccaacgcaagcttctcggttctcatctaggaacaacaatggccgtcacttctctgcagctgccctctccgatccactggcttactcctgctagaaatggctgcacccgcacaaggccgcgcgctactcttgttagctgtaaacataaccagtcaaccattgtccaagaagcaagcaggacatctcgtagaggtaccgtggcatacatttcgtctgctttgtttgcaatgttcatggtggctgaacgtgctgaagcaagaacctccaaacaagagaacaagaggaaagtaatggagaagctggagaagatccgggaggaggcactaggctcaaaggagaagaaagagaacacgagtaaggagtctgtggcgaacttgctaatccctcctactttggtcgatgcttacatctgaaaggcatcgtctcgttaatttttatgtttatgctaaatgctacttaacacttctaaatgtaaaaaaaggcagcccggtgcatgtagcttcgcccggtgctacttaacacttctgaatgtactagtaacaattgagaccagacaaccttgcaaaataactttcctgtgtcttcaaaaaaaaaaaaaaaaaaaaa

SEQ ID NO: 32 - DNA, 1207 bp, Hordeum vulgare
atctcaaactctgcccccgtgcccccgatgtcgagcagcctcttcctctgctcttaccaggtgcgctatgccagcctcccggcacctctccggcagccgggccgccacgccgaccggctgcccccggcggctcccgcgttcgtctctcgcagccttcatcgccctcctcccctccactggaccggctcgggggttcggatgatttcttcttgcttcgtggtcaaaagaagaaggcgtaggaacggtatccacgcctctttgtttggcgttggagctcctgaagctctggtcattggagtggtcgccttgctggtttttggccccaagggtctagcagaggcagccaggagtttggggaagactttgcgtgcgttccaaccgactatcagagagctacaggatgtatcaagggatttcaagaacactcttgaacgagaaattggacttgatgaggatcccccatccatgagttataggcctcctccatctatgaataatagccaacagcctgctgttgacccagatgtcaagcctgaaacaaccgtgccttacaccagcgaggaactcatgaaagtaaccgaagaacagctggctgcatccgcaattgctgcttggaatgcacagcaacctgcctcatctgaacagcaagaagcagcagcagcagcaataacaccttctcaaagtagtgacttggcattatcaggaggaggtagtgatggtcctggtgccgtgacggaggagtccaactcagaagcagcagcagcaacaacaccttctcaaagtagtgactcaacattatcaggagggaatgatggtcctggtgccgtgacggaggagtccaactcaggtaatactgagaatgcaaagctgagagatgaggcataatactaaaaacagaaagtatgttgtatgcggagtagagcaaggcggaagctttggcatcaattggttgtagaaagaatgaaatagttttggtttccatttggtaagctgggttggccaagtgatgggtgattcgaggcttcggttagtagcggcttggtctgttgtggtgtgtagcatggagagataggtaggtgatgcgaaaccgagctgtgcatatcttggtcctcctccaatgtcctatttttgccacggctgttgttacatgtctgtaccatatttgtgattatgcaaaggtaagcagatagatttttgaaaaaaaaaa

SEQ ID NO: 33 - DNA, 863 bp, Hordeum vulgare
ctcgtcgctcactcatcacccacactcccactgtgctactcccaccttatctagctcctgcgtctcggctgcagcttgaagctcgaccaggatggccgagccacggaggcgcagggcaccgcggacgcaggtcgccgccctgctcatcgtcttgctcgccgctgcctccctgctccaggccggcgacgctgcttcagggttctgcgcgggcaagtgcgcggtgcggtgcgggcggtcgcgggcgcggggggcgtgcatcaagtactgcgggctgtgctgcgaggagtgcgcctgcgtgccgacggggaggagcggcagccgcgacgagtgcccctgctaccgcgacatgctcaccgccggccccaggaagaggcccaagtgcccctgagcccggtgaccaccctctcgtccctccaccgtctctctcaacacaccaccaccgtcttcaacctccaccctacggtaatatattgtcatgtcggacgtgcgtgcttcagtgcttgtgttgtgtagcctccctgtggtcgtgctgattattggcgcgtgatatgtcgcgcgtacgtacgtacgtacctgtagttgcctgctatgctaaagtacgagtatatgttatcgttgtgctaggatgccgagtgagcttggtgcctgtaaattcatgcccatcggtgccaccatgtctcgtatgtataagttgcctgctgttcgttttaaccggtatttctctgtatgtcactctctgagtgctgaggcatgtgggccatgcatgtatataagcgacgtggcatgcgatcgggctaccaagtcagtaatgagatgatcatgtcgtcgttgtcgtcgtctttgtaagtgtcaccttgcacatg

SEQ ID NO: 34 - DNA, 1379 bp, Hordeum vulgare
ccgtccatacacaccgccgcggcggatagagttgttcttccagaggcggacgccgcgccagcgccacggcgaggcacccaccaccgtccaccgccatgctctccctcctcccgcccgcgcggctccgcgccgcgccctccgacgtccccgtcaccgcgccgcgccgccaggccgtcatcctcccagggctcgggaacaacacgggcgactacgcgcggctgggcgcggcgctgcgggacggccacggcgtgccgtccgtcgtcgcgcgggtgtcgcgccccgactggctccgcaacgccgccggcctcgccgaccccagctactggcggggcaccctccgcccgcgccccgtcctcgactggtacctgaaccgagtggaggaggcggtgtccgaggccagggagctaggctctccagacgggaagctgtcgttgatagggcattcagctgggggctggctcgcgcgcgtgtacatggaggaattcgggacttctgacataagtttactgctcacgcttggcactccccacctgccacctcccaaaggtgtttctggcgtaattgaccaaactagaggactactgaactacgtcgagaagaattgtgcccctgcagtttacacaccagaactacgatatgtatgcattgctggaaggtatattcagggtgctcctttaactggaagctcccttgctgctaccacagatgagcttgtcgccgtggatgccccgtcagaagtagctgaagcagtcatggtcagtgccgataacaaaaccgctccgacaggccccaccttccgggcccgtttcgtcggacaaggctacaaacaggtttgcggccgcgccgacgtctggggagatggggtcgtccccgaagtgtcagcgcatctggagggcgcactgaatataagcttcgacggcgtgtaccattctcctgtaggttctgatgatgaagagaggccctggtatggctcaccagcgatcctagagcaatgggtgcaccatctccttagttgattccacagaagctttaccaactccaaaagtttgtcaacaaaatggtgtactgccatgccccttttcactagtgaacagcacagcataacatcatatatacagtaatcatgtacagaagatgcagctgtactctcttctcatactgttccagagtgcgtctagatgtctcaggcctcggcgctccttgtatcgtgtaaccatgattctcaaaaaagaagaaaaagatgcagtctgtgtctgtacacagcttaggccggtgttttcctttcccttttgacaaattgttacactgtagtataacattgcgcaatgttcaggcccattcaatatgtatgaaattgcatatacaatgcgagctaaaaa

SEQ ID NO: 35 - DNA, 1865 bp, Hordeum vulgare
cggcacgaggctctcacctgctactgctagctagcccctccggctcaacggaagctagcgatcgccatagcctctgcgacttgccaaagctagcacgggcgctagaacaagaagaagaagcagaaccagaggcgcaaaaggctttgcgtgtggcctcaaggaaccccgaaaaggccgagaaggaaacaagataaaaggtaatttgagcagggggcaacgatgggttgcggcttgtcgacgccggacaacgaaggcggcggcacgcggaggaaacaggggagcgtcggcgacgtggtcgtcttcctcccggggctccggacgccgacgggcgtggacctgtcccagccgctcgccgggcgcctggaaaagggcgccgtggagaggctgtcggcgctgagagcgcgcgtcgtcgacatgacaatgcaagaatcggcgtcggccctcaaaccgaggcggaaggccgccgcacggcacggatctagcaccgctaacctcctgcaggcgctggaggactacctcccgcttctgctaggattggtgagagatggtggtgagttgaggaacagcgtggagtttgtgtggactaaccaagaggacaaggcagaggagacggccatggcggatgcgtggtacgaggtgctgtccgtgctgcatttgatggccatggtctgcttgctgcaggccaactcccttctccttccaagggcttacggcgacggttacgggccacgggtctctgaagagagcagacgcgccactgtcgacgttttcttgaaagcgtctggctacttggactgcgcgattcgacaagtgctcccacagataccaacagaactaaggagacaacttccagttgacctggctgaaggcaacctcaaagctcttagcctgcaagctctgggtcagggtgttgacatgcagcttgggctggcaatcgatagcccaaaggccacactagctgtaaaaaggcgcttagcttgtgagatggtcaaatattggcaccaggttcaggagagcattccagatcttcccgtgtctgacggatgggggaaaaaacatctgctatttgtcaagtggaagtacgtcgaagcaaagtctgcagcatactacttccatggcttgatcctcgacgaaggaaacagcgagaaatctcacggaatggcaatagcagcattggaagcttcagaggaatttctgaaagaaagcaaaagggcctctgaagccttccacgcaactcctccaacatctaggagccccactccattcggaacagccaagtatctgtttgacaagatcccgaaagaggcttcaagcaaggtccggatcaaccaggatctgtatactccagaaaggatcattggagcaccacccccattgccggatttctcgttggcactaacacctgaagactacgatcttcctccattagacccactttggaacaaagaagacggccaccagtaagtgtatattcagcattcagcaagagtgccttctgatgggaaggctctggcactactgagaaagcaacgaccaggattctgccatgcggaggccgaacacggcgcaaacgaagtgtacaaagatatgttgcaacaaaaaattggtgtcgacaaattggaagcaaattttagaaaggcctgaagatatctcaagagcatttttacagttaaatcttctctgacaatgggaacgcattgtcaaaagctttccaacaattcctgtaaaaattaaatttgcaatgagcgccatggttcctttttcttaggattttctggccatggcttagttttggggccattctgagcctgttgatgtggtaaatttaccaaacatgatcatgattttcattcaatgcttgagac

SEQ ID NO: 36 - DNA, 1254 bp, Hordeum vulgare
gtgagctctagctcgggctccccgtgcgcccaccgcgcgcgctccactcacttcctcttcttcaccccaccaccaccaccaccaccactcggtttgggtcgcattcatatcgcttactccgcactccactcgagaatgcagcagcagcagcagacggcgcggcggcggcggagcccgggcggcggggagtgggagggggcgggcacggtggacgaggcctccatggagcgcagcaagagcttcgtcaaggccctgcaggagctcaagaacctgcgcccgcagctctactccgcctccgagtactgcgagaagtcctacctcaacacccaccagaagcagatggtgctggacaacctgaaagactacgcggtgcgggcggttgtcaacgccgtcgaccacctaggcacggtggcctacaagctgacggacctgttcgagcagcaggcgtccgagatctcgacattcgagctcaagcttgcgcgcttgaaccagcaagtcttcacctgccaagtctatgtggacaaagaagggtctaggcagcagcaaatgatgggggcgagcatgaaacaccacaagcactacatcctaccctctacgggttataagagaactcaggctgtcgtgcacctgggaacagacactaatcaggaatcacagcctagaccttacccctcagcaaagacactttcctggcatctggcatcagacaatagcccttcagcagatggagcaaacaaacctacattcatcctagacgacacgatatcgtccaaacccgcatcggatggtttgcatcttcttggtaaggagttgcctggttctcccatgcgcaggcctctgcaactgaacaggaataccaaacctgacgttatacaaaaggctggcacaaaggatcagacaggtgtcaagcatatgtcgacgtttagttctttcgacaggcctacagggcgtgaaatccagaaggctcctgccaacactaagagcgtgctagcatctctgtttatgaaacacaagtcggcaaagatgaaaagtatctcagcccgatgatcctctgttgatgtaaatgaagtttgttgtaataatcagtacaagctaagtaaaatgcagttgtatctctttaagatgacaggtcataatatctcttatctgtataatatgtgtgtgctgattcgaagacttgtgaaaaccatacttttgtagtgttacaagtttaggtatattcacatgaaatcgtgatattccttgatatggtca

SEQ ID NO: 37 - DNA, 1299 bp, Hordeum vulgare
cggcacgaggcaagctccatcagtggctggctccgctctgcctctctctctctctctctctctctctctctctctctctctctcttccctgagctctctgtcactccatgagtccatgtccatgcacaggtaaagctgccgcgtcctagaagatccaggcgatgggatgaggcccactgcggcagcaaccggaccttccttcttcctccccagatgccagtcggtcccggccccggcatcatcaagggcggcaggagtagcagcagctgccgatccatgcaagccgcccaacaaggcgatccggtcatggcgagccgcgtcggcaggcagcaacggcggcgacgagcgcggccagtccgtgtcgacggtggcgacgacaccgtcgggaaggcgggcccggctgtcggcgaggcggcgggagagcatcaggctcctggacgcgctgccggaccagggcggcatcggcgagttcctgcggcaccccgccggcgtggagtccctgctcaacacccgggcgctgcagagcttcgcgccggtggagtcggagtcggacggcaccttcaggtgcacgctgcaccccatgggcttcctcggcttccaggtcgcaccggtcctggacctccgcgtcaccccgacccgcgacgactgcaccgtcgagatgctctcctgcaggtttgagggttcggactccatcgagcagcagaatgagctcttttcagcggtaatgacgaaccgaataacatggggagacaatggtgatgaggagccatgcttggacatcgatgtcaatctggaggtcaccctggaggtgtacacgaagccattcagcttgctcccgctgtcggcagtggagaaaccaggcaacctgctgatgcaagggctgcttgacaggcttgtgccgatgctgggtgagcagctgctgagggactaccattcctgggttcagcagcagacccagtcttcctcctcatgactcactgtggaaagtctgaaactaacactatctacctagcagattcctgggcttcatggccgggtcggttttcatcaaatccagccggctgcaccaccaaggaagaatcacgaggaaaacaatcatacatacacgcagcgtgggttaatttgtggatgtggattgatgcttgcatgatacaaacccactgtacgtagagtataatagagtagaattggccagggatagtctttccgaaacagagacaagaaaatggggatagatatgttcaacaatcatgatgcaaaccttcaagatcgctgatgtgaagatgttattcaattcca

SEQ ID NO: 38 - DNA, 924 bp, Hordeum vulgare
caccttcttctacttccctccatcagctcgccatcattcacacaccaccgcatgcagtaggcagtagccacactccactgccatcgctctcacgcacacacagcatcaccggcttacctacacggcactcccgtcgctctcagctgccatggcgtcctacaggctgctggtcatcctcgtcttctccgcgccgctcctcgacgccgcagccgccgacacctcctaccaggccgactgcccctacccgtgcctgctgccgccgcccacgccgccggcctccaccgccgactgcccgccgccgccctccgcgccgtccggctccggctacgggtacccgcccccgtcctcctccgggaacgcgccgccgtcgccctcgtactggaacaaccctccgccctccggcggctacattcccggctactaccagcctccctccggcgggggtggcggaagaggcggaggcggtggaggaggtggcgggaactacgggccggcgccgcccccgcccaacccgatcctgccgtggtacccatggtactaccggtccccgccgtcctcatccgcggtggcaacaacggggagcgcgtgggcggccgtgctctgcttggtggccgccgtaactgccgctgctgctctcgtcggttactagtacggtcatcatcgatcagttactagctatactttcagttcgtagtccatcaattcttgatatatacttgatgtataagataatggggtgccattattattagccatgcataatatctactagtatccatcgatggtagtactccctacatattgattcattgctcagttggcttttgggtggtgagtggagcgagcaactatatattgctggtgctggctagttttcttgggagcataatatatgtggctagctggtgatctcaaaaaaactag

SEQ ID NO: 39 - DNA, 1529 bp, Hordeum vulgare
aaaaaaaggtaccttcatttgttaactcgcacagcttagcgcagcaatgccggcgatggcgtcactaccgccaccggcgccggcgccggccgcatcgcgtcgccggaggttctccaccgcgtcggcgtcgctgcgtcgcgccgcatccggagggggctcgagctggcggggcgagcggcggctcatgtcggagctggagcgcacggtgacggcgggcgccgcggagcgcgtcatccgcggctacgtcggcaccaagtcggagcgcgccgtcctcgccgcgctctcccgcctcctcatggactccgaccctctcgccgtccccttctacgaggcggtgacccaggcccgatggttcaagtggagctcgatccacgccgcagccgtcaccgccttgctggaagccaacggcagcgccgacgaatccagatccctcatcgccgactccgccgggcgccgcgagtccaccgccgagctggccctcttctactgcgacctcatggcggccttctcctcgcgcgggctgaagcgccgggccatggatttctacgcgcagctccgggcgatgccgacgccgctcgccgggggcggcaagacctacatggccatgattaaatccctgtgcatgttgggcctcgccgccgaggccgaggaggcgctgcgggagatggtcgctctggggtaccaacctgatgcgtttcagttcggattggtggccaaatgctatgggaaggcaggccaattggctgagatggagagggtgattgcgtccatgtctgacgccggcatccgcctgggcaccggcgcggcgaacattgtcctctcgtgctacagcgcttgccgtgagcacggaaagatgctagcgtggctgaagaagatgcggaagctgcgcgttgcgccgacaaccaaagcctacaatttcgtgctcaactcgtgcccgacggtggtgtcgatggctcgtgaactgggcccttcgctcccgctgtcggcagcgcagttggtgaggaagctcaagtctgcatctccatggccggcagaagctgaggtggtgcaggagcttctggcagcctcatcagtgttgaacaaggcgatggtttggtcagaaactgaggtgaagctgaacctgcatgggttcagtataacatcagcctatgtgctgatgctgcagtgggtggacgcagtgagagggggccgcgcattgccattggaagtgtctgtcgtgtgcggtgtcgggaagcacagcgacgtccgaggcgagcccaaggtgcgagagctggcacaggaggttctgagccggatggggagccccctgcggctgtccgcgaggaacaaaggccggctcgtggcgaagcgagacagggtgaaacaatggctggccactgagtggacttctgtggtgcctgaggagagcacggatcagccgccctatgcgagtgatcagcaaccatttttgcccaatcttttaagaaaactcgggcagtttttttcctcatttgtggcagtttccagatgaatggcaagctgtttattgt

SEQ ID NO: 40 - DNA, 659 bp, Hordeum vulgare
gcagcggcctaaaatcggcaagggagccatcgtcttgtttcctctcctctctcccgagtctcgatttgcgccggcggcggaagcaatcgatctccatggcggcgacagcgctccggaccatctgcaagcggatcggcggccgcgccatccggccatcaccctccacctctcgcctctttcacagcacgagaaaagaagagctctactgcctgatgtccgaaaacagggccaggatagaaaaccagaagggtccgatcaagcacctctcatcccatgtggagcgtaaacccgaggaccccgtctggcgcttctatcgcagggcaaaatggtaccatttagtcatcatgtatagcccaacaatcctttatgtctgcatgtctgtgtgtggtgtgcctgatggcaagaaggagatgacaccagctgagaaggaggacggctagttccatagtgactaaccccagcactttatgtagttgccattgctctgtttggacaccgtggctttgttagactaaattatctgtcatgtttagtgcgtttgtgtgttatggtaaggctgaactagctgtggtgcttggtgtaaagtgctatcttaaaagttaagactgagttatcagtgagaatgttggctcaagtggtatagtagtatgttggtgtta

SEQ ID NO: 41 - DNA, 1998 bp, Hordeum vulgare
accacatcgccggctgacctctccctctccctcgacctcgacctcgacctctcccaaggattcgggttggtggctgagcttgaggaagcagtttgctgcagtctttggctttggggcggcgagcgagcgagtgatttttagtatcggcgaatggcgactcagtggttctccaatatggtgatggacgagccgagtttcttccaccagtggcagacggacgcgacgctggagcagtacacggagcagcagatcgccgtggccttcgggcagggggagatggaggcggcgctgatgcagcagcagtacgcggcggcggcggtcggtgagcaccggccgcgcaaggcggccaaggtcaacaccagctgggactcgtgcgtcacggagcagggctcccccgccgactcctcctctccgaccatcctctccttcggcggccacgccgacgcgttcgccaaggcgccgcaggccgggagcgccgccgcctactacggcgccgcctccgctcctgtggcgcccgtgaagcccaagcaggaggtcgacgcggcggccgtggtggcgccgttccagcaggtgaagcggagctacgacgccatggtcgccgagcccgccagggcgccctcccggccggccgcccagaaccaggaacacatcctcgccgagcggaagcggcgggagaagctcagcgagcggttcatcgcgctgtccaagatcgtcccggggctcaagaagatggacaaggcgtcggtgctgggcgacgcgatcaagtacgtcaagacgctgcaggagcaggtgaagggcatggaggaggtggcccggaggcggccggtggagtcggcggtgcttgtcaagaagtcccagctcgccgccgacgaggacgacgggtcgtcctgcgacgagaacttcgagggcgccgacgccgggctgccggagatcgaggcccggatgtcggaccgcacggtgctcgtcaagatccactgcgagaaccgcaggggcgtcctcgtcgccgcgctgtccgagctcgagagcatggacctcaccatcatgaacaccaatgtgctccccttcaccacctcctccatcgacatcaccatcatggccacggccggtgagcacttctcgttgtctgtcaaggacatcgtcaggaagctacatcaagcgttcaagtcgtcgccatgaagggcttgctccccctgaacaagtctaatttagatctttgccttcagtttccctaccttttttttttgtcattagcctcgaggatttggggctaatgggtcataggttcttcccagctggtgcttctgatgacagttcccttgcagtcccccacacggtgcccctcaaagatagccatttcccaccttttctgcctcgtgggtgcagcaaaaccactagttaattgttacttctaccctctccttttttttgcatggtttggtatcaatcactccatgttcatgggagagagtagagtgagaaaaaaatgagacctgtctttttctagggctagttaccaaggggagtttgaattttacaaaaacccatttttcatttcttcccttcacaaatatcgcccttttcaccctgctttttttcgacgagaggccggatcgagttttttcaaacccaaacacctacctttgccgtcctttcaaatcccaccatgctgtttcccaaaaggcttcaaatatctgtggacaaaaatggcgttttctttttttcggcatcgaaggggacttttgcaagccttgattcagaagtgcagtagtagggtgtgcctgtttttcaggggtagtgcaagctggttggcccaagcagcttggatggacccctttgcttgtagtttttcttatgggttttgttgtaacaggatgaagattgtagctctgtaccctcttgtttgcttgcatacaagtataaagaataaatgaatatgctcggttgttaacttaaaaaaaaaaaaaaaaaaaaaaaaaaacactgtcatgccgttacgta

SEQ ID NO: 42 - DNA, 1970 bp, Brachypodium distachyon
accgctgaagcaagcaaagcagcagccagaccgagaccgaggcctcgagaggagagagcctgcctggccgcctacctagcgcgcgcgcgcggcgcccgagagtctgactggacgcgcgcgccatgaggagggcgcagcagcagcagcagcaccagggggcgtcggcgccgggcgtggtgcgcgtggaccaggcgtcgcccgcttccaccttccgccagctcgacgacgccttcctgcagaaacaaacgaaaatctggcttggtgaagttctccatgttaggtttgacgaagacattttggtcgcagaccttctaggcgatggcgagttgctatttcaagtttcgaaagtaatatggaaaaggttactgagaaagaacaaagagcaactcaagcaatcgaaagtttatatttatgagagaacatcttttggtaaaagcaatgggaaatatacgccctatccaaaagtcgactcgtttctaaagatatgccaaatccttgggttggctgggattgatttgtttaccccttccgatgtggttgagaaaagaaatgttcggaaagtctgcatgtgcatacgttcgctgtctaaaaaggccgggatgatgcacctgaatgtacctgattttgatgttgtaactcacacaatagccatgcccaattatatggttggagttatccgcagaagtctggagcaaccacggtgcagttcatcttgttcgagtggatatagcccgcatgcgaattctgagagcatatttggacagaatgaccaacaaggtgacacgcattatgactctgatgaagcagagagcagtctctatgtgctagaacctcaggaaaatgttggtgaagacaacctttcggaacgtttgcaaataggcaatgcccccaaggaacaaagagaaggctatggagatagtggacatggcaagctggaagagaagtcagtggctgaaccagtgggttcacttgactttggcgttatggatgctgattctgcggattcagctccttttcacgacaaccaactgtgttgttctactcactcttcaactgaccagtgctcaagaactagaacaactaaatgttcaatgagctcggaagagtcagactccattagcagttacttagcgttcgacagtagcaagaatgatctggacgctcctaaggtcaaagtttctgaaaggattcatgatgaacatgacgaaccttcacattcttctattcaaggaaatgggaaaatatttgtcgatcatccaaaaaaagaaggtgatgacctcctaaaggacactagcgccatggatcaacattgtgatgcttttatctgtgatagggaatctgttagttcaagttctgaagaacccaggttcggattaaatggagagtcatactcaggtttaaccccaagaaattctacgggtggtcaattgccagcagtttctgaagatactacagcaagtcgagggctgaaacatgaaatcagcactaaggatcacattgatgcttccagatccgaggacgaactggcgaaaccactagatacagctgaacacaacaacggaaatgctcagaggaatgaggacgatcctcccaaatcagggaaaggcgtgctgaagtcagtggctggaggaatcacgctcgttggcgcagtgttctttatagctcatctcaggagaagcaaggggagaatcttcacagcaattttacctccactgtctgaaaaatctattcagagcgactcgaggacgacgaacgtggacaaacgaaaggcagccgagctgtatcccggcggatggctgaaggtttaacaggatggagtggacacggccaattaatagggcagcgcaatttggaattctgtgtatcatgtaaatccatatagcagaacaccttgatattcttgatacggatcaggcttaatatttactgaagaagcgatacataatacaagtagcttctagcttatactc

SEQ ID NO: 43 - DNA, 1865 bp, Brachypodium distachyon
attacaccatcaatcggagctcgctcacccactctgctccccgctccattcgcttgtcagacagcgctagctagcgctagcagcgaagaaaaaaaaaggcctagacgccgacacgccaacggcagcggcttgccgacacccaatggacgcgcggcggcggctgtgcctggtcgcggcggtgctgctcgccgcggcggcggcggcggaggggtacaacatcaccaagatcctgggcgagcacccggagtactcgcagttcaacaagctgctgacgcagacgcggctggcggcggacatcaacaagcggcgcaccatcacggtgctggtggtagccaacggcgatatgggcgcgctcgccgccggccgcacgctgcagaccatccgccacatcctccagatgcacgtcctcgtcgactactacggcgccaagaagctccaccagctcgcccacggcgtcaccgcctcctcctccatgttccaggagtccggcgctgcccccggcatgtcaggttacgtgaacatcacgcagcaccgtggcgggcacgtgacgttcacggcggaggacgcgtcggacagcgcgtccccggtgagctttgtgaagtccgtaaaggagatcccctacgacctgtcggtgctccagattagcaaggtgctctcctccccggaggccgaggcgcccgtggcggcaccggcgcccgtcaacatcacggagctgctctccaagaagtactgcaagagcttcgcgggccttctggccgccgacgccgacgccttcagcactgtcaacgccacaaaggacaacgggctcacgctcttctgccccgtcgacgccgccgtggccagcttcatgcccaagtacaaaaacctcacggcgaaggccaagacggccatcctgctctaccacgccgtgccggactactactcgctccagctcctgacgtccaacagcggcaaggtgagcacgctcgccacgtccagcgtcgccaagaaggactacagcttcgacgtgtccaaggacggcgagacggccgcgctcgacaccaaggttatcacggcgtccgtcacggccaccgtcaaggacgacgacccgctcgccgtctacgccgtgtccaagttcttgcagcccaaggagctgttcaaggtcgccaaggacctcgcgccggcgccggcgcccgagggccccaagaagaagagcagcaagaagaagccctctgccgcctcatcgccctccgacgacgacgacgactcagccgcggactcgccagacgacgactccgggtccgatgttgacgctgccgacaaggccggcgccgcaccgcccatgcttgccaggtgggtcacggctgcagcggccaccgtcgcggcgttggccttggcaacctaaattaaggtttgaattcgtgtattctgtgctggattctctcgttttttgtctgtcgattctgtcccctgttagtgcaaaaaacaataatgaggagggccgtttatttatattaatttattattgctgcatccagagaaaaagaaaagaggaacttcgacggcatggttctagcagtttgaatttttgtttattttgttttcttgtaatcatagtggtcaatgggattggaccattgaaatgtgtgtttatatatatactctgcatatatatgaaaaaacattgttgagtttagaatgccacattactcgtactttattttattttgccctccttttaagctgtacgcaacacatttgttgagataggcggttagatgcaaagtggagcttgcgccatgtgattagctttgcttgttcggcttgtaaaggggatgatgcccacttttttcagattgataatgtcagttttgtttgtgttctct

SEQ ID NO: 44 - DNA, 1858 bp, Brachypodium distachyon
acagcgtgaatgttttaccagttggcaggggagagatagagatggcgaggtcgacgacggcgaggtggctgctgctgcttgccctggtggccgcgtaccatggaggaggggcttccgtccgggctgccgtgggcgctggcgctcattggctgggcgggctgagccaggcgtcgttccccaagggcttcgtcttcgggacggccacgtcggcgtaccaggtcgagggcatggccttctccgacggccgcgggccctccgtctgggacgcattcgcgcacaccccaggtgctcccaaagccccaattgctattgctgcttattatgcttaccacttctgttgtgcttactgcttacgagagtccggtagattttctgataaggaaatattgtggggaatcaaaatgcagactgtcacaacagatcaatatcatcactacaagaattgccaagaaagaatcccagggacttacgtttttatgctggcacaggaagatgttaatctcatgaaaggattaaattttgatgcctaccgattttctatctcatggtccagaatcttcccagatggcgaaggaaaagttaacgaagaaggtgtagcgtattacaacaatctgatagattacttgcttcagaaaggcattactccttatatcaatctttaccactatgatctccctcttgcacttgagaagaagtatggcggatggttaaatgcaaagacggtggaactattcgcagactatgctgacttctgttttaagacctttggcaatcgtgtaaagcactggtttactttcaatgaaccaaggatagttgtgcttggtggttatgatgtagggtccaatcctcctcaaaggtgcaccaaatgcgctgccggtgggaactcagcaacagaaccttacattgtggcacataattttatcttagcacatggttacgcagttgcaagataccggaataagtataaggcagctcagcaagggaaggttgggattgttctggacttcaattggtatgaagctctcaccaattcaactgatgacgaagcagcagctcaaagagccagggacttccatgttggttggtttgttgatccactaataaatggacactacccacagataatgcaagaccttgtgaaagagagattgcccaggttcactcctgatgaaactaaattggtcaatggatcagcagactatattgggatcaatcaatacacggctaactacatcaaggggcagaaactggtgccgcagaagccaactagctactcagccgattggcaggttacttatgcttctgaccgtaacggcataccaattggaccaaaggcaaattctaattggctttacatagtcccgacggggatgtacggatgtgtgaactacctcagggagaagtatggaaatccagcagtcgtcataaccgaaaacggtatggatcaacctgggaacctcacccgcgatgagtacctgcacgatatcaccaggatccggtactaccggagttacctcgccgagctgaaaagggccattgacggcggcgctaatgtgcttggctactttgcgtggtctctcctcgacaactttgaatggatatctggctacacatccaagttcggcatcgtctacgttgacttcaactcaaccaaactcgaacggcacccgaaggcttcggcctactggttcagagacatgctgaaggtctaaaactgatggagtgtcagtgagttagcctagcctaatgccatcatcatcctattgtgcttgtttgcccactgttgtttggctggcatcacaattcagagctagttctgccctgagagctacaaaaaatggaaataaaatatggctca

SEQ ID NO: 45 - DNA, 1873 bp, Gossypium hirsutum
ggcacgagattctcaagtagttcaggtaattcactgtctgatattcatttgtagatcgagagcaaagcagtagtaaattagcgaagctaagcaatatttgaaagaatgggtaagcaaccgagcgcatggattacaacccagcagaaaaagagatggccactgatgattctattactcctttctctatcaacactcatggccttcctcatcagatccaccttcgattcttgcagcaacggttctagtaacaatgtcggcaatttcatccgagaaggacaagaagaagaaaaagggggtacccaccatcaagttaaccacaatgacgaagcaccgactccaaatcctctcgatttcatgaagtcaaaactcgttctcttagtctctcacgaactctccctttccggtgggcctttattgttaatggaactggcatgtctgctaagagaagttggcgccgacgttgtctgggtaactaaccagaaacaaaccgaatctgatgacatcatttacagtttagaacataagatgttgaatcgaggggttcaggttttctctgccaaaggtcaagaagctatagatactgctctaaaggctgatttggtagttttgaacactgcggttgctggaaagtggctggatgctgttcttaaagaacatgttgctgatgttcttccaaaggttctctggtggattcatgaaatgcgaggacattacttcaagctagaatatgttaagcacctccctttagttggaggtgccatgattgattcacacaccacagcaaattactggaaaaaccggactcgggaacgattagggatcaaaatgcctgaaacatacgttgtgcacttaggaaacagcaaggagctaatggaagtggctgaaaatagagttgccaaaagggttctctgtgagcatgttcgtgaatctcttggcgtgaaaaatgaagatctagtctttgctcttataaatagtgtttcccgagggaagggtcaggacctatttctccgttcatttcatgaaagtttgaagttgatccaggagagaaaactaaaggtgccaccaattcatgcggtgatagtgggaagtgacatgaatgctcagacaaagtttgaaacagagctgcgtaactttgtatcacagaataatatgcagggtcgagttcactttgttaataaaaccctaactgtagctccctatctggcttctatcgatgttcttgttcaaaattctcaggcccggggagagtgtttcggaaggataacaatagaagctatggcctttcagcttcctgtcctgggcacagctgccggtggcaccatggagatagtggtaaacgggacaacaggcttgttgcatcctgctggcaaagaaggcgtgatgcccctctcaaataacatcgtgaaactagctacaaatgtagagaagaggctgacgatggggaagaaaggatatgaaagggtgaaagagagatttttagagcatcacatgtccgaaagaattgccaaggttctgaaggaaatactgctgcacaaggcaaagcgccactctgagtcttgaaaactttgcttcactgttcagtgccttcatcatccggtactaaagttgctctctgctgtttttgtcaggcatctgatgaataataaacttgagggtaaaatctatttgtatattatgtagcaagtggggggaaaactgtagataatcatgttatgatacccatttttcattcttttttacgtttaaatttattcttttatacgtaaatctagagacagaaaaattgtgattcttaaattggttggattcaagattcccagtgcaatggttgatatatttccccttgaaatggtttaattgaggatttaagttt

SEQ ID NO: 46 - DNA, 1298 bp, Gossypium hirsutum
gttcggccttcttaaaatatatagaaaatccaatcccaccgttggccggcgaattatccctccgatcaccctccggtctgatccatgacgttgtcagacgaagaagatgagtttttggcgaatttccttgaatccgagctctccgatgaggaggagccggaagccaagcgattgcgcgttgtgaaggaagatgaggaaaaggagaaagaagacaaaggaggtggggcttcttcttcgaatatgaatccgaatccgaatcctggccaagtgaagaacaataataataggaacaatcctaggaggattgagagtggtactttcagcaagattccacctgagttatttactcaaatcctcaaattcctctcatccgaggatcttgtatcgtgctcgatggtgtgcagtttcctgaattatgcggcatctgacgaatccttatggcgccgactgtattgtatgcgatggggtttgttgcctccaacaaaaatacgagaatgtccttggaagaagctttatattcagcgtgatgaagaggacatgattgaacttgttaggaactgtccatctgaatttaaagaatactacattcaaatgcaatcagctaaaagaagccaagcacctcttccttctcaggtgaaggatgactcaataattcttgacaagacagttgctgatcgagtatctatctggaaaagtagtcgcggcctgactgataaggttgtcactgaccatgcttgttctggagaaacatgtacctactaccaaataggggatgtatttgtttgtgagaagactgggcaggttcatgtatgtgacgatacttgtcgagaagtcattttggatcccaacaatgagcttttggtctgcacaatttcaggccactgttttgataggttactgtcaccatccgaaatggaattggaagctgaacagcagcaagctggtggcacagatgaagcagaaccattcttgggatctggtcgctttgcacgagcttacttattaggatacaactgcgaggatgaaaaggagctggaagctgctttgaggttttgttgatccaaatcttttattactttcttgtaggtgggtattagtaaatgtctcagtttgagattgatatgtggatgctcttaagttttgcttttattgattctatagttgtacgagatagataattatagtggataatgtatttactatcatgtaaaaaaaaacccgtccccggcttgttcgtttattgtgcacaatggcgctgattggaatgaatcaaggtataaccataggtgtccttatcc

SEQ ID NO: 47 - DNA, 3345 bp, Gossypium hirsutum
atgagaatgtaaatgggttccttagaaaatgggatctcgttgaagagagccggtagcaggaacgaaaggcacccgttttcgagccgacccagatcgagattttctcggcttttgctcttcaagaagctagattatctccaatggatttgcaccgttgctgttttcctcttctttgttgtgtttttccaaatgtttttgcccggttcagtaatggacaaatctcaaggttccttcttagatgataaagattcggtatttggagaattgagttatttgaaagagatgggtgcgctagattttggtgaagatatcagattggaaccgtgcaagctattagagaagtttcagagagaaaataaactagtcaatttggattcttcatctggtttcaaccggagtcaacaccgtttccattatagaaaacctcagcttgcattggtgtttgctgatctattggttcacccacaacaattgctaatggtgaccattgcaaccgcattgaaagagattgggtatgaacttcaggtatactcccttgaagatggtcttgcacgcaatgcttggcaaagcatcggagttccggtcaccattcttaaagtcgaacggaatgagattgctgttgattggctgaactatgacggcatactcgttagctctcttgaggccaagagtgtcttttctagttttattcaggaacctttcaaatctattccacttatatggacaatccatgaacgagcgcttgccatacgttctagagaatacacttcaagtggacagattgagcttgtgaatgattggaaaaaagttttctgtcgtgctactgttgttgtcttccctaactatgcacttccgatgatctattctacatttgattctggaaactattatgtcattcctggttctccagctgtggtatggaaaggagagaatgcaatgaatttgttaaaagatagtcagcgtataaagatgggttatggacctgatgaagtactcattgcaattgttggaagtcaattcatgtacaagggcttgtggttggagcatgcccttattttgcaggctttattacccctctttgctgacaataattcaaattcccacccgaaaatcattattttaagcagtgattcaacaagcaactacagcatggctgttgagagaattgctctcaacttgaggtatcctagtggtgtggtgaagcatgtggctgttgaggaagaagtcgacaacgttctgagcatgactgacattgtgatatatggctcatttcttgatgagccatcattcccggaagttttgacgaaagccatgtcccttgggaaaccaatcatagcaccagaactctccaatatcaggaaatatgttgatgacagggtaaacggctatatttttcccaaggagaatattaaagttttgacccaaatcattttgcaagtgatatcaaatggaaaattgtctccattggcacgcaatattgcttcgatcgggagagaaactgttaaaaacttgatggttcaggaaactgttgaaggatatgcctttctactggaaaatattctcaagcttccatcagaagttgcacctcttaaggctgttgctgaacttccttcaaagttaaaggaagaatggcaatggaacctgtttggggattttctaaattctactcttggagacaggagtgccaattttttgaacaagttagaggagcaatggaaccattctcgaagggagaagtttggttcattaattgctgtggatgattcattttcatatgaaatttgggaggaagaaaaaaggacgcatattctcgatactaaaaggagacgagaggagcaagagttgaaagatagaactgatcaacctcgtggaacctgggaggacgtatatcgaaatgccaagaaggcggaccgtatgagaaatgacttgcatgaaagggatgaaagggaactcgaaaggattggtcaaccattgtgtatttatgaaccttattttggtgaaggaacatggcctttcctgcaccaaaattctctttaccgtggaattggattgtccacaaaaggtcgaagacctgggatggatgatgttgatggaccgtctcgtctgcaacttcttaacaacccatactaccgagacactcttgatgaatatggggccttctttgctattgctaaccggattgaccgtctacacaggaatgcctggatagggtttcagtcatggcgagcaacagctcggaaggcatccttgtccggaattgctgaaacttcattgttagacgccatcgaaaagcgaaagtatggtgacgcactatacttttgggttcggatggacactgatccaagaaacaacatgcagagggacttttggtcattttgtgacgctataaatgctggaaagtgcaagcttgcattctctgagactcttaaaaggatgtatggcttagggcaggatttcaactctttgccacccatgcctgaaggagaaggcacatggtctgtcatgcagagttgggccttgccaacaaagtccttcctagagttcgttatgttctcaaggatgtttgtggatgcattagatgcacaaatgtatgatgagcactatcaaagtggtcactgttatctgagtttctcgaaggacaagcattgctactcacgggtgcttgagctgcttataaatgtttgggcatatcacagtgcacgtcggattgtatatgtgaatcctgaaaccggtgcgatgcaagaataccacaagttcaaggatcggaggggtaaaatgtggatcaaatggttttcattcaacactttaaaggtcatggatgaggatttagccgaggaagcagattctgaccacccaaagagacgatggttatggccatcaacaggtgaggtcgtctggcaaggtgttcttgacagagagagaaatctccggaaccggcaaaaagagacaaggaagcagaaaagcaaggacaaactagagaggatgaggcataaacaccgtcaaaaagcattagggaggtatgtgaaaccccttccagaagatattgagatctcaaattcaacaacagtaacatcagtttaatttcatgtctgttttttgcatctttggcaatagaacctagtttgataattctttaatttttgatcttcttctacccttttcttttgcttctatgccttgtttatgtcagaaaggatgcatcatttgtttaaatgtgagaatttttgtatttagctaacagcatccttctggtcattaatattcttgaatggctcaaactgtacactaagttttacctttctccttattttctgccctcaattctaaattttatttttcgatgtt

SEQ ID NO: 48 - DNA, 1059 bp, Zea mays
ccctgaaactcaactagccgttggagtcaaggcagcggcggcggacgcggctgaaagctgtcgaccgtgccgcgccgcccccaacggtcactggagaggaagaagaaactcgcatttccatccccagccaattgtcgctcgcctttaaatcctgcgccccaccgccgcctccactcccaccgctctctatcctcccactcaaatactcctcaatagccatcgaggagaagggagatagaaacgggagggaacacccactcgatcgtcagccatgacccggggagagaaccaggagtcgcaaaccggtaacgtccccgccgcatccgcggcggcgccggggccgaagccggcgtcggcggggggcgggaaaggcgcggagggccagtcggtggtgcggcggctgcagtcggagctgatggcgctgatgatgggcggcgacccgggcgtgtcggcatttcccgagggggacaacatgctccactgggtgggcaccatcgacggctccgccgggacggcctacgagggcacctcctaccgcctcgcgttggccttcaccgccgagtacccgtacaagccgcccaaggtgcggttcgacaccccctgcttccaccccaacgtcgacgtgcacggcaacatctgcctggacatcctccaggacaagtggtcctccgcctacgacgtgcgcaccatcctcctctccatccagagcctgcttggagagccgaacaacgactcgccgctcaacactcaggcggcagcgctctgggcgaaccaggaagagtttaggaagatggtggagaaaatctacaagcccgccgcgtagaggaggatgacagcgcctggtgaagatgtgggttcttcaagcactgatttcgcttggattgatcgacaagagattatatttggatggtttgggttcccagtctggtgctgtagcaggaaggaatatttgggtcgcctagagcctggcgattctgtaattgttctgagttctaaaatgttcagatattcatttttccatgaatcgttttcgtcccttcgcctcttcctaactgcaat

SEQ ID NO: 49 - DNA, 2133 bp, Zea mays
cttcccactcggccactcctcatcagccatccccaaaaggccaaaacccgcgcacaccggcgacggcaggagaacctcccgccggccgccgccatgccgccgcctctacaggcccaccgcctactcatctcccaccgccgcctacccactccagctcgccgccggttcaccgccgcctcttccgtccaatccgctcccgccacaaccttggccccgggccccgccacatcctccatcctctccatccgcgagtcgctcctctcaggcgagaggaccgcggcggacatcacctccgagtacctctcccgcctccgccgtaccgagccgaccttgcgcagcttcatccacgtcgcggacgccgccgccgagcgggaggcggaggaactcgaccggaggattgcctccggggagaaggatgcggtgggtccgctcgctggagtgctggtgggagtgaaggacaatctttgcacagccaacatgccctccacgggcgggtcgcggatactggacgggtaccggccggcgtacgacgccactgccgtgcggcggctgcgggaggccggcgctattgtgttggggaagacgaacctcgacgaattcggaatggggagcaccaccgagggctccgcgtttcaggtgacaacgaacccgtgggatgattcacgtgtgcctgggggatcctctggtggttctgctgctgcagtatctgctaggcaatgcgtagtgtcactaggtagtgacacaggtggaagtgtgagacaaccagcgtcgttttgcggtgtagtgggattgaagccaacttatggccgggtttctcgttttggtctcatggcctacgcttcatcgctggatgttgtgggatgctttggttcgtcggtttttgacactgcaaccatcttatctgttgttgctggccatgacaagatggacgcaaccagcagttcacaggttgttccagagtacgcatcggagttggtctccctagatttactagaatcgaaaccattaaatggtgtgagaattgggattatacaagaaactcttggagaaggtgttgccagtggagtcgtatcatcaatcaagggtgctgcttcacacctggagcagttgggatctgtggtggaagaggtttcactgccttcattttctcttggcttaccagcatattacatactagcctcatctgaagcttcttctaatctatcacgctatgatggtatcaggtatggaggacaggtctcggcggatgacttgaatgagctttatggagagtcccgggctaatggttttggtcatgaggtcaaaatgagaattttgatgggaacctatgctctttctgctgggtactatgatgcatactacaaacgagcacaacaggtcaggacactggttaagcaaagcttcaaagatgctttggaaagatacgacattctaatctcaccagctgcgccatcagcagcctacaagataggtgaaaagataaatgacccgttagccatgtatgcaggagatatcatgacggtgaatgttaatttggccgggcttcctgcattggttgtgccttgtggatttgttgaaggtggagctgcagggctcccagtgggactccagatgatgggatctccattctgtgaggggaatttgctgagagtaggccacatctttgagcagactctccagaatctcagctttgttccaccgttgttggcagagggccagttgtaacagataatccactcgctgctcaacaagcaattacctgagttacgggttttggggtggctttctgtcattcgcatgcggaggaaattggtagcacgcatgacgcatttagaaaatagaatgttttgctcgtggggtcgctgataattgtgagagagcaacgacacccatgtgatgtacaccagcaaccagcacattgcataccacacagcattttacatgccttcagaatgattgatgattttgtatcaatgctggttttctcaagtgtcaaattttgcatagaaaatattagtgtccctggcagaggtgagtattccaccacctataagcatttgtggccttgtggggatccgatgagaaacagaacagaaagcagagaaacaaaacagaaaggacccatttggacgt

SEQ ID NO: 50 - DNA, 2103 bp, Zea mays
cactgtgcggatctgtaaccgtggtgcgtttccacttcctccccagctcatccgcaacagagaaattaatccattgcacacctccactcctcacccttcaatctttcgttcccaactgcgtttcctcctccgcgtcttcaaggaggggagacctgaaacgaatccagtccaggctggtggctgccggcgctggacctgaacgctggtgcatactgcgtaggcaagagcaggcaatggcggaggcgaatgcggggaaggagaagaaggaagtggtgcggctggagcgcgagtccgtgatccccatcatgaagcccaagctcaccatgaagctcgcctacctcatcgaacatcagtctgacagagaagaattcttgaagctctgcaggagggttgagtacaccataagggcttggtaccatctccagtttgatgatatgatggaactgttcgctctcttcgatcctgtgcatggtgctaaaaaactcgagcagcagaacttcctacctgaggaaatcgacacgcttgagcagaacttcctgtcctatttctttcgggtgatggaaaagagcaattttaacatagtaaatgacgatgaggttgaacttgctcattctggacaatatctgttgaatcttcccattaaagttgatgaatcaaagttagatgacaaacttctgtcgaagtattttaaggagcaccgtcatgaaaacctgcccgacttctcagacaagtatgttatatttcgtaggggcattggattggaccgcactagcaactttttcttcatggagaaagtggacatgatcatagctcgtgcatggcgaaggttccttgagaagacgagactgcaaaagctgttctcaagaaagaaaaatagtaagccaaagatagattccaagaagaatgatgatttagctagtgaaatagaagacaaggagctttatgttgaacgcatacgtcttgaaacaatggatttaagctttgggaatttatttggcaaggtcacaattcaagagcctacatttgaagaggtgattgtcttgtataggagaaaaagtccaaagggccaggatgatagggcaattcatgtaaagcacttcaaaaatatcccaatggcagacatggagttggttctgcctgagaagaaaaacccgagcctcacacctatggactgggttcaatttattgtttctgttgtcattggacttgttacactcatcagttcactggaaatgcctaaagctgatttctgggttgtaattgcaatcctctctgcactggcaggatattgcgcgaagatctatttctcgtttcaacagaatatggcaacctaccaaaacttaatcactcaatcaatgtatgacaaacaactagatagtgggaaaggcacactcctccacctctgtgatgatgtgattcaacaggaggtcaaggaggtcataattgcctactacattttgatggagaatggaaaggctaccagtgatgatcttgacttgcaatgcgaggagttaatccaggaagagtttggcttgcaatgcaattttgaggtgatggatgcagttcagaagctggagaggcttggtgtcattacaagagactctattggaaggatttgctgtgtccctctaaagcgtgccaatgagatcatcggcgcgaccacggaagaactggttatgaaagccaggcaaagctagcaatctattattttgaacaatgtagccgcattgtagattcttgcctgatggcgctgtaacgtttatggttactccagaaagtccaaacactgaactcttgcacaccaggagataagtacattctggtcatctccacagtagttctgggagagctacaagaaaatgtggttgtatttatttttttttatttttttggtggggggtactatggtttgtggaacgtcgtcgagggtgttgtaagcatgtagcattcttttgataacaagcgtggtaggaaggatgtttgaagaacacatacaagggctattatgttgctggattgatgctgtgaaccatgtattcttttcgtcagaacagtaaacttccgtaatgctgacggttcattgcggtgtgtacattgggccac

SEQ ID NO: 51 - DNA, 1320 bp, Zea mays
atgcgcctcgcggccgcttcgacagtccctcgcgttccatttgcttcggctcatctcagatcaagctagcgcacctgacacccaccacctccctcccagatccaccaccccagccatggccaccgcctttgactccccgacctcctcccccgccgccgcgcccttccacgacgaccctttcctccatttcgacggctcggcccccgccgccgccgacggcttcccggcctccccggacgcctacgcgccctcccccttcggcatgccccactccaacggcgacctccacgacgaccctttcgccgcacctgctgactccaacggtgggcccatccttccgccgcccaccgagatgggccgcgaggagggattcctgctccgcgagtggtgccgacaaaatgctattcaccttgaggaaaaagagaagaaggagaaggagctgaggagccaaatcatcgttgatgctgaagagtttaagaaagcttttgttgagaagagaaagctcaatgctgagacaagcaagggccaaaaccgtgacagggagaagcttttcctagcaaaccaggaaaagttccatgctggtgcagataagcaatactggaaggcgatatctgaacttatcccacatgagattgctaacatcgagaagagaggggcaaggaaagacaaggagaagaagcctgggatcgtggtgatccagggaccgaagcctgggaagccaacggacatggcacggatgcggcagatattgctgaagctgaagcacactcccccaccacacatgaagccacctccgccacctgccgcagctaccggaaaggatggagcaccagctgccgccgggaaggatggagctaagccagcaaccgttgccaacggcagtgtccctgagatggaaaaggctgctgcggaggcatcagtgccagcggcagcaccaccagcagcaactgagccgatcgcagctgcttaatctaatcatctgtggtaggaggatgtgaaaaatctcttattggagttgttgcagaggcggtggtggtgagtgaaactgaaaacgtgtgaatttccggcatggtggaggcatgcactgtgtatttgttacctcgattcatttacattactgctactatatattgttattgcattttgtagagaaggggcgggcgtatcctggttcatggtaataataaggttgtattaggaggatgtttggctgtattatgtttcttcttccaagtgtttgtaaatttcccttttgttattaaaactgattgtattgttaaatttttctttgttattaaaactgattgtattgttaagcta

SEQ ID NO: 52 - DNA, 1223 bp, Zea mays
gcactgcacccaccttttcaatccaatcctgccgcattgcataattcgcatcgaagatcgatgtgaatccgtggaagggagggcggaggagaaggaagaagaggggtcgaggccgaatccgccggtgagaaggggagcgatggcgaggctggcggtggccgcgagggcgttctccgctgcggcctccggcggcggcgtgtccttggtgcagggggcgtcccgggggatcggcctcgagttcgtgcggcagctgctgcgcagaagcgatggaggccgcgtcgtcgctacgtgccgcacgccgggttccgcggccgagctccagaagctcagggaggagcacgcgcccgggcgcctcaccgtgctgccgctcgacgtcaccgacgagagcaccatagaggcagctgcggcctcaatcacggagacccacggttctcttgaccttctgatcaactccgccggcatcctctcgatcccgaacgtgatacagccagagactacgctaagcaaggttcagaagtcgtccctgatgctggcatacgaggtgaacgcagtcggccctatcctagtgatcaagcacatgtggcctctgctgaagatcggaggccgctccgagactaggagagggttcgcgcttgttgcaaacatgagcgctcgagtcagctccataggagacaacgctctgggtggctggcatgcgtacagagcttctaaaacagcgctgaatcagttgaccaagacagtgtcggtggagttcggcaggaaggacaacatcgcctgcgtcctgctgcatcctggaaccgtggacaccgacctctcgaggccgtttcagaggaatgtccccgagggtaaactcttcacgagggagttctctgtgcagaggcttctctccgtcatcgacagcgtcaagaaaggcgacaacggcaagttcttcgcgtgggatggccaagaaatcccttggtgaacggtcatcgtaactcgcttgagtctatagcacagcacacagcagtcaacaacgcccctggttttaatccaacgttgtttttttttcaacaagccaagcgaacagatgcattatttctagctaaagggtcctctttttgtgttatcaccgacctaaagttcaagatgttttttttcttcttctaagtgttgaaatattagacatttttaaatcaaattctgaatataaatcatgactaaatcaaaagaactgaagtataaag

SEQ ID NO: 53 - DNA, 884 bp, Zea mays
tcaaaataggtcgttctaaactgccgctctgcaaaatacgcccgcgctagctcaggtcgtaaaaatgggtcgctcaagcgctgtcactcgccaggagaggtcacggcagcttctggcgtacctggcaggtgggccccagtacgcttgtacctattatgcccttacggtttaactccatgccgtctgttcttcttctctggacgccgagcactccttctcctcctcctctgtcggcggtcgtgggagacgtacacggcgattaggaggcacgtcgtccaccagtctcctcgcagggatgtcgaagagcacggaaatcgcagataaagcaatcatcttgatgcaggatcatgccaagcatatctatcgtatttgcaatgagaagctaatattgggtaaaggattgactgcatttgaggtcaaagaacttcgtgaagcacttgaattcgccgccgaaggattggaccaggactcccttttttgccaagaggaattggatgcaactgttaaggaggaacaattggagcatgacgagaaggtggcttcacagatgattgaaagcccacttcttctcctgattcggactgcttcctatcccttgaagagcacattgagaagttttggggcgttgattacaactcggaccagatgcctagctactccgactaggctcagagtttatggtgctgtgaaattctggatgtttgggtgtaatggtattttggatgtgtatgtgaactgtaattctggatgtgtggatgtaatggtgaactgactgaatggtgtcttgtgtaatggtattttggatgtctatgtgaactctagttctgggtttaatggtgaactgaaattcagtgttcattgttcagtataatttgttaactcca

SEQ ID NO: 54 - DNA, 754 bp, Zea mays
aatttactggacctgcttagtaccacatccattaggcccgtttccagtttccaccgtcaacagaggatggctatcgccgccgttcgccggctcttgtggcgcgaggtggggactgcggccgccgccgcggccttggggacggacgggaatctgttcgctcgcctggtctcggagccggagtgccgtgtcaaggcgaccatggaggaggctgcctcctccgggacccaccgcgacggcgccttctgggagccccccgtcaccgcgctcctccgcgcgtcgtctcctaccaaggcgcacctcgactaacagacactaggctgcaaactgtgggccatgaaaaaaatggagagatttgatgaatccatgtgacatgcagcaccaaccaagtggtccactttgcacctgatgttcagaaacagtaacagtaaccggtcaccagatctggtctacagatcatgctccaccaaatcttatccgccatgataaaaatccaagttgcgtcgagtgggcacacaaacaccgcacagtttgtttatctagaaatttacatctgattttagggcaaccaaaggtaatccacagtagctggttctcacatgcttgagaagagaagcaggaggaagagaacatagctcatgaaacatcgcctgtctgactgtctctgatgcgaagcagggaaggggaaggcaacgtgatgaacagctagcccatcttaatttaccaaaaaaagaaagaaagatggcaagacattact

SEQ ID NO: 55 - DNA, 2318 bp, Zea mays
cccgttagttgcccagccccagacccagagaggagggcgacgaacacacggtgacggagagccgagtggacaggacaggagcgcggagggaggaggaaacaaagcagaaaagcaacccccgtcttccatctttgcggagcgacgcgcatctggcctgcccatctctttcgtgctcctaccccccgccttcttccgcccgccgcctcagccctcaaggcttttccttctcatcttcttctcagaccggggacgggcccgacggggacagggacaaaaggtggtgcgatcttgttgggcacactccgcctccgcgcgcgggaagagagagagagagagagagagagagagagagagagaaggacggagggtggcagggccgccgcgccggtgagccgacccccagccatggcattgccggctccccccgtccgcctggcgctgctgctgctcgtcgcgctgccattctgcgccgcgcatcccgggccgggggccttcaacgctcctcgccacttccagacgcccgcgctccactctgatggatttggcttggtggcaagaaggtcgattgctgaagctcctgctgacatcaacgtcactacgaatagctcctttgtgctggcggcagataggacatatcgaagggaccctttgaatggcttcaggaaatacccgggcggctggaatatcagtgaagtgcactatttcgcttccgtcggatatacagccattccgctgttcgccattgctctcgtgtggtttgtgatctttttcctggttatgcttgggatttgctgccgtcattgctgttgcccgcatcacacctacaagtattcacgaacagcatatgctctatcattgatacttctaatactgttcacatgtgctgcaattgctggatgtgctatgttatacgatggccagggaaaattccacaagagcacaacaactactctgaagtttgttgttagccaggcaaactatactgttgacaaccttaggaacctatctgatagtttgtctgctgcaaagaaggtcgacatagcacagtcctttttgctgcctcctaatgtgcaaaatgagataaatgaaattcaaggaaagctgaactcatcagctactgatcttgctattaaaacaacagataatgccgcgaagatcaaaaaggtgctaaacagagtgcggcttgctttagttgtcattgcagctgtgatgcttcttctggcatttgttggcttcttgttatccatctttggtctggaattccttgtctctgtcttggttattattggatggatattggttactggaacgtttatcctgtgtggtgtatttcttcttctgcacaatgtcgtttcagatacttgcgttgcaatggaagagtgggttgctcatccgacagaacacacagccctggacgaggttatcccctgcgtggagcctgccacggcgaacgaatccctgtacagaagcaggcaggtgacgttcgagctggtgaacgtggtgaaccaggtgatcaccaacgtgtcgaacaggaacttccccccgcagctgacgcctttgtactacaaccagtcggggccactgatgcctctgctctgcaaccccttcacgcctgatctgagggaccgcaactgcagcagaggagaggttaccttggacaacgcaacccaggtgtggaagaagtacgagtgccagagcaccaccgtctcaggaggagccgagatctgcgcgacggtggggcgcgtgacccccagcatctacgggcagatgaccgcgggcgtgacggtgagccaggggctgtaccagtacgggcctttcctcatccagctgcaggactgcaccttcgtgcgcgacaccttcacgaccatcaaccagggctactgcccggggctggagcgctacagcaagtgggtgtacgtgggcctggtgatggtctcgtcggcggtgatgctgtcgctcatcttctgggtgatctacgccagggagcggcggcaccgcgtgtacagcaagcagcaccagccgtacccggtggaggacaagccggcggcgacggtcccgggcgcttgaattgatatggcccgcccgttccagtgctccggcctactcccgtgccgctgtgcatactgtactccgcgcgctagttgggttttacgtggtggtgtaggtggatgatgtaccctggattgttgttcgtttgcttggtgttgctgtatgtttgctgattttaagttgttgtgcattctcgtactgacggtagctggacaatgaattgattgtgttgggattggttattattaggtgttcttcagttcgtttct

SEQ ID NO: 56 - DNA, 1388 bp, Zea mays
gtcgcgacctcgccacccaaattcatcaagctcaacacgatctcgattcgattccagttcatccatccaacgcctcccgcctgtacgtatagaagaaagaaggaagaaccgtcaccgtacgtcctcgccagtacaaataatggccctgctcaaagccgcgcgcgtcgccgatgtgcccaccctggacgtggtggtggcccccggcctggtggcggttgccaaggcgaggagcgccgcggcggtgggcggccggttctcggtgatcgggcaccgcggcaaggggatgaacgcgctggcgtcggaggacccgcgtctgcgggatgtgcgcgagaacacggtccgctccttcaacgacgccgggcgcttccccgtcgactacgtcgagttcgacgtccaggtcaccaaggacgggtgcccaatcatcttccatgacaacttcatcttcacacaagacgatggtaagatttcacaaaagcgtgtggccgatattcagctggaagacttcctgcagtatgggctccagaatgagcaggggaaggttggcaagcccctgcttcgcagattgaaggatggcaggatggtgaactggaacgtgcaatcagaggacgctctttgcacactcgaagaagcgttcgagaaggtcaatccaaggttgggcttcaacgtcgagctgaaatttgacgacagtcttgaatacaccgaggaagagctcactcgcatcctccaggccatcctgaaggtggttttcgagtacgccaaggacaggcctatacttttctccagttttcagcccgacgctgcgcagctcatgcgcaaattgcaaggcacataccctgtctacttcttgacgaacggagggacggagctatacgccgacgtgaggaggaactcgctggaggaggccgtcaagctgtgccttgccggtggcctgcaaggaatagtttcagaagcccgcgggatcttcaggcaccctgccgccgtgccaaagatcaaggaggctaacctctccctgctaacctatggaacattgaacaacgtgccggaggcggtgtacatgcagcacctcatgggagtgaacggggtcatcgtcgacctggtgccggagatcaccgaggcagtctctgagctcatcgccctgcccgagcccgacctcgacctggaagtgggcagcttgagcaaccaggcggcagctagaggagccacaacaccgaatttctcgcagcgcgagatctcgttcctgctgaggcttattcctgagcttgtccaataatgcctagacttcctggtgtctgtctgtctgtctatcatggatgaattgactaatgtgttactgatgtactgatccgcatacaagaaaagaagcccttgtgcagggtattatttgttgt

SEQ ID NO: 57 - DNA, 1200 bp, Zea mays
cgcgtcggtcgtgtcacgttttgctccagtccctgaaacgaaagagttgcggggcaaaaagaaaaaaaatctagaaccttctctcgttcaagcccacagaatccaccaagccacggcgtcaccgccagcgcgactgccatctcggggaaggaaccgaaccgacccctgaaaagaattcggtgcgtcggaaggaagagcaaccctgcggtggtggagcgaggacccgggttgagggatgtggtgggagtgggagggcgacggtggtgaggcgccgcgggaggagactcctgtcgacttcgatttcatcgccctcctcgccaagcccaaggattactacaagatactggaagtagattactatgcgtctgaggagacgatcaggtccagctatatccgccttgcactgaaatggcaccctgacaagaagcaggggcagggcgaagagaattcaacctccaaatttcaggaaattaacgaggcataccaagttctgagtaatccagcaaaaaggcaagagtatgacaaaaaaggcattctatacgttcaagatcagaatgtagtggattacctgaaccggcacaaggggctaatacttacgtgcaatggtcttggtataaggtactcagtatggtgaacacgctcaagggcccacagtttgcactcatctgcagtcttggagaatctgtaatgtatgccatcaaaatttattttcatcccttgtgtgccatagaatggcatatatggatttttgtgtgtatgacaggtggggccagtggggatgaaaataatttctgatgacatacagggaagcctttgatctgaaaatggtatagtgcagcagtgccatgtttgaaagccaaatattgaccacttgagttcatcctacaaggctacaacagagttgatttttatttgtcgatcagctgttgttgaatgaaagaggcagatatgttcctgctgctccttgtatgtaacatactgttcctaaccatgcaatgtaagcgtttgtttctgtcttggcgctttgtattgacgttatgtggacctgaatgtctgtggaaaaacagagtggtatcatgctccttccccggaaactagtacatctatatcctcattaacatactctctccgtttttattagatactgtgttagctttgtcattgattttaaaaaatatatagattcatgttattggttca

SEQ ID NO: 58 - DNA, 4199 bp, Zea mays
gagcaagccgccgagcacccagcgagaacctcccactcctcccagtggctctctgtcctctcgcgccccctcgcgtcctcactgccacttgaaataccggtgggcacacgaccgctccagtgttcaactgctccgggctgtgatttggtgcgacttggtgttgttggtggtggtgctacacgtcttggcctctgcttcctcggagggattggagccgtttgaactcaggagcttgctgctggccatggtccaagggttaggggatggattgaggcgtggggggagaggagcgcagtagcttcctcttcttcttcttcttcggtgcgcgggtctgggctctcgggagcgagcatggcggcgggttgggattgcgacagggtcagctgatcctagcaattggacccgacagaccattttattctgtgatctcatcataattgaagcccccactgatgaaaagctgttaccttggttgctttcttgagtactggtcaccagatagtagcatgttctcttctgtgtgattaggcttgattgtggactgacactcctggtcacttatctcttgtgatcatccagagtatatcatctgtcagctgatcttttctctatggaatcgcttccctttatgaaagtatccttgttttagggcaaatctcctttggcaaacattgttcagggtgcatcactttgctggttatcctgagcatattctcctcgtcgaatgaactatcagcagcgaagagacttccaaatgatatccatcaggaaattctcatttagtttgatggaagtttcataaggtttcgtaccatctgatttgctgggcaaatctcctttggcagtacttattaatagctcttttgggggcaaatctcctttggcattagctttaagatttctcactgggcaaatctcctttggcactagttctacctttagtttcacatcgctcttcgggcaaatctcctttggcactaaataccaattatatttactatttttagtaaatctccttccgctgtgcgcactagcatctatatctgggtaattctcctttggcattatcagtcaagtgtgctgcctgcctgcacataacttatacgagaatatcaagaagtgattctggaagaaatacttggccagctggtatattgaccttctggacatcaatttgcatattgttccttgttcttgagattaccacgttacccaagcagccacaccttactaagaagggtttgaaatcatggatttgtttacaattgactcggatagtgagtcatatactgggaccagtgacagtgaagaccaagaatgtgaatttacatatagtgaccatgcccaaaacatcttgtccagtctggatgagagcattggcaagattgataattttttgacttttgaaagggggtttctgcatggggatatagtctgccctgtttctgatccctcaggtcagctgggacgtgttgttggtgttgcaatgtttgttgacttggagacaagctcaggtgacataattaaagatgtaaacagcaagaagctatcaagagtgagatcttttgtttccggtgactgcgttgttatggggccatggattggacgagtgataagagcatttgatcttgtcacacttttattcagtgatggagcaaagtgtgaaatcctgttaagggattcggatgtactgaagcccattcctcctgttctttttgaagatgcaccttacttttattatcctggccaacgtgtgaggatagtcgatccgtcagtttccaagtcagcaacatggttatgtggatcatggaggcccagtagagatgatggtattgtctctcatgtcgatgtagggctggtgcatgtgaactggatcacatctgtaaccaatgtttggggagataaatcatcaagtcctccaaacattcaggacccaaagaagctcaccttgctgtcatgtttcccttacgctaattggcaactaggtgattggtgtgctcttatgactgacaacaatggatgcctctggatggattctggcaagtcttgtattcttagtgaagaccagaagtgtgactctcatgcacacatgtattttgaaagttatggttcagattgttctcaaacatttgttgttgccaagacaaagagcactgttgatgttctgtggcagaatggaactgtatctcttggtctagaaccccaggcattactccctgtgagtacccttggtgaccatgatttttggccaggtcaatttgtcctagaaaaactgactgtagaagatgctgcaagatgtccgcgaacggcaatagtgagtgatgtggatgcactggagcgaacagtaaatgtaaaatggattggtccagcacatagtgacattgtcagctatggaagtgaccctgcagtggagactgtaagtgtttatgagctagtagagcacccagatttctccttctgcactggcgaggtcgttatcaggtcagctatgaacatagacaagtctgaagcagatcccacaaatgggtcattggcaagcaaagaatcattggttacctcctctggcttcttatcatgcaccggaaatgtacttgggtacaaggacaatggaattgaagtgcaatgggctaatggtgttatatccaaggtgcaacattttgagataattggattggacaagcttcttgataatagttctgtagaatcaatgaatgaggaacatacaattggtgattcattagacgaggctgagcaggaggaattgaaccatgaggtctgtttgtttattgctctggagtctactgaagactgcactggctccttgtgcaaagccactgcttttctatttcccaagacagcttttgacttcctgacaaatgtggctgctagtttgtttggtattcatggttctccatctccaagctcagttttggtagatcctcgatatgaaattgtgaagatggcagaaatgcagccatgtgcagaagaaacaccaaaagaagaacagatagtgaagtttgtggcgcagattgacaagccaattctctcttcagaagatgccatctcaaaaagattcgatgtagtcactgactgtttggatcatcattttgtgaaggaaaatggccatgaaagtgttacaagaggttggttgaagaaggtgcgactggaatggaacatcctgcaaaatgacctaccagatggtattcatgtgagagtttatgaggaaaggatggatcttctgagggcttgcatcgttggggcacctggaacaccttaccatgacaatctttttttcttcgatattttctttcctcctgattacccccatgaaccaccttctgttcactatcactctggtggtctccgcctgaatccaaatctgtatgagtcgggaaaagtgtgcctcagcctcctgaagacatggacaggcactggtaacgaagtgtggaatgctgagagctcaactgttcttcagctgctgttatcgcttcaggcccttgttctcaacgaaaaaccttacttcaacgaggcgggatacgacaaatttgtgggcaaggctgatggagagaagaactccatcacgtacaatgagaatgccttccttctgtcatgcaaatccatgatgtatgttttacgcaagcctccaaagcattttgagacgttggtcaaggagcatttcacctgccgtgccccgcacatcctggatgcctgcgaggcttatcttgggggcgatctcgtcggacacgcgcacgacaaagcatacgtagcagaggacggcaacaagaactgctcaaccggtttcaagataatgcttggtaagcttctgccgaagctcgttactgccttctgtgaggccggtatcaccagcgaccggtaaaaccagcgcaagcctgctctctgctgcatcagcaatggaattgggacccttctttatattgcgcgtgtatattcgatgcttgtgtattccaaataaaatggcgcctggtttgtgtgttacttgtgcctgtcttgtaaatgtgaaacagtattcacagatgattgctgaactgatatgattggtcttgtaaatgcggaacggtatgtacgcatgattgctggtgtttatgttgctaagctgaaggcagctaaacactcaagtgtttgggtttgggctgtcttctgcggtcagtgtgaaataaaatgtaaatgtgtgttgttca

SEQ ID NO: 59 - DNA, 1111 bp, Zea mays
acgcaacaaagcatcttgagtgttcgacagcgagccatggagaagacgtccgagaacgccatcccgccggcggcatccccgctgatgctgttcgggtcgtgggcgagctcgtacacgcaccgcgtgcagctggcgctgcggctcaagggcctggagtacgactacgtggaggaggacctggggaacaagagcgacgagctgctgcgccacaaccccgtccacaagaaggtgcccgtgctcgtccacggcggccgcgcgctcccggagtccgtcattatcctccagtaccttgacgacgcctggccggagacccgcccgctgctccccgccgacgccttcgaccgcgcgctcgcgcggttctggtgccacttcgccgacgacaagctcgggccggcggtgggcgcggtgttcgcgtcgacgggggagggccaggaggcggcggtgcggcaggtgcacgagaacctggcgctgatcgagtccgagctccgcgacggcgcgttccggggccgccgcttcttcggcggcgacgaggtgggcctgctggacgtcgtcctgggctgcggctcctactggctcgccgtgttcgaggaggtgaccggggtgcgcctcgtggacgccgacgccttcccgcgcttccacgcctggctgcgcgacttcgaggccctggacgaggtccgggagaccatccccgcggtggaccgcctgctcgagtacgcgcgcggcctccgccacatgctgctcggcctcgcgggggccggcgccggcgccggcgcggacgcgccctccaccgacgcccccgccgcaccgccggcctcggctgacatcgccgtcgacatttgaacgcagggcgtcgtcgcgccgggcgtctgccagcgccgtccggctagccatcagtagctagtacgtagtaccagtatagtttgcagagtcgattgcgccatgtgtggtggctgcgtgcctgtgcctgcctgccggcctggcctggagtgcggttctgctgccgccacagttaattggcccagtttgtctagctgtcgagtttttttttttcaactctctctgtctctctccgactcttcccttctttttgataaagttcgtccctgcagtt

SEQ ID NO: 60 - DNA, 4002 bp, Zea mays
ctccgaaatgcaagcggcccacctgcttccgacggcatagcgtcttggactctctctcctctctctctccgagtctctgtctctgtctcttccgacgcgacggcagatttgggaggtgccgcggccagagagtgcacaagcacaactgacggtgctcgctcctctgctctgactcatcgctcgacgacgaaaacactcgttggatgttgcgctgtgttccaatccaatccgctccgctccactccgctccgcaacccaattcccatctccgccggtgagggattcgccacaccacacgccaggccgcccctcggtcgcggaacccacttcctgctggcgcgcgccgtcttccgttggtccggacatgtgtctttgacagatcgttacaggaggaaagaggtgcccctgtttgtccacaatggctttagctcatgccagcgccatgtttcctccctcgagcccctcacataaaacttgggaggacccgtcattcttcaagtggagaaagcgtgaggcgcatgtaccactgcgctcacaggacacgctggaagcggctctgaagtattggcatgaacggaggaatgtgaactatcacaatgctgacactgctgtctggaacgatgacgctgttcgcggtgctctggaaagtgctgccttttggtccaagggcttaccgtacgccaaatctctaagcggatactggaaactccttctgtcgccttcagcggaaagtattccggagagattctattatgctcattttgatgattcaaactggtcgggtttgccagttccctcaaattggcaaatgcatgggtttgaccgtccaatctacacaaatgtcacatatcctttcccattgaacccaccatttgtgccggctgataatcccacaggttgttacaggacagtctttcacatcccaaaagagtggaaaggtcggaggatcttgctgcactttgaagctgttgattctgcattctttgcttgggtaaatggagtactagttgggtatagccaggatagcagacttcctgctgagtttgaaattactgattgctgccatccttgtgattcggacaaggaaaatgttcttgctgttcaagttatgaggtggagtgatggctcttatcttgaagatcaggatcactggaggttgtctggtattcacagggatgtgctcctactatcaaagccacagatttttatcacagattacttcttcaaagcaaccttggatgaaaatttcagtttagccgatattgaggttgaggtggagattgactcacacaagcaagaccaggagcacgtcccaactttgtctattgaagcaacactcattgataactctggactatctaacagtatagatgctgatctttcatccgctaatgcagtcaatttgaaaccgaagccaaaacgaactcgaagcccttgtcttggttttcatggttatgtacttggtggaaaaatagaaaatccaaaactttggtctagtgagcatcctaacttatacacgcttgttgttctccttaaagatgccaatgggaagcttattgactgtgaatcatgccaagtgggcattcgtaatgtggtcatggcacacaagcaaatgctcgtcaatggatgtcctgttgtgctaagaggtgtcaacagacatgagcaccatccacgccttggaaagacaaatttagaagcatgcatgatcaaggacctgattttgatgaggcaaaacaatatcaatgctgttagaaatagccattacccacagcacccaaggtggtatgagttatgtgacatttttggtctttatgtcatagatgaagccaacattgagacacatggttttgatgaatctaacactttcaaacatcctacacttgaacctatttgggcaaatgcaatgcttgatcgtgttgttagcatggtggagagagataagaatcatgcatgcattattgtttggtctctaggaaatgaatcttcatatggacctaatcatgcttccatgtctggttggattcgtgaaagggatccaacaagactcctccattatgagggaggtggttccagaacatcatccacagatattgtgtgccccatgtatatgcgtgtctgggatgttgttaagatagcaaaagatccatctgaaacaaggcctctaattctttgcgaatattcacatgctatgggaaacagtaatgggaatattgatgcgtattggatggccatagacaacacttttggactccaaggaggttttatatgggactgggctgatcagggtttactgaaggaggactcagatgggtctaaattttgggcatatggcggcgactttggagatactccaaatgactccaatttttgcctcaatggcattgtgtggcctgatcggacgattcacccagctcttcatgaagtaaaataccttcaccagcctatcaaaatatcatcagcagataatatgcttaagattgaaaatggacacttttttgagacaacagaagctttggacttcagttgggttcttcatggagatggttgtgtcttgggctctggtccattgaatattccaactttggcaccacaaactagtcagctcatcaacatggaatcatcaccttggtttgccctttggagtgcctgtgcagcaaaagaagtatttttgtctgtgaatgtgaaacaaaggcatgaaacacgatgggctaaagctggtcatctcttggcttcagcacaactgtgtttgcctcagaaaaatggctttgtccccagcgtgatagcattgtccagtagccctttggtctgtgaacgcattggtgataatgtaaccatctgcaagaataatgcctggaaaattaaagtaaacagtcagttgggaacaatcgacagctggaaggtcaacgacgttgagcttatgagcaaggggatactcccatgcttttggcgcgcaccaactgacaacgacaaaggaggtttcttcaccaagccatatgactcgcgatggagagaagccttcctcgacaatgtctcgttccacagcagccagttctctgtcaaggagttgccggacaacaccgtggagttctccaccctctactacggtgttcccgggcacctacccaagcctgacgacgaagcctccgagtccattctcttccgggtgaagatggtatgccggatccacgggtcaggcgacgtggttctcgactacgaggtaaaccccaggagcgacctccctccccttccccgggtgggcgtcgtgttcagcgccgggaggtccctgagccacgtcacgtggtacgggcgcgggcccttcgagtgctacccggaccgcaaggcggcggcgcacgtcggcgtgtacgagagcagcgtggaggagctgcacgtgccgtacattgcccccgtggagtgcggcgggcgggcggacgtcaggtgggtggcactccgcgacgccggcgggctcggcctgtacgcgtcggcgcacggcggctccccgccgatgcagatgagcgcgagctactacggcgccgcggagctggacagggcaacgcacgtccacaggctggtgaagggggacgacatcgaggtgcatcttgaccacaggcacatggggctgggcggcgacgacagctggtcgccgtgcgtgcacgagcagtacctgctgccgccgacgcggtacgccttctccctgcggctctgccccctgctgccgtcgtcgtcgtgccatgacatctacaggtctcagctccccagctgatggtgccgtgtgccggaggcccgtcgatgtcgagccttgggaaacaacaatgaacgcaatggcctggccagtgaatgaaagtatataatattgtaataaagcagagacgtattagctcctgcaacggcctcgcgatcgcctggatatgtctatgctgagggggtgtttagttaactaataacctaactacatatggcgccaagttactaaaacttaataaataactattactaactaaaaaa

SEQ ID NO: 61 - DNA, 990 bp, Zea mays
ccattcggacttccctttattccccttcctatataatcccatcgactgccatcttcagatcttcttccgcttccaacttccgttccgcaaattgaaagctcggcgttgccctgcgcccctgcctcgagctcgaaggactttgtccctatacgtcgttgtccagctcctcgcatattgtggcctggtgcagattggagatccgcccggacttggatcgagtcctcctgtctttggacattcattggagtgctccattcattgagacagcatgcctaagataaagacaagccgtgtcaagtatcctgaaggatgggagcttattgaaccaacaatccgtgagttggatgccaaaatgagagaagctgaaaatgatccacatgatggaaagagaaagtgtgaagctctctggcctattttccgcatttctcatcaaaggagccgctacatatacgatctttattacagaaggaaggagatatcacaggagctttatgagttctgcctagaccagggttatgcagaccgtaacctgattgcaaagtggaaaaagccaggttacgagcgcctttgctgcctccggtgcatacagacacgtgatcacaacttcgcaacgacatgcgtctgccgcgtccccaagcatctgagggaggagcaggtgatagaatgtgtccactgcggctgcaggggttgtgccagcggtgactaatcttgtcatcatgtcgttcggctcacgactcaccatcgcaaccttaaccggatgaggtgccctgctgtaaacatggatccggctgcggtgattagcattagtttattgggtaaactagttgggggaggactaaatttcctcacgtttggatgtttctaactgttatgtactactatgacgttctcgtgtcacaaatgcttgcgttaaattagtagcgcttttgcattttattgagtctgttaattggctactgttgtgggttctaacaatattttttttgataa

SEQ ID NO: 62 - DNA, 2309 bp, Zea mays
tcctcgaatctctccaccgtgtaacacacagccttgacggcaggcccgccaccgcgagatgcctcggaagtcgcacaaggcgaggggcgcggccgcgcacgccgccgttggtctcacggccgggccgaggcctcccctgaaggccacggccccaaaccctagcgccgccgccgagcttccccaggtcgtcgttgccgagacagagggcctcaaggtacctgacgccggggcgtccgccgccgctgacgccctggagcgcctccacgtcgcccctgcttccgacggtgatccgccgcctcccgagcccgtgcacgagcccgccgcgccgcctcagcccccgccggccgaggcgtcgtcttctgggaggtctgcggcgggcgggagttgggaggaggaggctgtaaggaagctgcgggagctggcggaggttagtcgggatgagacggagttgaccgaggaggaggtgcgcgccaatgatcagaggcaggaggacgagatctgtgccctcgaagcaatttttggagatgctgtagtgattttggacagaaagggaggccagcggtctttccaggttcttgtgcatattgaggttccagattatatagatgtatcaacaaagctcagttatggtgatggaacattaaattatgcgtcaacacatgatgatgatgaccttttctacaagttcagagttgagcatttgcctccgatcctgctaacatgtctcctgcctacatcatacccaagtcaccgtcctccctttttcactatatccacatattggcttgataaaggcatgatttcaccattatgtcgcatgcttgacatgctttgggaagagcaacaagggatggaagtaacatatcaatgggtgcaatggctccagagttgttccctttctcacttagggtttgctaatgaagtagttttgagaaagagtgatgtaacatgttatgcagatggtgaagataagcgtgcctgtccagattacgcttcaccagatgttataattccaaggatgatgagatacaatgacaataagcatcatgaagctttcttacatgctatccatgattgcatgatttgtttaagcgagtgtcctggtgttgatttcatcaaacttccgtgtcaccatttcttttgctggaaatgcatgcaaacttactgcaaaatgaatgtcaaggaaggaaatgtagtgaagttgctatgtcccgatacaaaatgtgaaggtgctgttcctccgaatgtattgaaaaggctgcttggagaggatgaatatgaacgttgggagggattattgcttcagagaacccttgatgcgatgaaagatgttgtctactgtccaagatgtcaaactgcttgcttggaggacgtaggtaatgaagcagtatgttcaagttgtttgttcagcttttgcactctctgtagaaatcgccgccatattggagagcaatgtatgtctccagaagagagacttatgatcttggagaaacgccaagaatctgggaatgtgcaaggagatcagatgaaagttctacaggaactacgcagcctgaaggaaattatgaaggattcaaaacagtgcccaaaatgcaggatggccatatctaagacagaaggatgcaataagatgcattgtgagaactgtggggagtacttctgctatcaatgcaaccgtgcgatcactggatatgagcatttcaggggttcgtgtgtgcttttccctcaagaggaattggacagatgggaaatgcaaatgaatcaaagggtcggacgccaaattgttgcacatgctcatgctgcaatacatgggcagaatggtcaagctcatccttgccctacatgtcggcaaccgtctccaaagatcggaaacaacaaccacctcttctgttgggcatgccagaagcatttttgtgccctgtgccataaggctgtccaaaagcccgcacagcattacggccccaaaggatgcaagcaacatacggcagatccctgaatgaggttttcccatatgtgcatcaacaccgtggtgccagggcagtttccatgtgttctgtgcaagtacagataaatacttgtcagataaatacttgtcctgggacgtacttcactcctggattccattattattattatttttgctgcaagcatgttttgaagtttccgtcgtcgttgtacctacagtaacaattgtgcagtttacattcgggaacatgaacaggaactgttcattcattcgttcagtaccagatgaattgttgagaatactcgggtgttgaagttgagaatactcgcgtattaaagatgcg

SEQ ID NO: 63 - DNA, 1896 bp, Zea mays
tttcattccgggagatactttacttcacgcacctgtaacgccgcaccattgcaccaacaccaggcaacggcacgccgcgttatgcgttacacgtcgcagctagcactagcactgtacactacagaaacctccattgccagccagctgcgcagtgcgcttgcctctgctgcgtataaagtttcttccttccttggccgcttctgcgctcgcctcccttctcctcccccatcctctcccttgtggttctagatccactcctccccgtgctcactgctcatccgcgaacaggttgagcggggacgccgtggaggggcgagggggagccagattgagccatggcctcctcctgggttcttgccctggttcttgcgctgtcggcaggcgcaagcctggcgcgtggctcagagccgtggtggaacgagacacaggtgtacgccaccaccgccaactccggtggcggcaacggcgtcttcgtcggcctcacgctcatccagtcggcggcggccaagggagcggtgtgcttggatggaagcttaccaggttaccacctccacagagggtttggatcaggagcaaacagttggctcgtcaatctcgagggtggaggctggtgcaatgatcgcagcagctgtgtgttccgcaagggcagtcgtcgtggatcatcaaatcacatggagaggcaactccagtttacagggatattgagtaacaaacctgaagagaatcccgatttctacaactggaatagagtgaaggtccggtactgtgatggtggatctttcactggtgatggctctgatgcggctgcaggcctttatttccgaggtcagcgcatttggcaggccgctatggatgacctaatggcccaaggaatgcgttatgctaatcaggcccttctttctggatgctctgccggtggtgtttctaccatacttcactgtgatgaattccatggattgtttccctcgaataccagagtcaaatgcctagctgatgctggaatgtttcttgacactgttgatgtttctggccgtcgggaaatgagatcctttttcaatggcattgtgagattgcagggttctggaagaagcttgcctaggtcttgcacctcacacatggacaaaacctcgtgctttttcccccagaatgtgttgccaaccatccgaaccccaacttttgttttgaacactgcctatgacgtgtggcagcttcaacaaagtgtggcccctagaacagctgatccccaaggtctttggtcaaagtgtaggacgaaccatgccttctgtaatagcaaccagctccagtttttgcaagggttcaggaaccagatgcttgatgccgtgaggggtttctctgcatcaaggcaaaatggtctgttcatcaactcatgttttgctcattgccagagcgagagacaggatacttggtacgcgaacaactcgccacgtcttggtaacaagaaaatcgctgacgctgttggggactggttcttcgagagggggaacgccaagtacacagactgcccatacccttgcgatggcacttgccatcaccttgtgttcaggggagaccactaagatcattcttcagcaccaacaaattcatcagatggtacaaggatcaaaccccaatgggtacagaatggaaaacaggatatagatacagataaggtgcaagtggtcggcttgcccatgtttgttcatcagtgagtcatatgattgatagtgcgaggacctcacccgcgaacgcgcggaggaggcctctgcattagattcacataccgtcatgatatcgattattttcattggaaaagcgtccatgattacgtaccagaacaattgagttacatactcatttcgtgtactgtattaataacactagaacgttacatattca

SEQ ID NO: 64 - DNA, 1789 bp, Zea mays
acctctactctcactagaacagaaccctaaacccgcatcccgaacattgacgccggcgatctccgccgccaccgccatgttcgggaccccatccatcactcccgctttcgggaacccctccagcaccccggtttttggcacgccatccgccacccccgcatttggcgcgacgtcgtccaccccggccttcggcaccctctcgtcgacgcctgccttcggcaccccttcgtcgactcccgctttcggtaccccgtcgtctacgccagcgttcgggaccgcttccacgacccctgcgttcggggcatcgtcgtcgacgccagcgttcgggaccacttccacgaccccgccgttcggctcgctgaatttcgggacgccctcgtcgacctcagcattcggcacgccgtcttcggcgccggcgttcggcgcactcaatttcggaacaccctcgtcgacctcggcattcggcacgccctcttcggcgccggcgtttggcgcgactccttcgccctcgccctttgggttccagcagcaggcgacgccgtccccatctccgttcggcttgctaggaggtggcggcgcgcaaatcaccacccagatggcccccgttgcgccgctgccgctctccccgtccgaccgcgacatccaggccattgtggatgcgtacaaagaggaccccggtaatccacgttatgctttcaggcatttgttgttcagcgtgacagaaccttcccaaagggtgaagccagttgctgcctcagatattatgtgggcagaagcaatggggaaacttgaatgcatggatagtgcagacagggagaggctgtggcctcagcttgtgcagggttttaaagacctttcccatcggcttaagcttcaagatgaagtccttgtttcggacactgatagattgagcatgactcactctaatgttaaaaagctgcaaaggcatttccaagctgacacgtatccttggatccagcgattgaagcaacaagagctggctattcagagacgtcttttaaggtttgttagaatagtggaggcattggagaatcggggctaccgctgtcctttaacaaaggaggaagctgacttgtatgaaagattggttgctatattaaagcggctaaaaggacataacgctgatcttgctaagagggtcaatacacttgtttcgacgtcgcgtcttctggctagcagtggtggtgctggtggttccgtttatattcccagttctgcaaaagttgatgagcggagtgttacagagcttcttgaggccttacaacaacaaacagaggcagttgccaagctaggtaatgtgttgaagagggatatcagggacatggagatcatccagtcagaaggtacggatatggctgaagacaatgtggggagaagggcacagaaaatataagattgaagcatggtctttgtcgtagctaagtaataagcgggtgatggaagggatccatcgtcgctagaaggatctgagcctccaacttatttggagtaatgggccagggaaatgatatccctgtgtaactgctgcaggcaagcttgattctgcattctttgggaagctaaccatggtcaatcagtagtggtatgtgtagattgtatgtggaactgaggcagtattcttagaactcagctttctcctcgtgccaactacattttcagtgctgttttgttgctcaccgtgattcgttgagctgttttgtaaccccgcggatggtgttgtggaatggacggagccctgcatatgcttggtccttgtcctcgacgttgc

SEQ ID NO: 65 - DNA, 1570 bp, Zea mays
cagtgttacacatcgaaatctccgcctcctccagtcctgctcgctccccacctctcatggcggcgccggcggccacccgcctccactccccgttcctcctgcttccttccccaccgcacccccacccttcacttcgcctccgcttcctcctgccgtccccgccgccgctccgcctccgccgccacttcccgctgctggctgccgccgccgtatccgccgcagccggcgccggcggtggcggggaggaggtcgccgctaggaaggacgacaaggccaggcagctgcagaagcgggtcctcgtgggcgtcgccatcggggtgggcgccggcggcatcgtggtcgccggcggccgggtgttcgccgccgccgtcgcggccgccgttcttgccggctcccgggagtacttcgagctcgtccgcagcactgtagccggaggcgggaccccgccgccgcgctacgtgtcccgcgtctgttccgccatctgcgctctcatgcccatccttacgctgtactatggacgcatggatgttactgtggcgttttctgcattcgtcattgcaatagcattgcttttacaaagaggaaaccctcgttttgctcagctaactagttcagttttcgggttattttactgcggttatctaccttctttctgggttaagcttcgatccggactagctgcccctgccttaaatacaagcatagcatacaattggccaattcttcttggtggacaagctcactggacagttggacttgtagcaaccttgatggctattagtagcatcattgctgctgatacatctgctttcctttgtggaagggcatttggtcgtacccctttgactaacataagccctaagaagaccttggagggtgctttagctggcctagctggctgcgtactgaccactgtgctgctgtcgactgccttacgctggccaaggtcgcttttgagtgccacagcttatggaatcctgatcttcctgggttcgttattcggggatcttgttgaatctctgatcaagcgcgacgctggtgtgaaggactccggatcgctcattcctggtcatggtgggattcttgaccgagttgacagctacgttttcacgggggcactttgctactcttttgtcagagtggctctacccctgtacggggtctgattagagcaccggccttcttgttgttttgcctttctccttccatcagcaatgcggtcagtcaccatacattttaacatgcaacgatgagtatttgctgggatgccctagatcagttcttcatctcaagacaacgtggtcttccctccaagcgaatttggtggccactagctcgtcatcgacattgcttcttgctttgggtttgagatggcctttccagctcaaccagtttcttgcaagccttgtaactctgtgtgtacatagtttattttttcatatagagagagagtaaaaaggaaaggctaattattcatcacaaaagctgttaacagtgcattgaggcagcttatgtcaatatgtaccaaactacacttgttttaataattcaaggcactaaattccctatc

SEQ ID NO: 66 - DNA, 917 bp, Zea mays
agctctgtgctctccaaatcagctgagcaacctgcaggccagttccaccaagctaaggaggtgagaatctctgtaaaacgctgaaggaaaaaaaaaatgaaaggatccagcgagcatggcgagacctcgaagcaggcgcccctgggcagcagcaggggtgtcagcaaaggagtgtccgtgctcgatctaatacttcgcttcattgccatcatcggcaccctcgctagcgccattgcaatgggcaccaccaacgagacgctgcctttcttcacgcagttcatccggttcaaggcgcagtacagcgatctccctactctcacgttcttcgtcgtggcgaattccattgtctgcgcttatctcaccctgtcgctcccactatctatagtgcacatcattaggagcagggctaaatacagcaggctgctcttggtcgttcttgacgcggcaatgctagcactggtgactgcgggagcatctgcggcagcggccattgtgtacttagcgcacaaaggcaacgtcagagcaaactggcttgccatttgccagcagtttgactcgttctgcgagcgtatctctggatccctcattggttcgttcggagccatggtcatgctcgtactgctgctactactctccgccattgctctagccaggcgctaggcggtgcgtgttgcggttattcgactccgctatccttgtgtaatcatacgtgtgcctattataacctctcgtgctatgatcctctcatatatccccaattgttggcttgattctgcacttcttttcttctgatggtgtgcactatcatgtatagacgctacaaaaaaaaataggtgaactattatgtatggatcaccgtagtttctgaaagacttgttgggtattgtattcacttatcagaacaaaaacatgaaaga

SEQ ID NO: 67 - DNA, 2788 bp, Zea mays
ccctattctactccactctgttttctggaggctgctaaactaaacccttcttctccccactccgccctcggacccgccgccgccgccgcttgccgggtctatagccatgtcaccagcggttgcctctgcctcatctggcgaccgcatacgaacctacgaagacttcgtgcgggtacacgcgtacctgctggccgcggcgggcatcccgccgtcgctgcaccggaggctgtaccgcaagctcgcggacgaggtcttcgacggcggggaggtctttgccgtagagccgtgcgaggacgggaggcagcggcgcctcgtgctcaccgccgatcagtctctaggaaaagagtccgatgtcttcctcgtcgaccatgcgtggtccttccgcctccctgatgcgctcaagcagttgagggaagtaccaggattggctgaaaggatggcagcattaatgtgtgtcgatttggaccgcaagattgaagcagatgagcaggatgatgacgagagtgggagcttggagcatgtatcgcaagtagtcgagaaagaaagggctagagttcaggagagaagtgattctacagcttggctggaacttgaagaacttggaattgatgatgacatgctagtagccttggatctatctgcaaattttccgaatctggtagctctgaacctatggggaaacaagctgcgggatccagagaaagttatgcaagaaatcaggaagtgcacaaagctaaaggcactttggttgaacgagaatcctgttcttggcaaaagtattgacaaagctgttttcgatggcctctctggattggaaatatacaattcacattttacaagtaaagccggagagtgggcactaggtttttgcgcagacattgttggagcagataatccctgttcttctgtggaaagcacattgtttgggagcattgggactattgacctttctgatagatgcattcacaagctaccagaggtgttctctcctagtaaattgccatctctgtcaaaattgaacattcgtggtaatcctctggatcaaatttctggcgatgatctcttaaagctatttggtggattcactcagttacaagagttggaggttgacattcctggccctctgggaaacagtgcaatctccattcttgagtctcttcctaatttatctttgctaaatggcgtggattcctcaagcataatagagagtgggaagcatatagttgactctgcacttgaaccacggcttccagaatggtcacctgaagaaccccttgctgaaagagttattggcgcaatgtggttgtatcttatgacataccggcttgctgatgatgaaaagattgacgaaacacctgtttggtatgtcatggacgagttgggctcagccatgcgccacagtgataatgcaaacttcagaatagctccattcttgttcatgccagaagggaaactgcacactgctataagttacacaattctgtggcccactcatgatgttcatactggagaagagtgtacccgggatttcttgtttggtattggtgaggataaacagcgttcagctaggcttacagcttggttccgcacacctgagaactactttattcaggcaattttgaggtaccaggaacagcttcaatcaaatagcatttgttcttcgacaaaaatagaagagacacagacaccctcaaccaaaagtgtacgctcaagggatggtcgcgtccttcgagtatatactgacatacctcatgtagaggagtttttaacacggccagaatttgttctcacgactgatccaaaggaagctgacatcatctgggtaagcatgcaagtagattcagaagtaaagaatgctgtagggctcacagaccaacaatacacaaaccaatttccttttgaagcttgcctggtcatgaagcaccaccttgcggagaccgtccacaaggcttggggctcacctgaatggcttcaacctacatataacctggaaacccatttgtctccactcattggtgattattgtgtgaggaaacgagatggcatggacaatttatggatcatgaagccttggaacatggcgagaacaatcgataccacagttactggtgatttgtctgctatcatcagacttatggagacaggccccaagatatgccaaaaatatattgaacgccctgcacttttccaaggaaggaagtttgatcttcggtacattgttttagtccgtagtatccgccctttggaaatatttctgtctgatgttttctgggttaggttagcaaacaatcagtacactttggagaagactagcttttttgagtacgagacccatttcactgtgatgaattatatcggaaggatgaatcatatgaacacaccagagttcgtcaaggggttcgagaaggagcaccaagttaaatggctggacattcatgaaagcgtacgatctaccatacgccgtatctttgaggcggccgcagctgtccatcctgagatgcagaacccattctccagggccatctacggtgtagatattatgcttgacaacagattcaaaccaaaggttttagaggtgacatactgtccagactgcgggagggcatgcaagtatgacacgcaagctctggtaggaagccaggataccatcagaggccgtgattttttcaactcggtgtttggctgcctctttcttgacgagcaaacgcatgtattgcccttataggcatccgccccagaggcggctgctgtaacatcaggttttatcataataacgtgacatatgtat

SEQ ID NO: 68 - DNA, 1294 bp, Zea mays
atctgtccccatttccgctaacagatttggagaacacaatttgccacaaagaaagcaatgttcttcttgtggaaatacatgcagctatgaaggatgaaggtgactatttcactgttctgcagaacaagaaacggaagttaaaggtaagttcagtaacatgggctgagtatctatgtgatttcttggaaatgacaaaaaatgaagaacgttccacaaacattgcaacagtaataaggggttattatggtcttattgacactgatataaagcttaagatcctccgggaactagtggaagaagctattcaaacctctgccataaaggagatactaagtgaccgtgtggaccagaaacaagtcctcaatgcaacaaaaagagagaacaccagaaaggacaaacaagagaaaaatcttaacactgaaattgccatgaaaagtcaggagaatcagacagatgatgtgcaagttggtcatgggggtgtagatgagctggttaggagaaaagaagaaaatgacaagagcaatatttctcggagtagaacagaagggaaacgacacttggtacagcaccttgagacggagattgagaaattatccatccgatccagcccacttggtaaagacaggcagtacaataggtactggtttttcaagcgtgaaggaaggctttttgttgaaactgcagattccagagaatggggttactacaacactaaggaagagctttgaaacggcaactagagaagttttacagtaagataagtaatgccctagagaaacgatcaaaagatatcgcaaacaggatgttacttgaagagggtgtactgcggcgttccacacgtgtccgggctcagccaaaggacatggcattcctcaagtacgtcaacaagtggaaggataactgaggtggcggtctgccagcggtggtggtggtctgccagcggtgggaggataacttgagccactgggtgacagggtttgcagtagatgtgtttggtttgaggttaaagtgggatgggacgggggcgacaccgtcctctcaattttttaattttttgggatcacgccgctacaaaaaaactactctggtgtttacctcgtccctacgtgactcccatttaaccactagagtaactgtgaccgtcccatttcatcctttcgtatacttggttaggtcgtcacagtggttcgccatactcgtcgcattagctaatgaaaactgtactagaacctagttttcttccctttgctactgaaatgaacactggttcacaaatgaaaagcttttgctactg

SEQ ID NO: 69 - DNA, 1282 bp, Zea mays
acgattcatactgcattcactcacctccggcggcctcccacgaagaattcgctcgctttccccggttgcccgtcaccactgacgcccgcctcccccgcggcccttcccatcgccgcgtataaaggttcgctgccggcaacgagaagatgcagctcaccgccacctccacgctcgaagctcctcccgaaccggccgcatcgtcgccatggcagccgccgcttctgcaagctccgtgaaggaagtgctgccgtctcccctgacctccgcctccgagccccctccccttttcgatggcaccaccaggttgtacgtggcctatctttgcccgttcgcgcagcgcgcttggattgctagaaactacaagggtctgcaggacaagattaagatagttgccatcgatctcgctgacaggccagcgtggtacaaggagaaggtttatccagaaaacaaggtgccttctctagagcacgacaaccaggtgaaaggagagagcttggatttggttaagtacattgacagcaacttcgaaggtccatcgttgctccccgaggatcatgcaaagcagcagttcgctgaggagctgctcggatacactgacgcattcaacaaagcattttactcatgtttagtcgacagggaagatgtgtctgaggaagccgttgctgccttggacaaaatagaagacgccctggggaaattcaacgatggcccgttcttccttggtcagttcagtctggtggacgttgcgtatgtaccgttcatcgagaggtttcagatactctattccaatataaagaactatgacgtcacaaagggcagacccaaccttcagaaattcatcgaggaagtgaacaagatcgatgcgtacacacagactaaactggacccgcagtttttgcttgagcaaacaaagaagcggcttgggattgcttaaagcctgtgaccaaggacgagactttcgccagaagcaccagcgtagtagatcggagctcgttttagtcggttgtgtgcttggatattacatctggtcttcaataaggcatggccttctgtaatggctgtgcttctgaaaataaataaactagttgtccaggtattatcgttgctttggtgacgtgtcgatgtcactgtatatatatgaatgggtcggaaagaatgatgatgtgcagtgtgttctgtgcaaatattgccgagatgaaggatcagtatccatgtagacattcatatattgctcatattgtgacacggcgcatgaaagacatggtttcggcccctaccacgc

SEQ ID NO: 70 - DNA, 1497 bp, Zea mays
gaccctgaagctgggtagctcctgctcctatcccggctgctggcgcgccgtggttttgtgctcttgtggacacactggcctccacccatccctctcacgtctctggccatccgcagccaaggcgcgcggcccatcgtcgatttatagccacaccatggccaggaagtgctcccactgtggcaactacggccacaactccaggacctgcggactaggactaggactaggacacagagaaataatgctctgcgaaggtggcgacgacaataatggccgcagcggcctaaggctcttcggagtgcaggtccgtatcggcggcggcggtggcgcagggtcggcgtccatgaagaagagctacagcatggactgcctgcagctcgcggctcctcatgcttgttcgtccctcgtctcgtccccgtcgtcgtcgtcgttgtgctcgtcctcgtccccgtcgtcgctgctgctgtcgattgatgatgggttgcagagaggggcggccgatggatacctgtctgatggacctcatggcagagctgtgcaggagaggaagaaaggagttccatggagcgaggaggagcacaggcagttccttgccggcctggacaagctgggcaagggcgactggcgaggcatcgccaggagctacgtgccgacgaggaccccgacgcaggtcgccagccacgcgcagaagttcttcctccggcagagcagcatggggaagaagaagcgccggtccagcctcttcgacatggtgccgatctgcgagaacagtgcgagcatctccgatccgctggacgtggcacgccatggcgtcgcctcggcagactccgagagggcggccgtggacgtggacctgatgaattcgacgacggagggtgacgacggcaggagcagggacgtcgtgtcgtcggcgtcaggtgcagggaccgcactgcggttcccggcagcggcagctcagacggagccgctgcatccttcgtcatcgcatggccatgggcgcggccaccactgctctccgttggacctggagctgggcatgtccctgcccgccccatccgtcggaacgtgatggagatgaggcgaggccgaggccgtgcgtgactgctgtctccctcagctgtgtgtgtcagccagatggagatgatgcgctagccaatacagtactgttcgtgatcgtgaaaacggtgtgcaaacactagcacagcggcactaaactaggatgtcgctcctcgcaccatattgtgtactgtaaccacgttgatccacgtcatctctatctcttcaccaccgttggatcataggctgtcagtttcatctatccgtccatgtgtcatactcattcacgatgcggtggcttaatgatccagcagtaatttttcttctttcgtgacttaagggtatatacggtggtatttaatgtagaggcttttgatgtatttaaaggggtatttgcaaaaaaattatggagccgtctctgcatgaagaaacgcatctgtc

SEQ ID NO: 71 - DNA, 2173 bp, Zea mays
cttattcgctcccacatccaccaccatctctaccgcgccgcacccagctccagctctagcagcaccatctctaccgacgcacccacctcctcctccttggtgaaggccggccgcgccactgcacgagcacacacgaacgcacagagacgggtggccgccgtaccgacgcccgcgcctccaggtagactagactactactagtacctggcagggggctgctccattgccggcacatcatcaggaaaaagaagggagctgtgctaaaatttcttggaggggagggggtagagatgacgtttggtagcgccgacatggaggccggcggcggcggcgagcgccgccacggacaacaggaggaacagtcatccgacgagcggcgcgcgcggttcgcggaggactggggctgctgcgcctgcgcctgcgcggggctattcctggggcccaacccgatggtggcgcgctacctgtacgcgctcatcttcctcgtcaccaacctcctcgcctggacgctccgcgactacggcgactccgcgctcgccgagctgcagcggctgaaggtctgccagggcgcgctctactgcctgggcgcggagggcgtgctgcgggtcagcctcggctgcttcgtcttcttcttcgtcatgttcctgtccaccgtgaacgccaggaaggtgcacgactgccgcaactcgtggcactccgagtggtggccggccaagctcgccctctggctcggcctcaccgccgtcaccttcctcgcgccgtcgccgctcgtccagctctacgggaaggtggcgcatttcggagcaggggctttcctggtgatccagctgatcagcgtcaccaggttcatcatgtggctcaacgactggtgccgcgcagagatgacccagaagagataccacttgcagattcaggcggtgtccatcgtcacgtacgtggggtcgctcctggggatcgtgctcatgtacgtgtggtacgcgcccagcccggcctgcaggctcaacatcctcttcatcaccgtcacgctggcgctcgtgcagctcatgaccttcgtctccatgagctccaaggtgaaggcagggtacgtggcgccggggctgatggggatctacgtcgtgttcctgtgctggtcggcgatcagaagcgagccgcacacggaggtttgcaacaggaaggcagaagtcgccacgagcgcagactgggtgaacatcgcgagctttgtgatcgccgtcgtcgtcatcgtggcggcgaccttctcgacggggatcgactccaagtgcctccagttcaagcaggcggagggggagtcggaggaggaggaggaggacgacatcccctacggcctcggcttcttccacctggtgttctccatgggcgccatgtacttcgccatgatcttcgtcggctggaacgcgaacgcgagccacaccatggagaggtggacgatcgacgtcgggtgggcgagcacgtgggtgcgcgtcggcaacgagtggctggcggcaatcgtgtacatatggatgatgatcgcgcccgtcatctggaagacgaggcaggtgggatcggcggcggagacgtgagcagtttttccgctgattctgagtttctgacagccggaatctatatatacatacaaacacaagagcaaatcaaagggacgggaaacgggaagaggtggtgcgtgctaactcctatgcatcgcattcctggatgttcattggtcaatgatgatgctgcactgctgcagctcgggtagtttttgctaagctggaggtgcagcagacaagacaacaagaaagaggaggcaactaaggagtagtactatactgatgccactagtccatcgtggagctcggttcaggaagctcatcgatctcgttgtacttgtaccgaactatctcaaaaaacatagtgcctgtttgtctggattgctgctcggccacaagcacagctgtctggcccggggcaccatccaaacaatcccatatagagcgtgtttggacgcaattcatgggcctgtaagcaaacacgtcccaattatctgaactcggaattatttacgcctcggcaagattcatcaactcaatttttttgtgaacaatcttattgtgttactaggtgaatgcccgtgcgttgctacggagtaaacatattatgataagatatattgaaattc

SEQ ID NO: 72 - DNA, 3194 bp, Zea mays
tttctattccacgaccttatccacaccagcagattcgaaattcacggacaggcccatggacccggcgaaagccagcggtggttcagcccctgacgtgcgggtcccactctccagccgcaccgcctagagaggcagaggcatcccttcgcgtggaagcaaacgaggcgtgataaagtggggctcctcggtcccggcgttggccgcatcgacactcgccgcgcaccaccaccaccgctgcggctcacggctacgcagcccgctctcccgacccccccgtgccctcctctttttgctactagcacatagagtttcgcccgaatcgatcgccgactgactccgctagggttcggcccgatcgccgcttcgtcctcccggctcccgcggggaccccgccgagatgtctgactggagctcgccggctgcgccgacgttcttcccttttggcccgcaggccgaggggtgggacgtcaccttcaaggtcaaatatggtgatacacttaaaaggttttatggttgtgccaatgggagtcattttgacatgaatttatctgctctacgggcgaggattgatactgcctttaagtttggtcctgacgttgactttgttctgacttacaccgatgaggatggtgatattgtcatgctagatgatgatgatgacttgcgtgatgcagctctccgtcagagattaaaccctctcaggattactgttcaactgaagaaaaatcaaccaactgaaaaaaaagatacttctgcaccagtgaaatccgctgctcaggatccactatcccagttaatgtcagctattgaaggtttgaagcctgttcaggaagatagtctggcccatataaaatcagctattggtgaagcaatcaagtctatcccagagccaatacctgatgcccttgcaaaactttctcatgaaatacttgatgcagcaccaccaccattagctgagctgatgaaaccttttgcacaattgatggcaccaaacaataatggcaatgggccatctgatgtgcatgctgaggggtcatctagctcttccagtgcacaggtgccagctgaagctaaaaatgagcccaaagttaggccaagtttgggtcttaagaccgtgttgaaagaggctgctggacctgttcctaatgctggagcttctcaggttcaacagccattaatgtatccatctgttgaggagatgctgttcccctgtaattcagtcgacaaatctgtttgcaaagggaagattgatgctcaaagtaagggaaaatctgttacgtcctcaggcatccaacctgctcctcattctcttcgtactcatgccccacctccaccacatccgtgcatttcagaatggtcccgagcacaaagaagccaacaccgtcaattgaaatttgaagacaatgcaaaaaccactaatgattctagatggcgcattccgatgtataaaatgccctatgcaccaccacctccagcagtgccacccccaggctatgtaccttctccacattttccttatccaggccgcctcttatcttctgggcatccatacggagatctcgctggtaacatggaaaactcagcaccacatagtctgcatagatggattcagtgtgatggctgtggagcgcaaccaattgttggtccacgttataaatctaatgtgaaggaagactatgatttatgtgattcctgtttccagcgcatgggaaatgaaatggagtacaccaaaatagacaagcctattttaccccacaggtttctaagagatccccatgtgtaccggaaggtgcaccatccacgggttctaatgaagtcaagacgggagaaacttgaaagtcgcttcattttggatgtgactgttcttgatggaacactgatgacaccttctaccccgttcactaagatttggcgcatgcataacaatgggtctgttgtgtggccacggggcacacagcttgtctgggttggtggagatcagtttgcattgcagacatctgttccattagagattcctgtggatggttttcctgtggacaaagagattgatgttcctgttgattttgtggcacctacaaggccagggaggtacatatcttactggaggttggcttccccttctggtcagaaatttggtcagcgagtttgggttcatatccaggtggaagacccttcttttgttaatgacaataacaggaatgctgctattaacctgaatctgcctccagagagctatagttcaaacacaaccaacttaattgatgtgaacattgagcctgctgactcagcccttagtgcacatgctaagcgcacaaaggagttccatttctgttcaactgattttcctgaacccagtaagtctgtgccttttacgttggccactacctctttgtctgcagcagctcctacaaaccaaactggtgatgttcccatgtccagtacacctgctgctgcttgtttgccctctgttaatgtgcctatgcatgaagtcgttactactcatacaccgtcacctattacgcctgtcttgcctacaactatacacttttcagccccagtatctgctcctgcaattgcccctgagcttgcatcaggggctgttggtgtgcctccacctgttagtgctgtggtacctgagctgtcagaactggatgttcacaatgaggagaagttgctgagggagctggaggaaatgggttttaggcaggtcgatctcaacaaggaaatcctcaggcagaacaattacaatctggagcagtctgtcgatgacctatgtggcgtcaatgaatgggatcctctccttgcagagctggaagagatgggatttgatgacacagagatgaacaaggagctgcttgcgaagaatgagggaagcatcaagcgagctgtgatggagctcattgccagggagaagaaggacaagtgaagatcgtgtgctatctaagtatatattcgtaaataatgagacggctgtgccactgcggtgcagccctggtgcgtctcagagcttgcttatggtgaactcttcgtgttaggtttcttccttatatctgtcgtgtctgcggtgtcgatgaactatctagtatgtggagcgtgtgcgtctcagcagttaccctgccatgccacgtggactggctgtcgtgcctactgtctgttaccatgtatatatataaaaaatgatgcgtggaccaatg

SEQ ID NO: 73 - DNA, 2635 bp, Zea mays
accaccacccgtcctcggccctcctctctctctctattcccccctccccggaggccggagcgctcgtgcggaccacgaggaggaggagagagagaggcagggagccctagccctgccctgcgcgccggcgtcgccagggttagggtctccccggggcccccgccttccttgccaatccctccgccgtcttctcgctctggccgatccccccgcccgacgcgcggggggcgcctagcggcgtgtctgcgttcggcctcgacggcgcggcgcgagccaatgctgtgtgcctgaccgtcgctttgggattgattccactcggaggtggccagctagccacccgagctcgctgtccttgccggtacggcgtttcctgaggaggttccgtgcgagatccgaaggccggcgtgatgcagcacgatcagcgcaagaagggttccgtggaggcagagtttttcacagagtatggggatgcaagtcgatacaagattcaggaagtcattggtaaaggaagctacggggtggtctgctccgctgtagatgtccacactggagagaaagtagcgatcaagaagatacatgacatctttgagcacatatctgatgctgcccggattctccgtgagatcaagcttctgagactcctaagacatccagatattgttgagatcaaacatattatgttgcctccatcaagacgggaattcaaagatatttatgttgtttttgaacttatggagtctgatcttcaccaagttatcaaggctaatgatgacctgacaaaggaacattatcagttctttctctaccaactgatccgtgctctgaaatacatccacacagctaacgtttatcaccgggacctgaagccaaagaatatattagcaaattctaactgcaaactgaaaatttgtgattttggactagcacgagttgcattcaatgataccccaacaacgatcttctggacagattatgttgcaacaagatggtacagagctccagagctctgtggatccttcttttcaaagtatacaccggccattgacatttggagcattggatgcatctttgctgaggtgttaacagggaaacctttgtttcctggtaaaaatgttgtccatcagttagacttaatgactgaccttctaggcacgccatcgatggatacgatttctcgggtccggaatgagaaagcaaggaggtatctaagtagcatgagaaagaaagagacaatttcgttctcacaaaagtttccgaatgcagatcctttagccttggatcttttgcaaaggcttttagcatttgatccgaaagaccgtccaactgcagaacaggcattggctcatccatactttaaagggctagccaaggttgagagagagccatcttgtcaaccaatcacaaagatggagtttgagtttgaaaggagaagagtgacaaaagaagacattagggagctgatattccgtgagatattggaatatcatccacaactgctcaaagactatatcaatggcacggagaggacaacctttctgtacccaagtgctgtcgaccaatttaggaagcaatttgctcatcttgaagaaaatagtggaaacggacctgtgattccaatggaaagaaaacatacttctcttcctaggtctactattgttcactcatctccaattcctgtcaaggaacaaccccgtatcggcccatgtagggaaaggccttcatctgatgagtcctacaggaatcctcgggagacagaacaatattccggcaatctccccagaacgtcacaggctccacaaagagtgccaacagcgagaccaggaagggttgttggtccagtaatgccttaccaaaatggagacaccaaagacccctacgacacacgaaggttggcaatgagctcaggatatcctccccaacaaatcccacaaacgtttggttattatcagacacatggtaaaccagcttgctgcgagccatcacaggctgaaaggtacacgctgcatcagcaggctgcctatgcctgcgcaaaccgtacagccgcgtctgatgttgctctggacatgagagcacccccttttcagcatctatcggcagggcagagaagtgactcttgtgataggctgacagcagagacaaacttgtacacgagatcaaccaacggcatcgctgccactgcagcaggagtggcagcaactactcacagaaaggtcggcgttgttccgtttggcatgtcaaacatgtattagtgactggatcatggccgaatcatggtgaatcctctgtgcggttgatgggtctatgctgccttcaggtggctaaacaccgacaacttgaagcggccaatcaaacctttggctggatgctgcaagtttagagtgcagtagacagtgttttttctgtgtggtcaggaaaagaggaacaccgccggcggcatgaagcctgccaaaaagtttgtatctgcctgtgcctgagaagtgtgcccttggttgcacactgagaaggggtatagtcggcagtccggcggcatgtaatctgggcaatttaggcgccaatttcttttctagagcgaggaggcagaagggaaaggaaggaacattaacgttttaaatgttgtatagagacgtttctcatg

SEQ ID NO: 74 - DNA, 1116 bp, Zea mays
cccgtccgcaaatccctcgtctagtctgctgtgccatctgttgtaccacgactaaaccacagctccaccgtcaggtcttcttcccctttcgtgtcctctcctgcgcgcgcaccgacaagtgaacgagcgagcgagcgagcatcatggacatggaggcggccgcgatctccgggaccgccagcgcgtcgtcgtccacgtcgcggcgcggcaggagcatctcccgcctgccagcgcgcgtcgccggcgcggtgatccggggcctggtcaccttcgtcttcgcggcagtgggcatggtcctcggggccgtcacgggcgcgctgatcgggctcgccacggagagcggcctggtgcgcggcgccggcatcgggtccatctccggcgccgtcgtgtccatggaagttgtcgattcctccgtcgccatctggcgctccgacgagtccgggatctggagcgtcctatacgtgctcgatgtcctctggagcctgctgaccggccgcctggtgcgagagaaggtggacccggccgtgcaaagcgccgtcgacagtcagatgaacgccgcggactcgcaggacatggcgccgacactggcggacatgttcgagacgggcgccgccgacgccaagggcatgccggccgccgctgtcgcggcgctccccatcatggccttcaccgagcacaccgtcgccgacggctccggggagcccatcggctgctccgtctgccttcaggacttcgaagcaggcgagacggcgcggagcttgccggagtgcgggcacacgttccacctgccgtgcatcgacgtctggctgctccggcacgcctcgtgcccactgtgtcgtcgcgcggtctaagccggtgcgcacacttttcgttaggatgtctttgggcaaccgtgagccgatgcgcgtgcacacgtgtcccagaccaggagcacagtatagtagggtagtaggagtgcaggacacctggttctttcttgcataccttgattatttttttccttcttttttctacgtcttgagcacgcatgtacagatacagtacgtggctcacattgtctcacacacacactgtggatgtaaatatgtatagggtaaatgttgtaaacaatgtaat

SEQ ID NO: 75 - DNA, 765 bp, Zea mays
cgcactagttcgcatcaagcttcaagcatccccacacgcactccgcctccgctccgctgtctccaccggtccgcccctcctcccctcctttgcgcctccccgaatcgcatcagcctttctcctcgtgtcgcgactcgcgagcgaaaccctcgccatggcggaggcgaccgacaccgccgcagccacgccgccgccagcgccagcgatggcgactttgtccccgcctcctaagtcggggatcccgccgcggtacaacctggacgccaagtgggacgcgtgcctcgacctctccatccgtcgagttgcctactcctccctcgccggcgccttagcgggcctcctcctcttccgtagccctactactcgctgggcatcagttacccttggggctggtgtggggataggggctgcatacactgaatgctcatacttgttcagtggtggtcctccaaattggtcacccaaagtatcaacaattccttctgcacactctgaaggagaagacaagtaaacccttgcccgttggatggtggagttgtggtgtgtgtgaagtactggctgtttgtgctggatattgcactgcctgtggccataccatagcatgcattgagttttctggcaaacccattgaattccccaattgtggtctagcgaggaagtgcctttgcttggtaacttgttcgcgccatacttctggggctgtatcatcgccaaaccatgcgacgcttacttatttcatttggttctctgcatgcttctccccaa

SEQ ID NO: 76 - DNA, 878 bp, Zea mays
agcacagaatcaaaaatatctgcctgcctacctaccgatggccgccgcgttgtagttgtagtgtaacctagccacacgacgcatccgcggttcatcggcctcgcaggaaacgagcgtcgagcaaaaggtcgaattctcaactctcaagcaccagcaggaatcgagcgagcgagcgagcagtgtccgccccccatggccatggtcgcgtccacctccttcgcgtaccacaagccgcgtttcgcggtggtgtgcaggaagaacagggacggccgggacagggagcgggacggcaaggagcacaagcaccccttcaaggtcgtcgagatcacgccgcctccgcggtgcctcggcgtccgctgcttccccaccaacatccactgcggcgagagcgtgacgatcgaggggcaggcgtacacggtgtcggcggtgacgcaccggtaccagctgcgcaaggggcggtacgagccgagcgagaagcgcctcgacgtcctctccaccggcagatacatcctcaacctctacctccagaacctgctcgaccagtcctagctaccatatctgtatctgtactgtacatcagcatcgcttcactctgtatagatatacatacatatatatgttagctagtagcatcgaacacttgtcccggtgggtggcggacggagatagtgtttccctgcgtgctgctctgtgtaaactgaaaaatgcgagatgaggcataaagttcagtgaaaggttgcatacattttcttgaagaaaaaaaaagttcagtaaacgagtttggattgagtgagattggatgagtttgaatcctaaacgggctcgttcggttagctttcaattcatgtggattgagtgagattggatgagtttgaatc

SEQ ID NO: 77 - DNA, 2223 bp, Zea mays
cagttccggcatgcttaatcttcgggtcaacggtttcgatggaaacccagtgagacactgcggccttcgcccttccatcttcatccagctggggaagataaccctccgatccggcgcaggcatgcttaatctgtccaggtataaagcacaaaaaagtgatcctctcatctaattgagactgttgagtatctcacatattcttgtgcttgcttgctgggatcggctttggctcaggagcatgagcgaaaagatatgattcttcatttctccttctggctataagttttagtttctttatgatgggaaataaaactggtaagcctgtcttcagtgagctcaaatccacagagtttagtttattggagagcactctagtacaggatcattgtgcaatcccgacttgtgtaccattggattttctgaaggccatcacgagtgatttctctaaggagcaagagctaggaagaggtgggtttggagttgtttataagggccttcttaaaaatgggaaggcgatagctgtgaagaagctttctgaaatgaacctagatgacgatcagttccataatgaagttacttatcttttcgggttgaagcacaaaaatattgtccagctaaaagcttattgtgctgaatcacggtgggaagcaatcgaattgcgcagaaaatatgtcatggctgaatctcggaaaaggctgctgtgctttgagtgtataaataataagagccttgataagcacctttctgctgaatctcatggggttgagtggcatatcagatatgagataatcaaaggaatttgccatggtttgcattaccttcacacagattgccaaattgtccatttggacctaaagcctgagaatatattgctagatgacaacatggagccaaaaattacagattttggtatgtccaggctctttggtctacaacaatccaaaatcatcaccaaaacttgtggaggaacacttggatacatggcaccagaatacttactaaaagggttgatttcagtgaaggccgacatattcagtttgggcgttataatcatagaggtgatgaccggaggccggaattatcccacttgtgaaaaatcttgcgagcaattcgctgttgatgtggttggacgttggaggaagaggttattggaggaggcaggaaggtacacacccttggaaaaatacgttgagcaagtagagacatgcatcttgataggattgatgtgtgtcgatgatgatcctaacaaaaggcccacgacattggacattatcgaaaggcttaccaaagtagatgtcacgaacacggacagagggccacccaaaactctggaggccgcgacagggcttacaggccaccccaacctcgcaactagatcatttcttgacaggttccgccgaaccatcgtgatagggatgctgaagaaggccctgaaaatccaggacgtatcgcagttggagcagctcctggccaaggaggtgctgctggagctccacaaaatcggcacgaatgcaactggaaacagatcgttcctggagaggctccacgcaagcatcaccatggctacgctggttcaggcgctgcattccttggacttggatccatcggcggcgctgcgtatggaggtgctgttcttggcgctggagaatatgcgtggaaaaaacaactcaaggcgaagaagcgaggacgtccttgagctggaggagcggccagagcagatccggtcggtgctggaggctggcaccagggccaggctcagtgatgaggaacacatgccgtcggtgtctgtgcaggctgaagaccaggcctttcccaaaccgaagttggccaaagtacgcgccaccgccccggtgtgcgtgtcagcagtgtggttggcggccggcataggattcctgtgtggattcaccctaggagagatgaggggattaaggcggacgagggtccacgaacgcacgtgatgccaatgtgcccacatgacatggccagaaaatgtcactgcggtggaccatgcatgcacgaattaaggagcaccagttagaatacgtattctagattcattttacaaattctgtatttaaaaggaacttgtgcattgtgacagaggcggcggactggatcaggttgtattgtttctgctggtgtcctggcgtatgtataagccacggagtgtatcggatgaaattgaacagagaaatgtgcaatatagaaccgtgttgagggcag

SEQ ID NO: 78 - DNA, 1331 bp, Zea mays
acgcacgaagaaaatcccgccgccctccacttagatttttccagcgacgctgtcttcttcccctgttgcgcgccgtggagctcccacacgcgtttcttcccctgccgaagccctcccatggcgcccggctctgcttgcccgtggccgtcgttcctaggatcagcctccatctccagttcgtctctctccctgcgcgctttcccagacgcgcgcctagctcctcgcgcgggtctctggtgctcagcagcccagctccctctgctcgcgacgcacgcccagcctctcccaagaactcgagttcctctgctttttccccaaccgcgcgcggtacttctcctctgctcgctcgtcgccatggcgatggccaccgagctcccttgtcgtggcttcctgcttcctcgtcgcgcgcgtagcgttccgtcgttccctgccgtgaccccgtcgtggtgcttcctcgcgcgcagctcaccccaactcccattcgtagtggtcgccagtcgtcgacctagctcggattccatttcgccaacacctgctcctagtcgacgcttgctcggattcgcgtccctgcgcccagccaagttcacccctgcgtgcagccgtgggtttctctgcacagcgttcctgctccccggcctctgtcgtgctcgacagcatgtaattcatgtcgaagcagcagcttcgatcccttgcgtcatgctcaccagatcgagtctcacgtcgtcgatctgtgccattatatttggctatcggtttcgccggttgtcgattttcctattcgctatggtcatcacgacaattgttcctatccgagctagcctcgctcgccagccgtcacgccatctttacctgttaggccgtgcgttgccgcgttcacttcgttgtgttgccgcgttcacttcgttgtgtcatcgtgaacttgtcgacatactgttgtggtacctggatcgcgcttgctgttgggcctatgcttcgtcgccgaaggtcttctaggaagaagcgaccttcggctgaagctgtttgtgtaagatggccgaaggtccctcttcatgaagcttcggtatcacaaaccgacttaaagatagaataaccttttggtccataaaggtctgagtcaatgttgtaaactttcataagggacatacttgtaatctctcacaggctgcgccctgtgcctataaatagtgaacagtattcctttactgttcacgtattcctgtatctgcaatcgcatcattcggaaaccaatctttgccaaggcagaggtataactgtattcaataattaaatatactgagtaaatgcaatgtggttcgtttatgattcgttta

SEQ ID NO: 79 - DNA, 1880 bp, Zea mays
ggagtagagacaaacaaaaagacggccgcgtcactgattcaagctagcccgccatggacgacgcacctgcagccatcgtcaaggccaagggcggcaggggggcgttcctcgcccacttcttcatcgtgctccccgtcgtcaccctgtgcgtcgtcgtctacgccccacgctacttctccggtcccccaccgtactacggcggcggcgccaacgacgtcggcggcatctccgcgcccaggcccagctcgatgacccgtacgtcgtcctcgtcgtcagcgcatctcggcgggttgggctacgtcgctggccgccgcgatgcagacgaagacgaccagcagctgggtgtgggtgacggcggcgcgctgccgcagcaggtggttcttgacaaccaggtgggctccccgtgctcgtccctgcccaaccacaccatctgctgcgaccgctccgactaccactccgacgtctgcttcatggccggcgacgtgcgcacggacgccgcgtccctggccctcctgctgttcccgccgcgagcagcgtcgtcagcgccggagccacccgccgcggaggagcggatacggccctacacgcgcaagtgggacgcctacatcaccaagaccatccacgaggtcacgctccgggtggcccggccggaggaggccgccgccgccgcgcaccggtgcgacgtccggcacgacgcgccggtcctcgtcgtcacggcgggcgggtacagccacaacatgttccacgtcttcaacgatggattcctgccgctgtggctgacggcgcagcacctccgccgccgcgccgtgctcgcggtgctctcgtacagcccgcgctgggccggcacctacggcgagatactcgcaggcctctcgcggtaccacgccatcgacctgctcagggacaagaggacgcactgcttcccgggcgccgtcgtgggcacccgctaccacgactacctcgccgtcaactccacgcggctccgggacaacaagaccatcgcggacttccacgacttcctcgccggcgtgtacagcgacgacgacgtgcgcaacgacaaagctgcaggcggcagcagcagcagcaggaggccggagatggcgtggtacgagcggcgccggccacggctcgggatcgtgtcgcgcaaggggaggcgcgtggtcgagaaccaggcggccgtggcgcagctggcggcgtcggtcgggttcgacgtggacatcatggagacggccaacggcgcgccgctctcggccgtgtacgcgtccgtgagctcgtacgatgcgctggtgggcgtgcacggcgccgacctgaccacgttcctgttcctgcgccccggccgcgcggcgctggcgcagatcgcgccgctcggcatcaccatgctctcgcgcaacctcttcggcgtgccggcggccaggatggggctgcactacgtgcagtacgacgtgagcgcgcgcgagagctcgctgagccgcaggtatccgctcgaccatgtcgtcgtggccgacccggcgagggcaaggcgggagcaggggaagcaggagtgggagcttgtggagcacgtgtacctacgagggcagaacgtcagcctggacctcggcaggttccgggagacactggccaggatccactcccgactcaaggagcaacaacaaggtcacgcttccaggtccagtccagatgcgtcaccgcaaatataggcttgttgcatactgctaggtaacgtagacgtttatttggtgctataaatattgatattttacttataaaattagtgatataaggcaattctataagttagtttattaatttagagtagaggaagtattgttttacttaatgataacgtcatgttcacttgcctactgagatctcgtttatgt

SEQ ID NO: 80 - DNA, 1412 bp, Zea mays
cgggtcgtcggcgtcctggtggtggtcgtatcttatctctctcactgccatagtgccatcgtgcgagcggcgagaaagtagaaggaagtgtgtcgtactcgtactcataccgggttggttggtttttgagacgtgtgcggtcgggagaggggatggagagaaagggagggtgctgcctcgcgccgaggtacgccgccaccgcggccgcgcagcaggcaggcgcggcctggcagatggggaggatcatgctcaagttccgcccgattgcgcctaagccggcggccatggcgcccgcgccggcaccggcatcggcaccggtgaccggatcagccgccggtgccgggagagggaagcgaaaggccgcgtgcggaggcggcgggaggaggggccggaagcccaagaaggcggccaaagttgcgatggtgactgcagcgcctgcggcgacggcggcggcgcaagatgtgggcgactgccgggagcactgcgacaaggagaagtcgtcttcgtcgccgtcctcgtcctcgtcggggacgtcatccgtggactcgtcgccgccaccccggccgcagcagcgccagctcgcaacgctgccgctcatgcccgtgacggcggcggaggataaggccgctgcttgtcctgcgacagtggggccggatcagctcgtgccgtctcaggtggctacggcggcacggccgttggctccgcgcgcgatgcgccccgctgctgctgcagcttacttggtgacggtggaagaggtgaccgcgacgtggcgcgacggcgaggcgccggcctccgcgacgggcgcagacgaggccccggcgttcgtgtcggaccagtgggggcgcgtcacgtggtggaacgccgcgtttgtccgcgctgcatccgcggacgacggcgacgaggcggcggcgcccgtcgtgctcggcggagccctcccggcgtggggcacctgcgcgggattcacgtgccgcgtccgcgcccggcactggagcgcccggcgcgtcggttcccccgtggtggcgccctgcgatgtgtggcgtctggacgccgccggcagctacctttggcggctggacctgcaggccgcgctcactctcggcggctgcctgtgaaccgtacaccactgtcaagagcaagcaacgaatatgctgtgctactcctctacgtgcggagacgtgttgtattttattctatgagcgttatttactgacgtaaggcatggtttaatcgacggattgctatcctggtcgggcttaattaaggacgttgaagcctggtaaggtatactaacttagcgtccttcggaatgggagtgagttgggaggacttgaaaatgtaagaagaaaaaaacaaagcatgtgatggatgcttctagatgtgcaagctcagtcttcatctcagcagcgcgaaat

SEQ ID NO: 81 - DNA, 4939 bp, Zea mays
cccgcctgagctgtgctgccctctccttccatttccacactcgccaatcatccaccccatccatcgccgtcgcctctttcttcccccctctcttcttctccctccccgatccttcgcttctctatcgcgagcacgacggagcaggagggcggcgacagcaaggggatgtcgggggcgtggggcggcaccacgcagaagtgcgcgtcgtgcggccggagggtgtaccccgtcgaggagcttgccgccgacggccgcgtctatcaccgcccctgcttccggtgccaccactgcaagagcacactccagtttagtaattattcttccgtggaaggtgtcctatactgcaagcctcactatgaccagatattaaaatcaacaggcagtttggagaaaagttttgaaggtgtggcccgatcagctaagtcagaaaaatcaaatggacataagggccaacaaagcagtagattctctaatatgtttgtgggcacacaagagaagtgtgttgtttgcaacaagactgtgtacccgcttgagaaggttgctcttaatggaaattcttatcacaaatcatgctttcgctgcacccatggtggttgtacgctcagcccatccaatcatatcacacatgaaggcaaactttattgcaagacccaccattctcaactgtttatggttaagggaaatttcagtcagtttgaggacaattctgggaatgcaaaagttactattgagaaactgccagaaacagaagaagccaccaagaatcctgatcaaggtgatgaagccacaaggaaaccggtagaaaatgagcctacagatgagaaaacttcaaaaaataatgttgcagctgagaaacaattgcaaagtggtgttgatgtcacaaaaccatctgagagtaccacagcagaaaatgaacgaggtactgagggtgagtcaaagagtaatgttgtcaacaagaagccgtcagaaagtattgtagaaaagccactacagaacagtgtggttgatgtaaagccatcaggaaacagtgcagccatgagaaaaccctggcaacgaagtatgcaaacagataaaccgtttctgagtagcacaagcactgtgaatccatcatcgagcagtgataccactgagaagctatcatcaagtaatggggttgatatgaaacagtctgaaagcagcacattagtaaaaacaacatgtaaacaaaattcaccaactgagaatccaccacagagcgttttaccatcggataagccatcagcgaccagtgtagatgatgcaaagccatcagaaagcagcaaagtgataaaaaaaccatggcaacgcaatatggctgccgagaagcaattacagaacagtgcaccatcacagaaaagtgtagctactgataaaccatcaccaacaaccggcatgaagtcattagataacaccacagaagttaaaagtccatgggggcgcaggatgttcaataacaagtcactaaagcgcagtgtagatactgagaaatcttctgaaaccagtgtggttgatgtgagacctggggaaaccagtacagtagcccctgtgccacagcaacaaactgaaaatgttgagaaaccttcagctaccagtgcagatgatgcgaagagtgcagatgatacgaagagtgcagatgatgtgaagccatcggttgccagtccagatgcgaagagcacagatgatgtaaagtcatcggagaataatgcggcagtagttagaaagccatggcaacgcaacataggcactgggaagcaacccctgaccactgtagttggtccaaagacgactgaaacaagtggaactgtcaaaaggttgtggcagcgcagtgctgcaactgcatcaaaaagtggtacggctgttgtgacaccattgcaaagcagtgtggttgtctccaagccgttccaaagcaacgtagctgtgaaaaagacatggcaaagaagtgtaactccagaaaaccagctagagagtaatatgtctagcaataagccattgccaagcaaggtggttgttgagagtctactgcaaagcaacaccgttgagaaagtgtttcagagtactgtacctactgaggaaccacagaaaggcatcatggccactgaaaatcaatcgcagaccatcaaagttacaaagaagagcaatgaaacatccatggagctatcagtaacaagtgagacaaccaaaccgccaccacttgctgcaaccgtgttgcaaagtgatgtttccacagaacaaccatcacaaactgatatgcctaccatggcacctagtcagatccctgagcccaccgagaagccatcagaaagtgattttaatgctgagaagttatcagaaagtgttgttaaagctgagaagtcatcaacgactgacactgctgctgagaaaccacttccaagtatgatcactgagaaggtagaaagtgtagcaggcacattgaagccatctcaaagtgatacagcccttcaggagatcttagagaggaatatggctactgaggaaatactgcaaactgccatggctgttgaggatgcacctccaaccaatttgatcaccgagaagtcattaatgaaagatgcttcagaggagccagttcaaactaacgaaccatctgagcagccactgaaaactgaagagattgagaagccacaacaaagtgaaaagattgctacggacacgagagggagtgaagtatctactgaggagatgctagagcttgaaagtaatgccactaaattaaacaaggatcaatcagaacttgaagggctttcatctggtaggaatcctccaaacttccaaagcaatccaaatgctgggcagcgatcagagtccaaaggcattgtggccgagaaggcagctgaccatataatggaagctgaagatgatgtggatgctgagcactcatcagaatctcaaagcgttgcacctgctgaggttcgaaaggagcaaccatcagaacatcaaaaggatgtggatatggagcagctattggaacctcaaaatcaggatcatccttggaatccactagatcctgttagtgatacagctgccaaggattcatcagagcctaaaagtgacatagctacagaaaaacctgcagaatctcaaaacaatgcagaacagtcagttgagcagcaatcagaaccgcaaagcgataaatcaactgagaggccagaagtgcatcaaagtaatacatctaatgatgagctttctaggcttcaaaacgatgcaggtactgataaactatcagtacagtcatcagatcctgagagcaatgcatctgtcagtaagccatcagagtctcaaactgatgtggctaccatggaggcactggaacctcaaattgatgctcctcctgataaggcaactgaccagccagtgaaacctcaagatgatgcatctgctaagaatccaatgggaactgaaagtgatgctgtttgtgataaaccttcagaaagcagctcagatactgaaacacttcttgtatgccatcagaacagcagcataaccactgatgaacctgtacaaggtggcatttcttatgatacaccacatcagagaagtgcacccatagaaacaacaccaggaagtgaaacagttgttgacgattgcatacatcacgaagataccagcagcaaaccatcagaggaaaacaaagctattgaggagccagaagaggtgagtgccaagctgccagatgaccatgtaacttctgagaagtcgtcagaggaagacaaagaaaacgcagaggcatcagtagacagtgctcccctggggaacccattggaggtcaatgaggagagctccaatccttcaggggatactgtaactcctgagaagccactggaggaggataagacgagcgcagagccatcagaaagcgatgcatcctttgggaaaatattggaggccgatgaagtgagtgccaacccatcagaggatattgcaactcctgagaagccactggaggaaggtgtgggaagtgtggaaccatcagaagacaattctgttcttgataaaccattggaggaagaagaggttgatgccaaaccggtgaaggacgttgtaactcccgagaagccattggaggaaggctcaacaactgcagagccattagaagacaatgctgcccatgaggaagcaaaagaagaagatgaggtgattgccaagcccctgtccagtgtggcacttgagaagtcactggagggaagtgaggcaagtgtagagccatcggaagacaatgctgctcttgagaaaccatcggaggacgacgaggcaaatgccaagtcatcagaggacagtgtatatgtggagaagccacaacaggaagaagatgacaacggtgtcaaggcattagaggagggcgtgtcccctgagaaatcagccgctggcaaaccattagaagaagacccagtccatgagaagccagcggacgcagtagctgagccgtcatctcaggacgacactgccactgaaaagccctcagctacaactgacactgcagaaactgcatgagacatcagttagctggttaaagttagttagcaacagttttaaacggagtgtggatcgaatactattggtcatagttcggcgtggcttctgtttgtttttttttttggtggggtgggggtggggtataatgcttgagttgtaaaatttgagggaaagaaactatagtattgatttggtttttttacaagcaataatcccctcctccacatgttaggaggaggataccattgaagttctatacataggatttgtgtgcggtttgattttttgtttggaagttgtactttgtaatcgattttgtgcaaatatgactgtgcttgctcattattcggttttctgcgtgtaaattgatctagcaagattttatgtgcaaatggtgtggctaagctttcaataatactagaaaaagaaa

SEQ ID NO: 82 - DNA, 1606 bp, Zea mays
aacgctcaacttgaaagtcacaggacagcacacaccccacccacaactaccaaccttctccggaaggccaaatccccccgggccaagggaaacgagggagagagaccctccgcccctctcctctccctctccttccggtgaggcggtgagctatggagtcggcagcggccgcgaagacggtggagcggctggcgcagcgcctggtgccgccggcggagcccacccccactgccccccaccgcctgtcgtggctggaccggtacccgacgcagatggcgctcatcgagtcgctgcacgtcttcaagcccgacccggcgcgtgacgggctcagccccgcggagaccatcgagcgggccctcgcacgggcgctggtcgactactacccgctcgccggccgcctcgccgtgtccgacagcgccgggggcctgcacgtcgactgcagcgctgagggcgtctggttcatcgaggccgccgtacggtgccgcctggaggacgtcgactacctcgagtacccgctccagatccccaaggacgagctgctcccgcacccgctgccgaggcccagccacgaggaggagagcaagctcatcctgctcgtccaggtgacggcgttcgcgtgcggcggcttcgtggtgggcttccgcttcagccacgcggtggcggacgggctcggcgcggccaagttcatgggcgcggtgggggagctggcgcgcggggcggaccaggtctccgtggcgcccacctgggcccgcgacgccatcccagacccgtcgggcgcgctggtcggcagcctccccgagcccacgggcgccaagcgcctcgagtacctggccatcgacatctccgccgactacatcgaccacttcaagtcccagttcgcggcggccacgggcgggggccgctgctcggccttcgaggtcctcatcgccaaggcgtggcagagccgcacccgcgccgcggggttcgaggaccccgacacccccgtgcagctctgcttcgccatgaacgcgcgcccgctcctcggcgcccgcctcccgcggggcggcgccggcttctacggcaactgctactacatcatgcgcgtcgcgtccacggccgacaaggtgtcctcgtcgtccgtcaccgacgtggtgaagatcatcagggaggggaagaagcggctgccgttggagttcgcgcggtgggcggcgggggaggagggcgccgacggcgtggacccctaccagatcacctccgactaccggacgctgctggtgtcggattggacgcgcctcggcttcgcggaggtggactacgggtggggcccgccagcccacgtggtaccgctgacgaacctggactacatcgccacgtgcatcctcgtcaagccatgggcccacaagccaggggcgaggctcatcacgcagtgcgtgacgcccgaccgcgtctcgcgcttccacgacgccatggtggacatgaactagcgccccgcctcgtcctgcgttcaccacccgccgtcgtctccgccggcctcccgtttgttcatgggtttcttgtttttttttctcctctcagttactgtggtaattattagttggtattataattactaatcacattgctgcct

SEQ ID NO: 83 - DNA, 1044 bp, Zea mays
tttttattccttactcaaccttatcaatacggcagctacaggtgttcatctctccagccgtgatacttcctgccgcgagctcatcttctcctccccagatttttccctcccgccgctcaagtgcttggatatctcaagccgccgctctggtctgggataagatcccgctgcccagtctgtcttcttcccccctgcggcagcttccgcggcgtccgtctccttgctcgcgccctacttctccccaaccacggcgccctctgttccttccagccggtcgactccctctgcagtcatgcgctcgcccagctcccttgcctcccccatggccagcgcccccttcagctcctctgctcgggtctccctcccatggcgcctccctctgccggccgccaatcttcctgcttggatctcgcccagctcgatctctgcgtctcctgctagccgcgagcccctgctccctgatttctccttgctcgctcctgagccatggagttcctgcgcgctccctctgctctctctccagaccgccggctccagctcgtcgagctcctccttgcttctctccacggcgctcggctgttcctactccctcccttcacgcgcgattctctgctctgtgcgcgcggtatttctccagcatgccgcgccgtccctgctcctccagctcgccgcgccctggattccatggctgcgccctggggttttgcacggagctctgcgcgcccagccccctccgttctcctcctcaccacggagctttccctccagctccttcctctccctctcggttctctgttggccgatgctctgctcgaccgcgccccctgctgcgcgcgctcgtgcgctctgcgctttgctcgccgtcgcagccagcgacgcccctgcttctccctcgtccatgccgcggcgtcctgctcgctccctggtgtcgtgcgggcgtgtcctcgagctccccatggcggtcctgtgctcgcgtcggccctagcttggtctctcccatgacgcgcggcttcctgcgcgagttctgttgcgtccaactccatc

SEQ ID NO: 84 - DNA, 1145 bp, Zea mays
atccattatcacagtgtctcctactatttctttttactcactgtggtggactcgtctctatatattgcaagggtaatgacacttgtctgactcccctcacatacagatacagtacagttcacacactctcctgtctcctatccatccagccaccgaagctagccaagaccaagatgtctcagttgctgcacctgccggacctcgcggcgccgcggaccaggatgggctcggcgctggcggcgggggcccgcgtcaagcagggggaggcggggacggcgagggggcgggtgctcagggtcgccgaccccgtgcggcgggagtgcctggtgccggtcccgccgccgccggtcctcgccgcggggaggcgcggagacgacgacgacgtcgacgaggagaggcagcggtactacctcaacctgggctacgcgatccggacgctcagggaggagctccccgacgtgctctgcaaggaccacagcttcgacatctacagagaagacattgtcttcagagaccctctcaacacattcaagggcctgggaaactacaagaggctcttctgggcgctgcgcctcaccggccgggtcttcttcagggcgtcgtgggttgaagtggtcagcatatggcagcccgccgagaacagcatcctgcttcgctggaccgcccacggcgtccctcgggtgccctggggctggtgggacgccgcccacgcccgcttcgacggcgcgtccgtgtacaagctcgacaggaacggcaagatctacgagcacaaggtgcacaacgtcgctacgaacccgccggccaagtccaaggtcctgccggtccacgagctggtcaggtcactcggttgcccctccactgcccaacccacatgttctgacttctgaagctttcgtcgtcgcagtgatgtgccatcttatatcttattattcgagattaattagcatggataggatgctacgtcgagattaattatctggaagaaggattggcgtgggtttaacatgataccctccattttttttgtttttcagtgtgatttgatagcgcacaaagttacagagcactcctgcaggctgcagttgtatatatgtacagttatagaataagaacatcagttattgattgttaaagcatcagtcagc

SEQ ID NO: 85 - DNA, 1106 bp, Zea mays
ccatctccacccaggaccgccgccctcatccgtctcccccgtcttcctcgccctcgtctacctcgtgctcgtcggaaaaagcagctcagtttcatcacaagtttgttttgggatctttcgcctcaagtttcatctagctaccttcaacaaatccttcaatctccatggctacatcggacaagaaaacaaggggctatgttccttggaatgatgagatggataaggtactccttgatacatttgtggactattacaataaaggtgatagatgtcagaatgggtggaagtctcatgtatacacagctgctgtgaagaatgtttgtgagaagtgtaatgtcaccattacaaaggaaaatattagctctcgcagcaagacctttgataagcactacaatatcattaatggtttgttgtccactagtggttttggatgggattgggagaagaacaagctcaaagttgatagtgacactgtatgggatgagtacgttgagaggaataaggaagcaaaaggatatagacataaggttgtgaagttttgggatctactcagcctagtgtacaataaagaccaagcaaatggagagggtgctaaaacagcagctgaaagttcaaaggaaatggcaaaagagaatgataccggaggcaaggatgctccatattctgtatcttcctcgagtagtttaaaaagacaaagatcagatgattcatttaactctatatggtgtgataagttcgacatgcttacatcatcattgaaagatgacggtccaaagctaccctcttccgccgaagttctcgccgcattacaagaggttgagggacttgatgaagacacagaacttgagctttatgacatcctcacctctaatgcacgcaagtttgagtcgatgatggcactcccaatggaaaggaggaagaggtggcttatgatgcagctaaggaagtgaaacaacttatatgtgaacttatatctctgtattgaactgattgtgtgaacttgtctttgtgaaacttttgtgtgtgaacttgatggctatgtgaaactgttgtgtgtgaacttgatggctttatgaaactactatgtgaagatttgatgtctttgt

SEQ ID NO: 86 - DNA, 1664 bp, Zea mays
atactcctgcggcttccagcttgctttccatcgttcgatgtcaccgccgacgcagatggcttccctcgccgttctcgtttgcctcgtctgcgcagcgctcgcctccgatgcggcggccgtccgcgtggagctcacgcgcgtacacgccgaccccagcgtgaccgcgtcccagttcgtccgcgccgccctgcaccgcgacatgcaccggcacaacgccaggaagctagccgcgtcgtcgtctgacggcacggtgtccgcgccggtctcgcccaccaccgtccccggtgagttcctgatgacgctggccatcggcacgccgccgctgccgttcctggccatcgccgacacgggcagcgacctcatctggacgcagtgcgcgccctgcagccgccagtgcttccagcagccgacgccgctgtacaacccgtccagctccaccacgttcagcgcgctcccgtgcaacagctcgctgggcctatgcgcgccggcgtgcgcgtgcatgtacaacatgacgtacggcagcgggtggacgtacgtcttccaggggaccgagacgttcacgttcgggtcgtccacgccggcggatcaggtccgcgtccccggcatcgcgttcggatgcagcaacgcgagcagcggcttcaacgcctcgtccgcgtccggcctcgtcgggctgggcagggggagcctgtcgctcgtctcccagctcggcgcccccaagttctcctactgcctcacgccgtaccaggacaccaacagcacgagcacgctcctcctcgggccgtcggcgtcgctcaacgataccggcgtcgtcagctccacgcctttcgtcgccagcccttccagcatctactactacctcaacctgaccggcatatccctcggcacgactgcactgcccatccctcccaacgccttctcgctcaaggcggacggcaccggcgggctcatcatcgactctggcaccaccatcacaatgctgggaaacacggcgtaccagcaggtccgcgcagcggtcctctccctggtgacgctgcccacgacagacggatcggcagccacggggctcgacctgtgcttcgagctgccgtcctcaacatcggcgccgccgtccatgccgagcatgacgctccacttcgacggcgcagacatggtgctcccggcggacaactatatgatgtcactctcggacccggactcggactccagcttgtggtgcctggccatgcagaaccagaccgacactgacggcgtggtagtaagcattctcggcaactaccagcagcaaaacatgcacatcctctacgacgttgggaaggagacattgtcgtttgctccggccaagtgcagcacgctgtgatcagaaatctattccaattcaaatgctgaaaaaatcgaactagactacgacaatgaacaggtaagcgccagacttgtcgatcgggcagtcgcagtgctacttcccttgtgacagtctagctgtactttagtttgatgttttttttttgttttagaaaaatgattttttgggacgttttacctttgttgtgttgctagggttgtgatgtaaagcaggaaatatttaaacttatcagttactgtgtatgttatttcatccatattcatattttccctctctctacagagcacttacgtgtgcattattc

SEQ ID NO: 87 - DNA, 1099 bp, Zea mays
ctccccccatcctccccgccacctctcaccccccgcaagcgagtcagccaagccaagcgacgcccaacccccgcctccattcccgggccggagacgcgcctgcctggccgcgacgccgccagccatgggaatggggccgctcgacaacgccgcgtcggccgcgctggaggccgccgccgccgccgccgccgccccctcgcgggcgggctcgtacgcggtgctgcagtgcggcgaggactcggagtacgtgcggcagaagtacggcggctacttcgccgtcttccgcgcgctgctggaggaggacggcgagaggtggcgggtgtacagcgccgtccgcggggagctccccgccgacgccgaggcagccgggttcgacgggttcgtcatctccgggagctgcgccgacgcgcacggcgacgagccctggatcctcgcgctcgtcgacctcacccgccgcgtccacgccgccggcaagcgcgtcctcggcgtctgcttcggccaccagatcctgtgccgggcgctgggcgggcgcacggggcggtcggccaagggctgggacatcggggtgagctgcatccacccgacggcggcggcggcgcggctgttcgcgccgctgaagctgcccgtgcacatgccggtgatcgagttccaccaggacgaggtgtgggagctgccccccggcgccgaggcgctggcgcggtccgacaagacccgcgtcgagatgttccgcctcggcggccgcgccatgggcgtccagggccacccggagtacagcaaggacgtcctcatgagcatcgccgaccgcctcctccgccacaaccacatactggactgccaggtggaagtggccaagacgagcttcgacgtgcggcagccggacaaggagctgtggagcaaggtgtgcaggggcttcctcaagggaaggctccagtcgtcgcagcagcaaggtgtggcgctatagcaggaggaaattggggggcattggatgcctaggttaatccgtcatattgtttgttttttattatatgtgcttcagaactcaagagttgtacagaaactgctatcttcgtccgaagcattaataaaaaaaaaggaggga

SEQ ID NO: 88 - DNA, 818 bp, Zea mays
acaggcaagcatctggccacatgtgcactcacacgactcagggcgagaggacagcagggcacaataaccgttccactttggtccataggagcgcatagcacagcacaaggagaggccgagaagcgctttagccgtagccgtagcgataagagtgagctagctggtgcacaccggcatggcggccacggcgtactccgtggcgctcctcggcggcgcgcgcctccccgccgctccgcgctccgccctcctccctcggcgcagcgtctgccagcttcgcttccaagatgcaccgaggctctccctgctccgtgcgaaggccgcttccgaggacacatcggcctccggcgacgagttgatcgaggacctcaaagcgaagtgggacgccgttgaggacaagcccaccgtcctcttgtacggcggcggcgccgtcgtcgccctatggctgacgtccgtggtcgtgggcgccatcaacgccgtgccgctgctccccaagatcctggagctcgttgggctcggctacaccggctggttcgtgtaccgctaccttctcttcaaggaaagcaggaaagagttggccgccgacattgagaccttgaagaaaaaaatagctggaacagaataaacgctcatggaaagttttagagcgtcctttcttctttggaaagagatctattcgatcggagaaccaatatgcaactacttgagtactattattgcccatgtattgtgtgctgtatatcttctgtatacaaaggaaggttcgtttgttatgtacgtagtagcattgtagtttaaatgtatcgtattacctatctgct

SEQ ID NO: 89 - DNA, 922 bp, Oryza sativa
cttccgcttccgctctcttctccgcacctcatggcgtccctcctctccctcccgcgtctcactctcaccccgaccccacgcgcgaaccccggccgccgcagcgcccgccccacgccggcgagcatcacctgcggcccgcgcgacaaccgcggcccgctccagcgcggccgctccctctccacggaggccatcctcgccgtgcaatccctcaagcgcctcacctcctccgaccgctccccggccgccgccgccgccgcggcctcgacctccctcggccgcctcctcaagggcgacctcctcgccgccatggccgagctccagcgccagggccactggtccctcgccctcgccgcgctccacgtcgcccgcgccgagccctggtaccgccccgacccggccctctacgccacgttcgtctcctcctcgccggccaccgaggacggcgccgccgccgtggacgcgctcgtggaggcgttcctggaggagaaggagcggggcggcgggttcgtggatggggaggaggacgtgtacaagctgacgcggctggtgcgcgcgctggtggcgaaggggagggcgcgcgcggcgtggagggtgtacgaggcggcggtgaggatgggaggctgcgaggtggacgagtacatgtacagggtgatggcgagggggatgaagcggctgggcttcgaggcggaggcggcggaggtggaggcggacctccgggagtgggaggccaggatctcgccgccggccagagacgtgctcgacgaaatgcgcgcgcgagaggagcagcacaactgcggcttaactgtaaatctgattatcgttttagaaacctgaggattattaaagtcgtagctgcttctcttcttttttttttactgcaatttttgcaaagaaagtaaagtgttctgctactgtaaccagc

SEQ ID NO: 90 - DNA, 1093 bp, Oryza sativa
ctagatatagcttgtgtgaccggctcctacggccctaccattgagggttcgcctccgatcttctgccggaacccatagccatgaggacttcccttgttcgtttcttccttactatcctcgccaacacgtttctccattccccctaccagcactcctcacctcctgaatcatcccaatgttcgacgccgcttggtagcgagagtggaggaaagaggaggcgggggaggagggggaagcagaagggcttgggtgaggtggtgtctgttcacgagaaaaaggaggcaaaaacatcacctttccccctcctgctgttgtgccgtgcaacgagacggcggatcacagaggtgtatgatgagatgtaccaaattgttcgtgctaaaaggaatgatactggcaaggttcacgagttcattaactgtttggtagatgcaagaaatgaactgctgcacaagtcggagatggttcaaagaagctgcagaataaagaaggccttactatccaacccttgtagtcgcagggctaacagttatgaccgcctctgcgaacaggtgcataaattggaagccgagcacaaaaggctaaagaaggatgcggatatctacaactatattcaagagcagcttcagatgtcagagtcatacaaactgttgattgagcttagtgcgttggtggagaaggccgaacgtgaggatgcccttgccaccgaggccgcagagatgacattcgaggagctgctggctcaggagaagagcgacgccgccttctggcagcgtcacaggaagctgacctcaatcttacccaagtagagtttgataactgaccgcgcgatttcaccatcgtcaatagtagcccgaacccgtaaccagaatttgttcctggtggagcttttaatgttgctagttgcaaccgtggtgtaatgcgcttgccaagctcttgggcgcctgaaagtccagagtccttgaccataaaacctgagagattcaggtggttggctgacgaccagcaaatgctctcatatatcctatctggtacttcggccatgaagatttcttgcctgtggatgccctgatggaattgagctttcttcaatgca

SEQ ID NO: 91 - DNA, 1816 bp, Oryza sativa
taatatgaaagggagatagcagtggttgtacatatatcaagcttatcaattactgatccaatcaataatgagcgatgcgatgaatgatgcattgtcatctggcatatgcatgtggctggcccaccgccgcaagcgggccccaccccgtcgcctcgcctcgcaacaaaaccggagccactcgagcgagtgaaaacggacaagaaagcggcgtcctcgcatcgctctcgatcagctcagcgtcgcgccgcgccacgccacgccacgccaccccaccacccaccccggctttgaggccaatccggagtcgccgggcagccacgcagcaggcgggcatgagcttgacggggcatggcggcggcggcggcgaggggacggcgccggcgttggagctgctggatgagtactggttctttagcaacacgctggggaagaacgggaggcatggcggcggcggcggcggcgggggtaggccgccgatgctgcccaggtcgccgtcgacggtgagtggtggtggtgggcggccggggaaaggtgtggaggcggtggggacgtcgaggctgttcgcgtccgcggggcggaggctcctccggacgccgtcgctcccgtcgccgcgcgtcgggatggagatcgccaaggaggacgaggaggtcgtcgaggaggccccggcggcggcgggcggtggtggcgatcaggaagccgacgcggaggacgacgacctgaactggagctcgatatacgagggcgtgctccgcaccaggatcgccgaggaaggtgtcaggtcggcgctgcggcgcgcgccgtcgatgcccgtcacgtcgtccgcgacggggcgcgacgacgacgcccgccgcgaggatacggcggcggccgccaccgggtccacgacgccgggcatgtccaggctcaggcacgcccacagcacgctggagagacactgccgctcgcacacgcccaccaccaaggctgaccggacgccgagaacgtcgggcggcggcgacggcggccatcggaggcagccaccgcggcgagagctgcggtcgttcagcgcgaaccagcagccgctcgtccggcaccagagcctgttccacgacaagaagtggaagagctcgagcgacctggagtcgatcgaggtgcaggggttcagggacctgggcttcgtgttcgaccaggaggagctccgcgagagcctcgccgacgtcctccctggcctccgcggcaagcccacccccaccggctccggctccgccagcgacaacgacgacgcaaacacagccacaaccgccaccggcagcgacgccgtcgccgccgtgcggcggccgtacctgtcggaggcatggtaccacgtgcggcggccggcgccccgatcaccggcggcggcggcgatgaggctgcagcaggcggacgcgaggtcggcggcggagatgaaggaccagcttcggatgtgggcgcaggccgtggcgtgcaacgtccgacaagagtgttaaaatcggatcgatacatggcgtcgaccggaccagacacacgatcacacgagttttttttttttttaccgcggaaaccagaagcaccaactcgatgatactactaccatttcagtagttgagttttgttactttcgcctgcaaattccattccaatccaagagggtgatactccatctaggtagatgttcagtgctcttcccaccttttgtttttctttatatatcctcctttggttgatctatgaataatatggcggcaaccgccctattctttttgttaatacccaaatgaaaggatttacaatctataatgctgagaggctccatttggaa

SEQ ID NO: 92 - DNA, 1641 bp, Oryza sativa
ccagccagcgcggcgccaaactccacctaccgacgagagagagagagagagagagggggagggcatggccgccgccgccgccgtcgccgccgtcgccgccgcggccgcggccgcggagcccaccgtctccaagtcggcgccggagctggtcccgcccgcggggcccaccccgcgcggcgcgctgccgctgtcgtccatcgacaagaccgccgcggtgcgcgtctcggtggacttcatccaggtgttcccgccggcgaccggcgggcccgcggcggacggccaggaggacgccgtggccaggatgcgcgacgggttcgcgagggcgctcgtgccgtactacccggtggccggccggatcgcggagccggcccccggggacgtggtggtggactgcaccggcgagggggtgtggttcgtggaggccacggcgagctgcacgctcgccgacgtgaacaacctcgagcgcccgctcctcatcgccaaggagcacctcctccctcgccctccgcccgaggagaagctcgaggacctcatcctcatggctcaggtgaccaagttcacctgcggcggattcgcggtggggatctgcttcagccacctggtgttcgacgggcagggcgcggcgcagtttctcaaggcggcgggcgagatggcgcgggggctcccggcgccgtcggtgcccccggtgtgggaccgcgacgcgatccccgacccgccgaagcccccgccgcgcgggccgccgccgtcgttcacggcgttcaacttcgtgacccaggtggtggacgtctcgccggagtccatcgcgcggatcaaggaggacttcagcgcctccccgacgggcggcggccaggcctgctccaccttcgacgccgtgaccgccgtggtgttcaggtgccgcgcgctcgccgcgtcgtcgctccccgacgacgccgaggtccgcctcgggttcgccgccagcacgcggcacctgctcgccggcgttctcccggcggtggacgggtactacggcaactgcgtgtacccggtggggatcgcccgtcaccgcggcgcggtgcggggcgcggcgctggcggaggtggtgggcgtggtgcgggaggcgaaggaggcgctcgcggcgcggttcacggactggctcggcggcggcggcggcggcgaccactacgacgtgccgctggactacgggacggtgacggtgtcggactggagccgcgtggggttcaacgaggtggactacgggttcggcgagcccgggtacgtgttcacgctcaacgacgacgtcaacatcgtcgcgtcggtgatctacctccggccgccggcgcccaagcgcggcatccgcctcatgctccgctgcgtcgaggagccgcacgccgccgccttcgccgacgagctcgccaagttcgcctagatatacgtgccatattgccatgacgatgtgtgtaaggatctcatctcatatcatttgggtcacaagttcacaaccctgctgctgctggtttgtgcatgtaaaattcgatcaacgttggaattcgtgacgtttattcgtgtcttaacgagacgttatgtcgtaactttggcgcgagagggaataaaatccagtgaagtctctggtttacatctagtcggactatcaccgtttggtat

SEQ ID NO: 93 - DNA, 469 bp, Oryza sativa
atcatcaacaacacagctgcttaagagcttctgagccttatcccagggtcaggacagaacagagcagagaagcatcagaagaatggcttctctgaaggccgtgaaacctgccggacttgccaaggagccggctgccaagctcagtgagacggcgacgaagcccgcggccgccaagggcggcgtcaagaaggctgagcagaagccccgggagcccaagaagaaggtgaagagcagcaagccggcggcagccaaaaactgatagtggcaacaggagagatggagatagtacgagggtctccatcttacgctatgctatgggattatgaatcccgtctgtcccttcctctcgtcaccccgtgatgtcttgatcatgtagcagcaaccttagtcaagctggtcttgacggtgtgtgcagcccatgtgatgaatattacaaataagatggtacagttgtgacatccgcttcata

SEQ ID NO: 94 - DNA, 1773 bp, Oryza sativa
gtctagcctcccactaatcccggtgccttcttgatcccaccgatccccgtgctttcttctcttcggcatcgccacgaagcggagggtgccatcgcagcagccatcgccgacgagcggctcacggtcactgcggcctcggcaacgtccggcgatcgtcgtcgatccttaccttactccctcacgccccctagctgtctcctcgagaagaatcctgcttaagttgatttacctccgggtgtttacggtctttcaaattgctaagcataatcttgaactttccaagaaaaaaaacaggcctgcattaactagtgccagggcagcaataatggatttgtgcgacgacactcatttcccatgggaggggtcccatactattgttggcagcaagcggaaagctaaggatttaatggcaaaaatctgaacttgtttaatggaacttataagatggtggaaaccacagttgatgttatgataagaaaaggaacaaacatgagactcgaaagctacgagtttttgagtgatttcaagcatggcaacgctgtggtactcctggactacacagagtccggaaacaaggggagtttcatcgtcacacaagttgatgggtcattcactgcctggtttgaaacaggtggaaaagagctctgctttgactcatctggtcatattactcagttatttaaagacatgattgtcgatttttacgatctgacctggagtttgcacaagaggcacttagtcatgcagaattttgtaaaggaaaatatatacgtcaaaatctttgatggcgtacccaaacttatgattctactaactgaagttaaattggttgatcagctagggccattcaaacaggactggagtcatgtccaaggcctcatgacttggtgtaaagaacaatctggtttaaaaatggactttcttaccaagagtttctatgatttcatcggatctaccgactgcacagtaatcaagctgagaaactaccctgatgattgggatgaaaaaaagaaaggtgattatttgctcacactcgcagaagtaaaccacggagttcttaaagataagttgaagagtagggatgattttcattggccgtttgtgaagctgcctaagctggagcagaacttaccaccaatgttacagcaaattcttagtggggagagacagatgaaaagaaagttcgacgtgacattcttttgtgattatatcaacctcttgagaaactcctacaagaaattcaatgaattaccagaaaatgttaaggctttatgcataaaccaggatggcttcattaaactgatagatgggtggtctcctgagttttggaccaagatctacgagaaaattgggtggccagattataatatctggaagtggccttgtaaaaaatagctttagtgctttgcatttgaccagaacactgcttgatctcaatgatggcgatgccggtgcccgcgctgacattctcaggacatatggtgctgttctgcaggtccgatccttagatggctcctgttaggagtttttggttcttagaattatgttagatgctatctcgaaactctcaagtaattttttgtcctcctgcatgaagcaaaacttagtgtattggttgaaaatctggcatgattgaatggagaactatcgagattcattactgtgagtccatgcacttttagaccttttagataatgatgcacttctagaccttgtttggatgggcctcaattccggccagcgcaagtggatgtgtatgaattcaggctcgtc

SEQ ID NO: 95 - DNA, 1688 bp, Oryza sativa
cccgcccgatacgccgctccgccaccgccgccgccgccgccgcgtccgcgtccgccgccgatggggtacgtgctgtcggcggtggcgagggtcctggagcagccgacggcgtggggcgcggcctgcgagatggccgtgctggccggcccgctctgggccgccgcgctcctcggcctcctgctcggctgggcgtggcgcccgcgctgggccgccggcctcgtcgccaccgccgacagccaccccgcgccgctgacgttcgccacgctggagttctggaggacccagctccccgcccgcatccgcgccccgctcgcgcagtacgtcggcgccgccggcccggcgccgccgccgcagcaggaggacgactcctccctgcttgggtcgtcggagatggcgaacgagcagctggcggtggggaaggatgacctgatgaacctctggaggctagtggagggcagggatggcggcccggcatggatcaagatgatggagaaggcgctgcccgccatgacctaccaggcatggaggagggatccacagactggacctccacaataccagagtagtactatatttgagaatgcaaatccggaggaggtgagggacttcttcggcgacgatcaattccggatgtccaacaagtgggatgatatgcttatctatcataagactttggaagagtgtcagacaacaggcacgatgaaagtgcattgggtccgcaagttccccttcttttgtagtgacagggagtacatcattgctcgtcggatatggaaactgggaggtgcatactattgtgttacaaagggtgtgccatgctcatccatcccacgtcgtaacaaacctcgtagagtagatgtatactattcaagctggtgcatccgtccagtggaatcaagaagagggaacagtggattgacggcttgtgaggttctcctgttccaccatgaggacatgggtattccctatgagattgcaaagattggcattcggcagggaatgtgggggtgtgtaaagagaatcgaacctggacttcgggcctatcagaaagcgagagctgctggggagccattgtctcagagtgccttgatggcgcatatcaataccaaggtcggtgacaattttgttcgtggattggaatccaacgacgatcagtcagatattgtggaagcagaagagaaacccgcgaaaaaccgagtagcaaggttccttgtgctcggtggagctgttgctctggcttgcactcttgatcaagggctgttgaccaaggctctcatcttcggtgttgcacggaaatttgtagggcagaggaacacattgtagcattacctgatctctgtcactaatcctctgagccaatctgcttattggatgaacactggcacattcactgtcttggcatggaggaattgaggaggagatgatgatccaatggctgacattggcctgtggcacatgccatgatgccattgagggcagatgaaggacttcgatgtatatacaacgccggctgttggataatgagaaagagaggcaatggagtaaaaaatctgtacttttacatttggaaaaggaattccagctatatattacgtggagcctttgtttcttgtaatctgctactatgtggagtaaatcagaggactcgcaaagtcatatataaacatttacttttgctctttacgcag

SEQ ID NO: 96 - DNA, 1099 bp, Oryza sativa
catcacaaaacacataaaactatatcatcatcttccatagctgtacacatcctatattttcattcatggcgatgacaccgcagctagcattttctcgcatgcctccagggtttcggttccagccgacggacgagcagcttgtcgtcgactacttgcagaggcgtaccgctgcgcagccatgcgttactcccgacatcaccgatatcgacgtttacaacgtcgacccgtggcagcttccagccatggcgatgtatggatcggatcatgaccggtacttcttcacgatggcggcccgagaggcgcaggccagacgaacgacaccgtcgggtttctggaagcccaccggcacaaagaagacgatcttcgtcgtcgccggtgggcatgaggtgcccaccgccgtcaagaggaggttcgtcttctacctcggccaccaccaaccatcgggcagcaacaacaacaacaaaacatcatggatcatgcatgagtaccgtctcatgaactctccaagagcggcagtgccgtcgtcttcttcggtgaatcgtcttcccactgatgatctcacggaagagatggtgctgtgtaggatctccaacaaggacctgcctaaaccacccttcatccacaacagcttgttgcagttctcttcagtggggttgaatggtgatgggtataattacttgatccttgatcaccttgagcctccagcaatggagtatcctaatgttggcattggtaatgttgatgatgctgctgctggtactgatgatccgggtgaccttgatgaggagattgatgatagcatgcaaagaaaccatggtggctagaattaaccagtagcatcatgagtgaatggttttgcgggagatttgagttaaatatcagataataaaataataatacaaagaataaaaagaaaaacaaacctgtatagttagcaggttttgattcatttcgttgaactttgtgtgcttgttagctagcctatataccaaacatgccttggcgaggctttctatttgtatatagctttttttcttttttctattgtaaggttcgaactctattgagttgattgaataaacattatgcaatttatgta

SEQ ID NO: 97 - DNA, 5325 bp, Oryza sativa
atggaggcggcacgtggggcccgatcccgggttccggtggcggcggtggtagcggtggtgctcgtggcagggctcgccgcgggcggctccgcggctgagatccggcggcagaagaacgtgcaggtggcgctccgggccaagtgggccggcacgccgctgctgctcgaagccagtgaactgctttcaaaagaatggaaggatctattttgggattttattgaccattggaaggaactcgataaggcatctgaatgtttgacagccaagtgttgtgttcacaagattgttgaggatgcccgctcatttctgagtgagccactggcttcaatttttgagttctcacttacccttcggtcagcatcgccaaggttagtgctctacaggcagcttgcggaggagtcattatcctctattcctgttaaagatggcactttggagcaaacctctggtcctagtactggggaaaattttcatgaggctgttaaaggaacttgctgctgggtagacacggggagtgctctattattcaactcagctgatctacgcaaatggcttgatggcttgggcaaactagctgtggactccactcaacaacctgaactctttgagtttgaccatatatatcctcaatcaaatattactgctccaattgctatattttatggggcttttgggacaaaatgcttcaaagagctgcatgttcacctggcagaagcatcaaagcagggaaaagtaagatatgccctgcgccatgtcctgccatctggatgtcaggctacatctagcttctgtggttctgttggtgctatagatgcagtcactttgagtggatatggtgtggaacttgctctcaagaacatggaatacaaggccatggatgacactgctataaagaagggtgttgctctggaagatcctaagactgaagacctcagtcaagaagtcagaggatttatattttccaagattttggaacgcaaaccagcgttaaatgctgagataatgtccttcagggattatctgttgtcatcgacagtatctgacacacttgaagtatgggaactcaaagacttgggtcatcagacagcgcagagaatcctccatgcatcggatcctttacagtcaatgcaggaaattaatcaaaatttccccagtatagtttcatcactgtcacggatgaagcttgatgattcaatcaaggatgaaataattgcaaatcagcgaatggttccacctggcaagtcattgatggctttgaatggtgctttgattaatattgaggatctcgatctttacctgttgatggatatggtccatgaggaattatctcttgctgatcagtttgtcaaactaaagattcctggaagtgctgtccacaagatcctgtcagctgctccaccaacagaatctaactcgttccgtgttgacttccggtcttcccatgttcattatcttaataacttggaggaagatgcgttatataaaaggtggagaagcaacatcaatgagctattgatgccagtcttccctggtcagatgcgctacatccgcaaaaatctattccatgctgtttatgtgcttgatcctgcttcaaccattgacatggttctatctctataccaagatagtgtccctataaggtttggcattatattgtattcttcaaggcttattagtgttattgaagaaaatgatggcaatcttccagtaaataatgggtctaagactgaggaggatatttctattttgataataaggctattcctgtacatcaaggaaacatactcaacgcagttggcataccagttcctaagcaatatacataaatcacagaacagtggtgatgactataatgaagagtctgtggaagctcatcatgttgaaggggcatttgttgattccttattgtcaagtgctaaatctcaccctcaagatgtgctgctaaagttgcaaaaagagaacatgcacaaacaagaggctgaagaaagttctcgttttgttcacaaacttgggttgtataaactccagtgttgcctattgatgaatggacttgtgcatgaatcaagcgaggacgcaaccatgaatgctatgaacgatgagcttcctaggatacaagaacaagtctattatgggcatatccagtcccatacagatgttttagagaaatttttgtcagaaagtagctacaagcgttacaatccatcgataactggcaagagcactgagaataagagatttgtctcactagttgtaccgtatcatcagggagattctacacttcatgacattacttatttacactctcatggaactacagatgatgccaagcctgtcactcatctagttgctgttgatatttcttcgaagattgggataaagttgcttcatgaggccatacgttacctgtttgtctctgatttggatgagccaatttttgtccttagctataaggaaaaggtactggacttcctgcatgagctctgcaaattttatgaaggacaacatgtgccttcttccggggttggtgataagattagcactatgagggagaaggtgtatagcatagctgctgaaactggcttgcctgttgataattataaagcgtggtttacaagttattctcatgatgcagtcctcagaggaatgaataagttgtctgacttcttattcgggaaactagggcttgaatttggcagcaatgctgtgattacgaatggacggttacttcaatctgatctgtcggcagcttctgttgttcatgacttcatgctattccttacctttcaggtatttgttgtaaatgaaggagattcatttctaactgatgatttaggcctgcttgagtctatggagtacgaattgagaacaaaacacatttatgaaataattgaagagatcgaatggacaggtgtcgaccctgatgacctgacaagcaaattctacagcgatgtcgccatgttgatttcatcatcaatgtctattcgtgaaaggccatccgaaagagcccattttgaaattttgcatgcagagcacagtgctattaaactgaacggtatgagttcaggtgttcatatcgatgctgtcattgacccactaagtcctgctgggcaaaaacttgctccactcttacgcattctctggagacagattcagccgagcatgagaattgttctgaatcctattagttctcttgcggatctacctttaaagaactattatagatttgttcttccatcaatggacgattttagcagtaccgattattctgtgcatggacctaaagctttcttcgcaaatatgccactatcgaaaacacttacgatgaacattgatgtccctgaaccatggcttgttgaacctgtcattgccatccatgatctggacaacattttattggagaatctcggtgatgttagaacattgcaggcagtgtttgaacttgaagcactcctcttgacaggccattgcaaggaaaaggatagagaccctcccaggggtcttcagtttatccttggtaccaaacgaagaccacacttggtagatacgcttgtcatggccaacttgggttactggcagatgaaagtttcccctggtgtatggtacctacaattagcgcctggtcgtagtgcagatttgtatgagctaccttcaaaactcattgccattgatagcttgaggggcaaacttatgcacattgaagttcaaaagagaggaggaaaagagcacgaggacttgctaaatgctgatgatgacaaccacttccaggaaaagatggataacaaaggctggaataacaaccttttgaagtgggcttctagtttcattagtggcgactcatcatcaaaaaagaaggatgagaaaatctctgaccttaaagctacaagacaaggggagacaatcaacattttctctgttgcttctgggcatctgtatgaacgtttcctcaagataatgattttgagtgtattaaagcaaacacaaagacctgtgaaattctggttcataaagaattatctatctccacagttcaaggatgtcataccccatatggcccaggaatatggatttgagtacgagcttgtcacatataaatggccaacatggttgcacaaacagaaagagaagcagcgaattatatgggcatacaagatcttgtttctagatgtcatatttccactttcactgaggaaggttatttttgttgacgcagatcaaattgtgagagcagacatgggagaactgtatgacatgaatctgaagggtcgtccccttgcgtatactccattctgcgataacaacaaggagatggatggctatcgattttggaagcaaggtttctggaaagatcatctgcgaggaagaccataccacatcagtgctctttatgttgttgatttggccaaatttcggcaaactgcttctggagatactctacgggtcttctatgaaacactcagcaaagaccccaatagtctctcaaatcttgatcaggatctcccaaattatgctcagcatactgtgcccatattctctctccctcaagaatggctatggtgtgaatcttggtgtggaaatgccacaaaggcaagagcaaaaaccattgatctttgcaacaacccaatgacaaaggagccaaagcttcagggtgccaaaagaattgttccagagtgggttgatcttgacagtgaagcaaggcagttcacagcacgaatcttgggagataatccggagtcaccaggaactacttccccgccatctgatacaccaaagtcagatgataaaggcgcaaaacatgatgagctatgatacaccagccgctttggaggcaaggattcttcacactgactgtagttctctggtgtcccagcagttaaaatcatattgctggttcagggggcaatgaagtgcagataccataatgtgcgaatcaatcgatgatcaataatcaatggtggtgccattttgcattttgtagggctaactgccgaaaataggttcacgaaggggtctagttggtagtttttcaagaacttgtatacatagaacactgtaatcccaattcgtgtattaagatgttcttcctgggacgctgtaaagtttattggcaactgccagttgaaagctagtattagcaatctggcagcccgagaattttgtaaaagttggcacccaacaaagctcgagaatgtaagatactttggtgttggtattccaaaacatttgtagtttgtgtatttgatacgtggaaatttgatgctcatttttctaagataggaatttcgaaagacgcaccaaaaaaagggcgttgcagagtttgataaatct

SEQ ID NO: 98 - DNA, 1598 bp, Oryza sativa
gaaccacacacactaatccggtccaccggaatcgaaaccaacctgttgatcatcgtgcacaagcacaacttgccaaccgccacttcacgcgatcgatcactctcactcctctcgctgccgctgccgcacctagccaaattatgccttcgccttcgcacctcgccggcgcgctggacgcggcgcgccccttcctgcgcggcgaggaggagcaggtggacccggcgctccccaagctggccgccgtgctgcgcgccgccggcgccggcgagtgctggcacaagcacggcaccttcctcgcccacctcctcgacgtccaccgcatcctccgcctctggggcgcccccgacgccgtcgcgcgctgcggcctctaccactccgcctactccaactcctacgtcaacctcgccatcttcgaacccgacgtcggccgcgaccacgtgcgccccatcgtcggcgccgccgccgagcgcctcgtccacctcttctgcgtcgtcccgcgccaccagctcatccacgacgacctgctcttccactacgccgaccaggacctcgtcgccgacctcgccgcctccgaggcgtcactgcaggacgcgcggcgcgggctgttccaccacgacggcgaggcctggcggctcaagatccagcgcctcctcccgccccacggaatcactgtcaaacacatcaggactggcgaggatgtggcactgtcgaggcgcatcgcggcaaccttccttctcatgacaatggcggacttcagcgaccagctcttcgactggcaggatcgcctcttcgacaacaccaatggccgcctcgagttcagtggcaatacctggacttcgctctggccaggcaccggcaagcccggcctctggactgcctccatatcccgcatgggcgcgctctacagcctcatcgttcgcgaggaagagatacacatagctcaacgaaagcatagcaacaatggccaagaagacgatcgtgacgaggacattgagctggtgatcccaccggtgttcaatggctgcacccaggtgctcaccgccgacgaccagaaggcggcacgggacctctactgggatgcagtttgcagcggcggcgaggacgagacggattggcgcaaggtggaggagatcctgcgacggtgcattggcaggaacccgtttgtaggagagcctcacctggttcttgctcaggtgcttctgaacatggagatgtatgaggaggcagaggagcagatagaggcaggggtgaagctgttgctggagtgggggagcagctgggacaagaggatgccatgggaggcttgggtgtcatggggcagggcgatgctgatcaaggccaaggacaaggattggccgcacacctccttcggcatcctcagcatagggcttgtcaagtgagtgaacccattcacctccactctctgatggtaaattaagctgcacctgtactgtacatgtcataacatcacctgataattgctgtatcctctccatcggtatatatatgcttagctcgatggaggaaatcaaacatgatggatatgaaataaatcgctccacaaatatcaaaataatttgacgcatccatagatatca

SEQ ID NO: 99 - DNA, 1218 bp, Oryza sativa
gaaaaacccatttgcatcatgcgtcctcacttggcctgcctccctccacgctcctccgtctcctacccctttctcgccttccccaactttatcctcgctcactttccatctcacacgacggccacactgacgagtagtagacggtgaacagcctacagggaggaggcatgggggtagccgtgacaatggcgagctacgccgccgtcctgcgcccgcacgcctcgtcgacgaggactccgcgcgggcctcgtcgtcccgcgggcgcggtgccacctacgccgcgccgggcagcgctgcgagctactacgcggtctcctccggctgtcgctgccactccacctccgcgggagcgggtgcagcagcagcagcagccgggtgacggccagacgacgacgcggctctactcgctggcgccgtgcccgctcctgctggcggcgctgctgccgggggccgagccggtgcgcgccgtgttcgagccgttcgtcgagctggtcaagacgtggggcctccccggctggctcgtgcactggggccaccccggcaacatggccgtggtgctctttgcaatgggtggctacggaacatacctgggcttcaggatcaagctatcggatgaccctgaagagaaggccaaggccaaggacctccacccgaagctcctcgccggcatgttcttcttcttcgcagctggcgccactggtggagtcaccgctcttctcacgtcagacaaaccaatctttgagagtccgcatgctgtgaccggcatcatcggccttgcactccttaccattcagtctatcctgccgacattgttcgagggtaatccttcgctgagaaatgcacatggactcctcggcagcggcatcatgaccctgtttctaatccacgcagccttcgggctacagctcgggctcagcttctaatcctcagccacaacatctggggtttgcttctctgtgattagctctcagaggcatccctgttacacacatcgaagagaaatgaaacacagagagagttttctctctcttgttttccctttgtttcttttcaccctgcgaatgttgacaataatgtagacctggtgttggattgtgtattgacgacaacgaattccatcgtgttgcgctgataattgtgtgctgggcactgtcaatttgaccgagacatgatcagttgcacagggtccgataagcagaatcacacatcgaatatttg

SEQ ID NO: 100 - DNA, 3029 bp, Oryza sativa
gtctccccgttcagcgagccagagaggaaacgaaccgatcgatcaggccgtcgctccgctcgccgccgcgcgacgcgacgcgacgcgacacgccggagacggacgacgagcgctttgccttccccgcgcgcgcgcgcgcgcgcacggaggcggacgctggtcggtttggtcgggtgcgaccgggaacggcggccatggcgcgcggcgggggcggcgggtgctgcccgccgatggatctgatgcggtcggaggcgatgcagctggtgcaggtcatcatccccacggagtcggcgcacctcaccgtctcctacctcggcgaactcggcctcctccagttgaaagaccttaacgcagacaagagtccttttcaacgaacatatgctgcccagataaaaaggtgtggtgaaatggctcgcaaattaagatttttcaaagaacaaatgtccaaagctggcatatcaacttctgcacaattaactgaaatttcgttggactttgatgatttggagataaagcttggagaactggaagctgaactagctgaagttaatgcaaacaatgaaaagttaaagcggacctacaatgagctgttggagtacagtactgttcttcaaaaggctggtgaatttttctattcggctcaaagaagtgctgcggcgcaacagagagaaatggaggcaaatcaatctggtgagagttcactggagagccctctgctggagcaggatacgttaacagatgcatcaaaacaagtgaagcttggatcattgagtggtcttgtaccaaaggaaaaggcaatggcttttgaacgcatcttattccgtgccacgaggggaaacattttcctcagacaagagtctgttgatgaacctgtcactgacccagtctctggagaaaaggttgccaaaaatgcatttgttattttctactctggggatagagcaaaagccaaaattctgaagatatgtgatgcgttcaacgcaaatcgctacccatttccagaagatgttgctagacaattacatgctgttcaggaggtatctgcaaagatatcagagttaaaggcaacaattgacatgggattagcacatcgtgacaatatattgaaaaatatcgcgtctgagtttgagaattggaaccgtctggcaaataaggaaaaaataatttaccacactttgaacatgttgagtgttgatgtgacaaagaaatgcttagttggtgagggctggagtccagtttttgcaacaactcagatccaagatgcgctccagcgagctactcttgatagcaaatcccaagttggttcaatttttcaagttctcaacacaacagaatctcccccgacatatttccagacaaataagttcacttcggctttccaggaaattgttgatgcatacgggatagccaaatatcaagaagcaaaccctggtgtattcactattgtcacttttcctttcttatttgctgtcatgtttggagattggggacatggaatttgcatattggtttcgacactctatctgataatccgagagaagaaatttgcttcacagaaacttggagacataatggagatgatgtttggtgggcgctatgtaattataatgatggcactcttttcaatctatacaggattaatatacaatgaatttttctctgttccatttgagctttttggtaaatctgcttatgcatgccgtgatccttcttgtggagatgctgcaacagaaggattactcaaggtaagacggacatacccttttggtgtggaccctgtatggcatggcagccgcagcgagttgccgtttctcaactcactgaagatgaagatgtcaattcttcttggagttgcacaaatgaaccttggaattgtgattagttactttaatgcgaaattcttcaggaacagtgttaatgtgtggtaccagttcatcccccagctgatcttcttgaacagcttatttggttacttatccatgctcatcattatcaagtggagcacgggggcaaaagcagatctgtaccatactatgatatatatgttcctcagtccaacagatgaacttggggagaaccaattatttcctggacagaaaacagtgcagcttgttttacttctgcttgctctggtgtctgttccctggatgctgatcccaaagccatttttcttgaagatggagcatgagcgaaggcatcaaggacaacaatatgcaatgcttcagagcacagatgactcagtggtagcggagatgggacatcataatggctcgaaccaccatgaggagttcgagttcagtgaagtttttgttcaccagttgatccacacaattgagtttgttcttggggcagtctcaaatacagcctcatatcttcgtctctgggctctcagtcttgcacactcggagttgtcaagtgtattctatgacaaggttctcctcctagctttcgggtacaacaacattcttatccgcatcgctggcattaccatcttcatctgtgcgacagttggtgtcttgcttgttatggagaccctaagtgcattccttcacgccttaaggctacattgggtggagttccagaacaaattctatgagggcgatggatacaagtttgcgcccttctctttcgcactgatcagtgaagaggaagactgagtttgcgcaattattgcatctattgtagcgtgtaatttcttggggcgtccttttttctcaaagcgtcaagtatttatcacggaagaatcataaacctccagtttgttccttcatcaggaaagggactagcagcatcattttttgctttgctacgaatgattcgtggcaagatgattttttgggtggccgttggcacatcgggtggcatcacccttattttggtgtaaggctaataaataataagtaaattctgcactcgggttgccatttgggcaattagttttctgcacataaataaacattgtatcaaatgttaatattccattgggttcttttattgtcaataaagagtgcggcctacattctttaaaa

SEQ ID NO: 101 - DNA, 1102 bp, Oryza sativa
aacgcaagcggacaaagcaaaaaacacagaaaaaaaatcgcggaaaaggagaaagaaaccaggcgactctcggccgcactccgcccactgcgagtctgcgacggtgcgacctctctacctctctctctagtctctccccccgacgagagctcccccctcgatggcgtcgcagagcaccaagcccgcgcaggccgccgccgagccgtccccgccggcggccaccgcagcagcgggggaggcgccgccggctccgaaccccgcgtcggccgccacgccagcccaaaaccctaccgctgccgcgggggcggccgctggcggggccacggatctggagaagaagatgcgccgcgctgagcggttcgggacggccgtggtgatgtccgaggaggagaagcgcagcagccgcgccgagaggtttgggactggatcttcaaatgaaaaggcggaggaacaaaagaggaagtccagggctgagagatttggccttgcctcatcttctgctgacgaagacgctaagaaaaaagctcgtttagaacgatttggtcagagtacaaatgttgacaagggggaagaagagaaaagaaaggcacgagctcttaggtttgcagaaacatctagtggaccatctcaagaaaatggcaaagacagctccaagccgacgcaggacgcggccactgtggcaggcacggcataatggaagcactccctgccttttgtgagatctcggacatggcccttacttttggggtgaagccgtagtttgtacaacactaacgacatcagtggcatcatgttttctcctagccatgttgagtgctatttactgtgttgacttgcttacggtacttccctagcagtgtagcttgacttgctgcttggtttgggataatactgtacttttgttacctccctcttttaatgaccatggctccttaggtatgtaccagtagtaacttatgttgttgtagttagcttttaagacgttatcgtattctaagttttagatgcttccttcgtgttacaaaatgacatacgcaacaatgccaatgtcttggcagcggggcatgtgaatatctgatgatgcatttcgttagtgcataca

SEQ ID NO: 102 - DNA, 4973 bp, Oryza sativa
ttggtgtggcgtttttcttgggcaggggacgccggtgaacatcatcgtcgggtcgcatgtctgggcggaggatcccgacgacgcgtggatcgacggggaggtcgtcgagatcaggggcggcgacgccaccatcgtcagcaccgatggcaaaacgattgtggcgagcctcgcaagcatttaccccaaggatacggaagcgccacctgcaggagttgacgacatgacgaagctggcttacctccatgaacctggagtcttgcataacctcgcttgtcggtacggtattaacgagatatatacatacaccggcaatatcttgattgcagtcaaccctttccggaggctgcctcatctgtatgacgtgcacatgatggagcagtacaaaggtgctgcatttggggagctcagccctcatctgtttgcgatcgcagatgcttgttacagggcaatgatcaatgaacaagggagccaatcgatattggtgagcggtgagagtggtgctggtaagacagagacgaccaagatgctcatgaggtatcttgcattcatgggaggaaggtctggaacagagggtcggactgttgaacagcaggttttagagtctaatccagtactggaagcatttggaaatgcgaagacggtgaagaacaacaactcgagtcgattcggtaagtttgttgaaatccaattcgacaaatatgggaagatatccggggctgctgttcgaacgtacctccttgaaagatcgcgagtatgtcaggtctctgatcctgaaaggaactaccattgcttttacatgctatgttctgcaccaccagaggatgtgaaaaagtttaaggtgggagacccaagatcattccattatttgaaccaaacaaactgctatgaagtagctaatgtggatgacgcaagagaatacctagaaacaagaaatgctatggatgttgttggcattggtcaagaagagcaggatgcaatctttagagtagtagctgcaatccttcatctgggaaacatcaatttctcgaaggggcaagaaattgattcatcgaagctgagggatgagaaatcagtctatcacctgaaaatagtagcagaacttctaatgtgtgatgaaaaggctcttcaagattcgctttgtgagcgtgttattgtaacacctgatggaaatatcacaaagccacttgatccagattctgcagcactgagtcgtgacgccttagcaaagactgtgtattcacgactgtttgactggattgtggacaagattaacaactcaatcggtcaagatccagatgcaactaatattataggagtacttgatatatatggatttgagagtttcaagattaacagcttcgaacaactatgtatcaacttgacaaacgagaagttgcagcagcactttaaccagcatgtattcaagatggagcaagaagactatacaagggaggaaatagattggagctatgtggaatttgtggacaatcaagatgtgctggacttaattgagaaaaaacctggaggaataattgcactactggatgaagcatgcatgtttccaaagtccacacatgaaacatttgcccaaaagatgtatcaaacatacaaggcacataagcgcttcagcaaacccaaacttgctcggacagcctttacaatcaaccactatgcaggagatgtcacatatcaagctgatcagtttcttgacaagaacaaagactatgtggtggcagaacatcaggctctacttaattcctcaaggtgcccttttgttgcaaatctctttcctccattacctgaggaaacctctaaacagtccaaattctcttccatcggtactcgctttaagcaacaactacaagctctcatggaaacactgagtacgacagaaccacactacattagatgtgtgaaacccaatgctgtacttaaaccaggaatctttgagaatttcaatgtccttaaccaattgagatgcgggggtgttctggaagcaatccggatcagttgtgctggctatccaacaaaaaggacatttgatgagttcattgatcggtttggaatgcttgcagcagagcttgtcgacagctctgatgagaaggctgcctgtgcagcaatatgtgataaaatgggtttgaagggatatcagataggaaaaacaaaggtattcctaagagctggtcagatggcagagctggatgctcgaagagcagaagtattggccaatgctgcacggcttatccagagacgtataaagacacatcttacaagaaaggaattcatcaacttaagaaaagcctcaattcagtctcagaagttttggagggcacgcctagctagaatatttttcgagcatatgagaagaaatgctgcttcaatcaggatacagaagcatgcacgtactcattcagccaggaaatcttaccttcaaatgtatgagtcagccatagtaatacagacaggattacgtgcaatggcggcttgcaatgaacacagattcagacgagagaccaaagcttccataataatccagactcgatggcgccaacacaaagcttatgttgattacaaaaagcaaaaaagagctactttgattcttcagtgcctgtggagagcacgtattgcaagaaaggaacttcgaaagctcaaaatggaagcaagagagactggcgcactgaaagaagcaaaagacaaacttgaaaaaagagttgaggaactcacatggcgattagatgttgagaaacacttgaggattgaccttgaagaagccaaggggcaagagatttcaaacttgaaatctgtgttgcaagaaatgcaagaaaagctttcggaagcacatgcagcaatagaaaaggagaaagaagatgcaaaactagcaattgaacaggcaccaccaaagatagtagaggtgccggtggtggacaatgcaaaagttgagctgctgactagacaaaataaggaacttgaggatgaacttgttacatttagaacaaaggctgaagatctagaaaagagacttctagaggttcaaaaggagtccgatgaattgtcgagggaaattctagaaaaggactccaaacttaatcaacttcaggagatgatagaaaggcttgaaacaaatttatccagcttggaatctgaaaaccaggtcctacgtcaacagtcactacttgcatctgcagatgacgataaatcaaagcaaatagagagtctggaaagcaagattgccatcttggagtcagaaaaccagttgctccgcagtaaatcttctgtagctgttcaagcagtaattactcctgaagtgattcagccatcagcaatggagggccttgtgaatcgatatcagcttgaagaacataaaatcctcattgaggaggtggttgttcctcctataaagaatttaagcaaacaaaagtcgctcacggatcgacaacaagaaaatcatgatgtcctgatcaaaagtctggctgaagacaggagatttgacaacggcagaccagctgcagcatgcatcgtgtacaaatcactcctgcactggcactcatttgaagcagagaagactaacatatttgaccgaatcatccatacaattaggtcatcaattgagcacgctgaaagttctacagaactggcttattggctgtcgactacatcaactcttctctacctattacaaaatactcttaagtctagcagttcagcaggtaaaggatcaaatcgcagccgaaccacaacaggcaacctgttcagtaggatggtgcagaatgctcgatcgtcgtcattaggatcaggcatatcaagtggatatagtggaatggttggaaggcctgacactgcatcaaaggtagaggcaaaatactcagcactacgtttcaaacagcaattaacagcatatgtcgagaagatatatggaatgatcagagataacctgaagaaggaaataaacccgttcttgattatgtgcatacaggctccaagggctgttcgtgtgagatcatccaggggatcgttgaaaagtgtacattctaattcactatcaaggcaaacatcaagtgtgcattggcaaagcatcattaagtgcctgaaccatacactcgaaacaatgaacaataatcacgtacctccaatgataatcaggaaaacattcaatcaagcatttgcctttatgaacgttcaactcttcaatagtttgctactccgtcgagaatgctgctcctttagcaatggggaattcttaaaggctggtttacaagaattagagcagtggtgctctgtaacaactgaagagtatgcaggaacgtcttgggatgaatttcagcacatcagacaggcagttggatttctggttttgcatcagaagacacataaaaccttggaggaaatcactgatgagctttgcccagttttgagcatcactcaaatatatcgcattggaacaatgttctgggatgataaatacggtgcacaaggtctatctcaggaggtcattggaaagatgagaacaatggccactgatgactcaataactactccaaatagttcgttcttgttagatgacgactcaagcatacctatatcgttggatgatatagcacgactgatgcttgacatagacctatctgacgtggaaccaacaccactgctcaggcagaactctcagttccactttctactgcagcaccacgccacacagactgatggcattgtttgttaatgcaaagttgaaaacataattaaacaggttccgctattttgtgaagttcctcggtggtgatttcccttttttttatgggagtgcaggcttgccttttttttgttggcaatttcaggtgggagattttacaagaaagaaaaatatagaagatttttttaccattcttttcatttgttctgattgtttgaaagaggaaaggttgtatttttaatgtaaaagtgtacaagcgaaagtaaatatatgtatattttcagct

SEQ ID NO: 103 - DNA, 1912 bp, Oryza sativa
aaatacacacgctattgcaactttgcaagtgcaagttcacagcgcagtgccgccatggagagcatcaacgtagcaccaggaacaaccgctacgcctcgcatggcgccgccgccgccgccgccgtgcatcaccaacctccagagtacccttcgctacaacaacctgctcttgcaccgcaagacgaaggggtggaagccgcggaacgtgtcctgcagggtcgaccgccgcgacgtgctcctcggcatcagcggcgcggccgccatggtggccacgcagggcggcggcggcgcgctcgcggcgcccatccaggccccggacctcggcgactgccaccagcccgtggacgtccccgccacggcgccggcgatcaactgctgcccgacgtacagcgccggcaccgtcgccgtcgacttcgcgccgccgccggcgtcctcgccgctccgcgtgcggccggcggctcacctggcggacagggcgtacctggccaagtacgagagggccgtgtcgctcatgaagaagctccccgccgacgacccccgcagcttcgagcagcagtggcgcgtccactgcgcctactgcgacggcgcgtacgaccaggtcggcttccccggcttggagatccagatacacagctgctggctcttcttcccatggcacaggatgtacctgtacttccatgagaggatactgggcaagctgatcggcgacgagacgttcgcgctgccgttctggaactgggacgcgccggacggcatgtcgttccccgcgatgtacgccaacaggtggtcgccgctgtacgacccgcggcgcaaccaggctcacctgccaccgttcccgctcgacctcgactacagtggaaccgacacgaacatcccgaaagaccagctgatcgatcagaacctcaacatcatgtaccgccagatgatttcgggagctaggaaggcggagctgttcatggggcagccgtaccgcgccggcgaccagccggagccgggggcgggcaccgtcgagagcgtgccgcacaaccccgtccacagatggaccggcgacccgaggcagccgaacggcgaggacatgggcatcttctactcggcggcgcgcgacccggtgttcttcgcgcaccacggcaacgtcgaccgcatgtggcacatccgccgcggcctcctcttccccggcgacaccgacttcaccgaccccgactggctcgacgccagcttcttcttctacgacgaggaggcccgcctcgtccgcgtccgcgtccgcgacaccctcgacccgtcggcgctgcgcttcacgtaccaggacgtgggtctcccgtggctgaacgccaagccgtccacgggagcagccagcacgccggcgcccgcggccggcgcgttcccggcgaccctggacaagaccgtgcgggtggccgtgacgaggcccagggcgtcgaggagccgcgaggagaaggaggaggaggaggaggtcgagatccccgaccactccacgtacgtcaagttcgacgtgttcgtgaacgcgcccgagagcggggacggcgcggcgacgtgcgcggcgacgtgcgccggcagcgtcgcgctggcgccgcacgggatccaccgcgaggggcagctgtcgccgaggaagacggaggcgaggttcggcatatgcgacttgctggacgacatcggcgccgacggcgacaagacgatcgtcgtgtcgatcgtgccgaggtgtggctgcgattcggtcaccgtcgccggcgtcagcatcggctacgctaagtgaagcacaacgtgaaccgtggacgtatatttatcatctatacatgtgaacccagatggagagacggatttgtgtttgatatgtgtgtgactaatgattgtatacaaaataatgccagtaatataatgagcatggatgatattggctt

SEQ ID NO: 104 - DNA, 835 bp, Oryza sativa
tcaacttaaccaacacagcatcaacccactacagtacaacgagtccactgcaagcgaggaaaatttccacagatcaccagtgaatcaagtcatcaaccttcaatggcgggtgcagcgaaggcgtcgtggatggtggcgatgagcgtgggcgccgtggaggcgctcaaggaccagggcggactctgccgctggaactacgcgctgcggtccatccacaaggcggccaaggccaacgccgccggcgtctcgcagggcaagaagctgccagcttctgcggcggcggtggcggagaggaggagagcggagaaggccgaggaggggttgaggacagtcatgtacctcagctgctggggtcccaattagctaggccattagtgttagctcggatggatctcgatctgctctgctgggtgtccgtttgacggtagcagccatggccggagacgtaattggccggttgctcccagctgatcgtaatatatcacgatgatgatgaaaaattctgctacttgagtacaattgcttcatgggtcattttgcctttgtgattgtgtcgtctagaacaatttatgaactgaccacttttacggtcatgcacgcaaaaatccggccgtgtcatcaatttaagatccaaactttctgggagaaaggtgttctgttcttttgatactgcaccgtaaaatttatgatcgaaatgatggaagaaatggtagcaatctagtttgtacttaatacttaccacttgttactgaatgatagtcagatctgtaattcaattcaatttggtatggaatttttttaagagaatggaaagattctcaacctttgcttaaaa

SEQ ID NO: 105 - DNA, 1460 bp, Oryza sativa
agatttctttcacagattcacgaattccacccgtttcgattcgattcgattcgattcgatgcttgtgccctccgccccgggagagactcgccggaattcgattgcttcttgctggtagggggagccatgggagagctggcttcctcgccgccgcccgcggcggtgctgcccgtcgtcttcgtcgacggcgaccagaccgtcgacctcggcaccgtcaccgtccagccctccctcggcgtccgcaagctgcaggccgtcgtcgccgacagggtggggctcgcgccgcagcagatcctggcctcgctcgcgcgcccccgccgcgcgcgccgcgtgcccctcgaggaggggaccgacctcgccgccgccgtcgcgcgcgagggctccggctgctacgtcctcgccgccctccgccgctcccgccgcgagcgccgcggcggccgctcccgccgcgagaagaaggcggcggccgcggccgcggcggcgggggccgcgcccgctgcgccgacgcaggagaggactatcctcaagcgcctccccgcgatggatctggcctccctggcctcgaccccctcgccggcggcggcggccatgttcggcgtctgggactacgaggcgcagctccaggagctgcagcggcagcgcgagtggtacctcatgcacacggcggcggcggatccgtacttcccgctggcgccggagcgcgaggacccgcccttctggtcagcgcagccgctgctgcggcaggggacgccctcgtcgtgccccgagtgcgaggcggcggcggcgatgatgcgggagccggggttccactggtgcgtgcgcgacgcggtcaccgtcggattccgctcactggtggggccaatcgagcgcccggcgaagaaatccccctcgccgtcgccctcgccgcctcccctgccgccgacccccggccgactcccgccgtcgttcgtcgggatgatgcccgtttactagccgtcgattcgattagaagaaaaaagaaatgtaaaaaaaaaagaggagaaaaaactggaattggggaggcttgcgtgtggaattggtgcaccagcgcagaagaggagttttttttttttttttttttgttatggaggaggaagcggccaagtgcgaacgagtccagaggcgctggacacgttggagcctgcaactagcttagctgttacgaagaaattttcttttttttttcttggggtggttactgcttgctgctagtgctatgtgacaggtggtatgaggtggtacgagcctgaccaatgtggctcggtcgaatccagagatttggaccaacatctctggaaccctctgttttttcttttttagtttttctgagagagcgggagagagagagagagatgcctgctggatgattggcatttgttcctggtatatcaaagtggtatatgcagaacaacattttagtacctacttgagtatgtgctgaa

SEQ ID NO: 106 - DNA, 1136 bp, Oryza sativa
aacgctaatagcctctctcatctcagtatattcatcagtaaaaagcaatggactgctgcttgtgcaggtgagggagtgagcgagcactatactagtagtggtaagagaagagagaaatctaagagagagagagagagagagatggatcatcaccagcaccacgagcagcagcagcagcggatggtggagatgcggatggggatggcgatgggcgaggcgtacgtcgggggaggagaggtggtggcgcgggaggcggcggcgcaggcgctgggggcggtggtgcagctgcacttcgacaagacgctggagaagaagcgggcggcggacgcgcagaagcaggagctgtggcgcctcttcctcgccttcttcctcttcctcgccatcctcctctccgccgtcgcccagtccccgccgtcccgcctccagtgccgccacctctgggcccccgccggcctcctctccctcgcccacctcgccttctacgccgccgtcgcacaccacctccgatgcctcaacggattcaggtaccagcggcgttgccacaagctgaccctggcgctggcggcggacaggctgcggatgctcaagtccggcggcgacgtggtggcggccgccgacgtggaggtgccgtaccaggagccgcccgagagctacctggccaagttcaagcgcagctgggccatccacttcgccttcctcatcaccaccttcgccttctccgtcgccgccgccgtcgccatcctctgcttctagctctcagatctcctctcaactggactactcctccaatccaatcttactagtaggagattttgattgatcatcagatcagatgatggaagagtcgttcgttgtttatctctactgtaatccctccctctctttctctttcttgtcgtattcattgtgatttattagtagaatgttctatgttaattgcccttcagcgagaggccctcacatgcattatctcaattgtcagccagtgtcacattcactcgctcaaatcgcggcagcagccagcagccactgtggcaaaagcaactgtatttatccttaactacagtatctagtactatgatctctcttggagattggttagtttgtgagtaaaagctgccaagcttgttgctatc

SEQ ID NO: 107 - DNA, 1315 bp, Oryza sativa
catcaactgcaagcttacatcacactagctaattagctacttactcttcttcttgctagcttgctagcttctgcatttagacattgcaaaatctgaaaaaacttgagaaattaactaaacaaaatggttgttccggtgatcgacttctccaagctcgacggcaccgccgcagagagggctgagacgatggcgcagatcgacaatggctgcgaggagtggggattcttccagctggtgaaccatggcgtcccgaaggagcttcttgatcgggtgaagaaggtgtgcttggagagctaccgactccgggaggcggcgttcatggagtcggagccggtgaggacgctggaggggctcatggcggcggagcggcgcggcgaggcggcggcgccggtggacgacatggactgggaggacatcttctacctccacgacgacaaccagtggccgtcgaacccgccggagttcaaggagacgatgcgcgagtaccgcgcggcgctgcgggggctcgccgagagggtgatggaggccatggacgagaacctcggcctcgacaaggggcgcatgaggcgcgccttcaccggcgacggccgccacgcgccgttcttcggcaccaaggtcagccactacccgccgtgcccgcgccccgacctcatcaccggcctccgcgcccacaccgacgccggcggcgtcatcctgctgttccaggacgaccgcgtcggcggcctccaggtgctcaggggcggcgagtgggtcgacgtgcagccgctcgccgacgccatcgtcgtcaacaccggcgaccaggtggaggtgctcagcaacggccgctaccgcagcgcgtggcaccgcgtcctccccatgcgcgacggaaaccggcgctccgtcgcgtcgttctacaacccggcgttcgaggccaccatctcgccggcggtgggcgccggcggcgagtacccggagtacgtgttcggcgagtacatggatgtgtacgccaagcagaagttcgatgcgaaggagccacgcttcgaggccgtcaaggcgccaaaatctgcttaaagttaaaaatagacttttatttgtgaattaattaattgattagttgcataaactatacataaccgcttttgctattcaagataaaaaaataggtgaccttacaaaatttaagtggttattattgtcatgagaatacaactattgttatgttacagtatatagtttggtattttagtgtgtcacggtttgtcagtaggaatatataataatgtaatagatcgtgttgttatatatacatgaataaactatatagatttttttaatt

SEQ ID NO: 108 - DNA, 1564 bp, Oryza sativa
aaccaacccccacccatcgctctttcccctctccccctctctgcagcttctctggtccgaactatccctacaaaggagccacacgcatatctcgccccgtttctgctctacaagcctattatagcactgacatgtagtgtgtttcgttgcattgcaacccccgctcctgaattctctcactctctctgctcctcccgtttcctggacctcgtcgtcgtcgttgtgcgggccgatggggaacccgccggagctgtactacaggatcctcaacatctccagggacacgtcgccgaaggagatcagggcggcgtacaagacgctggtccggcaatggcaccccgacaagcacccgccctcctccaagaacgaggccgaggcccgcttcaaggccatcaccgaggcctacgaggcgctcctggaccagcaggagaacagggcggcgttcggggcgcggggcaacgtcgacgccgtcgacgagaagggagataggactgctgccgccggcggcggcggcggcggcggcgccaccactaccggcggagtcggcggcgacgggcgtgcgccgtcgtcggcaatgccgcgggcgcagggcgccgagaagaagaaggcgccctcggcggcggcgccgccgccgacgaggaccgcgccgtgcggcacgccggcgagggagttcaagaagccggtgctgtacagctcgacgggcctcggcgaggccgcaggcggcgggcggcggcgcgccttcgccgagttctcgagctgcgtcgtgcgcaaggcgccgccgctggagcgcagggtggagtgcaccctcgaggagctctgcagcgggtgcaagaaggaggtgaagtacacccgcgacgtcgtcgccaagaacgggctggtttccaagaaggaggagacgaagacgatcagggtgaagccgggttggaagaaggggatgaaggtgacgttcgaggggatgggcgacgagcggccgggctgcctcccaggcgacgccgtgttcaccatctcggagaggaagcacaaggtgttcaagaggaaaggcaacgacctggtgctcaaggccgaggtgccgctggtgagcgcgctcaccggctggtccttctccttccggctgatcggcggcgagaagatgagcttcacgttccgcgacgaggtcatctcccccgggtacgagaaggtggtcgccggcgagggcatgcccgtcgtcgccgccggcggcggcggcgagaaggccgccgccgcgcgcggcgacctccgggtgaagttcgacgtcgtcttccccaagaacctcaccggcgagcagcgcgccggcctcgccagcatcctcagagcctgtccgtgatcgaattaccacacgcatagtagtacacatttttacaagttttttttttttgtttctactcgtgtagaaaattttggtttcattttttggtgttgatatactagcgatggatcgatcgatcgatcaccctgcaggtgagtacataaagatcgagtatgagatctgagcgaccgttttgacgcatatacgtatataaatacgggatggttgttgcaggaacaa

SEQ ID NO: 109 - DNA, 1558 bp, Oryza sativa
aatccgctcgtttttttgctgctgctccggtgctcccccacccaaacctctcctcgagcctctccccggccggatcgccgccgcccgccgacactcgccgtttctcccgaaacaggtggggtttgcatggtctcatcggtgctgagcatgtgaattttaggaagttgacaagagttcacatttaattcgtacatgatgaatggttcaaatggttcccaagggtatcatgtgaatggaaagcaagtgcaaagcgttgttccttccattcagaacaatggaccaagacaccggccattgactctaatgagacggtgccgtggcatgttatgtttggttattatgccgttgacagcatttatgatgatggtttacctatcccctgtaactactttcctcatacggttgttcagtgtgcattacagcagaaagtcgacatgctttctgtttgggatgtggttagcaatgtggccatttttgtttgagaagattaacaagaccaagtttgttttctctggcgaaactgtgcccccaaaagagcgtgtcttgttatttgctaatcacagaaccgaggttgattggatgtacttgtgggatcttgcgttgaggaaaggccgtttgcagtgcatcaagtatatccttaagaaaagcttgatgaagttgcctatttttaactgggcatttcacattattgaatttattccagtagagcggaagtgggaggttgatgaaccattaatccgaagtagactttcggaattaaagaaccctaaggatcccctttggttggcagttttccctgaaggcacggattacacggagaaaaagtgtatcaagagtcaagagtatgcaaaagagcacggattgcctattctgaataatgtcctccttcccaagacaaagggttttcattgctgtctacaagagttgagggactccatggattctgtttgtgacatcacaatcgcatataagcatcggccaccgacttttatggacaatgtttatggtattgatccttctgaagttcacatacatgttaaaatcattcaagtctctgacatacccacctcagaagatgaagtcgccgattggctgatcgagagatttaaactgaagaacaagcttctgtctgatttctcggcacttggccatttccccaacgaaggaactgaagatgatctgtccacactcaagtgcatcgcgaattttgtagcggtaatcagcacaacgaccgtcctcacgtacctgaccctgttctcgtctgtatggttcaagattttcgtagcatttagctctgctttccttacttttgcaaccttatactccatacatctgccccagctgatatgctccccggaagctggtacccatgccaagaaatcctgaaagtatttgtgcaagtgtaaccctcagctgtgtattagcagaaagatattactactctgctcagaacccaacttgtgggttgtggcatcatcgccatgtatacctgtatatccaatgggatttgtcattggaaatgtttctagctctatagttcagtactacgattctttta

SEQ ID NO: 110 - DNA, 3970 bp, Oryza sativa
tagcgaagagaaggagaagcacgcacgcagcacgtgaacttccagctctaaacccttccccctctcttgttccaagcccctcctccccttacccccccgccgccgccgccgccgccgcctcatcacccgaaaccctagccccattcgccgcggtcgccgcctcacccgaaaccctagccccattcgccgccggggtcgcggcctcaggagcggaggccatggaggacgtctgcgaggggaaggacttctccttccccgcggaggaggagcgcgtgctcaagctgtggtcggagctcgacgccttccacgagcagctccgccgcacgaagggcggcgaggagttcatcttctacgacgggcccccgttcgccaccggcctcccgcactatggccacatcctcgcgggcacaatcaaggacgtggtcacccgccaccagtcgatgcgcggccgccacgtctcccgccgcttcgggtgggactgccatggcctccccgtcgagttcgagatcgacaagcagctcggcatcaccaaccggcagcaggtgttcgacctcggtatcggcaagtacaacgagacctgccgcggcatcgtcaccaagtatgtcgccgaatgggaggccgtcgtcacgcgcacggggaggtggatcgacttcaaagacgactacaaaaccatggacataaatttcatggagtccgtttggtgggttttctcgcagctctgggagaaagacctcgtctacaagggtttcaaggtgatgccttacagtacaggatgcaagactgcactatcaaactttgaggccgcacttgactataggactgtcccagatccagcaatcatggtgtctttccctattatcggtgatgcggacaatgcagcacttgttgcatggactacaactccctggacacttccaagcaacttagccttgtgtgtcaatgccaatcttgtgtatgtcaaggttaaggacaagtcaactggagcagtgtatgttgttgctgaatctaggcttgggcaattgccagccaaggctaaatcatctggaaagaagcaagcaccttctaagggaggcactgctgaagttgttcagggtggattggatactgaagcatatgaattattggcaaagtttccaggatcatccttagtaggcctaaaatacaaacctctgttcgattttttcttggagctccaagagactgcctttagggtgatagcggataactacgtaactgatgatagtggaactggtgttgtccattgtgctcctgcttttggtgaagatgaccaccgtgtttgtcttgctgctggtatcattgaggccagtgggcttgttgtcgccgttgatgatgatggctgcttcattgaaaagatatctgagttcagtgggcgatatgtcaaagaggctgacagggatatcatcaactctgttaaggataaaggaagacttgtcagtaaagggagcattgaacactcttatccattttgctggcgctcgggcactcctcttatttaccgggctgtcccaagctggtttgtgaaggttgaaaagattagggaccagttgctggaatgtaacaagcagacctattgggttccagattatgttaaggaaaagcggttccataattggctagaaggtgctagggattgggctgttagcagaagtagattctgggggactccactaccgctgtggatcagccaagatggtgaagaaattgttgttatggattccattgagaaacttgaacggttatctggtgtcaaggttaatgatcttcaccgacactatgttgatggtatcacgattccctctagcagaggtccggagtatggggtgctcaaacgagttgaggatgtttttgactgctggtttgagagtggttccatgccatatgcctacattcattatccatttgagaaccgtgaattgtttgagaagaactttcctggcaactttgtggcagagggattggatcaaacacgcggatggttctatactttgatggtgttatcaacagctttatttgggaaacctgcatttaaaaatctgatatgcaatggtcttgtattagctgaggatggtaagaaaatgagcaagagtaaaaagaattacccttcacctgtagaagtcatcgatgaatacggagcggatgctttgagactgtatttgataaattctccagttgtacgagcggagtctctacggttcaaaaggagtggtgtttttggtgttgtgaaagatgtcttcctgccgtggtataatgcgtatagatttcttgtacaaaatgccaagagacttgaaattgagggattctcagcattttctccaatagatcaagcctcacttctgaagtcatcaaatgttctagatcactggataaactctgcaactgaaagtctagttgtgccatatttggttaaatacatcgacaatcttactaatatatatgtgcgtttcaaccgtaaacggttaaaaggacgtactggggaagaagactgcagagtatctctttcgacgctctaccatgcacttgtaacaacttgtgtggcgatggctccatttacacccttctttactgaaactctctatcaaaacctacgaaaggtgtcaactaaaccagaggatagtattcatttctgcagtttcccttccacaactggggagagagatgagcgtgttgagcaaagtgtaaacagaatgatgaccatcattgatcttgcccgcaatattcgtgaacggcataacaaagccttgaaaacaccactgaaggagatggtgattgttcatcctgacaatgaatttcttgaagacataacgggaaagctaaaagagtatgtcatggaagaaatgaatgttaagactgtcactccatgtaatgatcccatgttgtatgcttctctccgggcagaacccaattttagtgtgctaggaaaaagactgggaaaggacatgggcaaagtgtcaaatgaagtgaagaaaatgacacaggaacagatcttagcctttgaacaaagtggagaaatttcattctttggtcattgcttgaagttagacgatattaaggtgatccggcaatttaaacgtcctgcaaatgtggcagagaatgaaattgatgctgcgggagatggtgatgtgttagtcgttttggatcttcgagctgatcaatcattgtttgaagctggagttgctcgagaggttgtgaacagaatccagaagttacgaaagacagcgcaacttgagccgacagacttagttgatgtatattacaaacctatggacgatggcaagaatactctagtagagattgtgcagtcacaggatcagtatataagggatgctcttggcaatccactaattccaaagatggcggcgccaccagatgcagtaatgatctgtgaggagtctcacaatgtacaagacatgtcgtttgtcatttacattgcaagggtttctccagtggtcacagatgatctccttgtccatgccgctggcaaccgtgagcattttgatgcattaaaagtatatttactgtcaaggtctatttccagattgaagaatgaattccaggctgggaatggcaagattacggtggatttcattgaaggcttcccaccaattgatctccagctgggaaaacatgtttttcttagtacaggagatttctacctggctactcgttcttgatttttctttcaagcatcccaattttgagtgatttatctttttttttactgcaatcattttaccccgggccctattctatttgtgcccacaaagcaatgtatgtggtttcatctgccatgaaagaatgaaaggggtactatcatattgaatggtctaatcgaaaactcgtgtatgctgtactgaatactgatacacccgtgttcatgtggctacacaccgattatttaattgtgccaatagcggttaaagcattcagttaattgtctttactacaccaa

SEQ ID NO: 111 - DNA, 5974 bp, Oryza sativa
ctctaaaacccccacttgaaacctaaacccttctcccccccattcgccggcgccgccgcacgcaaccccggccgccgccgccgcctccacccgaattctagctctcgctgccggctcgcccgcgatggcgccgcgcggcgacgggaagaaggggaagggatcggggaagcccgaccagctgcgccctaagagtaagcagttcaaaaagcactcgcgcaaggaggaggtggcgggtgagggggagcagcaggagcgtccggcggccccggactccgccgccgtcctcgccgccgccgccgcagacgacggcgacttcccgagaggagggcgtagcctgctgagcagggatgaggtggcggaggcgcgcgcggaggcggacgcggacttcgagagagaggagaggaggggaaagaggaagaggaagggtgcatcctcgtcgggagccggtggcgacgacgacctggggagcctcttcggcggggctaccaccgggaagctcccacgcttcgctaatcgcgtcaccttaaagaatatttcaccaaatatgaagctatggggtgttgtaattgaagttaaccaaaaagacattgttgtaagtctacctggtggaatgagagggtttgttcgatcagaggaagtgcatgacattacttcgcaagaaactcgtaaggtactcaccgcccaagtgaaaagtattgaggatcatggttacattcttcattttggagtatcctcctttagtggtttcatgccaaaggctgacagagaaagcgcgaagattgagagtggacaacttatacagtgtgttgtgaaggcaattgataaagctcgggaaattgttcacttgagttctgacgaagatttgctttctaaatctattattaaagatctgaaaggcctttctattgatcatttaattcctggcatgatggtcaatgcacgtgttcattcagtcctcgaaaatggagttatgttatcatttcttacttatttcacaggaacagccgatatttttaatttgtccaactccttcccctctggtagctggaaagacgattacattaagaataagaaggtaaatgctcggatattatttgttgatccgtcaacaagggcagttggacttacattaaatcaacagttacttcgccttaaagtaccctctattaacgttaaagctggagaaatctacgacaaagcacgtgttttgaggatggataaaagggctggtctttttcttgaaataccttctccaactccatcacctgggtttgttagtatacatgatgtctcagacaaagatgtgaaaaatgtggagaagaagtttaaagaaggtagcatggcacgtgtccgtgtgcttggagtgcgacatcttgaaggagttgcaataggcacgctaaaagaaagtgcttttgaagggtctgttttcactcatgctgatgttaagccaggaatggtattttcgagtggcgtgaaagcactttgcccacttccacacatgtctgagttagaacatgttgtaaaaccgccgaagaagtttaaggttggagttgaattaactttccgtgttttgggttgcaaatccaagagaataacagtgacattcaagaaatctctggtcaaatcaaaacttgatgtattggcctcatatgctgatgctaagattggtttattgacgcatggatggattactaaaattgaaaagcatggctgctttgtgaaattctacaatggagttcagggttttgttagcagatctgagcttggattagagccaggtactgaagctgaaaatgtttaccacgttggtcaagtggtcaaatgcagagttgtgagtgtagtccctgcttcaaggaaaataaatgttacttttctgatatctacaaatagggttattcaagctgacaccccaaaggtgggaagtattgtatctggtgttgtggagcgacttactcctgcagcagttgttgtcagtgtaaatggcttctgcaagggatcaatacttaatgaacatctagcagaccatcgtgatgttgaagggcaaaatttagttctttcagccaagcaatcactcatcaactgtgcaagtgacattccatcagaaatatctcagatgcatgcaggatctgtatttcatggttatgtttgcaacatcatagaagctggttgttttgttcgctttcttggacatctaactggtttttctcccaaggataaagctgttgatcgttcagtagaaaagctgtccaatgccttctatgttggccaatccgttcggagtcatatcctaaatgtaaatgtagaatctgccagagtgaagctttctcttcagcagtctatgtgctcttcagcagactgttcatttgttcaaggatactttcttctagatcagaagatcacagaactgaagtattcagatccaagtagttctttccatgactggttgaacacttttgccattggtaacttggtggaaggggaggtgggagcgatcgaagaatatggcgttatcctgaacttccaaagccatccggatgttgtcggtttaattgaacatcatcaacttggtgacagtagtgtagaagtgggctcttctgtgaagggtcttgttattgatttatctgatggagttgttaatatatcccttaaatcagaacttgttcgcagtgtcagcaaagttggaaaaaagaagaaacgtcacagagctgcagttatggacttggagctacatgaggaagtgaatgcaatagtggagatagtcaaagagagtcatgtggttctttccatccctgagtataattatgcaataggttttgcaccactgatggattacaactcacaactacttccttgctgcaactatgaaaatggacagcgcattactgttgttgttggaagtatgccaagttctggtccgacaggaagacttctcctactaccaaaagcatcaggcaagaattctagtgttagcagttccaaaagagcaaagaagaaaagtgacttcaaagttggatcacttgttgaagcagagattattgatatcaagccacttgaacttcttctaaaatttggttccaatcttcatgggagaattcatattaccgaggtatttgatgatgattccaatgattgcccttttagtgaactccaaattgggcgaagtgtccaagcgagaatcgttgctgaggctgaacattcaggaaaaggtggcaaaaattccaaatgggaactatcaattagaccatctttgcttcaaggagggttagaagactttactcctcctaaagcagaattaaggcattcaattggtggcattgtgcatgcttatgttgtcaaggtggatagagaatggatctggttaactgtatcaagagatgttatggcccatttatttattcttgatagttcagctgagcctggtgaactagaaaagttccaacagcgctatagtgttggccaggcagtgaaaggacgcattattggtgtgaacagggagaaacggttgttgagactgaaagcacttgacagtcagagtttgccagagaatataggcgaaacacaaaaaccactctctgctactgttgaacatacaaaacaaggagatatcattggtggacgtattcaaaagattctacctggtgttggtgggcttgtcatccagattggacctcatcttcatggaagggttcattatactgaaattgttgattcatgggtgcaagaacccatatctggatttcatgaaggtcagtttgtgaagtgtaaggtcctggatgtaagccgttcatcagaagggtctgtcagagttgatctatcacttcgctcatcaatgtgcgcaaattctaaccagtcaagaagattgtttgatgattcgagaattcgtacctcccgatttgagaagatcaatgacctgtgcccgggaacagaggttaagggctatgtgaagagcgtgaattcgaaaggatgtttcattatggtttctcggactattgaggctaggattattctgtcaaatttatctgatgaatatgtggaaaatcctcaaaacgatttcccagttggactgcttgtacatggaagggtcttgtcctcagaaccacaatcagggaaagttgaggtatcacttaggaagaatactggtagcaaatctcaaaaatcagatgatattagttacagcgatctgcatgttggggacataattgctggtcaagttaagagggtagaatcctttggactatttgtgacaattcagggcagtgaattggtggcattgtgccatgtatcagaactttctgatgaaccagtccttgatattcattcttgccacaaagctggtgataaggttaaagccaaaattttgaagattgatgaggaacggcatcgagtatccattggaatgaagaaatcttacatcggacctgattctacgggtgatacaagtgatgatgaggatgacgaaatagttcctgaggaaatcagtcgtaatcctgtgatgggtagagatcggaaccatgcgttagttcttccgaaaccagaatccagggcttcagtgctgccactccaggtctccttggatgaatctgaaggttcagaccaagagaatgataataaaggtcaagaaattgctaatggaactgaagtagatgataaaaagagcaacaaaaggttgaaggagaaggcgagaaaacaaagagaattagaaatcagtgccttggaggaaagggctttacaaagagatataccccagactccagatgaattcgagaagttggttaggagctctccaaacagtagcttcgtctggataaactacatggcatttttgttagacctagcagatgttgataaggcccgtgcagtggcggaaagggctttgagaacaataaacatcagagaagaggaggagaaacttaatgtttgggtagcatattttaatctggaaaatgaatatggcagtccaagggaggatgctgtcaagaagatattccaaagagccttgcagtattgtgatcccaaaaaggtgcacttggctcttcttgcaatgtatgagaggacagaacaatacacactagcagatgaacttcttgatagaatgacgaagagattcaaaacttcctgcaagatttggttgcgctgtattcaattgtccctcaagcaaagcaaggatgttgagtgcatcaaattgatagtgaagcgtgcacttctaagtctacctcagagcaagcgtagaaagttcctatcgcagactgctatcctggagttcaagtgtggagtgcctgaggaagggagatccagatttgaactgatcttaagagagtaccctaaaagaacagatctttggagtgtttacctagaccaagaaattcgccttggtgatacggaaattatacgggcattatttgagagagtaacatgccttagtcttcctccaaaaaagatgaagtttttattcaagaagtacctggaatatgagaagtcgcaaggtgatgaggaaagaatcgagcatgtaaagcagaaggcactggagtacgttcagagttcactggcctgatattcgcaagaccaataatccctctgaacctaagctgttgctgctgctatccgctattcggagtcgtggctgcagaaattgcgatcagcaacctgatgcgacgactcctgataggtttctgcgaggatcggcggtgtaactgtctgaatagctgaaggtcaagtccttggtcgatgcagaaactgaagagtgctaatcatagaaacggtgataggtctgatgtattttgtgcgttagtgctatggttgcatatttttgattagtgatgcgaacacgaacgttgttaagagggaaatgcagcccattcagttttgtaggaataagtgttctacgcttggaattgtcaaaagtttttaccaaaatatgatgtatacaaaccttttcttatcatggaatgttgcaattacctcctggttctcatga

SEQ ID NO: 112 - DNA, 599 bp, Oryza sativa
gagagagaagacgcgacggccacaaggtgttcgacgccgtctcgccggagcagcagacgccggcgaggaggaggagactagtagcttggagtctgaaggttccagccatggagctggaggttggggaggagacggaggaggtgggggtggaggtggcgtgcgagtgctgcgggctcacggaggagtgcacggcgccgtacatcgccggcgtgcgggcgcggtacgagggccgctggatctgcgggctgtgcggggacgccgtcggggaggagctggggcgggcctcgccgccgatctcgccggcggaggcgctcgaccgccacgccttcgtctgcggcgccgggcgccgctccaccgcgccgccgtcgcccgccgagagcgcggacgacctcatctccgcgctgcgccacctcctccgccgcaggctgggctccccgccgctgccgccgccgaggaaggttcgctccacgccaagcagcccgaggcgcgatgtgccgacctccgccaccgccatcgtctccgtcgataccggcggcggcggcggcgcaggcggcgcgctcgcgcggacggagagctgcttcgcggcgctcgtcgagtaa

SEQ ID NO: 113 - DNA, 885 bp, Oryza sativa
accattttcactcactcactcacactgaactcctatggcctccgccgtcgtagccaagccaccggccgccgctccggcgagccgccgccgatgcttcgtcttcgtagagcgcgccgccgccgccgccgtcggcgtcaacgcggcgatcgctgccgtcgatgaccaccgcccagttccggccgcggccgccgccgccatggacgacgtcgtcggccgcgtcgcgcggcctgcgcgccccagcgcgcgcgccatcatggaggggacgcacaagcagatcagctccggcggcgcctcgggcggctactgcaccgtgccgtggtgcagcatctgcaccgggaataacccgttcgccattgccgagttcttgctgtgctgcaacctctgcggcgtccctctcgccggccgccccagcttcatctacattggagagaaggcgttctgcaaggaggagtgcaggtcgaggtacgtggtggaggaggcgctgcgcgaggcgagggaggagaagcgccgcgccgccgccgccgccgccgcgtcgccggagaagaagaaggaggcggcggcggcgaggaagggcggggaggagtgcagggaggggagcatcttcttcatctgcgccgacgacctgtgaagaatgtgatggatatgatgcatcatgcgtgcattgcatggcggatgataatcggagcttggctgtaataataatcgatctccaccataatataatacaatagtaatatacttagtgtactgtaatgaggatgaataaaggggatcaaatcaaggccaccatgcatggctagtcgatatatatctgagtattttgtgttgctcttttttttgtgattttttaaagtgacatgcataaaaacaaaggaactttttctt

SEQ ID NO: 114 - DNA, 1474 bp, Oryza sativa
aaagtcgccaaaacaagacgtccaaccaagcatgtctagctgactagctccctatatattgcattacatgccacagcgccgcacccctgcgtgcgagacggcgtcgcgtcgctcgccacgacggacatgcagcacctgcacggcgacgtgctcgagtcggcggtggagcgcgtgccggcgcccgatctcgccgccgcggcgctggtgtcacgggagtggctccgcgcggtgcgcgccgcgctgcgacggcgcatgctgcggctgccgtggctcgtcgtccacgtgatccatctccggggccagcggcgcctcgccgcggcttacgacccgcgctccggggcgtggctcgccgtgcccacggcgccaccggcgcgccacggcgcgacgtcgccgccgcagccgcactcgcacgtccgcctgatgcggggcgcgagcggggaccgcgtctgcgcgctctcgctctccgggctcgccgtggcgcgggacgctctcgggatggacgacgacgcgctcgtcgtcgcgctcaaggcccccggcgtgtggcgcgtcgatccggtgctcgccgcggtgggtgaccgcgtggtcgccatgggcggcgcgtgccggctggcgctgggtgacggggaggacacctcggccgtcgaggtccacgagcgcggcggctggacgcactgcggcgcggtgccgaccgcgctccgggagtccgcggcggcggcagcgacgtggctctcgacggcggcgacggatcagagagtgtacgtcgcggacagagccacggggacggcgagctggttcgacccggcgaagcagcagtggggacccacctcccgcctccgccctgacgccaccgtctccacatggggcctcgccgccggccgcgccggcgccgagaagatcatcctgttcggagtgaagcatgcagacagccgagtcgtcatccgatcatgggaggtggacggcgacagcctctccctgtcccatggcgcggcggcggcgcacgacacgatgccgagcgagatgtccgagaggctgttcccgcacggcgacgacggcgaggaggagacgtcgtcgccgtcgatcggggtgtgcggcaacaccgccggtgggtacgtgtacaatgcggccgtgccggcgacgggcgccgtcctctacgagctccggcggggcggggtggagggcggcggcgtggagcggtgggcgtgggttgcgtgcgcgccggtggtggccgaagcggaggcgttgggacgcgtcatcctcgcgtgttcgccggtggggctgcacgagcttgcggacgaacggcttgcacactgaactaataatggctatcgtgacatgttgtcgatagccagttgagcttgtaataagcatatagggctgttacactctgaaaaataagtttggatactcccaccggttttataataattctcgttgttttggacaataataacacggcatattcactacatgacaa

SEQ ID NO: 115 - DNA, 1490 bp, Oryza sativa
aaaaaacgccaagaaaccatctgtcgcttttgaccccgggaagcagcagcagcagcagcggcggcggcgtatcggggcgtaacggaatcgaggtgtgttgccgctatataaagaggaagaaaataggccccaaaccaaaccaccataccctactacaaaccataggcatcgccggcaagggaggtcggaggaagaagaaagggtcgtcgaggtgttcttgaattctgaatttctgatcaagtcgatcgttcgccggcgacggcaaaggtggtaactggtagtactatatatgacgacgtcgatggagaagccccggcaggtggtgcggaagttcctggcgcggccgcagcacgagggcgtcggcgccgtcgttcgccggagcatcgggaggtttgagctgaggtacttcgatccgttcctcgtcctggacgagttctcagtgtctgctccggctgggttccctgaccatccacacagaggtttcgagaccgtcacttacatgctcgagggagccgtgacgcacgaggacttcgagggccaccgtggcacgatcaaggccggcgacgtgcagtggatgacggccggacgcggcatcgtgcactcggagatgccggcggggcccggcacctccaggggcctccagctctgggtcaacctctcctcccacaacaagatgatcgagccggggtaccaggagatacagagcaaggacatcgcgagcacgacgtcggacggcgtgacggtgcgggtgatcgccgggcagtcgatgggcgcccggtcgccggtgcgcacgcggacgccgaccatgtacctggacttcacggtccgcccccacgcggcggcgcggcagccggtgtgcgcgacgtggaacgcgttcgcgtacgtgctggagggggagggcgtgttcggcggcggcggcggcgacaaggccggggcgcaccacctgctgctgctcggccagggcgacggcgtcgaggtgtggaacaggtcggacaagccgctccggttcctgctcatcgccggcgagcccatcggcgagcccgtggcgcagctggggcccttcgtcatgaacaccgaggaggagatcgacatgaccatcaacgacttcgagttcagcatcaatggcttcgagaaggccaagcactggaagtctcaggcgctggtggcgctgggcttagagtagtagggtgcaaccatgggacgacacgacatgtcgacatatgctctgaacgaagggaaaaaaaatggaatagttctttctctcatgatacgaggttgttttatttatttgttttttttctcttccaaacaaatagcgatcactttgtgtacatatccggcataaggttgctgcttgcttttcaattaggcaggtgcttcaaatcttcggcccaatgactaaaaatcatgtacttactccacaagttcataaacaagtccttttggactttcactgtgtctaatgcaagatttgtttttatagaactcta

SEQ ID NO: 116 - DNA, 1647 bp, Oryza sativa
cgggagcaaacggcggcgacgcttcgcctccctctccggccgccgccgccgccgccgcagcccatggcgtcgctgctccgcctccaggccctcgccctgaacctaacggcaccccgccgcctccccttcctccctctccgcgtcacgactgcgacggctccgctcgccggccgcctctccaccgccgccgcctctggcagctcgccggagtcacctgcctcggaaccggatttggattccgggctgtatcttgtggcaacgccaatcgggaacctcgaggatatcaccttaagggcattgcgtatcctcaaatgtgctgatgtcatactatcagaagacacaaggcattctggaaagctacttcaacattataacatcaagacacctcttctcagctttcataagtttaatgagcgtgaaagagagcctaatatcttaaagagacttcatgaaggggaagcagttgcattgattagtgatgctggtactcctggaattagtgatcctggcatggaactggctagactatgtgctactgagggaatccctgttatccccattcctgggccgtctgctgcaatagctgctctttctgcatctggtttgccaactgatgaatttacatttgtggggtttttaccaaagcatgctcgatcaagaaaagaaaggcttgaaatatctgcctgtcaagctgccacacaaattttctatgttcctccccatggaattcaccaatttctttctgatgctgcttcatcatttggtgattctaggtcatgtgttattgcaagggagataacgaaattacacgaagagttttggcggggaactattggtgaagcaaatgaagcctttgcaactcggcagccaaagggagaaattacagtgctcatagagggaaagttaatttcagctgatgaaactccatctgaggatttccttgagcatgaactcagagaattgatgacgcagggacatcctctgtcagcggcagtgaaaatggtgagtgaagctacatcagcaaagaagaaggatgtttatgccctcgcattaaggttatttggaaaatgagtaaaatgcgatgttttgctctcatatggtaactaaactttcagaaaccatgaaggatgtttggaatgtgtcatatttttcagtccatttgaacatcgcggatatcttattgcctgtgtgcgtgcgcagtaaatagcctattgggcacgtccaaggccagggccactcactagcaaaggcagctttctgaagatgggaatagcaatggcagctttctgaagaactagctgattcaaacttttgaaagaggtgatatttggggaattttcagaaggtaccattcaaatttgctggaggatgatgctgttctggcgatggaaaaagtcttcgatctgtagcttcatcgttgtacaacagaagcttcgctgcatctgcatgacaagctatagctacctggttaggttaggcggtaagttagtatgatcaccttagattttatcgcaatagttatcgcagtgtatacattttgtcttagattcacatttatcgaaatcattattatggagctaatgggccgaatccgtcgtgaatggaccactaaacaggcctccgtaaatgagctaagcctgcgttctt

SEQ ID NO: 117 - DNA, 1033 bp, Oryza sativa
gcaagtgcatccataagatttttattttttttttaaaaaaatgaagccttctcacgtggccgctctcgcggcgctcatggccgccgtggccgcgacggccggcgccgtgacgttcgacgcgacgaacacggcgtcgaacaccgccggcgggcagcggtcgaccgggaggtcggcgtggactacgcgaagcagatgctcgccgacgcgtcgtccttcatctgggacaccttcgagcagcccggcgacggcggcgaccggaagccggtggacgcggtgaccctgaccgtggaggacatcgacggcgtggcgttcaccagcggcgacggcatccacctgagcgctcggtacgtcggcggctacagcgccgccggcgacgtgagggcggaggtgaccggcgtgctgtaccacgaggcgacgcacgtgtggcagtgggacggccgcggcggcgccgacggcgggctgatcgaggggatcgccgacttcgtccgactgcgcgccggctacgcgccgccgcactgggtgcagcccgggcagggcgaccggtgggaccaggggtacgacgtgacggcgaggttcctcgactactgcgactcgccggcggtggtgcaggggttcgtggcgcagctcaacggcaagatgaaggacggatacagcgacgacttcttcgtccagatctccggcaagaccatcgaccagctctggcaagattacaaggccaagtacggcggctagctgacgtgacgtcagctccggcgaggtggccatatatatatatagtactatagtagtactgtagttagtatcagatatgtggataataaggcaataaataaagccatgtttgatgtccgagggactgtttagattgtagctaaaataaatcttaccaaatttaggtaaagttgttaaatatatgcatccatttagttcattattaaactctgataaatacataagaaatcctgtcaaaacttaacaatattgttaaattgctaaaattttagcattaataaaatttaataatatttatttt

SEQ ID NO: 118 - DNA, 622 bp, Oryza sativa
ggtaaacggtaaattttccccacctgtccctggtccaaagtccaaaccccctcaaaccccatcccctcccccaatccttcccccgaacccccaatcccggcggcggcggcgaagatgatcataccagtgcgctgcttcacctgcggcaaggtgatcggcaacaagtgggatctctacctcgacctcctccaggcagactacaccgagggggatgctctggatgctttgggcttagtccgttactgctgtaggcgaatgctgatgacccatgttgacctcattgagaagctgctcaactacaacactctggagaagactgagaccactgctggcaattagatgaacctcgcatactccaccgcttcattgcacctagtatcctttagtctagtgtttatgctgtgtttgacacatctaaacaaacagtgctgctatgcttatgcaaaaagctgttctttgcacattagtgaatatggatggacttgaccatttccaatgtacccaggaattctccagctgtgtttcttctatcatctatgtaactgttgctaatgtgtattgacagcttgaaagccaactttattctgaatgtcatctcgtcatttcacggcaatttatcact

SEQ ID NO: 119 - DNA, 1275 bp, Sorghum bicolor
ctgccacgcgcgctcgcgcccagctcgcccaggcctgcgccgccgccgcccagagtgggcagaaccggccccccgcgcgcgcgcctgccccctccacctcggcgttcgtgccgatgcgcgccgcgtgtcccgctgtggacacggacgccgaggatgaacgcctccactctgaagccctagcctcgacgcctataaagagcccagccgccgccacgccctcgagctcttccctagtggcgccgccgcagtcctctgttccctccacccagcgccgccgccctccgccttgtcctccatgaccggcgccgcgacaacgccttcacgtcaagcctggacgccaccgaggccccggcgtcctccgcgaccgcggcgtcgtgcggactcgcgaccgcggacggccacgcggatgccacggccgcaccgggacgcaggcgcttgagttgtccgcgacgagcacccactgcgccaccgagagcccgagacgacggcgcccttgcttcgacggctgacatgacgcccagaagccaccttcgccgagccgtggccagccgcgacgctgccctcgccgcgtcgagcttcgaccacggctggccacgcgggcgccacagcactgccgagccgcctcggtgccccgcgacgccagctccggccacggccgacctgaagcccgtggcgtccacgtccgcgctcaggagccgcgaccaccgagcgcgacgtcgggccccgacgcgtccccgtcctcgccacggtcaccgcgtcaagctcttgtccctgtcttcgccaagccaaaccccggtgagctcgccaagaccaaagttttccccttcctgcgttcaccatgctgagatcggccttcgtgccgtgttctacaccttgcagggaggatgtgcccttggggcaccattgccgcatggctggaccacactgctgccctcggctaacccctggactcgctgcagcaagccgcaaccgcttccaaccagccgcagcaagccacagctggtcagcggcagatcatagccggatcagagtggcagcagcaggtctccgccaccttcctcatgttcgtcaaggtcgaaaaccccccctaaaccctagtcgacgttggaactccatattaattcatatctattcatacatcattttgttatctatcgtatgtccttatcatgaattatctatacttgtagcacgacctatcttcgcctatatcattgcctgtgccgtgccttcatgccggtctaattatttatctatctatctctcgtgctatgg

SEQ ID NO: 120 - DNA, 3168 bp, Sorghum bicolor
ctataacccactacccacgctgtccgcctgcctcggacacccactccactcacctcaccatccatggcgatggcgccctccacggccgccgccaccacccttctcctccccgtcttcctcctcatcgccaccgcaactcactgcaccgcagccgactcatcctcctccccggacgcggccgccctcctcaacctctctgcggcgttagcggacccctcgggctacctctccacgcactggactccggacaccgcgctctgctcgtggccgcgcgtgtcctgcgacgccaccgacacgcgagtcatctccctcgacctctccggcctcaacctatccggccccatcccggccgccgcgctctcttccctcccgcacctccagtcgctcaacctctccaacaacatcctcaactccaccgccttccccgacgagatcatcgcgtcgctcaagagccttcgcgttctcgacctctacaataacaacctcaccggtccgctgccggcagcgctccccaacctcaccgacctcgtccacgtccacctcggcggcaatttcttctccggcagcatcccaaggtcctacggccagtggagccgtatccggtacctagccctctccgggaatgagctcaccggcgagataccggaggagctcggcaacctgacaacattgagggagctgtacctcggctactacaacaacttcaccggcgggataccacccgagctcgggaggctgcgggcgctcgtccgcctcgacatggcgaactgcggcatctccagggagatcccgccggaggtggccaacttgacgtcgctcgacactctgtttcttcagatcaacgctctgtctgggaggctcccaacggagataggcgcaatgggggcgctcaaatcgctcgacctgtcgaacaacttgttcgtcggggagatcccagcgagcttcgcgtcgctcaagaacttgacccttctgaacctcttccggaatcgcctcgccggtgagattcccgagttcatcggtgacttgccgaacctcgaggttctgcagctgtgggagaacaacttcacaggcgggatacccacgaacctcggcgtggcggcgaccagtctgaagatcgtcgacgtgagcacgaacaagctcacaggcgttctgccatccaagctgtgcgccggcgagcgcctggagacgttcatcgctttgggcaattcgctattcggcgacattccagacgggctcgccgggtgcccgtcgctgacgaggattcggctgggagagaattttctcaacgggacaatacctgaaaagcttgtcacgttgccgaacctgacgcatgtagagctgcacgacaatttgctctccggtgagctccggctggacggagagaatgtgtctccgtcgataggagagctgagtctgtttaacaaccgactgaccggtcaggtgcctaccgggatcggtggactcttgggattacagaagctgctgctcgccgggaacaggttgtccggcgagctcccgacggaggtccggaagctacagcagctctcgaaagcggacctttctggtaacctgatctccggagcggtgcccgcggcgatcggcagatgccgtctgctcaccttcctcgatatctcgagcaacaagctgtccggtagcatcccgccggagctcgccagcctccgcatcctcaactacctcaacgtttcccacaacgcgctggaaggggagattccgcctgccatcgccggaatgcagagcctgacagccgtggacttctcatacaacaacctctccggcgaggtcccgtccaccggtcagtttgcctacttcaacggcacatccttcgccggcaacgctgggctctgcggggcgttcctctccccgtgccgctcccacggcgtcgcgacttcgggctttggctccctctcttcgacgtccaagctcctgctcgtgctcggcctcctcgcgctgtccatcatcttcgcggccgcggccgtgctgaaggcgcggtcgctgaagcggtccgccgaggcgcgcgcgtggcggctgacggcgttccagcgtctggacttcgccgtagacgacgtgctggactgcctcaaggaggagaacgtgatcggcaagggcgggtccgggatcgtgtacaagggcgcgatgcctggcggcgccgtggtggccgtgaagcggctgccggccatcgggcgctcgggcgcggcgcacgacgactacggcttctcggcggagatacagacgctggggcgcatcaggcaccgccacatcgtgcggctgctgggtttcgcggccaaccgggagacgaacctgctggtgtacgagtacatgccgaacggcagcctcggcgaggtgctccacggcaagaagggcggccacctgcagtgggcgacgcggttcaagatcgccgtggaggcggccaagggcctctgctacctgcaccacgactgctcgccgccgatcctgcaccgcgacgtcaagtccaacaacatcctcctcgacgccgacttcgaggcccacgtcgcggacttcggcctcgccaagttcctccgcggcaacgccggtggttcggagtgcatgtccgctatcgccggctcgtacggctacattgctccagagtatgcctacacgctcaaggtggatgagaagagcgacgtctatagcttcggcgtcgtgctgctagagctcattgccggtcgcaagccagtcggagagtttggggacggcgtggacatcgtgcagtgggtgcggatggtgaccgggtcgagcaaggaaggcgtgatgaagattgccgacccccgactctcgacggtgcctctgtatgaactaacccatgtcttctatgtcgccatgctatgcgtcgcggagcagagcgtcgagcgccccacgatgcgagaggtcgtgcagatactagccgacgtgcccggctcgacatccacgtccattgacgtgccccttgtcatcgagccgaaggagaatgggagcccgggggagaagaagcaggagcagcaggaagggtcacacgactcgccgccacagcaggatcttcttagtatctagaagtgcagttgcaagaattgatcgtactgatagtagtactttgtagcatccttgttcgtttcagtgaagcgttggaacgtggcggtatctgtgtgtgtg

SEQ ID NO: 121 - DNA, 1495 bp, Sorghum bicolor
gctaaaaccttatcggccttcttgttgcctccgtccgcatttgactgtccccgcatccatcccgtcccctctcagccggcgctcgcctctggtcgttctcgtcgacctcgccggtccgccattgttttgcccgtctcttcctccctctgcgtgtccggtggacctccgtcgtagctggtgctcgtgcggggggctgccgctgcacccccccctcctccgtcgtatttgcgtcgatgtttgctccgacctaggttttggggtttccacaccttcggcgccgccggtgtccgctgccctttcagtcttctccggtccattgagcttcttggtatgcctctgccccatgtgttttcccctatcttcgcctatgatttgtttcgtttgctttggtgtttgctccgacctaggtgttggggtttccacaccgtcggcgccgccggtgtccgctgccctttcagtcatctccggtccattaagcttcttggtttcagctctgaaggtccgcggtgccctgcatttgtgcctggttgggtcgatctccatctaggtgcttccactcctgcatgctcctcagtatacaaatggatccgcagcttggtggtggatacaaatgcctataaggtcatggcacaaatgcattacctaggtacctattaaacttcactgcaggggatgaaataggagaggcaaagtttctttgcatatcatgagctccagcaagcacctccatgcagacaccaacttcacttcaaattgcgtggtccacaggttcagcaacaagttcagatttcccacacgacttaatcaacacccgtctcagccgcggatccagatgacacacctacaaaggatcctggcaccgaggtcacctgcagaggcacccaatgctcgcagacacttatttaaagatgtcggtgcagtggacgagcgagtagcagacgatgagagtttcactgcacctggactgatacaggatgatatgagtatcccaacagggtctccaccacaaccacagacaaaaagggctagatctgaaatctgcaggggttaatcagctgcggctcaaacagggtagcctaaggccgcagtgatctagaaggggccatcattggtcttttgcgcatgaaaatgcttatgatcctgtagatggttctgccatacaattaaacataagaactgtttgaaggcctgtttgttgtataatatccaggccattctgcatctatctatctctataatacaatgaaacgcaactctcctgtatttttagaaaaaatttttgcatctatctagcgttacttaaactcagttgctccctctgcagcttatttattgtataatatccgtgctgctactgcctcagggagaatccgtatggtacaatcgtctgtttctgaatggaacttatgtagcagcctatttaaatacttatagaacaagcatatgtggtacaagtactaatataatataaaccagtgtacatgtgctgctacca

SEQ ID NO: 122 - DNA, 1437 bp, Sorghum bicolor
acactttactactaccacctaccccctacctcgttcccgtcgcttcagaaacccacaaaacggcggccatggcttcggcgcagtctacctcgaccatctcctcaacctaaactcagccacacaccttccttcagaaaatcacctaacctattagcagcaacagtcgacccctcgtcctttccaacatcaactccatcgccaatacagctaagtccatggcgaacaccctactaaactgaagacgccagattcacaccagcttcaatacgtccagatggcgcagcaccggttccagaacctcagaatcatcgataaaacagagctcagagacatcgatgccactatgtccggcaacacagtcttcgcaacagtcccggatactatctcggacacattcaaccactatgacctcgcggaggcaatccaacaacagttccagataaacatcgaggtagaagacatatccaggtataacgaaggttacttcttacgcgtgcacacacagcaggccagaacaaacatgctacaccgaggctttatcattgttcgaaactacctcattggtctgagaccatggaatccagaacatggatcaacagcagtctccttacaaaccgtgctaacctcttgtccactcaacatacacctagctacatacatacccttatcagatccatatgaacacctaaccattcacattaccggcgtaccaccgcatctatgctgcaactccctcatacacaaactgttccacaaaatctgcatcatccattcagtcaactttatatctgctacaactgaatatgagattagcgcccgcggaagggtaacaatgatcccacagactgctcatttaggaattagaaacctgagcggacagagtgaggtaatcaacatttggcagttatcttaccagacattcacagacgaaatgctaggcagacaaacaccaccaggagaccggcgatctgacctctgcggatactcagacatcgacacagagcaacgactggaactggttgacagcaacggaaataacgaagcaacctcccgactccaagtcgcctccgatacttcgacaatggacacatcagacaacagtattgaagaatgaaagtgaagccacaacaacaggtcaaaacccagctacgaacaaaagaaccaaaatggtccaccagaccatatagacacttactaatctatttcgtatctaccacgatgctatgtttgtaatcagcaacctatcaaactttcctatgtgtactctatatgtccctttactagattaagcctttccatgtacacataaaggcctactaaagaccatgtatccctagctttatgcagaagtatgtttacttaacccatgtgtaatatctatgctattcgcttcaaacagactgctacagaacgttgaatgctcaattagtaacttca

SEQ ID NO: 123 - DNA, 1510 bp, Sorghum bicolor
agccccaaccctagcagggagctggacacctgagccccagagccgccgccgccgtcgcccaaggcagagccgcgccagcgctcgcgcctgccacggcttccgtgcgaccccgcatccaccgccgcgtgtcccgctgcggacacggacgccgaggatggccgcagcgtccctggagccctagcgcccgcgctataaaagcggcagcagccgctcgcccttcttctacccgccgccgccgccatagccgactcgaagctccgcaccctcaccaagcgcctcgaccccgacctcgccccgcgcacctgcaccaccgagctcggtcacgccgtgacgccgtcgatcgccaccacgatgtcgcccgcaactgcgtcgcccgagcgtctcgtcctcggcaccacctcggcactcgcaccgcgccctcgccgagcagcagcagagccgcggccatggcctcgccctgccgacgccgccaagcaccactgcgcccgcctcggccgtgcccctacctctgtgtcaagcttcatcaccacgcgggggtcagccgcggtgccgtcctcgctgcgcagcggcctcgcccggcgacgtcgagcccgctgccctcgccgcgtcgagcttcgaccacggccggccgcgtggacgccacagcccggccgagcctctgcctcgccaccgtgggagtcgccgcggccacgacgccttcagccccggcgcccctccgcgtctacgacggtgtcgaccgcgagcccccgtgctgtcatggagcttacctcgtcgagccgacacgccgtcgacagagccaccgatgccgcgcgccgggcaccagagcaagccccttcgccgagcacccgatgcgccccgttgccgcggccacgccaggacatcgccatggtcaccgcgtcagcgccggccgtggtgatcgcgaccccgaccacgacgccgtgctcatcttgccacggtgaccgcgaacttcccttttgctggctgccgatcaccactgaacgtgcagcagcggcagcaccaccccgcgcgaagctcttctctgccgccggtgagccaccagtgcccaagtgccctccttgctagctttctgttttgccttgctgaaaccggcctttgtgccgtgttcttcactgtacagggatgctgcacccatgtcgtgccacttgccggagccgttggacttaacatcgctgctgttggagcaccgaacctcgaggcgttgccgaaccccaagacttctctttcagatgcaccccggccacttgcagcaagccgcgaccaagctgtagaagccctctgccatcctcgcccgcaaggtcgaaccttgaacctagccgacatcgtctccgacgttggcaaaacccttgccgttcatttcgatatcatacatgccatgtatcttgctcatgtatgcattatgatctatctgcatgaccatttgttcatctatccatgtcatgcacttgttacatgattattcatctcatatctcgtttaatgcgcgatctat

SEQ ID NO: 124 - DNA, 789 bp, Sorghum bicolor
ccccgcagtcctcgccatcggccttgctcccccacgattcgtacgttgcccagcactcttgcacttgcgatgcactcgctagccctcgccttcggcctcgtgccgccgccagccatcacccttgccgtcgtggtgagggtggcgcacgcgtggagaagcgtgaggtcgggttcgagggatctgacgatgacagtgcaaggacaagggctggcaacgccggcgcaagggtcggggccttctactcagcacttgtgcgattgccataccgtacaacctcctcatcgatgtccaacctcgccacatgtgtcgatctcgatctggatcttcgatggtccaacctgaacctcacgttgtactggaatctggaaacggaggcggccagttggtggagcacttaccttccaagcatatacatacaattgaccaacactgcacggaagtacacttcatcctaccatggtgaaaacatgtagctttgccactgctggcctctcaccatcgatatgcttggtcgccggcatggtagtgagggtgccactcatggataatatctgtgttttaagcttgagaatgtatctgaaactaatgctacacatggctacttctctcagtaatctttatttgactttgtatcatctttaggcttgtggcacctctagcggtattatcagtttggtgtatttttctcatatgagtgcatctttaatttgggttatcatattgtacaaacatttattgcttgatagtaagtgagtatttttccctctatctccatttacactgtctaaa

SEQ ID NO: 125 - DNA, 2278 bp, Sorghum bicolor
cacacagcttatcctttcccggcctcccacagtcctgctgtgcggctaccgcgggaaatggtcgcgctccacgcgaagcagcccacgcttcgtctactccccgcgccaacgagccatgtcattgcccgcccgcccacggcggcggccaatgtacgcctcggtgcgccgccgccgcctgacgtcgtcctcgactgcaaacggttggacgcgctgatgaagtccgggaggctaagtgacgcgctggacctgttcgaccgtatgcctcgcaagaacgtcgtcgcgtggaccacggccatctccgggtgcacgcggaacgggcagcccgaggcggccgcggccatgttcgcggacatgctggagtccggcgtcgcggccaacgacttcgcgtgcaacgcggcgctggcggcgtgcgcggccgcgggcgccggcgcgctcagcctcggcgagcaggtgcactcgctcgccgtgcgggcgggcttcgccgccgacgcctggatcgggagttgcctcatcgagctctactcgaggtgcggctccatgtgggcggctgaggaggtgtttcgcaggatggaggcgccggatgtcgtggggtacacttcgcttgtctcggcgctctgcaggaacggcgacctcgcacgggctgtggaggtgctctgtcagatgatgaggcaggggttgcagccgaacgagcacacgatgacgagcatgctggcggagtgccctcgaatgattggcgagcagatacatggatatatgctcaaggtaatgggttcacagagcgtctatgcatcgactgcactgattgacttctattcgaggtacggtgactttgacatggcggagaccgtgtttgaaaatcttgactccaagaacgtggtgtcgtggtgctccatgatgcagctgtgcattagggatggaaggttggaagatgcactgcgagtgttcagcgagatgatttcggaggccgttgagccaaatgagtttgcattttcaattgctctcggggcttgtgggtctgtttgtctggggcgtcaaattcactgctcagccatcaagtgcaacttaatgactgacatccgagtatcaaatgctttgctctctatgtatggtaggagtggttttgtttcagaagtcgaggctgtgcttggcaagattgaaaatcctgatcttgttagctggacagctgccatttctgcgaacttccagaatggtttcagtgagaaggccgtagcattgcttcttcagatgcattcggaaggttttacaccgaatgactatgccttctctagtggtctgagttcttgtgcagacctggcattgctggatcaaggaaggcagcttcattgcctggcactgaaactggggtgtgacttcaaagtttgtactgggaatgcactaatcaacatgtactccaagtgtggtcaaattggatctgcaaggcttgcatttgatgtcatgaatcttcatgatgtcatgtcttggaactcactgatccatggtctcgcacagcatggagctgcaaacttggtactggaggcattcagtgagatgtgttcaagtggttggcagccagacgattcgacatttatagcagtcttggtagggtgcaatcatgcaggtctggtgaaggaaggggagacattcttcagactaatgactgatcggtatggtctcacaccgaccccttctcactatgcttgcatgatcgacatgctgggtcggaatggtagattcgatgaggcgctacacatgatcaagaatatgccattcgagcctgatgttttgatttggaagacactattagcatcttgcaagctgcacaagaatcttgacattggaaaactcgcaacagacaagctgatggagctttcagaaagagactccgcgagctacgtgctgatgtcaaacctctatgcgatgcatgaagaatggcaggatgcggagagggtgcgtcggaggatggatgaaattggggtgaagaaggatgccggttggagctggatcgaggtcaagaacgaggtcagcacctttgttgcaagagacacgtctcattcagactccgcatccatctatcagatgcttgcagagctcgttgttgtgatgcaagatacagagttagatgttcatatgcagatttagatgccaaagatgaacatatcacttgcagactttacatgtactaggtagcgtgcccgtgcgttgctacgggatagctaatattttataaaaaaaatacatatatcgcatgataagataacaatgttgggtctatttggtt

SEQ ID NO: 126 - DNA, 2382 bp, Sorghum bicolor
cttcaccgtcaggcaaccatcccttatcctgttcctgttgctgctgcactcggtgctccagtccagtccacgccatggcttcccgcgccactctcctgccgctcttcctcttgctcctcgcggcgcccgcgctcgccacctccggcaccatcgtcttcaccacgctcggccggagccgctacgccttcgacatcttcgcgctcccactctctccgctctcctccgccgccgcctccgcggagctccgcctcaccgacggcgtctccgttaactacaacggcaacttcgcgccctcctcctcctcctcggagccgccctccctcctcttcgtctccgagcggaacggctcactaaacctctaccgcacccccgtccctctttccgcctccgccgcccgccgccgcgaggcgctggaggaggaggacgactcgccgacgctcacgccgctgctcccgtgggaccccatcgcgctcaaggaccggccctcgctgacccccgacggcgcccacctggtgtacgtctccacggcggagcccgcggggtccccgcgccggagctgggcggcggtgtactccacgagcctagcgtccggggccacgcgccgcctcaccccacgcggcgtcgccgacttcagccccgccgtgtcgccgtccggggactggaccgccgccgcgtcgcccggccctcgcgggtgggacggcgaggtggaggacctccgcaccgacatctacgtcttccggacctccgatggttcgcggcggacgctggccgtcccggacgccgggtggccgacctgggccgacgacagcaccgtcttcttccaccgccgggacggcgacggctggtacggcgtgtaccgcgccaagctctccttcacggacgacgacgacggcggggtggccgtcgcttccgtcgtcgaccggattaccccgccggggatccacgcgttcacccccgccgcgtcgcccggcgcgccggggctcgtggccgtggccaccaggcgcccgggctccgactaccgccacatcgaggtcatcgacgtgtccggcggcggcggcgccaacgccgcctacttcgacgtgactagggccgtggcgccgcgcgcgcaccacttcaacccgttcatctcgcccgacggcgagcgcgtcgggtaccaccggtgccggggcagcgggaacggggactcaccgctgctgctggagagcatcaagagcccggcgccggacacgttctcgctcttcaggatcgacgggtcgttcccctcgttctcgcacgacggcaagaggatcgccttcgtcgggctgccggggctgttcgtggtcaactccgacggctccggcggccgccggcgggtcttctcgggcaacgcgttccccacgacatgggattggaagaggaaaggtgtcatctacaccagcgtcgggccagacttcgcgagcgagagcaccgaggtggacgttgtcgccgtgtcccttggcgacgacgacgaccccaaagtctcgatcaagaagctcaccgtgggcggcgagaacaacgcgttcccgtccccctcgccggacggcaagtgggtggtgttccggtccgggaggtccgggcacaagaacctctacatcatggacgcggaggacggcgaggccagtggcatccgccgcctcaccgagggtccctggtccgacaccatgtgcaactggtcccccgatggcgagtggatcgcgttcgcctccgaccggcacaacccgggcggcggcagcttcggcatctacatggtgcacccgaacggcaccggcctgcggagggtggtgcacagcaccgacggcggccgcaccaaccacccctggttcagcccggactccaagacgctggtgttcacgtcggactacgccgccgtgtccgcggagcccatctcaaacccgcaccactaccagccctacggcgagatcttcaccgtcaacatcgacgggtcgggcatccgccggctcacgcacaactccttcgaggacgggacgccgtcgtggacgccacactacctgaagccggaggacgtcggcgagacgctgcaggcctccgggacgtgcgcgtttgaggattgccactggctcaacattgctgcccagccagatggcctcatgtgtggcaagcacggctgatgtagaatctgtgatgggactcatgtatgtatatatagcactatagcagcgatcatccagtgcagtgatgccatcttgtttgcttgcatactactgatatgaataaggtcatgtacagtgatgccaagtttaaggcaaaaattaaagaaactccacatacttatgacgatgcttacatgtactaatgacagattaattatgcatttatgcttaatagatttgtcttgcagtttcc

SEQ ID NO: 127 - DNA, 1637 bp, Sorghum bicolor
atggaccacacctgtcagaaaagatagccgagaaggccgcaaaaaccctggtcttctgtcttcgcagcggcggagtgcgcgcccatcagtcccgagttcccgccacacccctccattcccctcccaatcctttccccaaatctcttctctctagggcgaggcgaggcggggaagacgagcgcggcggcgaggatgttgtgggtagacaagtaccggccaaaaaccctagacaaggtcaccgtccacgaccaggtggcgcagaacctcaggaagctcgtgtcggagcaggattgcccgcacctgctgttctatgggccgtcggggtccgggaagaaaaccctaatcctcgcgctcatcaagcagatgtttggcgctggtgcggagaaggttaagctggaaaacaagacatggaaaatcgatactggaacaaggacacttgagatagaattggcaatgttgtcaagtgctcaccatgtggagatgaaccccagtgatgctggctttcaggacaggtatgttgtccaggaggtcatcaaagagatggcgaagaacaggccaattgatgccaaaggcaagagagcgtttaaagtccttgtgttaaatgaagttgacaagctctcacgagaagcccagcattccctccgcagaactatggaaaagtatagctcatcgtgcaggctgatcctatgctgtaacagctcctcaaaagtgacagaggctgtaagatcccgttgcttaaatgtgcgagtaaatgcacccagcgaagatcagattgtccaagttctagagttcattgggaagaaagaaaacctgcgtcttccagctggatttgcagctcgtatcgcagcacaatcaaaccgtaatcttagacgggcaatactgttttttgagacttgcaaagtgcaacaatatccatttacatcaaatcaagcggcgcctcctcttgactgggagcaatatgtgtctgaaatagcaactgatatactgacagaacaaagccctaaaaggctatttgctgtacgtcagaaattctatgaattacttgtcaattgtatcccgcctgaaagtattttgaagaaattgttggcagaattactgaggaagttagatgctgatctgaaacatgaaatctgtcactgggctgcacactatgagcacaagatgcgccttggatcaaaggccatttttcatctagaagctttcgtggccaagttcatgagcatttacaaggagtttctggtggctacatttggttgagcagaaccccttaacttctgcagctttcgtggccaagttcatgagcatttacaagtagttcctggtggctacatttggttgggcagaacctcaagcatagggttggctatcacattgtatcagggagtatctttggcggtgtagtcttgtactaaactcgtgaacgactagactagcttcattctgtctgtttaaaccatcgtcaactctggttaccctcttgtgattccatcgcgttgactgcacgtggacgttggtgaagttattattacatcctatgtgcggcatactcggaagttaggccttggtaatttttttgatactgtagcattttcatttatatttgataaatattatctaatcataaattaactaggttt

SEQ ID NO: 128 - DNA, 2035 bp, Sorghum bicolor
atctccattggtgcaattgcaaacgaaagggaccagaggacaggcccctctccctctctctccccaatctccacaggacttgttgagcttttaagcagctagtagcctagagcactagcagtccttttggattttggtttggaaacaaggcgtcccagtcccaaatctcaagcaagcaagcaagcaatctgcagatggcaacacagtggttctccaacatggtgatggacgagccgagcttcttccaccagtggcagtcggacgcgctgctagagcagtacacggagcagcagatcgcggtggcgttcgggcagggggaggtggaccacgccgtggcggcggcgctgtcgacgatgccgcagcagcagcagcagcagcaacccgcggtggcggccgagcaccgcccgcgcaaggcggccaaggtcaacaccagctgggactcgtgcatcacggagcagggctcccccgcggactcctcctcgccgaccatcctctccttcggcggccacgccgcggccgcgttcgccaagccggagccgcacccgcaccaggcgcccagcgccgccgcgtactacggcgccgcggcggcggccgccaaggcgccgaagcaggaggtgctggacgccgccgcgctgccgttcccggctaagcgttcctacgacgacatggccgaggccgccaataaggcgccggccgccaccacacgcccggcgtcgcagaaccaggaccacatcttggccgagcggaagcgccgcgagaagctcagccagcgcttcatcgccctctccaagatcgtccctggcctcaagaagatggacaaggcatcagtgctcggcgacgcgatcaagtacgtgaagcagctgcaggaccaggtgaaggggctggaggacgaggcccggcggaggccggtcgaggcggcggtgctggtcaagaagtcccagctgtccgccgacgacgacgagggctcctcctgcgacgagaacttcgtgggcaccgacgcttccggcacgctgccggagatcgaggcccgggtgtcggaccgcacggtgctggtcaggatccactgcgagaatcgcaagggggtgctcatcgccgcgctttccgagatcgagcgcctcggactctccatcatgaacaccaatgtgctccccttcaccacctcctccctcgacatcaccatcatggccatggctggtgatgacttctgcttgtctgtcaaggatattgtcaagaagctaaatcaagcgttcaaatcatccttctgatgggtttagcttctgaccaagcttaatctaggccaactttttcccatcagccttaaggatttgaggctaatggttaggttatcaggttattccttgccttgcttccgaagagagttgcttgcagtccccaacagagcccccccaaagatagccatttccactggtttttgctgcatgggtgcagagattattacctagttgcctaccaacctattttctctccctccaattttttacatggtttgatcttgtcactccatgtttttgggagggagcagattgtaaaaaaaaaacaaaaaaagaagagaccaacctttttctagggctttgctatgtaggtcggggagtttgacttttacaaacctaattttctttctcccctttgccagtatgttgccctttcaccttgtttttccacgagaggattgtgtttctcaaacacaaacacctacctttgccgtcctctcaatctcgatcacactgctcccagaaaagcttcaattgtggagaaaatggcgccatctttttttcagctctgagggggactttgcaagccttgatttggaagtactgtagggatgccacttgctttgtttttttgagggtcctacaagttggccgcacttgatgggccctttgcttatagttttcacatgtgagttttgttgtcacaggatcaaggtgtagttgttgtgctctcttgtttactctcatacaagcataaaaataaataaataaataaatgtgctcgtttgttacctttcatggct

SEQ ID NO: 129 - DNA, 839 bp, Sorghum bicolor
cggcatcggcatcggcagagagcgcagcgcagagtttctagagcatggaccacggcgacaggaggagcggcgcgacgggcaggccctggcgcggcgccggcgccggcgtcgcggcggggggcggcggcccgccaccgcccaaggtgtaccgcgtggagcccagggacttccgggagctcgtgcagaggctcacgggcgccggcacgccctccgccgccgccggcgcgccgggcccgtcgccgcaccagagggcgacgacgctgacgccggccatggtcactgcggacagcaggcgcgcccaggccgcggcggccgtgcccgtgcccgggccaaccgagcagttcgactacgcgtcctggttctccgcgccgctgctcagcccggcggcgtacggcgcgccgggcttcggtggcggacaccagcagcaccaggggagcagtgggcctctgctttagggcttgtaggtacagtagaaaacagagtcgtcgtcgtccctgtatagctgctccatcgctggttcgtgctcctctggctcgttttgcctttgtggtttggtcatgactacacaaccttcttgtcatcttgtgccacgaatgaaattcgaccagcaagttatacggctattgtttatttctggtaccttctgatagaaagacaaataaatttgttttcatcccttttcttttgttgtttctgtcgtgcttgtgcatccaccatccgatccaaatttccaatggtgacatataatatatgctccccttcacattttggtcgcatgtaatgtaatcattccatcatttttggccctagcgattgccaagcattcgatgattgcggtt

SEQ ID NO: 130 - DNA, 1612 bp, Sorghum bicolor
acgcgtctccctcctccctctactgccgccagccgcgacaagatatggatagagcggccgcgacagccgcaggcatcatcgtcatgatcccatcgccctcgccgtcgcctttgtagcactgccttcctcgtccaccgggcccctatttcttcccacttgggttgctagatcggattggatcccgtcggcccgtttcttggagaaggagagatggccgaaatggcggtgactgtcgcggccgccaacggcaccctccggacgtgctccggcgtgtcgccaacggcgcccggcggccgccgtgctgcggttcttggtcggtggcgggctcttgcgccagccaacttgagattgtcctctccagctgtgagggttccaagggctacttccgctgcggcggttgaggattggagcaacactgatatagtccctatcccgaaagttataatagatcaagactcagatccggatgcaacaattgtagaaataaccttgggtgatcgtcttggcgagctccttgatacaatgaatgccctaaagaacttggggctaaatgtcgttaaagctagtgtctgtctcgattctactggcaagcataacaagttttctataactaaagcgtccactggccgtaaaattgatgatccagagttgttagaagcaattcgactgacgatcattaacaacatgttagtgtatcatccggagtccagcagtcaattggctatgggagcaacttttgggccagaagcccctacagaagaggttgatgtggacatagcaacccacatagatatctatgatggccctgaaagaagcttacttgtggtggaaacagcggatcgtccggggttgctggttgaccttgttaagatcatctcagacatcaacattaatgtccaatctggagagtttgatactgaggggctactggctaaagcaaaattccatgtcagctacaggggcaaaccactgatggaggctttaaaacaggttctttctaatagcttgcgctatttcttgaggcggcccacaacagaggacgctagcttctagccagatgatcatgatgaagcctcccaactttcttatgagatgggattcacatgaattggataccatcatcaaagcatttgaaacacgtacaataatttattaagattggggaaagtatacttatgctatggcaccaccacttgaaggttccaaggcaggggaatctgttgtatccaagtgcaggagattgctattcttaagcatgcaatgacacatgattattttgctacctcggatacatgtttggtggtaaatataaataagatggaacattgtggggggcatcatcccgtgtctggatgcaaatataccttttattgtcagattaatgatgaagttaccaataacagtcttgagcataaaagtcttacaaagtcatcgtggatgagataaaattcagcagaactaagagcttcatctcctttttgtctataaatattgttacgttataaaaatatttaggccgtttagatcaaaaaggttttggattttgatattgtagcatttttgtttttatttgacaaacattgttcaattatggagtaacagacaaactgtg

SEQ ID NO: 131 - DNA, 3785 bp, Sorghum bicolor
gacgaatcgagggagagtggggagggaagcagggggtacgccgaggcacagaacaaccgacagggtatttatccccccgcccttgtctcgccccccatccctcgccctttcacttccatcgctccgtccgccccccattccctcctcctcctccgcagctttccctttcctgcacctctcgctaaatcctcttcctctcctcctgtactcgccctgccatgcttcgccgtggattttaactgcttgcttctgtttggaggaacacaggcatcaggccagccagggacgacgagagtaagaggaggaaggggttctgcatttctttcttcccctctcggttgatcttccggtcggtcgaggaaggaaggaaggaaggaaggaaggatgtttggggattgccaggtcctgtcctcgatggccgccatggccggggcctcctcgtcggcggacgcgctcttcatccccaacccaggcgcgctcgccggattcatgtcctcctccgccgccgccatgccattccaccatttctccaccactgccgcctccctgatacctaaggaggagggcggcatcatgggtgcgctccaggtggccaaggacgaggacatggatcagttggagatggacatggagctcagcggcggctctgggagcgcccacctggacggcctgctcagcttcgcggacgtggacgacgaccggacggagcagaagccgcagcacagcggcctcgaactccagacgacggtggacgccgccgggcagcagcagcagcagcagcagctggccaccgccaacggcaagaagaagcggtaccaccgccacacggcacaccagatccagcagatggaagcgctgttcaaggagtgcccacacccggacgacaagcagcgcctcaagctgagccaggagctggggctcaaaccccgccaggtcaagttctggttccagaaccggcgcacccagatgaaggcgcagcaggaccgcgccgacaacgtcctcctccgcgccgagaacgagagcctcaagagcgacaactaccgcctgcaggccgccatccgcaacgtcgtctgccccaactgcggccacgccgccgtcctcggagagatgtcctacgaggagcagcagctccgcatcgagaacgccaggctcaaggacgagctcgaccgcttggcgtgcattgcgacccgctacggcggcggacgacagccgagcatgtcgtccgcgctgggctgcttatcggcgccgcctccggtactcatgccgccgctcgacctcgacatgaatgtatacgctcgccatttcaccgaccagtcttcagtcatgggctgcggcgacctcatccagtccgtcctcgcgccacagcagcagatccccgtcggcggcgccgagcaccacgcgacgtcgtcgttcatgggcgccgccatcgggcctgtccaggagcaggacaggcagctggtgctcgacctcgccgccacggcggcagacaccctcgccaagatgtgccgcgcgggcgagccgctctggctgcggcgccgcggcgcgagctccgaggtcatggtggctgatgagcacgcccggatgttcagctggcccgtcgacggcgggcagcagggcagtgcctctacgggtgccgcggccaggaccgagggatcaagggacagcgccgtggttatcatgaacagtattacgctggtggatgccttcctggatgctaacaagtggatggagctgttcccttcgatcgtgtccaaggcaagaaccattcaggtcataaaccatggagctcgttctggtcatatgggcagtggatctctcctcttgatgcaagcggaggtgcagttcccgtctcctctggtgccggcgcgggaggtggttttcttcaggtactgcatgcacaacggcgatgaggggacctggtccgtcgtcgacttcccggccgacgggttccagctagaaggtctgcagacctcatctgttgtcaagtgctgtaggcgaccctccggttgcatcattcaggacatgcccaacggctactcaagtgtggtgtgggtggagcacatggagatggttggagaggagaagccactgcaccaggtgttcaaggattatgttgccagcggctatgcctttggggccacacgctgggtgtccctgctccagcgccaatgtgagcgccttgccagtgagctcgcccgcaacatcgccgaccttggagtgatccgcactccagaggcgagaacaaatatgatgaagctgtcacaacggatgataactactttctctgccaacatcagtgcttctggaagccaatcttggacggcactctcagaaactacagaggacacaattagggtcactactcgtaagaacacggatccaggccagcccagtggtgtcattctaactgctgtctctactagttggcttcctttcagccatcagcaggtctttgagcttcttgcagatgaacaacagcgttgccagcttgagattttgtcaaatgggggctcacttcacgaagtggcacacattgcaaatggatcacatccaaggaattgcatttctcttcttcgaattaatgctgcaagcaactcctcccagaatgtggaactcatgctgcaggagaccagcacccaccctgatggcgggagccttgtggtgtttgcgactgtggatgtggatgccatccaagtgacaatgagtggcgaggacccttcctacatcccacttctccccctgggctttgccatcttcccggccaccaacccttcgccagcagcaaccagcacaagctccggcaatggtgaaagcagcccaggtaacacagatgagcccaccagtggctgcctcctcaccgtcggcatgcaggtgctagcaagcgcggtgccctcagctaagctgaatctctccagcatcactgcaatcaacagccatgtctgcaacgccatccaccagattacaaccgcactcaaaggccaaggagctggggtgagcggggttgaaccggtggctgctgctggctccgactaggaagagtgggaacagaggagagcagatccatgccgaccaaaatgccttccaagtccggttatttttgctaacaaacatatcgcaggtgcaagcgaggatttgacaagagcccgaaactaacacatgaaaaaaaaattcaaaacccttctctttcccgccatatgcctcttaaaatgacaaaaatacccccgaccgaacaaacagtgtgggggcattttgatcattttgggaaggtagcgtcatctacaactactagaaaagggtcttgtcaagctctcacttgtgccggctgaatctatcacacagatggcaacaggtgcagtttggtcatgcagttgtttgctcctctcggtctgttcccttgctcagaatccagaactgtgaaaggttagcttcgattggtatgcttcttttgatttttgtaataataataagacggaagattacctaatagtttgcgcgtaatggttcgcggtcggtcgtagagctgtataactctgtattagaggttcaagacttgattgtgtaggaaagaagagaaaagtgcgagaggaggagtcaagagcgaaccaaaccagttgtgacccttggatctgatcccaggccatcagggaagaagggtcttggttcgggaattgacttgttccctctctgcattgcaatgttccatctgtaacctgcttatttgtgctactcaaactgtttgattacattggtaggttatcatgcatgtttgcagctcttgccctggt

SEQ ID NO: 132 - DNA, 897 bp, Sorghum bicolor
gaaaaagtcatagcagcgagtactccaccatctccatccatcccatcagagccacacgttgagcgaggacccaaatcccatcaccacaacgcccacaagcttgacgcaggggtagcaatggcgacgagaagctaaaccacgccaatcagagcggcagaggtagcatagcagctagctgcacaaacttgagcacctaccctctgtactgtgcctgtttttcagttggtacaggatgctacacccattgctcgcggcagtaacagctgccgtctcttcgtccttcgtctcaccgccgcggcgagtcccggcttctccgggtccgggacgacgacgacgacgtcctggtggcttcgcggtccggtgcgcgccgaacggaggtggcgtgacggcaggcgccgacacgaaatcgaagctcaaggtgggctccccgatcgtcatcgtcgaggcgcccgtgatgctcaagaccgccgcgtcggtgccgtcgctccggcacaacagcggtcaggtcaaggccggcgacgtcggaaggatcatggcgcggaagcccaaggacgtctgggtcgtgcggctcgccgtcggctcatacctgctggacggcaagtttttcagtcccttggattctgacgacggagacggtgatgagccccaggcccaggatgaatgagtgatcaatgccttgacgattgaatcgcaagtttactcacaataatgccgtgcaaacatgtccatgcctatgcatgattgcaatttgcaatgtactgtactgtagatgtgtaacttctgccgacagtagtaagtgattactatttgtattagaatcatcaacttatcatagaaggtaaacacacagcttcagtagttctaattttgagtagaacctagacgattgctttcctc

SEQ ID NO: 133 - DNA, 1201 bp, Sorghum bicolor
acacaccgtgcagacctccacggcgtcctcgtctccacccatttccgttgcagagtagctcgacagtttctctcagcctcgagcggagcggggagaggatcggatcggatcggatcggagagcctacgacgcggcaggagctggctatccctcgaggtcagggagcggcggcgtcgccgcgcccgcacgagacggcggagctggacgcggcggcggcgttcgccgggggggagtcggcggagcagcgcaaccgcttcctggtgctgcgtctgtacgaggcgctcaacgcccgcgacgcgcgccgggcgcaggagctgctggcgcccgacctcgagtggtggttccatgggccccccacgcgccagcacatgatgcgcctcctcaccggcgcggaccagcgcgacaaacagaaccgcggcggcggcggcgggttcgtcttctccccgcgctccgtcgacgccttcgggtccaccgtcatcgccgagggcgccgacgacgcgcgccagctctactgggtgcacgcctggaccgtggggcccgacggcgtgatcacccagctcagggagtacttcaacaccgacctcaccgtcaccctcctctccggctccggcgccgtctcctccaccaagaaagctgacattgcaggcgctctgcctaagctacaggacgctgcgtcttcttcttcttcctcctccccctcggcagctgcagggcccaagtgcctgtggcagagccgccgcgccgacagcgcacacaagtcgctgccgggcctcgtcctcgccatctgaagagacttgagaccgcaagatccatctgctaccctccagtataaccgtataataaaaatcctaaagttccaaactattatcgcagaaataatctggaacggcactagtcgtagtatgtactgtactgtactgtactcagagccagtcagtgaaaacgtaatgacgtttccgtatgcgtatggactgaactgaactggtccgtgctgtgaggttccggattcttgtacctagttagcttgtgtcctgttgtgtcgtctgtgtgtgtggaaattgtagtttgttaagtcatggcttatggtgcgcgctgccattgccgctactgtaatggtctgctgttatggtgtgatgatggatgtgatgctggtatattgttgtggctgaataaaagtggcatgagttggagggttaagaaa

SEQ ID NO: 134 - DNA, 2121 bp, Sorghum bicolor
tccaaccccagcagcccaaccacataccattccgtttgcccggtcctcgcccgcgaccgccgtttgactccagaccccgccccctccaccaatcggtggcaagggttgcgtgaaatcgccggtctcgcgcgcccattttagacggacgctgaccgagacaaccccggcgatccccacacacacagacacagacacaggcggagaggccacagctcggcggcaagcggcagccagcccagaccagagcgaaaacccaccgtcccggcacccaattttgaaccgccgcgacgctcccaagtcccaaccaaatccacgatccctccgaccgaaccgaaatctccgcctccctgccctgcccggcctaggaggaaagaaacgcacgcacccacgtccccgcgccaaagggaaaccgtcgccgcgtcgagagaaactgaagcggagcagaggaggagaggccgaaggccaggagaaggattcccggcggcgatggagcggtaccatccctccgaggtgtacgagctcttcgtgcgccacatgaacaccccgagggtggtggtggacaacggcgtgtgcgcgacggcgacgctggtgcaggtgcacagcgcgaggaagcacggcgtgctgctcgaggcggtggcggctctgtccgaccacggcgtctgcgtccgcaaaggctacatctcctccgacgacggccgctggttcatggacgtcttccacgtcaccgacgcctcgggacgcaaggtggccgacgccgacgccctgctggcgcgcctcgagtcctcgctcaccgcggacgcattgccgccccgcacaccgcccgccgccgccgtggggaatggggctgggcccgcgatgcccaccctgctcgagctcgtcggtgccgaccgcccgggcctcctctccgaggtcttcgccgtgctgcacgacctccgctgcgacatcgccgacgccagggcgtggacgcacggcggccgcgtcgcggccctcgtgttcgtgcgcgacgtggagacgggcgcgcccatcgacgacgcggcgcgggtcaggcgcgtcgagtccaggctaaggcacgtcctccgcggcggcgcgctcggcgccaggatggtccgggaagacgccgcggccgtcaacatggaccggaggctccaccagcttctcaacgaggacggggaggcggagtgccgcgccgaccaggcggacgcgacggcggtcgccgtgcaggattggggggagagagggtactcggtggtcaccgtcagctgccgtgaccggcccaagctgctcttcgacgtcgtctgcaccttgacggacttggattacgtggtgtaccacggcacgttcgatacggacggcgatcacgcccagcaggagttctacatcaggcggttggacgggcggccaattagctcggcggccgagaggcggcgcgtgatccaatgcttgcaagcggccatcgagaggcgcgcatccgagggcgtgaggctggagctgcgcatcaccgaccgccgcgggctgctcgcctacgtcacgcgcgtgttccgggagaacagcctctcggtcacgcacgccgagatcaccaccaggggcgacaaggccatgaacgtgttccacgtcaccgacgtggccggccggcccgcggaccccaagaccatcgacgaggtgatccagaggatcggcacggagagcctccgggtggacgaggagcggtggccgcgcctgtgctcgacggagggcgacgcgggccgcggcggcggcggtgcggggatcttctcgctcgggagcctcgtgaagaagaacctggccagcctcggcctcataagatcctgctcgtgaggacgccatcaaggggggggcacgtgcttgctcgatgggatggatccttgtgtaaatatgggatggtgcgtgggttaggatgtaaatggagtaggatttttaatttgccgtttctaggttttagttgccacgtgtacatagtagcaagtggagatggaaggttttaaaagttgctggtcggcaacagcttggagcttaatggacctctctggtgggtcatgccacattgccatgccatttatctatcattctaacttttttacataaaaatagatggatggaagaaat

SEQ ID NO: 135 - DNA, 943 bp, Sorghum bicolor
tccgcccccatttcccgacccctataaaacacaaggctgcccgcggcgcccccatcatccattcccacagcaccaccaagagcaagagcaaacagcaacacaagccaaggcaaagagaaggaggagaagcaagcgcgaagcagtcgtctcgattcacatggccatggcggcagcggagggcaagagccggaggttcgcgctggcctgcggggtgctgagccagtacgtcaaggccgagcagcagatggcggccgccgcagcccctgccgctcgcgccccggccacgacgctgagcctcatgcccggcgcggacgtcggcgccgagcaggagccgaccccggccgccgccacgaggggcgaggagatggctgggcccgcctccacggcggcgccgctcaccatcttctacggcggcagggtggtggtgttcgaggacttccccgcggagaaggcggccgaggtcatgcgcctcgcagccggcggcgccgagcgcgcggcggtcccggccccggccccggctccggctccggctccgcgcgacgacctgcccatcgccaggaaggcgtcgctgcagcggttcctggccaagcgcaaggaccgcctcgtggagcgcgcgccctacacccgcccgtccccgtcccccgcggaggaggcggagaagacgaagcagccggcgtcctcctcctgggtcggtctcggcggcagcacgacggacgccgagcgcctcaccatcgcgctgtgatttggggagttcgcgtcgcgtcatgtggatcgattaattcggtgggttcctgccttcctcaggctggattggtttgtatggaaattgaaatgggttgtagagagatgctattcttcttgtttttttttttcttacgagagagtttcgctgctcttgtaagatttgatgattcgataatactagaaagaaagatggagattc

SEQ ID NO: 136 - DNA, 757 bp, Sorghum bicolor
ctcatctacgattacaggacgtggtagtaatggtgggtcggaagccgatgcgccgccgccgaagtgaccggcaaccgccgccgcaatccttcggcgccacggctcgcccgagttccccacgctcgctcgcctccactcctgcctccgctgccgcggtcgccgccgacctggacgagctgctgctgacggcgcccccgccgtccgcgtcggagccccggagcttctcgtacgcggtgaagcagcagtgctgggagaaggcggagcgggttcccggacgcgacccggagaggtggcgccgcgatgcgctcggcaacatcgtcttccgcaagctcgtggggtgccccggctgtctctgccacgactacgaccacatcgtcccctactccaagggcgggaagagcacattggagaattgccaggttttgcaggctacggtgaatcgatctaaaggcaacaagactgagatatccaaatctgagctcatacagaagagtgcatattgtagggtttcaggacgggacatggatcttgttgaactctctgcctatggaaatgtccggcgagggccagattcagggggctgcaaaatccaatgaagtagatatatctgaggaatcacgtcaatcagttcgaagtagttgcctgaacctgaatggaatgtttgtactatgtagcttaacacttcaagtgatttacccgagaaaagaaattgtgatatataatatatttgaatcaatgattgtctgcattcatactc

SEQ ID NO: 137 - DNA, 1816 bp, Sorghum bicolor
gaacaattggcgagcggccgcagccgcgtgacaatgagagaggggaggaacaactcatcagggcggtgccgtcattcgggatgacgacaagcccacaagcagtgagagcggagcgatctttgcagacactgaaaccatttgcgccgcgcttgtgacagcaatgctgcgcaagtcgggcactgagcgccggcagccggcgttatggcggcgatgccgcagcctccggcagatcaagcaggtccacgcgctcatggtcctccggggcttcctctcggacccctcggcgctccgcgagctcatctttgcctcctctgtcggcgtccggggcggcaccgcgcacgcccgcctcgtgttcgaccgaatcccgcaccccgaccggttcatgtacaacaccctcatccgcggcgccgcgcacagttacgcgccccgggacgccgtctccatctacgcgcgcatggcccggcacagcgccggctgcggcggtggcgtgaggccggacaagcgcaccttcccgttcgtgctccgcgcctgcgccgccatgggcgcgagcgaaaccggggcgcaggtccacgcgcacgtcgtcaaggctgggtgcgagtcggacgctttcgtcaggaacgcgctcatcggcatgcacgctacctgcggggacctaggtgccgcggctgcgctgttcgacggcgaagcgcgcgaggacgccgtggcgtggtcggcgatgatctccggcttcgcgaggagaggggacattggtgccgcccgggagctgttcgacgagagccctgtgaaggacctcgtgtcttggaatgtgatgatcacggcatatgcgaagctgggagatatggccccggcgagggagctcttcgacggggctcctgatcgtgatgttgtgtcgtggaacgccatgatctctgggtacgtgaggtgcggctcgcacaagcaagcaatggagctctttgagcagatgcaggccatgggagaaaagccggatactgtcacaatgctcagcttattgtcagcctgtgcggactccggtgatatggacgctggccgcagactgcacaggtttctgtcagggaggttttctagaattggtcctagcactgttcttggaaacgcgctgatcgacatgtatgcaaagtgtgggagcatgacgagtgcactagaggtgttctggttgatgcaagataagaatgtctcgacttggaactcgatcataggaggattagcattgcatggacatgtcacagaggccatagatgtgttccagaagatgctgcaggggaatgtcaagccagatgagatcacctttgttgctgtccttgttgcgtgcagccatggcggaatggttgacaaggggcatgagtacttcaacttgatgcaacaaagatacatgattgagcccaatgtcaaacactacggttgcatggttgacatgctgagtcgtgctgggctgctcaaagaagcgtttgaattcataggcacaatgaagatcgagcctaatcctgtcatatggaggacccttcttggggcttgtaggatccatggtgagctcgaactggctgagcatgcgaatcaggaacttctgaaggcaaggagtgatgcaagtggggattttgtgcttctgtcgaatatttatgcttcagttggagaatggctggggtcagagaatatgagaaagttgatggacgacagtggtgtcaacaaggaggcaggctgtgcagttgtagacggcagttcaaaggatgtaattgactaatacaatcttgtagactgttctaattgcattctgtatttaaaaagtttttcatctgtctat

SEQ ID NO: 138 - DNA, 1285 bp, Sorghum bicolor
tctctgggacccttggcaactcgaactcaagagtcacagcacgcgcgtgctcgcctcacttcacttggcccggctgtctccacgccacgctccccacatcccctttcccctcctctccactctccagtaggtagagtggcaagaaggatggtggcgacgatggcgagctcgctgctgctccggccgcgcgcggtcctgccacaccatccttctagttctagctccagccgccggccattgccagccccgcgtgtacagctgcaaccgatcatccagcagaaaccgggcctcgcggcgagaagcgacggcgagcggaggcggccggccgggacgcggctctactcgctggcgccctaccctctgctgctcgccgcgctgctgccgggagctgagccggtgacggccgtgttcgcgccgttcgtggagctggtgaagacgtgggacctccccggctggctcgtgcactggggccaccccggcaacatggctgtggtgctcttcgcaatgggtggctacgggacatacctgggcttcaggatcaaactgtcagacgatattgaagagaaggccaaggccaaagatctccacccaaaactcctcgcagggatgttctttttcttcgccctcggcgcgaccggtgggatcacagctcttcttacctcagataaacccatctttgaaagtcctcatgccgtgactggagtcatcggccttgcacttctgaccgttcagtctatcctgccaaaattgttcgagggaaatccagggcttaggactacacatggtctgctcggcagtggcatcatgactctgtttctaatccatgcggcactaggcctgcagcttgggatcagtttctaacttgtggctaccatatctcggggtttgcttctttctgattcttttcagagattttaagtcactcttagtattatcacacgaagcatccccttataaatcaaaataatgtaagagaaaggaaatttttgttttccttgtctttgttggcacctgcagtcaatgttatgataatctgatatggcaaatttgtgataggccaatagaatatccatctggagacaaccaaacatggatacatgtctgttacctaaacgaataacagaatcagacaaaaagaagagaaaagagcaagaacatgttgtaatcctaaaagcagcaagcaaaatactgctaatgaccaatttttttcatgtcaccattctaaagaatcagacagtcgagttctagtgtgtaaatgacagaaaattttgttgcgtctctcaat

SEQ ID NO: 139 - DNA, 1850 bp, Sorghum bicolor
cgaccacgacacggacccgagccatcacagaaagcaagcagccatgccactgcacgccacgagccccgccggcgtgctcgcgtacgccgccctcgcgctcgcggcgctgcggctgctgctgtcctacaagtcggcgctctacgcgctgcgccgcctgtggcggtgcgccgacgagtgggcgcaggcgtaccagtaccacgaggtgccgcgcttcgccggggctgggtgcgacggcgccgagaacccgctgttccgcaaggccgccgcttacgtggcggcgctgccgtcgctggaggacgcggacgccgcgtgcgtggtgtcctcggcgtcccggaccaacggcgggctctccctgcagctcggcccgggccacaccgcgcgggacgcgttcctcggtgcgcgcctgtcgtggaccagcgcgggcggcggacccgagcgcctggtgctgcgggtgcgccgccacgaccgctcccgcgtgctaagaccttacctgcagcacgtggagtccgtggccgacgagatggagcagcgccgccgcgagctgcggctcttcgccaacgccggcaccgacgcggacacaggcgcgccgcgctgggcgtcggcgcccttcacccacccggccacgctcgacgacgtagccatggacccggacctcaaggcccgcgtccgcgccgacctcgagagcttcctcaagggccgcgcctactaccaccgcctcggccgcgtctggcgccggagctacctcctctacggcccgccgggcaccggcaagtccacgttcgcggcggccatggccaggttcctgggctacgacgtctacgacgtcgacctgtcccgcgccgtcgcctccggcgacgacctccgcgcgctgctcctgcacaccaccccgcgctcgctcgtcctcgtcgaggacctggaccggtacctgcagggcgggggcggggacggggaggcacgcgcggccagggtgctgagcttcatggacggcgtcgcgtcgtgctgcggcgaggagcgcgtcatggtgttcaccatgcgcgggggcaaggacgccgtcgacgccgcggtgctgcgccccggccggctggacgtgcacatccagttcacgctctgcgacttcgaggcgttcaaggcgctggccagcaactaccttgggctcaaggaccacaagctgtacccgcaggtggaagaggggttccacgccgccggcgcccgcctcagccccgccgagctcggcgagatcatgctggccaaccgcgcgtccccgagccgcgcgctccgcagcgtgatcaccaagctccagcacgtcgcgtccgggggcggcgcggcgccgcggtacccgtcgcacaggcggaacacgagctggtccggcggcgggcaccagtgggaggaccaggcccagtcggcgcgcgccagcgcggactccgcgctggccgacgacgagacggccgccggggccccgccgacgtgcggggtgttcggcaaggaggcgccgatgagggagttcaagaagctgtacgggctgatcaagatcaggagccggagggaggggtcgggcgtcgtgccacaggaaggcgacgcgcacgggccgccgacgccgggcaaccacgacagggaccggtgaacgttgtggatggtagaattgtagtggccagcaaaaagaaagcttttttatttcctttttttcttgttattattacagtttgttgttacactactctaggtgttagtgactggaaggaacaactagaattggaggaagataacaacaatggaggattgtgagtgatgtacatgagaggcattcttgtgtggtctcaatctctagaaagcaaccaatttgcactgcgtca

SEQ ID NO: 140 - DNA, 2241 bp, Sorghum bicolor
atcgcgaagaagaaaatcgaaaacacacccagccgccgtgccagcctttcctcttccccttccccccccttccggtcttcgtctccgattccgcccgccattgccgcctcccatccgcattgccacgcctcgcatcaccgattcgtcgtcgtcgtcgcaggcattgcgacctgcctgcctgccgccgtgagcgatggacccgtgcccgttcgtgcgggtgctggtcggcaacctggcgctaaagatgccggcgtcaacaaccgcgccacgcagcaccgccgcgtccggctccggggtgcacccgaccacggcgccatgctactgccgtatccggctcaacaagctcccctaccagacggcctcggcgccgctgctgccacccaccgaggaaggcccggcgtcgtgcacgggcgccttcgccgccgcgttccacgtctccaaggccgacctggaccgcgccgccgccaagcccgcgctcctcctcggcgcccgcctccgccgccgcaccgcgcgcctcaaggtcgccgtctacgccggccgcggcggcggcgcgtcctgcggcggaggcggaggcggggtcaactccggcaggctgatcgggaagctcgtcgtcccgcttgacctcggtgctgctatggcgaagcccgtcgtcttccacagcggatgggtcgccatcggcaagcgccgctccggcgggcgtggcaagaccgcggcgagggcgcagcttaacctcaccgtccgtgctgagccggacccgaggttcgtcttcgagttcgacggcgagcctgagtgtagcccgcaggtgcttcaggtgaaggggagcatgaagcagcccatgttcacgtgcaagttctcctgccgcagcaacagcgacctccgctcgcggtccgtgcagtctgatccgggcaccgcggggccgcgcaactggctggccaagttcggttccgaccgggagcgggcggggaaggagcggaaggggtggtcagtgacggtgcacgacctctcaggctcaccggtggcactcgcatcaatggtgacgccgttcgtagcgtcccgagggacagaccgcgtgagccgctccaacccaggcgggtggctgatcctccgcccggtcgacgggacctggacaccatggggccgtctggagtgctggcgcgagcgctccggcagcggcggagggggggacaccctggggtaccgcttcgagctagtcccgggccacacgaacgcgggcgtgtgcgtggcggagtcaggcctcccggcgtcccgcggcgggcggttcgccatcgacctgacggcggcgcagccgttcgggtcgcccgggtgcagcccgcgtgggagcggcgacttgggccactaccacggcggcggggtgtggccgttcggcacgttcaggggcttcgtgatgtcggcggctgtgcagggggaaggacggtgcagcaggccgacggtggaggtcggcgtgggccacgtcgggtgcgctgaggatgccgccgcgttcgtggctctggcggccgctgttgacctcagcatggacgcgtgccggctcttctcgtgtaagcttcgccgggagctgtcggcgtctcgcgctgagctggtccggtgacccctcgggcattggagggagtggaagctaagtgtggaggactggagggaggggcttgccggtctgcgggagggagagagagagagagtgtgtgtgatgtcgtctggtcgcaaagttttggggaggcggtgatcggacgagcttgttttttgggctgttttggtcgattgtggcttgcctgtaatttttcggtgagtagtgatgagtgttgttggtcttctaggtgctttttaaagtctagaagaagcaatgaaactggggtgagtggtgggtgtttttggattcccagtgttcttttttttttgtttgtttggccgaggagaatgaactgttgtgctcctcgtcgtgctggctaccgaagtggtagctactccagagcaaggaaagtttgaaggtgaattggaattgatgaatcgatggagggaagaagagatcttcttgtcatcctgtcacgctatctccaacggcatacccatttgggaaccaaactcaaaaatgggtatccaacacaatacctatagcctccaacagagtacccatacagaagacccactttgggtatcaggagagccataatctaaatttgggtatcctctcttttcgagacctattttgcagagagtgttgtcttttag

SEQ ID NO: 141 - DNA, 1068 bp, Sorghum bicolor
gcaatgccaaatctagagggctgtttcgagggggagaaatcaggactcgatcgcgggcgatgggggccggtgaccagggcacgtcgtcggagggggttgacatcctgaagaaccccacggcggaggagccccaggcgccagccgggaccaggaagaaggggaaggaggcgagcgcgccggagggcggtgaccttggactcaagctgaaggaagcgagcacgttgggcttgggcggtaagatcctgaagaagaggaaggaggcgatggcggcgttggatatcatgctgccgacgaagcccgcggcgaggaaggcgcagccggccggggtcgagaagaagaggaagaaggtggtcaggaagaagctgccgcaggatgtcatcgactcaattgtagcaaagccgtgtaagattgtgtatgagctctccgatgaagaccttgccgacaaatcccagcaattccgcgaagcctataggagagcaatgttagtccatgagaaggtccgcagctacgagcaggccctcatggagcagtacagagccacgggctccgtggaggatgaaattgaggtcaccgatgatgaggacgaggggacgggagaaaatgtcactggtgatgaggagacgtcagcgaacaaggtcacgggctctgtggaggatgaaattgaggtcaccgatgacgaggacgagaggacgggagaaaatgttactggtgatgaggagacatcacacatcagtgaacaaggtcaccggtgactaggaggagacggtggagaataagcccagaagttgccagaagttgcccgtggttatccaagatccagctaggttttgagtactattttgtctgtgatccagctaccctaagttatagtattgagtttgtgttatccagataccctaagttggagcagtatcatgtctgtgtgatcctattaagtgctcattattgtgttgtcaacccttttttgtcaactggtgattcctatatctatgttagttattatcacatcttgctgctggtgattctatgctattaattaaaccaacagtgttgcaattgtattcgatt

SEQ ID NO: 142 - DNA, 1898 bp, Sorghum bicolor
agcagggcggcggctggccttggtccagtggccgctgcaagcaaaggttcacagctagcatccgttccgagaaactctcctcgctcgtcggccggggaagaaggcgatcgtccatcatggaggcgtcgtcgtcgtcgtctctgtggggcggcctcaactccggcatcgtgctgagcctgctggccgtggcatggaccatgctatggcaggcgctgcagggcctccagctgcaccacttcttcgatcgccactcccgccgcctgtcgcgccgcctcgccgccatcctggacccggacctcacggtgaccatcgccgagtacaacggcgggcgcatgcgccgcagcgacgcgtacaaggaggccaaggcgtacctggagcgcgccacgcgggaggcccgcggcggcggcgccggcggcggggtgcgccacctcagggcggagcccgacaaggaccccgaccgcgtcctgctcagcatggacgacgacgaggagatcaccgacgagttccgcggcgccgtcgtcacgtggcgcgcctgcaccgcgccgcagcgcgaggacaccgggccggcgtacttctggcggggcggcgccggccagcgcgccgagcgcaggtcgtacaagctcctgttctccgagcgccaccgcgacctcgtcctgggtgagtacctcacccatgtccgacgcgaggggcgcgccgtcatggtcaagaaccgccagcgcaagctcttcaccaacatctccggcgacggctcctgggactccgacggtgtgtggagccacgtggtgttcgagcaccccaagacgttcgcgacgctggcgatggacccggcgaagaagaaggaggtgatggacgacctggacgcgttccggaacggcaaggactactacgcgcgcgtcggcaaggcgtggaagagagggtacctcctgtatggcccgccgggcaccggcaagtccaccatgatcgccgccatggccaaccacctcgactacgacgtgtacgacatcgagctcacgtccgtgcgcaccaacaccgacctccgtaagctcttcatcgagaccaccagcaagtccatcatcgtcatcgaggacatcgactgctcgctcgacctcaccggcaagcgcaagcggaagaagaagaagaaggaggaggaggaggaggagggcaagaaggacggtgacaaggagaaggaggacgacagcaacaaggcgggcagcagcaaggtgacgctctccggcgtgctcaacttcatcgacgggctgtggtcggcgtgcggcggcgagcgcatcatcgtgttcaccaccaaccacgtcgagaagctggacccggcgctgatccggcgcggccgcatggacaagcacatcgagatgtcctactgctgcgtggagtccttcaagttcctggccaaggtctacctcgacgtggacgaccacccgcgcttcgacgccgtggcggcgctgctgcgggaggtggacatgacgcccgccgacgtcgccgagaacatgacccccaaggcgcccggcgagaacgccgactcgtgcctcgccgcgctggtggaggcgctggagaaggccaaggtggacgccgcgctggcgaagaagaagaaggccaaggggaacaaggaggacgccggcgccgccgacgatgaggacgaggaggaggaggaggaggaggaggagtaggctggtgggtgttgacacttgttagttgctagctagagctacagatgtagctagtgagccggaggacctgatctgattgttgatctcctgagctgagaataatgcatgctaattaactagatgatgatttggtatctgagcttgctatgattattatgttgtcacagactgctattatattatacttcgaggctacttaattagagcctttttggatca

SEQ ID NO: 143 - DNA, 2175 bp, Sorghum bicolor
cactccgcacctcccacctcacaagtcacaccctcctcctcaccgcaaggctcaactgagccgaccccacccgtccggtcggcgtgcccgcctcccgttggcccgcgccgcgcaccacatcacaccgctacatacaaatactaatcggagccaccccggcgcccaacgacttgccagatcccgtgtgccgcaccggccgagcccacaccccaaccacacgaaccaacgttccccccgggcccccgcgaggaaaaccatgtgccgagcccggccgcccgccatgttcccacgcgccaggcgccactaaatcagcagcgcctggccgcccggagctccccccagtagcggcagcaacaaagcaggcagcagccagagccagcagtaacagtaagcagcagaaaccatggcgagatcagggcgggaaggggaggaacggaagctggtgctgggcaagtacgagctgggccgcctgctggggcagggcaccttcgccaaggtctactacgcgcgggacctgagctcctccggcgccgccggtggtacgggcagcggcggcagcagcagcagcagcagcgtggccatcaaggtgatcgacaaggcgcggctgcggcgcacggaggggatggtggagcagctgcggcgtgagatctccatcatgcggatggtgcggcaccccaacgtggtgggcatccgggaggtgctcgccagccgctcccgcgtcttcgtcgtcatggagtacgcgcgcggcggggagctcttcgccaaggtcgcccggggccgcctcaccgaggaccacgcccgccgctacttccagcagctcgtcgccgccgtcggcttctgccaccgccgcggcgtcgcgcaccgggacctcaagcccgagaacctgctgctggacgaggaaggccggctcaaggtcaccgacttcgggctcgccgcgctccccgagcagctgcgccacgacggcctcctccacacgcagtgcggcaccccggcgtacgtcgcccccgaggtgctccggaagcgcggctacgacggcgcccgcgccgacctctggtcctgcggcgtcgtcctctacgtcctgctctgcgggttcctcccgttccagcacgacaactacgtcaagatgtaccagaagatcttcaaggcagagtaccaggtgccgccctgggtctccggcgacgcgcgacgcctcatcgcgcgcctgctcgtcgtcgaccccgcgaagcgcgcctccatcgcggagatcatgtgcacgccgtggttcaggaagggcttcgtgccgccagtcctttcaccgccggtaacgcccccgaagaaacggctggacgaggaccacgacgccgccggcgacctcttcgacaccgacgacgacgacaacagcagcagctgcagcaactctggcgccaccgccacctcgcctcggtcctgcaacgcgttccagctcatctcctccatgtcctccgggttcgacctgtcggggctgttcgagaacgagcagaaggccgcgaccgtgttcacggcccgcgcggcggcggccaccgtggtggagaagctggagtccgtagcgcgcaccctggggttcgagatcaccagggggaaggagagcgggaaggtgaggatggaggccaaggccgagggcacaaacgggcggctcgcggtcaccgccgaggtgctcgaggtggccgtggacgtggccgtcgtcgagttcgcgcacgacgccggggacgcgctggacttcaacaagttctgcgcggtggacgtccgcccggggctcgcggagatcgtctgggcgtggcagggcgacagcccgcccgcgccggccgccgccgtcgggaccgcgtgaacaagaacaaacggccccttcgtcctgtccgtgatgtaaaaattgtagcgactttgcgtaggagttacaccagcttcatatagcatgtaagtcaagttttcgttgttgcttcgagacagccatggctagttttgttatgcgtcatgtgttgtacaggaagagaacaggtgcacaaaattaaagagaggtgttttgtcgacacgagtgtcgaatcgaggcgctgagtgctccatcggcttgcaaagttttgtagtgaatgtaatctgtattttgtggagaggtgtacatacatacaaaattttggtcatgatcaaatttagttttggtcccca

SEQ ID NO: 144 - DNA, 3413 bp, Sorghum bicolor
cgagcaaagccaaaccaaactagctcagctcgactgctccgccccgcttcgttgccaacttccgctccaagcgtcgcggtcgccaagtctcatcggcgagcccggtggctgtgctgccgccgcgatggattcgaggccccgcgagactgacgcccccggcgacccggccaacggcgccgcccctccgcaggccgcggcggtgacgtccgcgaccgcgaccggggacgtcgagatcatcaggccccgcaacgacaagcgtgggtaccgccgcgtcgtgctccccaactcgctcgagtgcctgctcatcagcgaccccgacaccgataaggcggcggcgtcaatgaatgtttcggtggggtacttctgcgaccccgatgggctggaggggctcgcacacttcctcgagcatatgcttttctatgccagtgaaaaatatccagaagaagacagttactcaaagtacattgcagagcatggtggttcaaccaatgctttcacatcatctgaacacacaaacttctatttcgatgtgaacagtgatagcctgcatgatgctttagataggtttgcacaattttttatcaagccattgatgtctccagatgctacacttagggaaataaaagctgttgactctgaaaatcagaaaaacctcttgtcagatccttggcgaatgagtcagcttcagaagcatctttgtgcagagaatcatccttatcataagttcagcactggaaattggaatactcttgaagttaaagcaaaggagaaaggattggacacaaggcttgagcttattaaattttatgattcacactactcagccaacttgatgcaactcgttgtgtatggaaaagatagtcttgataacctgcagaaccttgttgaaaataagttctgcgatattagagatgttgggaggaagccattttcatttcctggtcatccatgtacacgtgaacatctccagatccttgtcaaagcagttcccattaaacaagggcacactttgagaatcctatttccaatcactcccaatattcggcgttacaaagaaggcccttgcaagtacattagccatctgattggtcatgaaggagaaggatctcttttttacatacttaagaagttgggatgggctataagtttggaagctggcgaaggggattggagtcatgatttttctttcttctccgttgttattcagcttacagatgtaggccaggaacacatggaggatactgttggactattgttcagatatataaagttgctgcagacctctggaactcctaagtggatatttgatgagcttcaagctatctgtgagacaggatttcactatcgagacaagagcccccctatcaattatgttgtaaatatttcttcaaacatgcagattttcccaccagaagattggttgattgcatcatctgtgccatcaaagttttcaccagatgctattcagaatattttaaatgaattgactcctgagactgtaagaatattctgggaatcaaaaaagtttgaagggaaaacaaacttagcagagccatggtatggtacatcatattctgttgaagctgtccctccatcaatcatacagaattgggtagataaagcccctaaggaagatctagacctgccaaaacgtaacatctttattccaaatgatctttcattgaaatgtgtagaggaaaaggcaagttttcctgccatgctgaggaagacatcattttcgagactctggtacaagcccgatacaatgtttttcacacccaaggcttatatcaagatggattttcactgtccactgtcccaaagctcacctgagtcagcagttcttactgatgtattcacgaggttgcttatggattatttgaatgattatgcttatgacgcgcaagttgctggcctctattatgctgttaagccaaatgacactggttttcaggtaactatggttggcttcaatgacaaaatgagaacccttttggagactgttattggcaaaattgcagaatttgaagttaaggctgaccgtttttctgtgataaaggaagctatgacaaaggagtatgaaaatttcaagtttcggcagccataccagcaagtcttatattattgttctctgatactggaggaccaagcatggccatgggatgaggaattttctgcactttcccatctcgaagctagtgatctgggaatttttttgccccgtttgctatcaaaaaccttcatcgagtgttattttgcaggtaatattgaagccaatgaagcaaaaaatatcgttcaccatcttgaagatgtcttattcaatgcacctattagtgcttgcaagccactatccccatcacagcatcttgccaagaggattgtaaagcttgaaaagggtttgagatactattatccagcaatgtgctcaaatcaccaagatgaaaattctgctcttctgcactatattcagactcatcaggataatgtcaagcaaaatgttctacttcaactacttgctcttgttggcaagcagccagcttttcatcaattgcgatcagttgagcaacttggctacatagcgcttcttaggcaaagaaatgattcaggtgttcgtgggttgcaatttataatccagtcaactgttaaggatcctgccaatctggatgccagagttgtaaattttctcaacatgtttgaaggcactctctacaatatgtctgatacagagttcaagagtaatgtaagtgctcttattgatatgaaactggagaaatacaaaaatatacgcgaggaatcagctttcttctggggagagatttctgaaggaaccctcaaattcgatagaaaacaagaagaggttgctgcactgagggagctcaagaaggaagagttgatagacttcttcaatgatcatgtgaaggttaatgcaccacaaaagaagattcttagtatacaagtgtacggtggtctccattctgcggagtacgaaacaatagtgcaaaatgctccgccgccgcagtcgtgtgagataactgatatttacagcttcaggagatcgaggcctttatatggatcattcaggggaggtgttggtcagatgaagttatagttcaacattttctcatctttctgtaaaattctgaaaaaaagaataatatttttgttcaactgcttttgttggactaggctggcctgcatctacgttcatagttcatttaatcgaggacaccatattagggcatttacctgtgtttcttttttcactatgatcattaaaatattatgatattatgagatttcgcattgcttggtaaagacaaatatctagtcatgtctggttggtctgagatacaacaaatctatatctattattagtattagtataatattaaagagctaacatttcagctcaa

SEQ ID NO: 145 - DNA, 1118 bp, Sorghum bicolor
atccatcagtcatcacacagagtgcgccatggcgtacaggacgctggaggtgactctcctgtcggccaaggacctgaagagggtgaacctgatctcgcgcatggaggtgtacgccgtggtgaccatctccggcgaccctctgacgcggcagtgcacccagccggacccctacggcgggcgccacccgtgctggaacacctcgttccggttcaacgtcccgcccagcgccgcgacggccaccggctgcctccacgtgctcctccgcaccgagcgcgccctgggcgaccgcgacgtcggcgaggtcatcgtgcccctggccgacatcctcgccggtggcggcgccgcgtccgaccccgggtcccggccgccgcagctcgcgtcgtaccaggtccgcaaggtgcaccgctgcgagccgcgcggcgtgctcaacgtgtcctaccgcctcggccccatcgtcgccccgcaggccagagccgtcgacgaggccgccggcggcgccggtgccttcgtcgggtatccggtgccgcggcagttctacgcgccgtcgtatgcctatctgccctcgccgctgtccctggcgccgccgccgcctccggcgcaagctgccggtcgcgacgcccagctgcacccacctccgcagtacagcttgcctgctgctacttattcgcaggcttatccacagcagccggctgctaattatccacagcagccggctgccgggcgcgctgctctgccggcgccggcgagcggggagagcaacggcaagctggacttcggggtgggcctcggcgcggggctggtcagcggcgcgatcggcgggatgctggtcgccggcgacgtgatgatgtctgacgcggcggcctacaattccgggtaccgcgctggactggccgacggcggcgcggcggcggtgtacaagaattcttatcgcgttcacgacaaagtcgaagcaaaacgggcggcggtgtgactcacttgaatcgatgcatactgtgtgattgtcattagtctcgtcttgttaacaacccataatagtacttgccgtgtgtatatggaatatataattacgtatatatcataattaataatataagataagagaaattttacgaccctcg

SEQ ID NO: 146 - DNA, 1096 bp, Sorghum bicolor
attttattctctccccttgccattggcaggcccagtttctttgtcaccgtcctcggaggggaaggagcaatggcagcagcagcagcctccgtgtggctgcagctgcaggtccctccccatcgtctccacagtcccccggtgctctccctaccaagcaaccattcttcctcacatgcatgccctccagtatacaaatacaagaaacatgcggcgccagggagaggaaaccttcttctctgcagggcctctggcgcctcctcctcctctgtggtgaccaaggagcaggagggagcggccagcgatccttcgtcagaggagggatattctgagcctcaaatctatagttacaaggatgaccccaacttcaggggctgcaagggctgcggcagagacgagcttgagaggggttgcaatggcgaagggcggatccagggcggcatagctgccgtcccgggcttcggctggtggcccatcaaggcgtaccggccgtgccctggcttcgtcgcgtccggcggccgctatcggcgccagggccaaagcatggacgacgttgcatccggcaggggaaagaagaaaccctctcccgccaaaaagaagagcgacaacaagtaatcccagcccaaggaactgcagtgttgacaatgctaggaagtgtgttgtgttattcaggccagggtgaccaatgagattcggctgtcactgtctgcatcagcagtagataatgtttcttaccagaaattcagaatctatccaagatgaaatctgggaatgtttgccattaccatggtggaattggggaagctcaagttattcagaaacaacagttttggtccacaatggcaatatatatgcactagttgggactggttgtagaaacatcaagaatgtagggtgcagtgttgttctcctaggctccatgtactgtttcgatttcaattgtaatagtagtagcttggaacatctgactggaccgcctgtattattgtcttcaagtagaactaggtgagatctgtgccaggcaaggcaacccatgtattctcgtccataacaagatataaacgtgcataattgagcatcctagaaatcagtatagctt

SEQ ID NO: 147 - DNA, 1672 bp, Sorghum bicolor
tagaagttggaagcattccagagcattgctcaaaaagctctcctcgtcgtccttatccgaacgaacgaggcggaagaacttcaggtgcgcgggccaatccgccgctgggaacaactccaccaccaccttgtgcagttgtgccgcccgaggcccgacgcttttttaaaaaacgcggcgccgagtgaccgagaatcccaagtccgcctccgccttcctccgcccacgcaagcgcacggcgcgcgcactcccacgaaaaaagaaaaaaaaggaaagtgaaggagaggaaaaaaaagcgagcaagtggtaatcgtagagcacgccccgactggggatgacgcgcgcccgccgccaatggccgcaccgccgcagacgatagcgctcgcggggctcatgctcctcaacttcgtcctcgccgtggcagcgctctgccttcacgtccttggccgacgcaggcctcggcagcaagtcccgtcgccgccgccgccgccgctcgagccggccgtcgcgggggaggaaggcggcggcgaggagaggccgcataaccagcggcggaggaggaacggcacgcaggaggaggaggaggaggggtcggcggcggcggcggcggcggatggtggtggccacggcgcggacggggaccgggacgccgccgcgaaggcggcggggaaggaggcgctgctcccccgccggccgcagttcccgctcgcctccgtggcaggcgcgctgcagcggcggatcaacgcgcggtacgacgacctcgcgcgggccagcgaggcgcagtgcctcaccatcgaacaggttaatgagtttgttaacagtctcatagatgctagaaacgagctgctgcagaggtatgagaatgtagaaagaagcttcaaaataaagaaggcaatgctatccaaccatcgaaactataggtcttcatatgaacggctctttgaacaggtacgcagattggaaaccgagcgtgataacctaaagaaagatgccgccatctacaactacattcaagagcgtcttcagaagtcagcagcatacaaaatgatcatggagctcggtactatggagatggaggcccaagagatatcattcgaggagctgctggctaaggagaaggaggacaccgccttctggcagcgcaacgggaagatgagatcattctcatccaagtaggacacaatgtccctacctgggctcactgacgatggcagatctcaacatcggtagtctaaacatgaaatcctagcctgctccttgagagcagctgctgtatgcggtatgcctgcataccgtttggtgtaacgctgcgctcgtctgacaagatgttgggcccctgtcactcaggagtctcctggcatgattctgggcagattaataaaagagctgtgtcgtgatagtcgtccctgcctccctggtatcacactattcctcactagggcttctggtgcccggcgagttctgcagttgacggctcactgctgctgtggccttgtgctcagcttggctgtgacgtgcggtgaactgaccattcgactgaacaagagacgtgtgcgtgtttggaattctggatacgtggcttcagcattcaggatctaatctgaatttgtcctgtataacaaggcgtaaattgcggtgatcgggtgcatcatcaagaaatttcaatatttgggat

SEQ ID NO: 148 - DNA, 889 bp, Sorghum bicolor
cacagccagcccccgcagaagagcagtgaggccagctgggagcagagcacgtacgggttccatagcgcacgcatccgatcgatccatatccatcactcgcatcgcatctgatcatcatcatcacgagagcaccatgggcggagggcacgacatgcacggccacaacggcggcgtgaagggctacgtgtccaacctcgtccacggcggcggtggcggcggccatggccacggctatggcggcggccatggcggctacggcggccatgggcatggatacggcggccatgggcagggctacggccacgcgtaccctcctccggccgccgccggcgcgtaccctcctccgcacggcggctacccgcccgccgccgcctaccccgcgcactcggcgcactacgggaacatgggatcgtaccacagcagccacagccatggcggcggccaccacggcggctacggcggcaagcacaagggcggcatgttcggcggcggcaagttcaggaagtggaagtgaagctgaaagccatcgatcgaaacaacacgacacctacctctacggctctacgtacgtatctgccagccggcagccgcgtacgtacgtacgtacgtatcctgccagccgtagctaagcatgcactgcacacagttcctataaataaattaaataaagtagtgcaagcaggcaggacgcgtcctacgtgtacgtacgttcaatacgagtgccagtagtcgttatttgtatacggaataaagtgagacgtgtgtttctggtcatgttcatgtaacgtgctcggcgtatgtaccaccatgcatgcagtgttgtataccagtcgtatatacagtacaagccgagtataatacagtactgctatgtgcatcattaccttga

SEQ ID NO: 149 - DNA, 1659 bp, Sorghum bicolor
ctgctttccattgctagctcctatagtcctaggctagctccgagcccccggcctcttccagttccagcaacacgcaacgctgcacctgcacttggcgtagccatgaaggagttctcgtacgaggaggtggaggcggcgacgggcggattcgcggcgaagaacctcgtgggcaagggcagccatggcagcgtgtatagggccaggctgaggggaggcggcggcaggatgacgaccgtcgtcgccgtcaagcggccgtcgcacgcgcagggggtggccaagctcgccaacgagatcgccgtgctctcggccgcgccgcgccacccgggggtcatcggcatcgtcggggtgtcgtcgtcgtcatcatcgccccagccgccgccgccgccggccgcgtcggggcctcggctccccccgctgctcgtcatggagttcatgcccaacgggtcgctgcacgacctgctgcaccggtcgccgaggccgcccccgtggccgcgccgcgtggagatcgcgctggacgtggcgcgcgccgtgcatgcgctgcacgccgccgcgccgcgcgtcatcatccaccgcgacgtcaagtccgccaacgtcctcctcggccgcgacggccgcgcccgcctcgcggacttcagcctcgccgtcagcgtcaaggcggtccacgcgccacctggagctgctggagcctgcggcggcggcgaggaggaggaggaggacgacgacgacgaggaggaggacgaagaaggcggctcgtcgtccgcggggccagctccggcgggcacgatcgggtacctggacccctgctacacggagcctggtcggctaggccccgcgagcgacgtgttcagcttcggcgtggtgctcctggagctcgtgagcgggcgcaaggtgatggacgtcaactcgtgcccgtcgtccatcgtgtcctgggcggctccgctgatcgccgcggggcgggcgcgggaggtgctcgacggcagggtggccgcgccgcccacggcgcgcgcgcaccgcgcgttggcccgcgtcctcgccgtggcggcgcggtgcgtgtcggagaccgtggagcggcggccggccatggacgaggtggtctccgagctgcgcggcgccctcgagagcgccgggtggcggtggcgccaccaccgccgcggcgacagcggcggaggcggcgtggtggagcgggtgtgcaggcgcgtcgcgtcgtgggggcagcgcgtgcggaggaggagcaagagggtggtgagggcgaccaaggtcgagtgcaccgagcactccgacagcggcggcgtcgcgaccggctcgtcgtcgtgcgcggctgctctgccgtcgcatcggagcaacaacggcatgatgagcggcgccggcgcggcgcactcaaacgaatcatccaaagcaaaagagaacgctttgaatcgattcgagagcgaattggatctcgttttcagtagttgattgatgataaaccttggatggatttggattgaggataaaccttagactgttactgtcacaagtagttacgagactaattaatctacggctgtgttttgctcgggtttgttcgttgttcacctcgtgcaagatatacacgtacgtcagtatcgagatatggattgacgtggcgatgatgtatatacacttgataattcacgtttg

SEQ ID NO: 150 - DNA, 2489 bp, Sorghum bicolor
agttttactcccccagctgctgatcccccaatctctcctcgctctctgctgtccgtctatccccgcgccgcgcgcggttgctgccttgctgctggtacgatctctgtcctgattcagagattctagccaggacttggtgaagcagtgcacgattcgattcggtctctcagctccgccgcgggggtcttctttttgcggtttcaggttctttgcttgtgggatgagtggaaggaaggacgcccggttgcagaaagagggagaaaacctcgtctgcacgtgttgctgatgatccgtcccgtgctgataatatacaagctcgactgaatcaactgtttgagcctgacagcaccatgggttccggcgatttgagctcggagatggagaggaaggttcttggcctgacgctgtgggtctggattgccatcggcgtggtcgcacttctcgtggcgatcctgctgatgatctgcatttgggtggcgtcccgccggaggaccaagagaaccatggacaccctgaggcagacgcagatccccatctactccaaggagatccccgtcgaccgggtcggcgggcgcagccttgcacagacaatgcacgagcgcgagaagccgagcttgccgccgccggacaagtacaacgcgagcagggagccggcaggggccacgctgggccacctggcactcagcaagtcctcggaccatgataacatgagccaggggagctcggtttgcaatgtcgaccgtgctggcagcgtgcactccggtgaggatgggagctctggacctcggaggaaaccaaattcgcctgcggctttcgtgtcagcgtcgcccttggttggccttccagagttctctcatcttggttggggtcactggtttactcagcgggaccttgagcttgctaccgaccgtttctctaaggagaatgtgcttggagagggtggttatggagttgtgtaccgtggacgtctagtgaatggaactgaagtcgcaatcaaaaagatctttaacaacatggggcaggcagaaaaagaattcagagtggaagttgaggctattggccatgtccgacataagaatttggttcgactgttgggatattgtgttgagggggtaaacaggatgctagtatatgagttcgtgaacaatggtaatttagagcagtggcttcatggagctatgcatcagcgtggtgttttcagctgggaaaatcgcatgaaggttgtaacaggcactgcaaaagcgcttgcttacctccatgaagctatagagccaaaagttgtacatcgtgatataaaatcaagcaacatattgattgatgatgaatttaatggcaaggtatctgactttggattggctaaactcttgggatctgacaaaagccacattactactagagtgatgggaacatttggatatgttgcacctgaatatgctaatactggaatgttaaatgaaaagagcgacgtttatagttttggtgttctcttgttggaaactgtgacaggaaggaatcctgttgactacagccgatcttccaatgaggtcaatcttgttgaatggctcaaaacaatggtggctaaccggagggcagaggaagtggctgatccaagcttagaggttagacccagtattagggctctcaagcgggctcttttggtggcactgaggtgtgttgatcctgactctgaaaagagacctaagatgggccaggttgttaggatgcttgagtcagaagaagttccataccgggaggatcggagaaatcgtagaagtcgcactggaagcatggatattgagtccattgcagagggttcaaactccgcggagtttggaaagaaggtagaaaggactggaagctcaacatctgaccgatctcaaccatgaggcctggaaatctaagctataccaggaactgtctcagaaacgatgttaatcaccaaggtgattgctgtcctgatattggatgctggtaggtaactgaggcgaggcaagcccaggtattgctgcctaagtattagacctagttttcaggtggagtagaagcattcttggttgaggaacctcctggtctcctgttatttgtataggttatatgttagcgcctgaggaattcctcttgggttggttgggtgtttaacaattgttcggttcttttatttcttgcgttgttgccttcttaaatcagtttcacttctccctgatgcaatgctgcatatgaggttgtggtcttagtgttactgcttgtcattgtttctcatgtttacctgcggcctgccctaccttatccgatgagttcgttgggggaaccaaccagagcctacatggtcgtttggcaacatgtgctgattctcgctgacttgatagatgttgataacttcttgtcagcttagggttctgtttggttggtgcctatgtttagcaagaaaaaagtttacgacgtgtggaacatggtgttaagaaatgtagcgaactattgttgtggcaatg

SEQ ID NO: 151 - DNA, 4259 bp, Sorghum bicolor
cccctcccacccgatcctctcttggatctcgccgcgcgctcgaaggcaagcggggccgcgatgcctgcggcggccgttcccggaggcggcggcgccgccgacgccgaggagctgttccgcaccaagcgcatcccggagattcgcgcggctgagggcgccacccgacgcgagatctccgccaaggaggaggagctccggcagctcgtcgggcgcagctaccgcgacctgctcgactccgcggactccatcctcctcatcaagcagtcttccgatgccatatcggacaacctcgcccgcatctccggctccttgtcgtcgctctcgccgccccctgaaccctctcccgccgtaagcgccgcctcgccgtccccgtctgctggagggcgcgcgaggctgtacgcgctcgccgcgcgcgccaagtacctggttgacacgccggagcacatctggggccggctcgacgagggcctgctcctggaggcggcggggcggtacctgcgagctcaggtcgtgcacgggcggctctcccgcgacgccgcggccgccgcgcggttcccgctcctcgcgcaccaggcgcagctcgtggaggcgttccggccgcagatcgcccagcgcgcgcgcgagcgcctcgccgaccgccgcctccctgtagcggcccacgccgacgcccttgcggccgtggccgcgatcgacgccccgtcgcttgccccggcccaggcgctcctcctgtttctcacctcgcgccgcgcttggatctctcaagccctagctgggctcgcctcggatctgtcatcctacacctctgtgctgtgcgatatctcgaggatcgtgcggatcacgcttggccacgttggacagttgttcgtgcctgcactcagtgatatgccgttgttcttcaagacggtgcttgagaagaccccgcctgagcagttgttcggtggcattccagaccctgatgatgaagcacggttgtggaaggagcacatgaatcagatcgaggctacaatggtgctgcttgagccagatgctgttgcacgggcctgtacggattggctcaaggaatgttgcactgaaatttttggtgtgattgctggtgagcaaaagttggttgatgccattgggagtggggagctgcttgggtcagtgcaaaggcttgtacgtgatgcactagatgggagggacggattggagggaagtttggagcagtggctgaagagcgtgtttgggtcagatattgagtcgccatgggatcagatccgtgggttaatcttgaaggacggcaaggatatttttgaggattggatggaggaagcatttgtgcggcggatgaaggacattgtgcattcagagcttgatggattgggtgcttgtgttaacgtgaaggaatcagttcatgctattggtgccaatgctgatccaaaggatgctggagatttccttgcatacctgcggaaatcttcaaagggcggtggtttctggttctcagagtctaagatcaagaaaggtggagttttggcacacttgaagccaattgctgatgaaaatgatttccatagctgcctaacatcgtattttgggccagaagttagtcggatcaggagtgcaattgacagcaaatgcaagaatatccttgatgatctgttaagctttgtggagtcacataattcagcaccaaggctgaaggaattggtgccatacctccaggagaaatgctacaggaccatctcgagagtattgaaagaattagaagctgagctcagaaagctctctgctttgttgggaaccaaaaaggagggtaacgacatacctgcagcttctattatagcggagaggtctctcttcattggtcgtctcttgtttgcgctgagataccattcaagtcatgtacccctaatactaggttccccaagggagtgggtaaaggaggctggtggtgcagcatttgccaggttatcatcacctacaccaagacattcgagggcatctttcgattctttggtatcttttacacccagaaggcgcacatttgacggtcccaggagtcctggaaggcaattctcggatagccccagaaaacaaactattgctgctgcagtgtctttgtttggagctgatgatagatccaatcctagacttgatgaactcaataagaccctgcagtcactttgcgtcatggctcataatgtatggatagcatgggtgtccactgaactatctcgcattctttcatatgatctcaacaaagatgattcactatcctcttcgactcctttgaggggctgggaagtcacagtaattaaacaagaggaatcaactgagggtcccttggagatgcaaatagctcttccgtcgatgccttcattgtacatcatatcctttctttatcaagcatgcttggagattcataaggttggagggcacatcctggacaggatcattttacataattttgcatgggagctactgcagaaggtcatcaatatttatgaaaaatttctttcatctgttgaatctgggaattctccggtttcagagaaaggaattctgcaaatactgctagacttgtgtttcattggtgatgtgctatcaggaggtaaaagttcttccgccaacactactgaaatgcagacaaaacaggattctttgccaagcaccgtcaccaagacttccttcaggagaaaacagtcacaattacaggcagactcagctgtcatagagcctataaacaagttaatcaacaggctctcacagagattggatcctatagactgggccacgtatgaaccttacctgtgggagaatgagaagcaatcttacaagcgttatgttgttctttttggttttttggtccaactgaatcacatgtacactggtactgtacaaaaattaccaacgaaatcaaatacagattcaaatatcatgagatgctctcaggttccaagattcaagtacctaccaatcagtgccccagctatatcatcaagatcacacaaatcatcactacagtcgccgtctagcgactccacatctaaaagtccttggaaatcctattcaaatggagatagatctactacaccagagtttgatgataatgcaagtcttgtcggtgctgctccattgcttaagtcatttgttactcaggtggggagcaaatttggggagaacacatcgagatgggggtccatgctctctgacgggcaggttggtaagctaagtgacatccttccgggaccagcagctgggtttttctcttctttcacatctggaactcgatatgattcatagtaatggcaccatgacccttgatctttagcccttactacacgtcatacggaaacccacatgtgtcatcaagagagcaaaagaactgttggcaagtgtaatatgcctttggaaatctgctgctcacagaatgatgccacattgctggtccagtgttgcttggcatatcctgccgcgcctctgcacatcttattgtgactagacagtgtcatggagaagctcaggaaattatgatggagaagacgagatttattctatatcggctgcccacatgttgaatgagcagttaaggaaatcaagtttggtttcagtgtgtttcctgcttgcaatttgacttggtacataggacagagcaagtgcaactcgccgctgatactagcctcactttttggtgtgactcatgttgtggatacgcggcacttgaagttgtgaaaagaattttgggggtccattctttctttcttatctttggctcgagttggctgatttttttcaccggaacagttctggaactgctggggttgtggttttatcatgtaggcaaagttgcaaaatgtgtacactggaaatataggaataatacagtctgtatcatgcgttcatgtccattcagcatgatgtcttcttcgtttgtctacatgtgtggtttgaagctgttaggtacagttgctgattttatacgtgcctaagcctaattagagtgcagagattatagcaaaacaagcatctaagcattaccatggaaaatttggctggcggctgtgattggttccccgtatctcccctatcctggctgtttggggttgtattgcatgtatgtatccaccgacgcctgtatgtatatgtatggcctgttggatgtacccagatccagaataaagagcttcactttcactggttggatgcactgcgtcccaagctaaacactgctaggcctgggctcaggggaaatgtcagtgcaaaagctcatatatgca

SEQ ID NO: 152 - DNA, 1584 bp, Sorghum bicolor
cagcccacgccgggaggcacggttgagagccacacacaccgagacgtcacgcgcggatggccgccgccgcgacgggggagacccgcggctgcggctgccacattgtggcagtgccgttcccgggccgcggccacgtcaacgccatgatgaacctgagccgcctcctcgccgcccggggcgcggcggtcaccttcgtcgtcaccgaggagtggctgggcctcatccgctcctcctccacccacgccgaggcggccggcatccgcatccgcaccatccccaacgtcatcccttccgagcacggccgcgccgccaaccactcgggcttcctcgacgccgtcgccacagagatggaggcgcccttcgagcgcctcctcgacgggctcgagggcccgccgcccgcggcgctcgtggcggacgcctacgttccctgggtcgtcggcgtcggtaaccggaggggtgtccccgtctggtcgctcttccccatgtccgccgcctttttctccgcctactaccacttcgaccgcctcccggcctggcttaccgactatgagcacgcgccggactccggtgagacgataggtaactctgatcagagacttggacactatatcgctcgacacgcttcaagttcaataaggttgtcagatcttgagcccttaattcacgacaagagaaaagtgaagcatatcctagcaaccatctctagcgttagaaatgctcagtctctccttttcaccaccatgtatgagcttgaggccagtgtcattgattcgctaaggtcagtactctcttgtccagtgtacccaatcggcccctgcgttccctacatgacgcttgaagaccagcataccatgtccaatggcgaagttgccggccaaagagactatttcacctggttggattctcaacctgtgaactcagttttatatgtctcccttggcagctttgtctcagtctcagcctctcagcttgaagagatcgcattgggcctagtagccagtcaggtcaagttcttctggattcttcgtgaacaatcccctcgggtgcaagaactcttggctggcatcaataatgggatgatactgccatggtgtgagcagcttaaggttttgtgccatcattcagttgggggcttcttgacccattgcggtatgaactcgacacttgaagccgtctttgctggtgtgcctatgcttgccttaccactgttttttgatcaaccgattgatggacgattaattgtggaagagtggaaggttggcctgaactttagggattgggctagcaaggatgatctgatcgggcgagaggatattgcacgggctgtgaagaagctgatgtcttctgatgaaactgagacgaaggctctgagggaacgtgctcttgagttgaaggaggcttctcgcagagcagtagacaagggtggatcttcatactgcaatctgagttcattgatggagacggtatgcactccaaaataattggaattgtatttggtatacgctgaaaccgatcttgtcactgtggtggtgttgtaacctgtaacctcaatgcttcaaatatcaattgcctagtgttttcttc

SEQ ID NO: 153 - DNA, 2790 bp, Sorghum bicolor
gttttcattcattccctctcgctttctgcactcccgcttcaccggccagttggccgatccctttcttcatcagttcccgttcggtattctcgttaatttctcgcttggattggaggctgcatgccctgcccctggctagctgcagcaatggcgactcgcggtggagggccggctgcggcagccgtccttctgcaactcctcggcttcctgtttctgctgcggggagttccgtcgcgagccgaggacgacaccgtcgccgccggacggccgctgtccggcgggcagagcctcgtgtccaagcgtggcaagttcaggctcggattcttccagccaggtgcaacagacaactcgacccagcgctggtacctgggcatctggtacaaccagatctcggtgcacaccacggtgtgggtggcaaaccgggtgacgcccatctccgacccggagtcctcgcagctttccatctccggcgacggcaacatggtcatcgtcgaccacagcagcaggtctaccgtcgtctggtcaaccaacgtgaccgccaccaactcatccacggtcggcgtcatcctcgacaacggcaacctcgtcctggcggacgcgtccaacacctccgccgtgctgtggcagagcttcgaccacttgggcgacacgtggctccccggcgggaagctgggccggaacaagctcacgggcgaggtgacgcacctcgtggcgtggaaggggtacaaggacccgacgccgagcctgttcgcgctggagctggacccgcgcggctccagccagtacctgctcaactggaacggcagcgagcagtactggagcagcggcaactggacggggacggcgttcgccgccgtgccggagatgacgcccaccggcgcgtcgccggtgtccgagtacaccttcggctacgtcgacggcgcgaacgagagctacttcatctacgacgtcaaggacgagtcggtggtgacgcggttccaggtggacgtgacggggcagatccagttcctgacgtgggtggcggccgcaaacgagtgggtgctcttctggtcggagcccaagcggcagtgcgacgtgtactcggtgtgcgggccgttcggcgtgtgcaccgagaacgcgctgccgtcctgcacctgcccccgggggttccggcagcgcgacctggcccagtggctgcaggacgaccacaccgccggctgcgccaggaacaccgccctgcagccttgcagcgccgccgccgctcgagacgggcagaagaagcacagccgcaggaacgatgataggttctacacgatgcccaacgtgaggctgccgagcaacgcgcagagcacggcggcggcgagtgctcacgactgcgagctcgcgtgcctccgtaactgttcttgcaccgcgtactcctacagcggcggcggcggctgctcgctgtggtatggggacctcatcaaccttcaggacacgacaagcagtggcactaccggaggcagcagcagcagcatctcgatccgcctcgctgcgtccgagttctctagcaacgggaacaccaagaaactgatcatcgggctcgtcgtcgggggtttcgtcaccgcggtcaccgccatcgttctggctacaacgttcattctaagaaaacgaaggatcaagtcgttgaggagggtcgaaggatccctggtggcattcacgtaccgcgacctgcagttggtgaccaagaacttctcagagaagctcggcggcggggccttcgggtccgtgttcaaaggggcgctgcccgacggaaccctcgtggcggtgaagaagctggaaggcgttcggcaaggggagaagcagttccgtgccgaggtgagcacgatcggcacgatccagcacgtgaacctgatcaggctgctcgggttctgctccgaggggtcgaaacggcgcctcctcgtctacgagcacatgccaaacggctctctagacaggcacctgttcggggccagcagccaaggccaaggtgtcctaagctgggacaccaggtaccagatcgccctgggagtcgcgagggggttggactacctgcacgagaaatgcagggactgcattatccactgcgacatcaagcccgagaacatcctcttggacgacgcgttcgtgcccagagtcgccgacttcgggctagccaagctcatgggccgcgacttcagccgcgtgctcaccacgatgcggggcacggtggggtacctggcgccggagtggatcgccggcacggccgtcactgccaaggcggacgtgttcagctacggcatgatgctgttcgagattgtctcgggccggaggaacgtcgggcagcgcgcagacggcacggtggacttcttcccgtccacggccgtcagcctgctcctcgacggcgacgtgaggagcgccgtggacagccagctcggcggcagcgcggacgtggcccaggtagagcgggcctgcaaggtggcgtgctggtgcgtgcaggaggacgagagcctgcggccaagcatggggatggtggtgcagattctggaggggctcgtcgacgtcaacgtcccgcccatcccgaggtcgctcaaggtgctcgccgatccgtccaagtacgccgtcgagttcttctcaggcttgccgtcgacctgagattgggccactgtctgttagcggcatcaaacttacagtagggcgtgcagtggtgtatatacggagtatgagctaatgagtttgccaagaacttactcgtgccacgagcccacgaaccttgtggtagaatagaacttcttcaggtagccaagaagattt

SEQ ID NO: 154 - DNA, 1923 bp, Sorghum bicolor
acccctaagcctacacttccgaattcaccaactcctccacgccgcgtcgagatcactcacgccttcgcttctacaactccaccactcagcccgcccgccggagcaatggggagcacggggcgcgacccggaggtgacccgcgccgacttccccgacggcttcgtcttcggcgtcgccacctccgcgtaccagattgagggagcgagaagggagggaggcaaaggagacagcatatgggatgtatttacagatgacaaagaacgtgtcttagacaaaagcaatgcagaaattgcagttgaccactaccatcgatacaaggaagacattgagctcatggcaagtctaggttttagcgcgtacagattttctatatcttgggcacgtatatttcctgatggcttgggggaaaaggtcaatgagcaaggagtcgccttctacaatgacctcatcaactttatgatttcgaaaggtattgagccttacgcaactctgtatcattgggatcttccaaacaatcttcaaaaaactctggggggctggatttctgacaagattgtggagtactttgcattgtatgcagaagcttgctttgcaaattttggagacagagtaaagcgttggataacaatcaatgagcctctccaaactgcaatcaatggttatggtattggaatatttgcacctggtggatgccaaggtgaaactgcaagatgttacttggctgcccatcaccaaatcttggctcatgctgctgctgttgatgtttatagaagaaaattcaaggctgcacaaggtggtgaagtaggcttcgttgtggactgtgaatgggcagagcctttttctgaaaaagcggaagaccaaattgctgcacaacggaggattgactttcaacttggatggtacctagatccgatatattttggtgattacccagaaagcatgcgtcaacgactgggcagtgatcttccaaccttctcagagaaagataaagaattcatcaggaacaaaattgattttattggactgaatcattatacttcgagactcattgctcatcaccaaaatccagatgatgtttatttctaccaagtgcaacaaatggagagaatagaaaaatggaatagtggtgaaaaaattggtgaaagggctgcatctgaatggcttttcatagttccttggggccttcgtaaagtacttaattatatagtgaagaaatacaataatccagtaatttatattactgagaatggcatggatgatgaagatgatcaatccgcaacacttgaccaggtcctaaatgacacgacaagagtcggttacttcaaaggatacctcaattcagttgcacaagccatcaaggacggagctgatatccgtgggtactttgcgtggtcattcctggacaactttgagtgggctatgggctacaccaagaggtttggtatagtttacgtcgattacaagaatgggctgtccaggcatcctaaagcatcggccctgtggttctcgcgcttcctgaagggcgaggctgccgaaaacaaacctgatacaaactgagcgaacagcccgcagcaagtacagaacattacatatacacacactacacgtctcttctgttgttgtatcttacagtgagcaccggtgtatgtatgtatgtacgtaatagtctcagatgtgcttcctgcctatacctagtctgtcattgatccaacactagctgaaatgtattctccgagaatcagagcctcagcaccaataagctttgaattcatgccaggcagcagtctggttacagatagctcacacttgtcttctgaacacccatgcattcggcattattacactgtactgtcactgttgtactattcacctgtaagtaaggctgtattggcattaccgattcagatattcgtttgtgttgca

SEQ ID NO: 155 - DNA, 3954 bp, Sorghum bicolor
cattcaattggcgccaacagtgggcgggtgggcggctgctacagcacggcggcctccataaattagctccccccgcgtcggccccttccgtccccctgtcgtctcgccccgtgtcgccaccgatcggcccgtcgtcgatcacgcggacgcccgccggagcatgcgcctcgcgggcctcgtccgccggagaagaaccatcatcatcatcagccgcagcgccagcgcccgggaggagatgtagctctagctccgcggcccgcgaggaaaaggaacggggaatgaccgttacggcacgcgggaggagcggcggcggggtcgggatggaggagaagtgcgacgcgcccgggttcggcttcctgggcctcgaccggatgcgcgtcctcctgccgccgctccgcctgccggagaagctgtcggccagcaggacgctgcggacgcacctcttcaccaactaccggatgcgcaaggtgcgggacagctccaggtggctcatcccgctctgggtcaccatctgggtcttcatcgcctccctcctctacctccggatgagctaccaggccgtcgacaagcgccgggagtcgctcgccatcatgtgcgacgaccgcgcgcgcatgctccaggaccagttgaacgtcagcatgaaccacctccaggcgctcgccatcctcgtctccaccttccaccactccaagacaccctccgccatcgaccagaaaacgttcgcgtggtacgcggagaggacggcgttcgagcggccgctcacgagcggggtcgcgtatggggtcaaggtcacgcacgccgagcgggagcagttcgagcgccagcagggatggagcatcaagaagatgtactcctccaaaaccaagaagcagtcgcagggacaagggaacggcgaggacgccgaggtgcgggagccggcggaggagtatgctcccgtaatcttcgcgcaggacgcctacaagcacgtcatctccttcgacttgctatccggcgccgatgaccgcgacaacgtgctccgagctagagaatctgggaagggtgttcttactgctcctttcaagttgctcaataatcgcctcggagtgatctccacctacgctgtgtacaagtatgagcttcccccaaatgccacgccacaggatcgcattcaggctgctataggctatttaggtggcatatttgacattgaagcgcttgttgataagtcgcttcaccagctcgcgggcaagcaatccatcatggtgaacgtgtatgatactactaatgagaaaccgatcagtatgtatggttcaaatgatacaggaagtggcatgtgccaggtcagcacactgaactttggtgatccgacgaggaagcatgagatgcactgcaggttcattcagagcccaccttggccttggctggcaataacgacatcaattggaatttttgtgattggtttactggttggatacatagtttatgctactgcaaaacggattgccagagttgaagatgactttcaggagatgagtttgctcaagaagcgcgcagaggatgcagatattgccaagtcacagttcttggctaccgtttctcatgagatcagaactccaatgaatggtgttctagggatgctccaaatgctcatggatactgatttggacacaacacaacaagactatgttagaaccgcacaagccagtggcaaagctttggtatctctcatcaatgaggttcttgatcaggcaaagatcgagtctggtaaacttgagcttgaggcggtaccattcgatcttagaacagtttgtgatgacattttgtctctcttctgtgggaaagctcaggagaaaggactggagttggcagtgtttgtttctgaccaagttccacaaacactaattggcgatccaggcagaataaggcaaatcattacaaatcttgttggaaactctataaaattcacagagaagggtcatatctacttgactgttcatgtcgttgaggagattatgcattgtttggaggttgagaccacaaataccttaagtaggtacccagtggcaaacaggaagcgcagttgggaaaactttcaactttttagtagggaactgaactcctccgagatgccttttgcacccggtgcatcagactcaataagcttgataatatcagttgaagatacgggtgttggaatcccgcccgatgctcagtcccgtgtcttcacccctttcatgcaagtaggtccatccattgctcgcatccatgggggcactggtattggattaagcatcagcaaatgcttggtcggcctcatgaagggagagattggatttgcaagtaaaccccaagtcggttctactttcaccttcactgcagtgcttacgagggcccactccagtggaaatgagaataaatcatcagagtttaaagagatcaatgcattggtggtagatcatagaccggtccgtgccaaggttactaagtaccatttgcagagactgggggttcacaccgaattgacaactgacctagatcagtatatttctaaaattaattgtggatcacagattgcaaagcttgtgctcattgacaaagaaacctggctggaggaatcccactctatgcctcatttggttactaaattgaggaacaaagatcagccagactctacaaagttatttcttttggagaaccctaaaagttctgtcaaaagcagtttgcatatattcagggaatataacttgaatgtaattatgaagccacttcgtgcaagcatgcttcaggtttccctacaaagagcattgggtgggatagataaactgcattgcaggaatggggtagttggcaattcaacacttggcagccttcttcacaagaaacgaatcatagtggttgatgacaacattgtaaatctcaaggttgctgcaggcgctctgaagaaatatggcgcagaagtaacttgtgctgatagtgggaagaaagcaatcacactgctgaaacctcctcacagatttgatgcttgtttcatggacatacagatgcccgaaatggatggatttgaagccacgagaaggattagagtgatggaaagagatctaaatgagcaaatagaacgtggagaagccccactggagtgcgcaggggtccggcagtggcgaactccaatattagccatgacagcagatgttattcaggcgacacatgaacaatgcttaaaatctgaaatggacggttatgtttccaagccattcgagggcgagcaattgtacagagaagtagctcgctttttcctaaatcaagaccaagttcagtaggtaggcttatatggagtgtaaaatagtggaggatatcggcaacggttcacctgtcgaggctgaaagaattttgtcagagatcttagttcttgagagtgggcatcaattcgcagagttaggggccctattaaaacactagaaatgctgggatgtggcctccagttaggtggaaacactttaggctggagatggaaccacccatgttcggttccttggtacacctgatcaagctgcaaaactaaatgggcagtgtcttgaaataaagatgcatgtgcagcaatttactcgacaatttgctgaggtcaaggcgtgtgaaaaacttcagctgcattcactaacagcagatgtcctctgccactataatatagagtagggagagaagttttccttcccccggaaggtacggctgtacatattaggtattggttgtttgtgcaggcatttttgtatgcatcatcttcggtctgtatgggtcgaagctgtaaattgtaaatgacacattcaaagatggaagttttgtttgacaaaacatcagctgccatcagcttgtcgtcctgagtttctctcctgctactggttctctcaaccagccaattattacactgaaaactgcctgttggtgtggctttatctgatgaaatagcttttgcctgatgtc

SEQ ID NO: 156 - DNA, 2015 bp, Sorghum bicolor
atcccaattcccatcatcatgccattgccattggcggcccagagcgctctcgtcgcggcagccgtcgccatagccacggccaccgtcctcctcctcgtcccatggacgccaacgccgcgggaccgcttcgccgacatggtgctggccaacgccaccatctacaccgccgaccccgcccgccccttcgccgacgccatggccgtccgcgacggccgcgtgctccgcgtcgggacctacgagtccgtcaaggagctcaacggccgccacacgcatgagctgagtctcagtgggaacgtggtactgccagggttcatcgactcccatgtccacttcatcgatggtggattccagctagcgagggtgccacttcgagggatcagaaacaaagatgacttcattggcagagtcgaggaagctgtcagagataaacatcctgggcagtggattttaggaggaggttggaacaatgatttttggggaggtgacctccctgctgctgcttggctggatgatatgtcacctgataatccagtctggctctctcgtatggatggtcatatgggagtagccaactcattagctatgaagattgctgggattgacaaaaacacagacgatccaattggtggaacaatcatgcgaacaaccggaggagagcctactggtcttctagttgatactgctatgaagcttatatttgatgtcattgaaaaagtttctaaccatgaaagaagagaggctcttcttagagcaagtaaacatgccctaatgaggggagtgactactgttgttgatgttggaagttacttccctgggacctcaacagagaaaacatggcaagattttgcagacatctatgaatgggctcactcaatggaaaaaatgattatgagagtatgcttattctttccaatgcccacatggtctcgtgtttctgatcttattgatgaacatggtcgatcactaagtcagtggatccatctaggtggtgttaaagcttttcttgatggttctctgggttcttcaagcgcattgttccatgagccttacgagggtgatcctggtaattatggtctgcaagtgacagatttggacagcctacttaatagaacactagaatctgataaatctggactccaggttgccatacatgcaattggggataaagctaatgacttgctactggatatgattgacaaggttgttgatttaaatggagtgaaggaccgtagattccggattgagcatgcccaacatctggctccaggtgcagcaaatcgctttggcaagcatggtatcattgcatccgtgcagccagatcatctattagatgacgccaactcagctggaaacaagattggggtggaacgggctgaacgaagctcctacacatttcgatcactgttagatggcggtgcacagctagcttttggctctgattggcctgtttcagacatcaaccctctacaagctatccgaaccgcaatgttccgtaagcctcctgggtgggaggtcccctggatccctgcagagcgcttgaccctagatgaatcactgaaagcgcatacgatgtctgctgcctacgcctgcttcttggaccacgccgtgggcagcctttctgaagggaaatacgcggattttgtggtgctgccctctacatcgtgggacgaattctccaacgatgtgccggggcaggtcctggcgacgtacgtgagcggcaggcaagcctatccatgaaccataatagatagcagttctaggaagatcacgttgtgtagggttattgctaccattctttggaaatcaatggctgcaatactgtaatcagcattctcgaagatacgatctgcaacattttttcagagagatttagttactactacaaaagaaaggttcacttggaagtaaggccttgtttagtttgtaaaaattttcaagatttcccgtcacatcgaatttttggtcgcatgcatggagcattaaatataaacaaaaataaaaactaactgcacagt

SEQ ID NO: 157 - DNA, 4818 bp, Sorghum bicolor
ctccgcataaataccgcgcgtctgccccgcgccgcggcactcagaaaaggaagaacacgcaaggaacaaagaagcgctcgcgagaaggaagggaagagagagagaggacgacgacggccttgggacctgcggaccgcatcgctcgccggtagctgacgtcactcggccccgtggatttttcaagctctggtggtggctcgtctgtctgatccgcgctctgctgctttttctccgcccgccgcactgtatcacagccataatacctgttcacaggtctaggcatttatcctaccagtacatatagaattatagatagactaatagtacctaatatgtatccagcaaaccactacatggatccataccactcgcactacagaaatcatgctccttacccatactatcctcctcctagatgggaaatcccatccggtcacccacgggcaatggactcatcttattattatcggccaccaagctgtggaacttggccatacaatcatgatatgcatcactcacatccttctgagctccattgttgctgcaaccaaacatatcctcctggttactacagtttcagacccccattccctcaagaacttccaccccctcatttatattatcatgggccatttccacagcatccaaatgcatggccttcttactttgtcccatcacatccctaccctgttgatcatacaccatatggttatgacaagttcaagggccattgttgtggatgtccaaatcatgtgtgccctggggctgagaagagcaatgtgaaaattgaggaagaaaggcctgatgtcaagcttgagagtgaacacaagaatgctgatagcggcagtataattcaacacccaaacagcaagtatcctttcatatggctaccaccaggcaatatgaaaggcaaggagaatggagagcattatgaattgtcacctcagattttcaatgaatgggctccattgagtagcaagaggttaggggatgtgaagcaacaagagcaagataatcagaaggggaaacaattccagtggccaatggtttggatgccagcaggatatgatgcgccgaagcaaaaagctaaagagatgaatgacacggaagggaccccaaaatccccaaagatttctgaagagtctcctcaatcacccaagatcaagatcattcccctgtcttggtttgagaatggtcatcatcatgatcagaaactggctgccaaaaatgactctggagaccacaacaaaagatcagcagtaaagaaccaacctgtgcttactaataatgaagatgaagatagcatgacactggaaggaaaccctaaaactacttcagctgtgcccaagagcataaatgatgagaagaaacctctaagggaaagctgcaagaccattccagttgtgccagagaaagagattaatgaaaagaaggccagtacttgcagaaccattccagtcatgaaaggaagtgatgagaagaagattggcatgaaggaaaagaaagaggcaaaggagacgaacagtgttgaaaaggtagaagagaacaggaaaacaaaacacagtgactcatcaatagctaagcattcaaaattgcccccagtatgcttacgtgtggatcccttgccaagaaagaaacctggaaatggttcttctaggtctcctagcccaccaacaaggaaggatgctgacagcgcaaaggacatgaagaacccgcagaaccagaacctggagcctaaacagtctggtacaagtaatcatatcgctgtgtcagaggtgaaagaaaagtcgccttatgaaatgaagaaggaaattgggtttagaaatgaaacagtacaagcttctgctgttgaacattcacaggatgaagaagctcccacaagtgaagatcaccagaatgtccaagctggtagcactatggtgggtactcaagaaaatacaggcacgaagagcatacagggaggtgctgtgcaagaaaatgttggtgcagggagcttgaatggatgtgacaaaagcaaaaatgaagatgggacagtgattgaaagtgaagctgcaaaagatgacaaaagcaaaaatgaagatgggacggtgattgaaagtgcaaaagatgacgccaggacatatagagttaatttgtcagaaccagatgctgcagttcgtattcagtctgcatacagagggtatgatgttcgaagatggcaacctttggataagctccggaagatcaggcatgtgcatgaacagatgcaaggtgtgaagaagcagcttcaatgccttgaagattcttgcaataagccaacacaaaaagagcaagtggccattggtgaaactatcatgaatttactcctgaagcttgacacaatccagggcttgcatccaaatgtaagggaagctaggaaatctgttgctcgagaactgatatgcttgcaggagaagcttgatactctatgcaaagcgccatttggggacttggatcacacaaatagtaatgatgatggtgagtctgagaggaccaagagcattatccaaactgcagctcctactgtaacaactgaagcttctgatagagagagagctgttgaaatgggtaaggtagaagaaccatcttcagtgagcatggagccatgcaacacagttccatctgaagtttcctgggaggtgaggccagatgcagacttcagtgagaggagtgaaaaacaagagtcatgtagccccacagtggacgaagcacatgaagaggggaaagctgaggaacagattgaatttcaggtagcatcatcaatggatatgacaagtgatgaagtttttatagaacatcccactgacaaccaggagcacggaattcgagaatcaaatgttaattcagtggaacaagtgactgaagaagagaaaccagcagcagcggatgaagtgaaagagtcgccattagtgaactccatggcaccattgtattatgcagcttcattagaggattcgagtgggctgaaacaatacacagcttcgacccatcagaatctctatgctgaatctcctgcatccactgaggacattaacataagtgctctgactgcatctgtggaaagtgaagtggcaactgagaaagatggcccagttgacagtcaggtgcatgaaactgcagctttagaaaatgtggaactgaaagatgatgtttcttgtgctgaaaatgagcataacaaatcgggcagccctgttcatttggaggatccactagtacctttgaaggatgtagaaaagcatgatctaactcccgcaaaggactttgtcgtatctaacacagaagatcaacaagaagccagggatatccgcttgcaggtacaagatgtggattccatggaagattcaggcaaagtaccagatggaaccatagaggcttcaaccgatgatgatttagaactgggtactgcagatgtagaaaagcatgatcaacctaacttgctggaaccaagattggagtctgtttctgccccagaattgtctgtcttggatgagtctgatgataaaatgcaatgtggtgtttctggcaaggatgaggtaccacatgtggatgagaaaaccgaaactactgttgacaaggtaaccggaggttctgcaaactgcgaggatcttctttgtgagtcatcaaggacggaacctgacattcaagagagtcacactagccttggagaagaggtagacgtcacaatcacaacaggtggaacagtcttccctgattcagttagttgtgatttatcatgtccacacgatggtggcatgacagtatacgagggatctgagacggtgtcatcagagaaccaaactgatgctcagaaagaaaacatccattcagatgtctctcagacagatgaatgcactaagactcagaaagtccctccagtaggcacacagggagaaaattctgctgaagattctgatgtgcaggtgtctgagatggacaaatgcaatgagatgccgaaggaagctccagcacatgcaacaggagcaaatcctgctgaagacgaagcttccctgaaagaagacatcactgtgcagacagacaacaagccttctgcctccccagctcctgaagatccaaaggtcagtgacaaggagaagctggcagaagaaaaccagaagctgaaagagcttcttcaaaagcttctcgcatccggcaatgatcagatgggggtcatcacagacctaagtgagaaggttaaggcgctcgagcggaagctggcacgcaagaagaggccaaaggtgagggtgcacaggccgtccgggcatgtgactgccaaagtccactgaaaggaaggataatcttaaggtttgaggttatgttgtatggatcccatgttacttcttgtgtccatgttgtatttgcatgtacagccatgttatggcactatgctttgttttggacaacacaaggtgtggcatgttctgtattttgtgtttgtgtataatgcatccgacttgatctagtgttttgtgggcaattgattggaacaaatgttaaaggatacaagcagtgttgtgcaaagctttcctagaggattttggcactggtgcagatatgaagaaagctccttcacggacgcagtgcctgttctactacatatagaggaaagtcggcatcggagtggcagctgggcttgttaggttctactgtgtacttgatcaacttgttttgcattttcttaggccttgtttagatgtgaaaaaaatttggatttcgctaccgtagcacttttgtttgtttgtggtaaatattatccaatcatagactaactaaggtcaaaagattcgtctcgcgatttacagt

SEQ ID NO: 158 - DNA, 3706 bp, Sorghum bicolor
agtgccgttatcaacacgcgcggaccatgaaaatgagccccccggctctcgccgccggcaccacctcactgctgtcgcctcccaccgctgccgtctctgcccaccccttccctcccacgaaccacaagcctcacagcgcccgcatccgcctctcctccgccgccgcggctacctccagctccaggtgggtcaacccgcgggcacccccgccccggcgcggcgcgggcaggagcggggctaaccagcggctgcaccacctcgtccacctcggcgacctggacgccgcgctcctccttgtggagtccatgcgggatcccgagcgacccgccgcggttccctgtacactcctcatcaagaagctttgcgcagcgggccgcctcgacgacgctgagcgtgtgctcggggcctccgagcgcgcgggcaccgccgatgccgtcacgcggaacaccctcgtcgcggggtactgccgcgcggggggtcgtctcgccgacgccgagcgtatgctggcctcccttgccttgtccggctccgccgatgtcgtcacctataacaccctcgtcgcgggttactgccgcgagggccgcctcaacgatgcccggcgcctcgttgccgacatgccgttcgcccccaactcgtacaccaatagcaccctgctcaagggcctgtgcagcaacaaggagtgggacgatgccgaggagctcctctccgagatgatccggagtggttgccccccaaatgatctcacgttcggtatgataatccattcgttatgccaaaatggattggctgaccgtgcaatgggagttcttgatcagatgtccaagtgcaggtgcacacggggcgtgattgtttacaatgaaatcatcagttgccttgcagagctggggcgtgttgaggaggctcttcatttattcgaccaaatgccctgcaaacctgacatctttagttacaacactgtgatgaagggtttgtgtagagatgggcgctgggaggatgcaggaacgcttattgctgggatggttagaaaggattgccccccagatgaagttacattcaacacagtaatcagttacttgtgccacagagggttggttgactgtgcaatggaagttgttgagcaaatgcccaagtatggatgtaaacctgataatttcacctacagtgccctagttaatgccttatctgaacgtggctgtgtggatgatgctcttgagttactaagaactataccatggaaacctaacactgtttgctatcgatccgtactgaagggactgtgcagagctgatcgatgggatgatgttgggaagcttgtagctgagatgatcagaaaccagctgaaccttgatgaagtcacattcgggttgatcatcgactgtttgtgccaaaaagggctagttgactatggtgctgaagttttgagggaaatgacaaagtttggatgctcacctgatattatcatatacaattctcttatcaatgggttttctgaaaatgggagtgtggatgatgccctcgagctattcaaaaacatgtcctgcaaacgaaatgttgttacctataattatatgttgaagggtttgtgtagagctgagcaatgggaagatgctgggaagctcgtagctgagatggttaaggatgaatgtctccctaatgaagtgacatttagtaccctaatcagctatttgtgccaaaaaggttttgttgagtgtgcaattgaagtttttgagaaaatgccgaagtacaattgtatgcctaatgttataatctatagcacccttatcaatggcctttctgatcaagagtgtgtagatgatgccttgaagttactaaatgacatgccctgcaagccagataccatttgctatagtgctgcattgaaaggcttgtgtagggccgagcgatgggaggatgctggtgaactgatactggagatgattagaaagaactgtcttccagatgaagtcacattcagtatactaatcaataacttgtgtcacaaagggtttcttgagtctgcaactgaagtttctgagctaatgcttaagtatgaatgcatgcctaatgttttcatttacagttccctcattaatggctttgctgaacaataccgtgctgaagatgctctccagttactaagaaacatgccatgtgagcctgacaccatttgctacagcgctgcactgaagggtttgtgtagagcaaagcgatgggaggatgccagggagcttatagctgagatgtttagaaagcagtgccccctagatgaagcaacattcagtatgctcattggttcattgtgccagaatgggctggttgacatggcaactgaagtttttgagcaaatgtcagtgtatggatgtagccctaataggaagattcatagttcccttgtcaatggctattctgagcaaaggcgtgtggatgaaggcctcaagttattgagcagtatgccatgaaagcctacaatcaattcctgttgtctgtgttgaagagctttgagtcctgaggatggtaaggattcaaagtaaccaggctggagttcatcattgatttgatgaatttacatctggtactcattaattacttgtaccagaagaaagtttggtttgagttcttgagtattggaatggatgatgtcatgtgatcataattttttttttgagatagcctgcatggatgctttttcaagaatgaattatggcaggtaattgagatgggtactacatgtgactttttggctgtaatcaaacaaacaaaagcaccaatctttagtcataaaagaggttcagcattgtatcatggttttggatggcaatagaaggacagtagctgaagctctaaataaccggagatgggtggtagatatcaaaggagcacttactgtccaggtcttggaggtttatctcaatatttgggatctagtggaggtgtggccctgcagcaggtggtacctgatcagtttagatggaagttaactcagtcaggtacctacaacagcaaatcagcttatgctgcattctttggcaggaccatcaaatttgcaccatagaaaaagatttggatgagtagggctccactccggtgcaagttcttcatttgtttggctatcaataatcgttgttggatggtagaccatcttgctaaaagaggcttgccccactcggaggctgcccttttttatgataaagaggaagaaaccatacagcacatctttgtgggctgtgtctttaccgggcaggttttgttttaagttctacctgctctggtgccctcaacttcagacaccaaattttcaagttggtggaggaaaggttttcagcttattccaaaggaattgcaaaaggggttcaactatttagttattctggtagcttgggaaacctagaaacacaggaagagcatgccaggcctagcataccgatctgctccgagtgatagctgatgaatgcggttttttgggatgacaggagcttcaaaactccaagagctccttgcctggttgctgtccttggctgcttagaactgtggctaggttggtcaggggttttgatgtggtttcttttattgttttgtaagtgttagctactggttggtgttgtgtgagtggggggttgagtttttgtacttggaccggttcctgctggccctttggttctttcttcttcttaatgaaatgacacgcagctctcctgcgttgttcgag

SEQ ID NO: 159 - DNA, 1904 bp, Sorghum bicolor
cgcgccgtgcccctccccatcgcaccagctacctccctgcggctgctttgcatcgcctcgcctcgcctcgctggccgttagggcaaggcggcagggccgcgggcggtgaggcggggcgggggcctacggtgggggcggcgagcggcaggcggcaggcggcgaggccgccctagtaaaggatgatatacacggcgatcgacacgttctacctgacggacgagcagctgcgcgactcgccgtcgcggaaggatgggatcgacgaggccaccgagaccgcgctccgcgtctacggctgcgacctcatccaggagagcggcatcctcctcaagctaccacaagcggtgatggccacggcacaagtactgttccatcgcttttactgcaagaaatcatttgttcgattcagtgcaaagagagttgctgctagctgtgtttggctggcagggaagttggaggagagtcccaggagatcaaagcatattatatttgtcttccacagaatggaatgtaggagagaaaacttgcctatcgaattcttagatgttttttcaaagaaatattcagaactgaggcatgacctgatacggacagaacgacatctgttgaaggagatggggtttatttgccatgtcgagcacccccataagttcatatcaaactaccttgcaacacttgaagcccctcctgagcttactcaagaggcatggaaccttgccaatgatagcttaaggacaactctgtgtgtgcgatttaagagtgaagtagtagcatgtggagttgtgtatgctgcagctaggagacaccgtgtaccccttcctgaagatcctccgtggtggactgtctttgatgctgatgaagcaggaattcaggaagtttgcaaggttcttgctcacctctacagcctgcccaaggctcaatacattccagtgtataaagacaatgattcctttactgttaggagaatctctgatccacaggcttcaaaggaaagtccagcaagtgctgttgctagcgataagggtacccccataccctcaagttctagccaggagaaggattcagtgactaagactatactaaacaaggtgaaggaaaaaagtgatgacgaaggtaaaccattacccgctgaacttgatggaaaagaaaacttggtggtgaactcgaaaaatgagaagtctgattctggtgttgaccggagtcgggaaagagaaagagagagatcaagagggcgggaacgtgatgccaggggtagggattcggatcgtgatagcaggggtcgtgactctgatcgcgagagggaccggagacgtcgctctagggaaagaagttcaggacactcagacaaggagaaatcaaggcgacattcatcacgagaccgggttgactactacagttcgcattcatctcgtgaaaaagatcggcacaggcaccattgatcaaggtgaggaggatcccgatctgcagggcatcgctgcatggagaccaccacttggcagtgccgacccaatcatgaaaacttgtggattaccatcatcccattggtggttgcattggcttcattgtttatgcaccttggattttgtaacttgcaagataagcgagctgtgaaaaacttggatttgtagaaacttaaacgaaggatatatatataagataaaattggcgcaggtgcacactgaactgccatttccagcagagcttgtggaatgttataaaaaaacagagcatgtggaatgtttgtgccgtcatggtaaacgtttgtgtggatttggccatggtacatccacataacttattgaggttggcgaacaaactgttaaacttgttctcatatggggagcatcaggtctttgtgtgacttgtttctgattgcaaataattctataggagatctcatgcccaga

SEQ ID NO: 160 - DNA, 1469 bp, Sorghum bicolor
gtccgcgactcgccccttccgacgccgatacggcgataccgaccccgttcgatccctcattcttacgccggcctggagccctcagctcagccctcgggctcggcagaccatctcggctgctcgcctactccctagtccctactccccacggtcattctcgtgcagccgggccggcggcaccggaacagggcgcagccggagcagcggcgccttgtgcttgtgccactgcccacatccagcggtctggcgcctccactgttctattccttttcgtctgctccaatccagctgcggcctctaatttgtgctccaccatgaagatatcctggggtaagaattccaaggttaagaaacagtcggtggtagtatcaactataccaggcctaccatttggagtggggagtgacaacgatgaggttgaaagggaggaaaaatcagatgcaaacacaaactgtcctggaacaaagccagttgaaactgctgagttgctccagagtcagggagacaagctagccgaggaagggaagtaccatgaagcacttgctaaatgggaggctgcgcttatcttgacacctgataatgcaatacttcatgagcagaaagctcaggttttacttgaagtgggggatgcatggcgtgcactgacagcagcaaccagagcaacagaactggatccattttggcctgaggcttgggttacccttggtagagcacagctaaattttggggagccagattcagctatactgacttttgacaaggcgttagctatcaagcctgattataacgatgcaaaagctgaccgagaaactgctgctcgtctagtcaagaaacgagggcagctgcatacatcagggttaagtgctaacaagagacgcttcacagttggggagtacccagagaagggtgcagagggcgaagaaaaagggaaagaaacagctgtatagtccagttagtctgctcccttttaatccaggtgtggctgtcctagaatggagggagctcatgtaagatgtaaccgtttcaggattctgctctaattttgcatgtcaggattctggatctctgagcttctcggttgtgacaaagctgtatcatcgctctgtgaaactataaggtatatagaggtctagaaggtgagtatcgtgaagccatgtggtgtttgtgcatattcctgtgagccatgtgctaatgtgcctcgttggcccggcttattatcagtgtcaatgtagaccgatgggccagctaatttgttagaatctgtaacaagcctttttaactggcagcttctatgcagtgtcacaaggattgttgactatttaggaaagagaggaatgtgaccgtgtgagagaaaaatgttgtttgttctgcgaagctataaaattttggactatgagactatgtacaagcatcattttacaagttgctagttgctgcttgtacaaattcaaggattgtggaattctacg

SEQ ID NO: 161 - DNA, 1296 bp, Sorghum bicolor
agccagaaacagagggggggacacgcacgcacagagaccagggagcaaaggcagtgcaggcagggcgactggagctaagcgtgacctcgcgttgcctttgcttgtgtcgagaggtcagaggagaagcagagcagcggggtacggtggtgcacctgcgcgtagccgctccgaccatgtcggatcaccagaggatccaccctgtggacctggagggcggcagcaaccggccgacggcgccgctggtgccgggaggctcgtcgttccggtcagacaagggcgaccctgcggcagcgcggagcgccaaccaccaccaccaacaacgcgccgacctcgacgcgtgcccgctgcctccgccgccgcgccgcgtcgcgccagcggcgccgctacctccgccgccgccgaggaagcggcgcggccggggttgctgctgccggctcctctgctgcgcggtggtcaccgcggtcgtgctggcggtgctcgccgcggcggtcgtcggcgcgctgtacctagcgctcgaccccaaggcgccgcggtactcggtggaccgcctctccgtgtccgcgttccaggtcgacccgtcgacggtgacggcgcgggcgaggttcgacgtgacggtgacggcggtgaacccgaactcccggatcggcatccagtacgagcccgggtccagcctcggggtgtggtaccggtcgtaccgcctggcgcgcggcgcgctgccagcgttctaccagggccaccgcaacaccacggtgctgccgctggcgctggccggggaggtgcagctggccaccgccgtcgtgtccgggttgcaggacgcgcagcggacgggcgccgtgccgctcgtgttccgcaccgacgtccccgtgcgcgtcgaggtcggcagcttcaagctctggaaggtcacctccagggtgcgctgcgacctcgtcatcgacaggctcatggacgtcagtagccccatcaagatcaaggccagcaactgcaagttcagcctgaagctgtgatcgattcattcgttcgttcgttgccgcggttttctttcgttgggttgtctgctctcctctcttttgggagactagagagtcgtggcgttggatttcttctgacagagtgctggccgtgtggtggtagtatttggctatttgcacaggttcagacgcgcagtgcactcccgccaacttcgtcggtgttcatcccggccatgtacagatggtatggtagtatatgattgttgttagagaggaataatatgcatgatcatggctagatttttataattctagagttacttctgtc

SEQ ID NO: 162 - DNA, 1026 bp, Sorghum bicolor
accgagctcctccgcgtcgtaggcgtagcaaaatcagcaaggcaaaaacgaagcagaggccagggacgcgccagcgcgagcgataaggcacactgccatggccgccaccacggcgtactccaccgcgcttctcggcggggcgcgcctcccctctgcaagaggagccgccgcaccgccctcctccctcggcctcctcccgctgcggtctccgctccctctccggctccaagtccaagattctgcgccgccgaggctgtcgctgctccgggtgaaggcctcctccgatgactcctcggccgccagtggggacgagctcatcgccgacttgaaagccaagtgggacgccgtcgagaacaagagcactgtcctcacctacgccggcggcgccgtcgtcgctctctggctgacgtccgtcatcgtcggcgccatcaactccgtgcctctgctccccaagatcatggagctagtcgggctcggctacaccggatggttcgtctaccgctaccttctcttcaaggaaagcaggaaagagctcgccgacgacatcgagtcactcaagaaaaagattgctggttcagagccgaggattgccagcgtagctggacaaggtaatggttgctagcaggccgaggtgtttgctagcttagctctcctcttccgagagaattagcatttggactcggccgaggtgtttgcaagcaagcacggagaagtcgtaatccttgatgatggtgtttgctagcttagctctcctcttccggcttctccgtgcttttccctccctggctaaatcactgctgccacagtggttacaggcttgaaattgacaacatcaatagcaatttgctttgatgatatacctatttattcgttatatatcctgctcgacgatgatattctgagttcaaaatgcagtagcgtatgcatttactcgtgtgtaatttcaaactcctttcgtcttaatgaaacacgggtggcagccctgttcgcgaaaaaaaatttactcgtgtggttgtgtcagttcat

SEQ ID NO: 163 - DNA, 1459 bp, Sorghum bicolor
acaccaaggaaaaaaaaagacactagcgagccttcacttgcgttcccctggcccccgtcctctgttccagcgtttccgccgctctccagaagccctgcctacccgatgtccgtcgcgtccgtggccgccctccggacggccgcctccggctccggccggtgccacggcgcgggttccccacaggtcggcctgaacgggggcaggttcttgatgatgcagaggagggagctggtgaccaaggccgggatcgcgctcgccgtctcctgctccatggcaacttctccagccccggccaacggctctgctcaagggctggaggttttgccgttcaaagcggacgggtacaacttctggacgtggcggggtcgccggatacactacgtcgagcaaggcgccgggcagcccattgtgctcatccacggcttcggcgcttccgccttccactggaggtacaacatccctgagctggccaagaagtacaaggtgtacgccatagacctgctggggttcgggtggagcgagaaggcgctggtggactacgaggccaccatctggatggagcaggtctccgacttcctccgggagatcgtcaaggagcctgccgtcctcgtaggcaacagcttgggaggtttcacgacgctgttcacggcaaccgaggtgccggagctggtccggggcgtcgtgctgctcaactctgccggccagttcggcgaccccaacaagccggccgccgcaccggccgaggaggaggagggcagcccgctgtccaggttcatcgtgaagccgctcaaggaggccttccagcgggtggtgctggggttcctcttctggcagtccaagcagcccgccagggtcgagaaagtcttgaaaagcgtgtacatagactccagcaacgtcgacgactacctggtcggttccatcacggcgccggcggcggaccccaacgccggcgaggtgtactacaggctgatgtcgcggttcatgtcgaaccagagccggtacacgctggaccggctgctggggaagctgtcgtgcccgctgctgctgctgtggggggacctggacccgtgggtcggcccggccaaggccgcgcggatccaggagttctacgccgacaccgccgtcgtgcacctgcaggccggccactgcccgcacgacgaggcgccggagcaggccaaccgggcgctgctcgagtggctcgcggctctcgacgcccgcgccaagccggccgagcccagcctccagaccgtctgatcgatcaggcgtcaggggcttagcgtacatacatacactagtcaaagcatacaatttggtggccatgtgccaatgtagcataacactagttaaagcatacaatacggtgattcccatggtgcgagtaattgaggagttgggttctcggacgaatgacaagtgattgatcaaaattaatttcagagaaatggatttcacataaaac

SEQ ID NO: 164 - DNA, 1177 bp, Sorghum bicolor
gagaggcagaaaaaacagaaggcgggggagcctctggtttcgtcgtcgtcgtctccctcagccccccgtttgcccccacccctttcctttctgcaggcagggtgcttcaacactcgcacgccaccccactctcgtcagcttcctatatatataagtaggtcacctggctgtgcctcccagcaacagcaatccatccatcgctgcaaatccaaacacacagaccgtttgaaagagagattattattgtcgatcgatcgactcgaatcgaatcgaatcgaagatcgaggctaggtctcgaggcagatcgatggagaggattagctcgtccctgcagtcgtgggtggaggaacacaagctctcaaccatcggagccgtgtgggcgacggcggtgggcgcgtcggtggcgtacagccggcgtcgggcgccggcgcgtgccacgagcctgcgcctcatccacgccaggatgcacgcccaggcgctcacactcgccgtcctcggcggagccgcgctcgcgcaccactactccggcagcagcgccgggaagcagcggcaggaggagctggactacggcttctactcccagctgccgccggccaccgacgccgacggcaacgagaacgagcgctggagctggtagctagcaaggagaaggagcgacaagaaagaggaacaaacaacaataaattagtagcaataattggtgggtggcctggttagcaatcatgcgtgacgtggcttcgtcctaatcctaatcctaatcctaatccccgcccgtggtttacattatccatccatccatccatccatccacatcaatgaatgaatgagtccatgtctatccggacggcgcgcggcatccatcggagttgctaccggccggagcccgcgcgcccatggtttcctctagttggtttgctattgctaccggagacgacgacgatccatccagcgctcaccagcttgtatttccatcagagacttctgttcaatttgttgccttccatttcttctgtgtaacagtatcacctagcttgtaatacttgtaccattccatcttattattgattgaatggtcacgatgatgacgacaattatttatgttttgttttgtttttgatctcgcaaacaacaacaacaacaaaaaagcaatatggtaaatgtgatgcggctgtctctg

SEQ ID NO: 165 - DNA, 3782 bp, Sorghum bicolor
gaattcgtgattggacactgacatggactgaaggagtagaaaaccggattcattctcccgcctcctcgccgcatctagggtttcttaagcccccaccgcccatggcgggcggcggggctgctacatccacttccattcccgccgccgccgccgccgccggcaccagcaagaccgtgtccgcatcgctatggtgggactccttcgtcgccctctccgacgacctcgaccgagccactgctggcccctccgtcccggatgccttctctaagcggatcaaaagccaccacgcgtggctccgagggtcggtctccatgttcgagaagccgaacgtcgcgtcgaggagcgcactggacgctggcgaggttgtcgtcggggagcatcgcctcactgtcaagacggagctcaaggaggccgcgcttcgtgcaagcaagtgcctgaacctggatgaggtgcaatcatacattctggtcaagagatcttcagaaatctctccaacaatctgtgatgctgatgctgaggagtttcttcacctggtatctgtacaatattaccttgagcgtcagtgtttactgaagtgcatcagaagaatctttgttcatgcaagtgatgggtctgattcaactgatcccattcgagatgaggcttcactattgattagtgaagagatagaaaggaaactgatatccatcattgaagattgtttttcagctgcatcttctgtaaaagcggaagcagaatttacagtctctagtctggaggaaactttgattgaagttaacttgattcttgacatattgtttcttgctttctatggtaacttctcaagatgtaatggtagactgtggataactttgtgttcaatttttaaggacattctatgtggttcttatgatatccggaaatttgttgtatcacttgaggcgaagaattcatttcattatgctaaagctcagctacttctcatccttattgaaactttggactttgagaatctcctctggatgattcatgatgaagttcctctgagtggagggtgttctgcattttctgttggtgatattctggagatggatgttgaaatatcaaaatttcctgaattttcaatggtagaatcaggagcacttatactggcttgggcagttttcctttgcctagttctgtctcttccagaaagtaacaccaacttggaaattgatcatacatcttatgcccgacgggcctttgagtttgcaccattcaattatttactaggagttctttgttcaagcatcttcagggagtcagatggtcctgtttctggttatcggggtatattgcgtacattcatttcagcattcattgcttcatatgaggtatcttatgagaaagaagatagttctcttgacacgatttcaagtattttatgtgaagtttatgatggagaggaatctctctgtatgcaattttgggataaagatagttttgttgatggtccaatcagatctgttcttcatatggtggagaaggagtatccttttcagatatctgaactaatacacttcttatcagcggtttgccatgggacctggcctgctcattgcgtatataattatcttgagaggatgaatggagttacaacaatctttacgatcccttctgttgctgatggtgtggattatgggcatcaaattgaaagtcatcatccagtcagcattcctggtattgaaggcattacacttccccgtggaacccatggctacattttgaaagttcttcgagaggatactgtattagttcgctgggagttcccgcattctggggtattctttttgctcataactctggcgcaagagctccattcatgcaattataaggaggcatctgatatcatggacctactttatcggatggtgtcgtcaaataaggacctgtgcttcgctttgttgcatgttgacaagtcacctgctgttcaaacatcaaagaacttaggacaaattgaaaatcatgtcaggattgatatcgctaagatattttgcaattccattttcaaatatgtgagagatgttaataatgctgacatattgtccaaaacccttggtctgctagcagaaatgatcaaatgtgctccatatcacgtgttctatgcggcgtttgagtgcaacatcttcacttcacaattgaatggtccatcaagtgattggttactttctggtgccctagctagaatgctttttgctgcctctgagggaaatggagattgttcttcacttacatcttcagtgcttgattttgccattcaggttcttcggaaaggagcagctgatgatgatatgatatcacctttaattgttttctcaattcaatacatcatggttaatcatgtgaactggaaacacaaggaatgtagccgttggaagacaacccttcgggtgtttgaattggtgaaaagctgtattcaagtaaaaccattctcatcaaagcttggtggcatcatttgggaaattctactatatgattcatctgtccatggtgtactctggaccattttatctgtgtcaacacaattactgcatgactcatataggagcaattatcatggtcataaggatattgaagatatccagcttgtcctttgcaacggacttgatattatgtatcacatcctgtccaatttaccagaggatttactgccaaatccaccattcattaccatggttttgtcatcttcattgaagccattttcttttatcacagctctaatatcattgatgtcctttcataatcctgatatgcaattagctgccgctagagcattctcagcattgtgtttcattgcatataaggcccaacctcagttgatggaaaatgccagctttactggtgatgtttctgagattcggagattggaatcaatgtatatcctacattcttgatgaggatgataaaactaatgattgtttggttgttgctgtattccaccttttgacatctgctgctcgttatcagcctgcttttcttatttccttgatagagcagagtatgaagacaactgatcataatgcttccaccaatgatcatggcaagggagtttctgttacttcaaaaagtaatactgaacttgctgaccaaatcttggactatattgaaaggtccgtcgagctcatgaatagatctcccttggtgttactaagtattctcgacttgttgaaggcattatgggaaagtggtatacagtttttgtacattttagagaagctaagaagttctctaacattctgggataacttatcacggtgtattcgtgctacacttgatatctgctctattgacaatgtcaatgccgttgatgagaaattttcattaaggtaccattgtcagggtaagatatttgagatcatgtcacatgagttattcttgcaaggaaaattgcttgcagagacttctaatactgtccgagatgatccaaaggggcaaaaagagcataaaagtgggccttgtcatagcagtgtagtcttgaaatggtttgataatgctattttggacgatctgatcagtaacttgtcaagtaatgcatacaaaaaggaacttcttcatcatgcaaaggtagctgcctgcctatgtatcatccatttaataacaaagttgtcaactggtgattctgggagcttgtctttctcattcatgaagaaaattcagatcatatcaacaaaattgtcacagcaccatgcattcttagctctcctgtcgcagtattcccgtaatggatatagtggtgaacaagaacttaataatttggttatcaa

SEQ ID NO: 166 - DNA, 1950 bp, Sorghum bicolor
ccggggtcgagttcagagctagtcgagacactacactacacgagagtgaagtgggagtggccagtgccagtcggctctgctacagcagccactaatggctcgcgtcgccggcctttgtgagctgcttctcctcctgctcctcgccacggccacggcatcggccgccacacctcttggccggaagggcggccacgaagccgacgacgacggcgagctcgagttggcagcgaagaatgagaacgacggcgtcgtcgcagctgctggcagcaggacgtcggccgggaggtacgcggtgatcttcgacgctggaagcacggggagccgggtgcacgtcttcaagttcgacaagaagctccacctcgtccagatcggcgatgacatcgagttcttcgccaaggtaaagcctgggctaagctcatatgctggtcgacctcaagaggctgcaagctccctactccctcttcttgagcaagctgataagattgtccctcgccggcttcagaaaaataccccgcttaaacttggggcaactgctggtttgagattaattggagatgagaaggcagaagagattcttgaagcggtcagagatcttgtccacaccaagagcaaatttcagtacaaccccaaatatatcagtgttcttgagggatcccaagaagggtcttacctatgggttgctttgaattatctattaggtaagttgggcggggactactcgaaaacagttggtgtaattgatatggggggtggatcagtgcaaatggcctatgccatttccacagatgctgccgcaaatgccccagctgtgcctgatgggaaggatccatacattacaaaggagtacctcaaggggaaagattataacctttatgttcacagttacttgtactatggcgctttagccgctcgtgtggagatcctaaaggcaaagaatgggccatttagccattgtattttgcgtggattcagtggtaaatacacctacaatgggaaggaatatgatgcaacagcctcacctgaaggcgcggtgtatgacaagtgcagggaagagataatcaaggcacttaagttgaatgcaccatgtgaaagcaagaattgtacctttaacggcgtgtggaatggaggtggtggagctggccaagacaacctctatgttgcatcttttttctttgacaaagctacccagtttggcttcattgatagcaaggcacccagtgcaaagtccacccctgaggcgttcaaaggtgctgcagacaaggtttgctcactgagcgcccaagaagccaaagttatgtaccctaatgtccttgatgtgccatacatatgcatggatctcatctaccaatacacattgcttgtagatggctttggtttggctcctacgaaggagattacattggtggctagggtgaagtatggagagtactacattgaggcagcatggcctttgggtactgctattgaagctattgcacccaaaaagatgagacaagatgcatgattggggtcttttagggtccttagtcctccctagctagggattttgttttccccgacattgtggcatctttgttgattcatggattttgcattgatcctatgtaataaccgatctcttatgagaagccactttgtagtgatgatccatgtttctagctcaagagaagaaactttaccaaagttagtttgtgaagaatgcggatgaggattagatgaatagcaattagggataaattgtggaccaattagtcacctcacataataatggatcctttcagaagatcgaccgagggtcatgggtcatctcgtttgatgctccaccatttccactattcattcaagatatttcttatgtatctgtgtttccaaagttaacttaatgctctttatgccactagattgtatttccttatctaccatccacttgaacttttattccttatctac

SEQ ID NO: 167 - DNA, 1997 bp, Sorghum bicolor
attccaaaagctctccagctagtcgtctcctccaaccagcagagaggccgcgcgcgaacgaagcgaaggccccagcacagcaatcagctgagctctcctcgtcctcgccctgctcgtctcgaacctcgaagctctccaatccgccggtcgatcgccggaggttgctaaggtcgtgccggatcgatcgatcgacgacgaccgagatcgatcgaatggactgcggtggcgcgctgcagctcccgcccgggttccggttccaccccaccgacgacgagctggtgatgtactacctcctccgcaagtgcggcggcctgcccctcgccgcgccggtcatcgccgaggtcgacctctacaagttcgatccatggcagctcccagagaaggcgtatggtggggagaaggagtggtacttcttctcgccgagggaccgcaagtacccgaacgggtcgaggccgaacagggcggccgggacggggtactggaaggccaccggcgccgacaagcccgtcgggtcgccgcgccccgtcgccatcaagaaggccctcgtcttctacgccggcaagccgcccaagggcgtcaagaccaactggatcatgcacgagtaccgcctcgccgacgtcgaccgttccgccgccgcacgcaagaagaccaacaacgccctcaggctggatgactgggtgctgtgccggatctacaacaagaagggcgtgatcgagcggtacgacacggtggacgacgacgccgacgacgccgtggcagaggacgtcaagcctgcgccggcgtccaggaataacccgcgcgggaccgccagtggccgcggcggggcagcagcagcagcggcgccgatgaaggtggagttcccggagtacggtgggtactacgactacgaagacctcgaggcgacgccgtcggcggggatgctgtgcttcgatcgcccgtcggccgcggtcccgacggccccagcctctgcgcccgcgcccgcgcccgggccggcgctgtcgtcgccgccgccggcggcggactcggacccagagcgcgacgacgactcgaacaactccgtggcgtggacgatgcaccacacgcacgcgcacacggacaactactccagctgcggctccgagcacgtgctgtcgccgtcgccggacctccccgaccgcgaccacgccgagagccagtccgccgggttatggtggcccgtcggcgtcggcggcgactgggccgccgccgaggacgggttcatggtcgacgtcgacgtcgacgacgggagctcgctgttcgggccgccgtccccggggctgccgttcgctcgcgtcgacgccgccgcgttcggcgacatgctcgcgtcgtacctccacaagccgttctgaagcaagcccctgatcgtctcggccagtcaccactgacatggacgttctggtcgtcgtgtacctcggttcaggtcgtcgtgcaccgttgcgtgctcgaccttttgggcacagctgcgccgcatgcatggagatcgatgagggctgagcatggtggatgacttgtgacgatcatggtgggtacttggtagaggagcttgctagccgtcggatctgctggcctcggattaatctgactgtcagtttttggtcgcgtcaagtacgtagctgacaactaagaatgaagcctactcgattcaggggctgttgaattgttgttggtggcatggtgtatgtaatctagtctagtctagtctagttctagctgtacttagaattggtttcaggttaattagtggcaaacaggcaacgagctttaatttggttttgttgagtgtttatgcactataattgcaacgtcatgcatgtactagagtcgctctcagcggtcgctttctcgtgacagggccgggaagccgaaaaattttgtaatgcaattatctaataaagtgttgtaacttgtaattatatgtagtatgtgtttgcctcatgctctttgctgcccttctgcctaatctcaatgaataatggatg

SEQ ID NO: 168 - DNA, 5824 bp, Sorghum bicolor
acccctcctctccctctctcactctcttttcgcaacccacgccgcgtcccttgggagtccagtggagtggaggaagtggaaccgtcaaaatgtcgtcgtcctcggcgatgccgccgccggcgtcgccgcgggagcacgtggagaggatccggcgggagcgctactacatcgggcgcggcgagcagaacccgctggcggaggacatgcaccaggccgtcaactacctctcgcaggaactctactccaaggacgtccacttcctcatggagctcgtgcagaatgctgaagataatgaatacccttctgaagtagcaccttcgttggagtttctcattacatcaaaggatattactggatgtggtgcatcctccactttactcatcttcaataatgagaggggattctcttcaacaaatatagagtcaatttgtcgtgttgggaaatcaacaaagaagggaaacagacatcagggttacattggagagaaaggtattgggttcaaaagtgtgttcttgatatcaagtcagccctacatattcagcaatggttatcagatcaagttcaatgagaaaccttgtgcagaatgcaatattgggtacattgtacctcagtgggtggaatccacgcctagcctttctgacatcgaagcaatatatgggtgctcaaaagtcctacctacaactaccatcattttaccattgaagagtgagaagattgatgcggtgaagagtcagttgtcaagcatgcatcctgaaatgctgctgttcctgacgaagatcaggaagctctctgtccgggaggataaatctgatcccaacaatacaactgttagtgagatctccatatccagtgaaaagaactaccaagccaggaagaacatgcatgctgagtcgtacacactccatttatcttctgaagagactgggaaagatgaagctgaatgtggttattatatgtggaggcagaaattcccagtaaagccagagaacagagtcaataagcgtgctgaaattgatgaatgggtgataaccctggccttcccacatggtgagcgtctgtcccgtgggaagcagctatcacctggcatatatgctttcctcccaactgagatggtaacaagcttccccttcatcattcaggctgacttcctcctaggatcatcaagggaggcaatactgttcgataatccatggaataagggaattctcgactgtgtcccaagtgctttcatgaatgcttttgtaacacttgtgaagtccaaagctgatgcgccagcaatgtcgctgccatcaatgttcagtttcctacctgtcaattcgtcactaatcccactgcttgagccggttaggtctggcatcaaatacaaggttctcaccgagaatatagttccattagaatcttatgcttcacagaagatattctgtaaacccagtgaagttgcacggctgaagccagccttttgggctatccttggcaaagcacgggaattcggtgtagatttgaagagtctgtcaactcatggaacctacattcttagttctcattttgacaaaagtagatacaacagtgtgcttgagtttcttggtatcaaaagcgtgagcactgaatggtatgcaaaatgcattgaagggtctaaccttgtcaaggaggtagatgagcagctttacctggaaattttacactttgtcgcgagtaattgggaaaactgtttttctggtacaaatatgatgtctgttcccctactgaaatatgttgataggaatggtgttctctctttttggagcatatccagagctagtcaacagaaagatcggttgtgcattgcatctgatatgaaatacagatcatggctaatcagctggaacaaggagtttctgtcttctaataagttctttctccatccgagcacacaggctgctctggatggtttctcacagaagatgacagtggaaagctggcttcggaaccatgcacgagtggaggttgtctctgtctacagttatggatcgactgttgttgattccttgagtaatgatcaaaggtctgtccttgcttttgcacactttctgtaccactcatttaagatggagcacatagagagcttctggttatcaaagctctgctgtgccatgccgatagttgacagatatggcaatgttgtcaacaaaacagaaaacattatagttccagctaaggggagcaaatgggttggtttgctgggtacatacccatggaggaatcaaggctacattgaattgtcagcagattacaagtcagtaggccactttgctgggaactacacatctgaggatcagctgttggaatttctcaagatacacctgcatgcctcagatgtgccattgatacgcccaccaaatgtgaggttccatactgtctcatcacctctcaatgtggacaatacattcttgctactggaatggatacggaatatcaggtcaaatggtgtaactttaccagatcaattcctggcttgtgtagaagaagggagttggctaaagacatcagttgggtacaagccaccaaatgaatcatttctgtccagtgctaactggggaagtcttttgcaaagtggaccttcattcattgatataccaatgattgaccaacaattctatcaaaacaagctgcatatttacaaacaggaactcaaggtaattggggtgagatttgaatttgaggaggcatcatcttacattggaagccgcctcatgtctatggctgcaagcaacgtgttaaccagagactgtgtgtactccttgctgcggctaattcggttcctacgagagaaggttctatctccaagtcaattgattgacagtgtcaaagatggatgttggatgaagagtactgttggatataggcgtccttctgattgtatcatcaaagattcagaatgggcagtggcatcttgtatcagtgaccaaccattccttgatgtcgagttctatggcgaggacatcctttcatataaatcagagctggagttgcttggtgttattgttgggttcaaaaacaattaccatcttgttattgataacttcaagttcagatcctctgctattacttctgagtctactgtattaatcctcaaatgcattcgttatgttggatcatgtcaagatttcataaggaagcttagagatttgaaatgggtgaagactaatgtgggattttgtgctccaaatgtctcttttcttgtggattctgaatgggaatgccttgtgaagatcttcaaaggagttccaataattgatttaggattttatgggagtgtgatcagttcatacaaagaagagttgaagaaggccggtttgatcacacgatttgaggaggcatcgatggctatagccaatgttttcaagcgcatggtatcggagtcatcacttacgaaggctaatgtcctagctcttctactagcttaccggcagctgagaacacacagcccacttcctgttgagcttttcaactgcatgcgcacagagaagtggatacacacatcgctagggtttcaatctccatcaaatacaatcctatttgataatgcatggcaatatctatctcccatatcaatattaccgttcattgatgatggtgacacttgtaatggtttggggatggatatatacggctataaagatgagcttagggagttgggtgttactgttgaagtgaaatttggtgccagatttgcccttgctggcctcagcattcctgatgatccttccattttgtccaaagctaccattttgtcgtttctggagtgtatcaagaactactttgcctctgcaactgaacctccaaagggctttaaagaccagatttgcaagaagttgttgaagacatccttgggctaccaatatcctgatgaatgtattctcttcgatgcaaaaaattgttttctacagatggaagatggccctttcatcgatgaagcattctatggttcagatatagcttctttcaaacatccccttgcgatgattggagtgactgtggatgttaattctgcacaagatcttattgcccggtatctgaggaacaaaaaagatatagatactatttcccggatctacatgtatctgaagaaatgtaactggaagcctgacaaaaacaacaacaacaacagaaattggatttggataccaaaggaaacagagggtggagactgggtgagctcaagaagttgtgttctgtatgataagaacaatctatttggcctgcagctgcatgttctggacaaatattatgacagaaagctgcttgacttcttttcacttgctttcagtgtgaggcatggaccttgttctgaagactattgcaaactatgggccacatgggagagttcagtgcacgagctacccatatctgattgcttggctttctggaaattcatagcaaagaactggaccaagaaaacagaggaacttctttctggttgtgtcaaggttccagtatgtattgatggcaagatcattttatcaaacaaggagaacgtgttcattcctgatgatctgctgcttgcggatttgttcagaaagcatcctaaacaatcactcttcatctggtatccttcttctgccctaccttccatgtctcgagcaaggtttaacagcatatatggcagtattggtgtcaggacaatctcagaagcagtggccaagaatgattctttcacttcagcgaatagccatttcaaaacagctgttctgagtaaggtgatcaaggttggcttgctccaaatagtcctcgcattcctttccaaccctaattttgacattcctgctaaagataggcatcatctggtttcatgccttctgaatgtgactatcgaagagaccgatgaaccaatcacaatggcatatagtgtgagtttgtcctctggagagatggttgaggtgaaggctagacgaatgcttcggtgggaaagggagaattcaaagctgtacatgcagagaagtgatggtgcatccagctatgaagacaagattgaacttgcgacctactttgcacatgagatatctcatgggttgctctttcagatgccagatcagatatcttcactcactgaactcataaaaattggcagcttagtggacttccagcaggccgctgttgcgttcttgctgaagtccaaaaacctgcagctgttccctgaagatgaagatttcctgaactcttctgtgctaggtggcagcaaaaaaccagtggacaactagcagcctgcagattttactcttctgtacttgttcaaggttgctgatggcctgcaattcctagaaaaatccggtgttgcgcttgcgcttgtgcagttgtgcctagagatcccggaatatcatcaacgaacgtggtgtcttctatgatgcatatgtatcgttagactaatatctcctgaatatccagtgcctcctggtacaaaacttgtcagttgtttcggtgcagatgcttatctcagtgttaaatgacaccaagtacttgaattactgttactattattatcgtcaatgccttgtgtgtgctccgatttatggtcctgctacatgagttgtgttttagatttgtggcagtgacagtgatctgttaattgcacgggttttgcttgtactggaggccaaatagagttgtttccgtcggtgtataggcttggcgtatcagttgcatcttgccaatgaatgttgtcacgtttctgtaaccaagatagcatatttgttctttcacgtctcatgaaatgcactactagatgtcaaacaaatttatttgacactggtctagaagcattgaacatcctaaattagatgctcttcta

SEQ ID NO: 169 - DNA, 1477 bp, Sorghum bicolor
acatccagcgcctagctccagcccgcgagtaacaagacggcagagccggtttagcgccgaactcggcgattacagaggcggcctgtgggtcccttccttcttttctcgatcccctgtgccttgcccgctttccccaccgcgattttcctcaagcgcgcgctcagcccgcgacaatttctccttcgcgccaattcctctccaccaggcgccaaatcctctccaccaggctccaaatcttctcctttcaatgactatttaagtttctctacaatttattctatgattttccatctgtcgtaaccctagcctgaatcagatgtctcgccggtcgaaaagagagatggcgtcgccgcctcagatttcctctccgtccgtccccatgatgcccgcggcacgaccaagagagatggcgccgccgcctcagatttcctctccgtccgcctcagatttcctctccgggcctgggtgttttcctacgccaccagcttccataaacaccacgatggggtctgcagctcccagcccttggtggtgcggcccgccggtgccccagcaaggtatgtcgtggtggcctgcacctagctgtggtggtggtgccactgcgtcgtcttcccaatcggtccagaaagacgacatcgactctgatccaaaggaatgttgcaggggtttggataatcgcccacctggtggtttcctcagctatttcaatcacccatggagtcagtcacttccccagccgaccccaccacatttatttgatggaaatagagggaaagggagcccaacaatgttagcttctgaatctcatcggcgacgccggcccttgattaatttagacaatgatgaggataatgcaaatggtgctagtaggactgacatacggctaaaatatacgaagccagaggaagtgcgcttggtgagttgcattatatgtatttacagatggatgatgtcctacagcagcttacaaaacttcagggcacaaatgaaagtcgagaaaagatgttggaaacccagaaacatgtttcaagagagaagcttgaatcatctagacttaatcacctcgctgccaaagaaaatgctaaatcggctatgctggagacttacagagcactaagtatgaaagatacaagtgcaatgcctgatgatgtcagagctgagcacttggcatttatgaaatgtgtaagagagagcttatttggcaaatctgaatcagatgcaaatggttgctcttaaagagaatcaggttcctgttgggggttcttcctgaatgctagatatggctaaataaattgagactctggatgctagatatatttccaagtcattagtgtaatagttagttgctcatggtagtagccttaagcttttaaatttgtgtgccccctttggtctatcttatgctgtgaacttgatgtaacagccattatattttaccaaggaacaatattaatgcttattgcttcagtcgataata

SEQ ID NO: 170 - DNA, 4774 bp, Sorghum bicolor
ctccccctcccccctcctcagatccggccacctcctgcccgcctcgccgccggtcccgcgcggcccggaaccgaaccctagagctctcccccccgtggcgggtccgccgggcgcgcgcggagggaatggaggcggcgctggaggcggcgcgcgccaaggacaccaaggagcgcctggccggcgtcgagcggctgcacgaggcgctcgacgccacggcgcgccgcgggctggcggcggccgaggtcaccgcgctggtcgacacctgcatggatctgacgcgcgacgccaacttccgcatcgcccagggcggcctccaggcgctctccgccgccgccgtcgtcgccggcgaccacttcaagatccacctcaacgccctcgtcccggccgccgtcgagcgcctcggcgacggcaagcagcccgtgcgcgacgccgcgcgccagctcctcatcacgctaatggaggtttcttcaccaacaatcatagttgaaagagctggtagttatgcatggactcataggagttggagggtgcgggaagagtttgtacgtacagtggcaactgcagttgggctatttgcttctacagagatttccttgcaacgagttttgctttcacctgttctgcaattgatgaatgattcgaaccaaagtgtgcgagatgctgctatctcttgtattgaggagatgtacaagcacatggggtcacaatttcatgaagagttgcagcgccataatctgccttcctacatgctaaaagaaataaattcaaggttggataaaatagaaccaaaggttcgctcatctgatacagcgatgcagtataaggctgtagaatcaagatctgttagtgctaatccgaaaagaggcagcccaagaacaaaaagcataccaagggaaagtacactgtttggaggtgacactgatgttacagaaaaacctgtggaaccagtaaaagttcattctgagaaagaattacttcgggagtttgagaagatcgcggctacccttgttccagaaaaggattggtctttacgtattgctgccatgcaaaggattgaagccctggtttatggaggtgcgatcgattatccatcattccttatgctcttgaagcaactggttcctccattgtctactcagctgtctgatcgacgttctagtattgtcaaacaggcatgccacctacttaatatactatccaaagaactcctcggcgattttgagccatgtgctgaacaattcatcccgatgctttttaagcttgttgtcataacagtgcttgttatcgctgaatctgcagatacatgcataaaaactatcctgcggaattgcaaggttgctaggattcttcctcgcatagttgacacagcaaagaatgaccgaagtgcaatcctccgtgcaaggtgctgtgagtatgcacttctggtactggagtattgggctgatgccccagaaatacaacgttcagctgatttatatgaggatatgataaaatgctgtgtagcagatgcgatgagcgaggttcgtgcaactgcaagaacttgctatagaatgtttgcaaagacatggcccgagcgctcacgccgtctttttatgtcatttgatcctgcgatacagaggataataaatgatgaagatggtggtgtgcacaaaaggtatgcttctccctcattgcgtgatagggttgtgcagccttcacgtgcttcctctcattcaagtagtacacatgtacctggatatggcacttcggctatcgttgcaatggacaagagtgcagctatttcttcagattcatcttttccatcaaacaatcttcggttatcacagtcaaagacgattggcagaagttctgagagaagcctggagagtgtgcttagctccagcaaagaaaaagtttctgccattgaaagtttgctgaaaggtgtcagcatgtcagggcaaaatttcactgcagcgcgctcaacaagcttagatcttggagttgatcctccatcatctcgtgatcctcctgtgccgcttgcagcaccagcatcaaatgttctgtcattgcagaactcagcactgttggactcatcccttcctaccatcccacctagttcacgaaatggtggttcccgcttattggatacgatgacaacacacttgcctaccaaagaacggtcaaggtcaccgtatttgagtaatatgtcatctgagtccatgtctggcttatcattgccttactcaagaagatcttcggagaggcttcaagaaggaggccgcatggatgagagctatgatatccgttcagctaggcgaatccctcaaatgcattttgagagaaactatgctgatatgtcttatagggattccagccacagagattcacataacaaccatgtcccaaatttccagagacctcttctaaggaagcaagtaatgtcaagggcttctgcaagtggcagacacagctttgatgatagccatgtaccatcaggtgatgtgtctggctatacagattctctggcttctctaaatgatgcactttctgagggtctcagccctagttctgactgggtagcaagagtttcagcttttgagtttattcggaatttattgaaacaaggccagaaaggcattcaagaaattactcaaaattttgagaaggttatgaagctgtttttccgtcatttggatgatcctcaccataaggttgcacaggcagccttctctgcacttgcagagattatcccagcctgcaagaagccatttgaaagttatgtcgagcgaattctaccatatgtattttcgcggcttattgatccaaaagagttggtgaaaaaaccatgctctgtaacattggagattgttggtcgaacatatgctattgatatgttgttacctgcgctagtacgatcattagatgaacagaggtccccaaaggcaaaattggctgttcttgagtttgcaaataaatctttcagcaagtacactgttgactctgatggttatagtaacagtggcttccttaaactatggctttcaaaattggcacctttggtaaatgaaaagaatgcaaaattgaaggaggcatctatttctggtatcatatctgtttattctcactttgattcaacagcagtgctaaattttattctcagtttgtcagttgaagatcaaaacctcttgaggagagccctgaagatcaaaacccctcgtattgaggttgatctggtgaactacttgcagagcaagaaagaacgttcacgccccaaatcttatgaccaggcggattttggaacttcttcggaggatggctatgcactgacatccaagaacagctatccatttgggcggttttcttctagttcccttgatgctgaagggggaaagaagatcaattcaatgcaagaaccagtgctgcataatgtctctataggtcgaacagcttctgatatgagcatggatcatgctattcaaagtttagagtcatctacaggagctgaagttcatttaactaggagtagagaaccaaagactaacagtaactcagttgtggaagctgctcgctcttggacaaactaccctgaaaaaactgatgcctccttagatggtgaaactgctaccggtactcctcggttagatttcagccggtttcttacttctgatgggcataatactgttggttcaacccccgaagaaagtgttcaagagggtgatatgattgtgaatcttagttctataaagaccagccttcaaacagataacggtctgagcataccacaacttctccatcagataagcaatgacactgaagtttcaagctcggaaaagcgggaagcattgcaacagttggttgatgcttcccttgataataacagctccatctgggcaaagtacttcaatcaaatcttaacggctgtgctcgaggtattagatgactctgattcatccacgagggagcttgctttatctttgattgctgagatgctcaacaaccagaaagattcaattgaagactctatggagattgttcttgaaaaactcctgcatgtaaccaaagatgcagtggccaagatttcaaatgaggcaaaccaatgcttaaatgttctattggcaaaatatgatcctttcagatgtcttgctattattgtacctttattggtcagtgatgatgagaagatacttgtcgtgtgtatcaactgtttgacaaagcttgttgggcgcctttctcaagaggaattgattgatcagttgcctacatttctgccagcattatttgatgcttttaacaaccaaagtccagatgtccgaaagactgttgtgttctgcctggtggatatctacatcatgcttgggaaagcattcgctccatacttggaagggcttagcagcacgcagctccgcctagtaaccatctacgctaaccggatttcgcaggcgaggtccggcaagccaatcgattctaaccaatgagattgtaacattgttattatctgtggtctatatgagcatttgttaggtagggtgtttatcttgtcatttgtttgtgtatgtgtatagtataaacaagcgcctcccctctgtcaagagctcctggtttttgccctgtgtgattatgtattccccctttaccccttttttattttttctttggtagcttgtggagagtgttaatgagtgtggcttcatttgtactacttggtacatacgctgtacaaagaaaggaaagtgtagtttcgtggacaacagttatggaagtgattttttgggcccgatttccttggctggatgac

SEQ ID NO: 171 - DNA, 2716 bp, Sorghum bicolor
gcatagtcttctgctcggcagcgccgagatcttctgctccttccccactcccaggctcggctgcggcgtcggcggctccccctcccgcctctcgccactcgcctccgtcctccgcgcacctgccggcgaccctgtgtacgcacctccctcttccctcccgcctctgctgtaccgtgggagcccggcctgctgcccagtgtggccgggccttggctccgccggtgcttggtggcgcccagaattagcgtggaagcagggtggagtgctgtctgggcagaaatctgctcaccgggtgccaggaaacaggcggttggagataattgtttgggggattcgtcaagaaaagacccagtaggtggttgcgcacttgttatgctgagactgaatggaggctgtagacaagattgctgagcccaaagaccctttcgtgctcacttctcagaaggttcagagcttagagccaccgataccgataaaggcgtcatggaaagggaagtactcccaggagcaagaagagaaggatctgccagctgatggcgaagagagcttccggagcctggattcctctgatgaaggtggccggagctccttctctggagctagtcaccctccagagccaattgatatggatatcatgaagacggtctatgtcgcaatcgacgaggagaagtctgagccaccggtttgtttagtgcgaggagtctcggtgaaggggcctttcatagatgacctctcgatccgtgttgcaggcacaaaggcaaatctgttggtaggcgcaggcggtgctgaaggcatggctgaagagaggaaggtatctgcttctgcagtggcatcagtcgccacagcacgctcatctcaggctacctctttgcctcaggactcagaggagaaggagtgcgtctgggacgcttcactccctcccagtggcaatgttagccctcacagtagcattgacagcatgggtgtggtcactgccatgagcaccctccacagctgtgcgagcacatataaaagtgaagccatagctggtgaagcaatgctcaatgtggagaggaactgtgagagtgtaaagggtgttcgaggtgacttactagaaagtgcaaaaactagcatgagtcgagcaagtgatagcagtggtgttagcgatgacagcagctggagccacatcactggaggtgccagcaagcctcacaaggggaatgatcctagatggaaggcaattcatgctgtacggactcgtgatagtgttcttggaatgagccattttagactactaaagcgtcttggttgtggtgacattggcagtgtttacctctcagaattaagtggaactcggtgctactttgcaatgaaggtaatggacaaggcatccttggcaagtaggaagaagttaaatagggctcaaactgaaagggagattctacagcttctcgaccacccattcctcccaacgttgtatacacattttgaaaccgacaggttctcttgtttggtgatggaattctgtccgggtggtgatctgcatactttgcgacagagacaacctggaaagcatttctctgagtatgctgcaaggttttatgccgctgaagtacttctagctctggagtatctacacatgttgggagtcgtctacagagatctgaaaccagaaaatgttcttgtgcgcgatgatgggcacataatgctttcagattttgacctctcgctgagatgtgcagtctcacctacactcatcagaacatcagcttttgattctgatcccagaagagcaggtggttctttctgtgtacagcctgcttgcatggaacctacttcagcttgtattcagcctgcgtgcttcctgcccaaattcttcggtcagaagagcaagaagaagactagaaaggcaaggtctgagctgggacagaatgctggcaccctgcctgagcttgttgccgagccaacatcagcccgatcgatgtcattcgtcgggactcatgaatacttagcccctgaaatcatcaagggtgaagggcatggaagcgccgtcgactggtggaccttcggcatcttcctccacgagctgctgtacggcaaaaccccattcaaggggtcagggaaccgcgccactctgttcaacgtggtcggtcagcaactgaaatttccagagtcgccgtccacgagctactcaagcagagatctcatcagggggctcctggtcaaggaaccgcagagccgcctcggcgtgaagcggggagcgacggagatcaagcagcaccccttctttgagggcgtgaactgggctctcatccggtgcagcacccctcccgaggtccccaggcccgtcgaggccgagctgcctgtgaagtacggcgtggcggaggcgatcgggagcaacagcaagaggatagccggagcagacgtgaagtccggcgggaaatacctcgacttcgagttcttttagagtatatagtgcccagtggcagcctattgtttgcatactgtccgtgtatgtggccagtttgatgttgtgtgattcgatgtggtgctttggtgtctcaccgtcgatgcaaaattctcagatctgaatcgaccaaaaattagatagatctgtcatctgtttgccacttgcctgctttggcgcatttcgagttgtagcagacctgaaagcagtgagtgtggcaaaaaaattctcatgatcaaacagatgagaaggcgctttcctacttgttgc

SEQ ID NO: 172 - DNA, 2260 bp, Sorghum bicolor
attctctccccctccccagctcctccctgtctgcttccctcccctgctgtggcactgcgcctggccgcttgccctctccccctcaccttcacctcccccatcccgcaaccgcacgagcgttccctcaccaagaggagaaaaaaagagggagcgaaggaggcaaaccaggcggcgggacagcaacgcgacgtgcttgccattctctcgaggagctcatgcaaggtgtaagtcttactgcaagaagggcagctgtgcatgttattaagacccaaatatagcctcacttgattacactgcacggggggttgaaaacttgagatacagttgatcttctggttaagagtatggcttcaaggttatcacatcagctgagcaatggcctgtatgtttctggtcgacctgagcaacctaaggagaaggccccaaccatttgttccactgcgatgccatatactgggggtgacatcaagaaatctggagagctggggaagatgtttgatcttcatgttgagaagtcaagaaaatctggtcctctaggaaatgctccttcaagaaatacttcatttggcggtgctgcttccaactctggacccgtctccaatgctggtggtcgttccaactactctggttctctttcatcttcagttcctggtgctggcggatcagccagagcaaaatcaaactccggaccgctcaataaacatggagagccaacaaagaggtcatctggtccccagtctggaggagtgaccccaatggcacgccagaactctggcccccttccacctgtgcttccgacaactgggcttatcacatctgggcctatctcttcagggccacttaactcgtctggtgctccaaggaaagtatctgggccacttgattctgctgcatcgatgaaaatgcgggctacttcctttgctcacaatcaagctgttactaatctcaacactgaagatggttactcaattcagggaagctttccgaagccaatactctgggctgtgattctgctctttgtgatgggtttcatagcaggtggcttcattctgggtgctgttcacaatgcaattttgctgatagttgttgtggtgatatttggttttgttgctgcacttcttatctggaatgcttgctggggtaggagaggcgcaattgggtttgttaatcgctatcctgatgctgatctcaggactgccaaagatggacagtatgtaaaggttacaggggtggttacttgtggaaatttccccctcgaatcctcgttccaaagggttccaagatgtgtatacacttctactagcttgtatgagtacaggggttgggattccaaagctgccaatactgagcatcggcgttttacctggggtttacgctcaatggagcgacatgcggttgatttctacatctcagattttcagtctgggcttcgagcattggtgaaaacaggatatggtgcacgtgtgaccccttacgtcgatgaatctgttataattgacatcaatccagacaacaaggatatgtcccctgattttttgagatggctaagggagagaaacctttcaagcgatgatcggacaatgcgcctaaaagaaggatacatcaaggaaggtagcactgtgagtgtgatgggggttgtccaaaggaacgacaatgttctgatgattgttcctccatcagagcccatctcaactggttgtcagtggaccaagtgtgttctcccaaccaaccttgacgggcttgttttaagatgcgaagatacttcgaacattgatgtgataccagtttaactggcggtggaagagtcgttgccaaagaaagtgcctgttaaatatttgaatctgtattgtttcatggaatgctagttgagagaaatgtgcaaatgttgggtgtgattatggcaggttgagggtggttggttaagctggccgttggatgtatagttcttttttcttttaattgtgttttgtcatttctttttctttttaattttcagctgagatctgaaacttgtgtaaccagatgcctcttaatctaaatctgcgtggcacttagattgatttggttttgaagttagaagtttgttctcttttgtgctttgtgttaaggcaattagtatttcagtatttgaaagctagctacaagtgataggacctcagatgtacatttcccctttcattacgttttgccattttttctttttaatttcaactgagatcagaaacttgtgtattgggatgccatttagtttgattcgttt

SEQ ID NO: 173 - DNA, 1746 bp, Sorghum bicolor
ccgtacgcttgagctcaaacctcaaacccccaaaccccagcggccagcaaaagcagcggcggcggccaggggctgacgaacccgccgcgagaaaccccggttggcaccccaccaacggcatgggtggtattggcgtcagcccgtgcgatctggacagggagttcgcgccccaaatcgcccagctcctcgccacgcctcctctccaatccgctcaggaatattatgatgaactcatacggtccaagaagcctgatggcattagagtgagctacagtggcaagcatgggaaaggtgtttgtgcaaatagggactttgctgaagacgaccttgttctgaaggaccaaatgttggttggtgctcaggacagccttaacaagattgactgtgttgtgtgtagttactgcttccgcttcattggttctatagagttccaaattgggcgtagattgtatttgcaaagccttggtggtagtgttgatggctctactgagagacattgccatgggagtgatgctgggccaagtactggctgctctggtgcatcaagtgggaatagcaatgctgtgccacaagaggtcctgatgtcacttatggatggtaatatgtcattgcctttaactgatcagttctgtctgccatcagttgttgcttgccctggtggatgtgagggagaactctactgcagccaatcatgtgcggattctgattgggattcttatcactctttgctgtgtgctggatccaagaccgaaccattacggaaatccgcccttcagaaatttgtagggcatgctaatggaaccaatgatatttttttgattgctgccaaggctatcactttcaccttgttgagatataggaaactcaaaagacagcatgggtctcatgaatcgagctcttcgctcctcatggaagcctggaaaccactttcaatgggcttcaaaaagagatggtgggaatgtgttgctttgcctgaagatgttgattccagtgaagaagaattgtttagacagcaaataagggatctggcatttacgtcactgcagcttctcaaggatgcaatctttgatcctgagtgtgcacccttgttttcgcttgacatctatggccatataattggcatgtttgagatgaacaatcttgatttagttgtcgcatcaccagttgaagactatttcatacacattgatgatcttccagagagtgagaaggaggaagcagagaaggtaacggggccattcctagatgctttaggtgaagactattcagtcccttgtgagggaacggcgttctttcctttgcagagttgcatgaaccactcatgctgtccaaatgctaaagcatttaagagagacgaggacaaggatggccatgcagtgataattgctctgaggcctatcagcaagggtgaagagattaccatctcctacatcgatgaagaccttccatacgaggagaggcaagcacagcttgcagattacgggttcacgtgtacatgcttgaaatgccaagaagagcaaccggtctgaaaggagaactcagtttgtattttgtggcatttgggaatcttcatgtattttatttctctgggtaatttttgaaagcttggaaaaagtgaaagtgcacaaacaaggggagtttctttttgggttgcaacttgcgaaagatgatatgttcttgttcaaatggatagtggcgaccatgttaaaatgcaacagccgatcagtctttagcctcacattatgt

SEQ ID NO: 174 - DNA, 585 bp, Sorghum bicolor
gcgccggcgggcggcccggtgttggccgattcgaattcgacctcgacgcgatggggttccacctgcttgcgttcgtggcggcgagggggctcatgcaggtgttcaacctctcggcgccgctcaacctgcggctgccgctcgcgcgccaccttcccgaggccttcgccgtcctgtgcgtcgtgctcgcctcgcacgccgcgtgggtcaacgacgccctggcgcgcggcgccgcctggagccacagcgggagccggggcggcgtcgacgagtacgtccgctacgccatgctcagcatctccgactgacgccgcactgatcgatgacggacgacgcgacgacgatcgagtggacgacggccaggcgcgtccgtcctttgctagcttaattagcttaggagatatgatctcttcctccccttgtaatacacactgctcgctcgtttggtttcttcttgctcgtagctagcatgatttttgatagcatcgaaaagattgggatcagggagattgttgtaacatgcaaccgtcgttgttggcgcaaatacaagtgaattttttgttcgactgatcgaaatctctcatcggg

SEQ ID NO: 175 - DNA, 1121 bp, Sorghum bicolor
gagcgagacagaccaggaactgacgcatttgaatcggaggccaccgctgcgctccgagggccctcctcgctcgccacccgctcacggagacagggagaggtcgatggcgagctcgctggcccgcctgggagcggcgctgccacgcgcgcgcccgtgcgccacggcccgcgccctgccaccggggcggtgggacgccgcggcgctcggcgcctcccgccgcgccgcgctgaacgcttgcaggtgccaagttcattccgacgttaaagtagcccctgcatcggatctgaaggatggtagcaaatctgaaacttggaggatcaagatgctctacgacggtgattgccctctctgtatgcgtgaggtaaacatgctgagagaaagaaacaaatcctatggagcaataaagtttgttgacataagctcgaaagattactctccagacaacaatcaaggccttgattatgaaactgccatggggaggatacatgccattctttcagatggaactgttgtcacagatgttgaggcatttagaaaactgtacgaggaagtaggacttggatgggtctatgctgttactaaatatgagcctgtagctaccatggcaaatgcagtatatggtgtgtgggcgaaataccgtatgcaaattacaggtcgacctccactagaagagattatggcatcccgaagagctgcaggcgaatgtaaagatgacaaagtatgcaagatgtgagcataaaaaatggagctgttcgctgcagctaaaaagcagccgccaccgccgccgctgtaacagtgattatccgagtgaaaaacagccccagctgcagccgcagctaacacgcccaatgctgttctactgtactacatacctcacctctaggctcatatgcatagttttaacactaaaataatcgctatggtattaaaaagaaaggtgaatagcttatttaatgatttatcgaagtaaatatatacatttgtatgtacactgtactggtttgacggcaagacattttatggtgaaaacttccacgtagtgttctgtttttatcgtaagctcggtgactggtgagggattccacggtgcctcaagtcctgaactcctgatcatgggattt

SEQ ID NO: 176 - DNA, 1679 bp, Sorghum bicolor
agactctcattcctcttctcccctccccgatcccccttatcgccaccatgctgtcactctcgcacccgcaccccgccgcgtccaccaccgcgccgcgccaccagcggacgccccgcgccgccactcccgtgtggcgccgccgtcgcgccagccacatcgtcgcgagcgccatcctgctccccggcggcggcagcactggcggcggtggcgggcccggcgaccggaggctccccttcacgccgcccccgatggcaccaccgggccagctctaccagccgttccacccgccgccgtcccctctcccgcccagccttcgcaacctcgacctcacccagcgcctccagatcctccgcgaccgcatgggcctgtggcacgagtacgcgcccctcatcgcctcgctctcccgtgacggcttcaacccgtcctccatccaggaggccacgggcatctcgggcgtcgagcagaactccctcgtcgtcgcgtcccaggtccgcgactcgctcctcgacgacaaggttgccgcgttcccgcccgacctgctcccgtacttcgactcctacggcggacccgacctcctgtacgagctccgcttcctgaacgcgcgccagcgtgccgacgccgccaggcacgccatcgactacaggctcgaacccaagggcgtgcgggagctggcgcgcgccatgaagggcttcccgcgctggcgcggggaggaaggctgggaggccttcgggagggactcccccgccgactgcctcgcctacgcgcggttccgccagtcgagggaggccatcgacgtggaggagcgcattgcggagctggagcgcgcgctgcaggtggtggagaccgagtccggtagggcgcgcgtggagctcgagctggagcgcgccaggaagaaggcggccggggaggaggtggtggaggaggatgaccctgccgcctcgcggcccaacgtcacggtggtgcggctccagtacggcgaagtcgccgaggcgaccaccgtcttcatgctgccggtggtcagggagacggacggcgtcgcggccatggagtcggcgcccaggcggaccaagacggacgtggaccttggcattgtggaggtggacaaggcgtgggcgcggtgggccgtgctgcccggatggggccccgtggccgaggcagcggacgacgccgtcgtcgtcgagcttgcggacggccggaggctgccgtggcgcacggccgatgaggagccggtgctagtcattgccaaccggagcaagaaggaggtcgtggagcaggggatatacgtcctcgagaaggatggccggcttgtggtggagagggggaagaagctggctgagcagggcatagccgcggcagctgccgaggtggttatcgttgtccggccgcccaaggatgaggacggcatgattagcgacgaggagtgggactgatcactgatctggagaggaggtttatcaagggttttgcttggttttggagatgccaatttctctttctccattgggtggtaattggtggtaaagctttccccttctcttctttacagtctcgagtcgatcgatcgatgaataagagcaacgaattgccgcctcatgttgtttcggtacatgccataggaactattctctgtagtcccttagccttagccttgcattgctggctattctttccccacatta

SEQ ID NO: 177 - DNA, 2074 bp, Sorghum bicolor
gacttcaaaagttaagaaatatgatttatcctgttttataatttaggaagatctccaactccttcccccactcgcgctcggtcccagggatcggagcggcccccactcggcggcgtccaccgacggaggggcagtcccaggctcggcggcggcgtcagcggctcctcctcccgcctgtcgccagtcgcctcgcgccctcgcctccgttctccgcgcaccggccggcgaccctgcgtacgcacctccctctcccctcccgcctctgctgtaccgtgggagcccggccagctgcccagggtggccgggccttggctccgccggtgactccaacgttcaagcatggggctactggcactgcagcggctcatgtccctgcagcgcgaccggcagcggcgtcaacgacaaacccgaaccccaatcctgaatggatggattgctgcttcatcactgggtaaaaggaagggctcttcctgtcaaaaagatgctcatggtgattctaaagttgccaaaagaatgagatgctcaatcccagcccttccggaggacatctggcgccatatacattccctattgccactgcgtgatgctgcccgtgctgcttgcttgtctcactcctttctacgttcctggaggtgtcatcccaacctcaccttaaatatgcatgttcttggctcaaatgcaaatgtacctcgagagaattccagctgcataattgacaatatcctgaggaaacactcaggcagccacattaacatactcaagcttcagttatatggtatttatgattcctaccagtatctggacagttggcttcaggttgctgttacacctgggattgaagaactcaccattgagccatgtcatagtagagtcaaaatgaagcagaatgtcccatgcaaagttttatcttatggggtccgaaactcaatccggtgtcttcaactttccttctgcgccttccatcccacagctgaccttggcctgttgagaaacctaacaagtttgtgcctggagtctgtgcatattttggatgatgagtttgagtgctttctttctaactcccctgctttagagcggttagacgtcaataattgctcagagataatgtgcatgaggataccttgcgtgctgctgcagcttcattgcttaaaggtttcttcttgcttgaatctgcgagtgctagagagcaaagctcgaaatctatccagttttattttaaattcaggatgtaatgtaaaagtctcacttggagaaacattgcaaatgaagagccttggcatgcgccgttcaaacctcatatgttatgcccgtgccgaatttccatccaatctgccaaaacttgagtctctttgcatcagttcagattctgagatggtcgatacacctatgctgcctagcaaattcctcttcctcaagcatctgcgtatttatctgggatgggccttttcctcgggctatgattttttttctctggtttctttccttgatgcttctccttgcttggagaatttattgttgaatcttcaggtatcccagcatgcatcggtttttgatggttcatcacagttgaggcagatgcctgaacagcaccatggctgcctcaagagtgtgaagttcataggttttaattcagagaagagcttggttgagctaacatgttatattctcaagaatgccaagtcacttggatgccttacactggacaccacttatggtgatcccaagtgtgataacaaaataatgaccggtggcatgtgcgctcccatgaataaaggttttctcatggaagcccgtagaggtgtcgcagcagttagaacatacattgaagataaagtcccgtctactgttaagctgacagtggtggagcactgtactcggtgccatgctgataacttatctgaataggttagacttgatgaaccatgcttttctttcttggatagcaaggcctgttcaatatttatcacagattcacagtagctgtgtaatattcctatagatggatgaaccatgctttgtgtcttgtgttattgtaccccttcaatttgagcgctttttcttttatttatttatt

SEQ ID NO: 178 - DNA, 2435 bp, Sorghum bicolor
aagaatggaaatcgcagtcggcggacggagctcgcagctcgtcgcttcgttgtaagctccgactccgagcctccgagcagtcgttcgttgaagaagctagctgctccttcctcctagtataaaggagcctccttttttcctttgccgtgccgcgccgtcccgtccattctgcttccgagccttccttctccccccctttcgccgccgccgccgcgtggttgggtgggtgtgtgctgtgctgtttgttccaacatcaccggagcgcagcgcagcgcagcgagcagccgaggagcggagccggagatgaggtgggcggcgttcctgtgggaaggcgcgtcccgggcgtccggcggccgccgcccgggggtctccaacctcctcctcgtcgtcgcagctgccagtagcggtggcctcgttgcctatgccgactccggatcagatgctgctgttgagaagccgcaacttcctccaaggaaaaaagttgtggtgcttgggactggttggggcggcaccacattcctgaggaatctcgatagcaggttgtacgatgtgcaggttatatctcctcggaactactttgcgtttacgccactgctcccgagtgtcacttctggaacagttgagcctaggagcattgttgagccaatccgtaggatcttggagaagaaaggtggagaaatcaaattttgggaagcagagtgcttcaagattgatccacaaagcaagaaaatccattgtcgctcgaatgttgggacaaatcttgaggggaatggcgagttctcggttgactatgactatctcgtggtagcagttggagctaggacaaatacattcaatactcctggcgtggtagagaattgccacttcttgaaggaagtagaggatgctcaaaagatcagacggagtgtgatggactgctttgagagagcaagcctccccttcctgaatgaagaagagaggaagaagaatcttcatttcgtggttgtgggtggtggacctactggagtggaatttgcagcatctctgcatgattttgttaccgaagatttatccaagctttatccctcggttcagcaccttgtcaagatatcactgatcgaagctgcagatcacatactgaccatgtttgacaagaggataactaactttgctgaggataagtttggaagggacggtattgatgtgaaaacaggatacaaagttgtgaaggtttctaaggatgatattaccatgcaaaatcctgccactggggatatttcagttccttatggcatggctgtctggtcaactggtattggaactcgtccattcgttgtggaatttatgaaacaaattggccaggccaatcggcgtgtcttagctactgatgaatggctaagggtccgtgaatgtgatggcgtctatgcaataggtgactgtgctacaataaaccagaggaaagtaatggaggacatttcagaaatattcagagttgcagataaggataagtctggaaccttgactgtgaaagaaattcaagatatcctggatgatatttacgtgagatacccacaagtacagctctaccttaagagcaagcagatgaacggcatcgctgatctagtaaggagtgccaaaggagacgctgaaaaggaatccatggaactgaacatcgaggaattcaagaaggctcttgcactcgtggattcgcaagtcaaattcttacctgcaactgctcaggtcgcatcccagcagggccaatatcttgctaggtgctttaacaagatgaaggatgctgaagaaaaccctgaaggtccaatccgcatcaggggagaaggccgccatcgcttccgccctttcaggtaccggcatctgggccaattcgccccactaggaggggagcaaactgctgcacagcttcccggggactggatctccattggccacagcacccagtggctctggtactccgtgtacgcaaccaaacaaatcagttggcgcacgaggatgctggtggtatctgactggacgcgcagattcatcttcggaagagactcgagttgcatatagtcaagagaaggaaaagattttgctgtgacatataatatatatatattcagatgaacggggccagtagagcctcttcccacttttttttagtctgatttcacataaatgttctttttttgttaagggaagaatgcgagttcccttgcactttgtatagtgcaccacgaagaaattcctttgtacctacctttttctggagagagttgtactgcacttttgcggcctgagtaactcagattcttttaatagctatttttttaccactaagatgtgatatgcaaaagggtcagttcggacctgattttgttgtgttaaatccctgctttggctgcccatggtaattaactagtgattcagttggttgcatgaattttgtggcgtttggt

SEQ ID NO: 179 - DNA, 2347 bp, Sorghum bicolor
agcacaaatcagcaataccaaaagatccataattaatctaacgtacacgtacgtagtccagctgatttgtccacgcggcatggcgacgcccagcgccgccgcctccagcagcttcctcgtcccggcgaccaccgctgtcgcctcgacaccctctgcatgcccatccacgctccccaagaagaatgccgctggcgctgggcgccggcggcaccgcacaatgcagtgcagggccagcagcggcggaggccgccgtggcgacggcgacgacgtcgacagccgcctcctttggctgccccgtcgtcaagtgctcaccggcctgagcggcgtcgccgccggcttcgtcgggtaccctgacgaccttgcgtccatcgccctcgccctggaggcgaaccccgtggagagctgccgccgcggggagaaggtgacggacaagatcgtggagtgctcggacccgaaccgcggcttcccgtgcccgccggcgacgcggatccccgtcgtcgacttcacgccggagcccaaggtgacgcgcatccggcagccggcgcacctcctggacgccgagtaccaggccaagtacaaggaggccgtccggaagatgcgggcgctggacaagtccaacccgctgagcttcgcggcgcaggcggccgtccacgagtcctactgcgacggccactaccggctggacccgtcggagaagaaccgccccttcgacgtccacttctcctggatcttcgcgccgtggcaccgcatgtacatctacttctacgagcgcgccctcggcgacctcatcggcgacgacaccttcgcgctgccgtactggggctgggacacccccgccggcatggggatccccgccgtcttcaagggggacgacgacaacccgctgttcgacccctaccggaacatggacaacaacgacgccctcatcgacctcgactacctgaaaactccccgacggccgaccgtcccgttcacgccgccgccggtgtccgacgccgccgcgcgccaggcctacgacgacgccgttcggaccaaccttgccaccgtatacattcagcaaatccgtgacggcaaggggcctcgtgcgttcctcggcgagaagctctgcagcgaggcgagctcccgggtgaaggaggtgaacgagcgttccaagaggcggcagggcgccggcgcgccgaaggtgaaggcgagcaacgcgcagggcacgctggaacggatggcgcacacgacggtgcacgtgtgggccggcaggtcgagccccaaggctccggcgacctgcacggtggacggcggcggggtggtggcgcacgacggcaagccgcactgcaacaacgacatggggttcctgggcacggcggggagggacccgctcttctactcgcaccacgccaatgtcgaccggatgtggcacctctggtccaccaagctcggcggcaagggcttcgacgacgcggagtggctcgacaccagcttcgtcttctacgacgacgtcaagagcccgcggctggtgcggatgaagttccgcgacgtgctcgacgtcaccaacctcggctacacctacgacaaggagtcggaggcggcgctgccgtggctcaagagcaagcccacccggttctcgtccggcaagacgccgtcgtcgtcggtgccggcggcggagcccaaggtggcgtcggagttcccgctgacgctgacgaaggaggcggtggacgtgccgtcggtggcgatcccggcgaagcagccagggaaggacctggtgctgctcatcgagggcatcgagtacgacccgcagatcaacaacaagttcgacgtgatcatcaacgtgcccaaggaggacgccggcaaggtggggcccaaggactgcgagtacgccggcagcttcaccgccgtgccgagctccaacgccgccggcgggacgctcgtggggaaggtcacgctcttcatcgacggggtgctggccgacctcgggctcaccaacgagagcgccgtcgacatcgtgctggttcctcacaccgacgaggagatcaagatctacctgccgccgaccatcgagaacgcatgagaacgcattgctggctgttatcttcgccgcgccgccgccggccggtgactgagcagcggcggcgatttctttttaataaggtttaaaaataaattagtaaaatgttctactcctgccgtttgattattgtgtttgtaagtttttaataaactggatgaaatgaaactccggcacattgcggcgggacagtaatatatggaatgcatgattcttgctacatgtaggtaggttttgagaaattgcatatatagtccgatgtggaaattaatgttgatttcaatgaatata

SEQ ID NO: 180 - DNA, 1259 bp, Sorghum bicolor
ctcctcctcgtctgcgcatccggccgtccgcatccctcctctcctcttccgcggcgcggcctggtgcaagaccaagatcaagggggaggagaaggccgcgatggcgagcggcgtcaacgatggcagcgggaagagcctgacgcattggctgcgggagaacgggttcgacgacgacgccgtggcgcgcatgtccaggcggtgcaggaacctgcacagcctcgacgccggcgaggcctcgggcgtctgggactacctcctgacgggcgtcaagatggagcggcggaagctgcggcacgtggtggccaagtgccccaaggtgctcaccctgtccgtggacggcaagctcgtgcccacggtgcagtgcctcgccacgctgcaggccaggcccggcgaggtggcgcaggccatcgccaagttcccacagatactgttccacagcgtcgaggagaagctctgcccgctgctcgccttcttccagacgctcggcgtctccgagaagcagctcgccaagctgctcatggtcaacccgcgcctcatcagctacagcatcgaggccaagttctcgcagaccgtcgacttccttgtcggccttggcatcgacaaggaaggcatgatcggcaagatcctcaccaaggagccgtacatcatgggatacagcgtcgacaagcggctgcgtcccactgccgagttcctcaagtcggcagtcgggttacaggggcaggatctcaaaagggtgatcatgagcttcccggacatactgtcgcgagatgtggataagattctgcggcccaatttagcgttcctgcagagctgtggattcagcaggaatcaggttacggctttggtagctggataccctcctgttctcatcaagagcatcaaacattgcctggagccaaggatgaagttcctggtcgaagaaatgggacgggacatgggcgaggtggtagattacccccagttctttcgccatggactcaagaggagcctggagtaccgtcacaaggtgctcaagcagatgaactcgagttgcagtctcagcgagatgctagactgtaaccagaagaagtttgccatgaaatttggtttggttgcagcagtttaggtactcatcttttctctagttccaatgtagtatgttttattctcaggtgaatcttttgtttgtaccatcaggttgtattgttcttgaatatttgggcaatgataattgataatgcaaggttcgctttcaagtttcaactggtatccttgagacc

SEQ ID NO: 181 - DNA, 2783 bp, Sorghum bicolor
agaacacactcgcctccctgacgctggatttaagcagagcagagagcagagcagagcaaccgcccgctcgcccactccgcccaccacgatctccctccctccgcacgccgcacgggcagacccagccaaggcacagccgagaaccgaagcacgccggccggcgggcgtcggcgtcgcctcccccgccggcggcctgctgctcgctcgtcctcgcttccgcattggatcacgcggcggttgggcgacttggtgtctgctgctggtggtgattgcgcctagccggtcgacgcggagacggcatcaagtttctaacaatttgaagtacccgaaatgggcgcaagagataatggggagggaagggatgagaagaagggaattggatcagattatgtacctactagagattccttttcttcacaaggtgagtctcgggttccaaggaagctcagtaaaaaggagacaaaagacaataatagcccccgaacaaccaaaagcagtgccagccgtcaagctcaaactaagctgcaacataaaggattaaacagtgtacagaacaagtctcagaaacaaaagaaaacagttagtcctgctaaggctgttgaagttagaaaaccagacattacaagaattccttcccgccctccgtcagaattgtctgaggaaacagatgatataatcagtgatgctggaactgttgatgataaaggcaccgaggaggccaaggagatcgatgtgttagatgaagctccacactgtgatcagagtactggtactgatgacgaaattcctgatattgaagacaaggtagttgatcatggaaaatcagttgtaggtcaaggcaatggggaattagtgttgaaaattgacaagttggaacaggaacttcgtgaagttgctgctcttgaagtttccctgtactctgtagtccccgagcatggaagttcagcacataagttgcacaccccagctcggcgtctttctaggctatatatccatgcatccaagttttggtctgaagataagagagcttcggtagcaaaaagcattgcttctggtcttgttcttgttgcaaaatccagtagcaatgatgcttcgaggctgacattctggctgtccaacacagttgtcctcagggagataattgtacaaacttttggcatctcacatcaatttactccatccatgacgactatgaacatgaatggtggtgccaaaaaacttgatgggaaatctatgacaatgctgtggagaaacaatttcaatggcatgcaaaccaaacttgctgcaatgcagatgccagatgattggcaggaaacaagtacacttttggctgcactagacaagatcgaatcttggatattttctcgcattgttgagacagtatggtggcaggcactaactcctcacatgcaaaaacggacggaaggcgcatcaactccaaaggctggtagagtgttaggtcctgctttgggtgatcagcagcagggcaccttttctgttaacctgtggaaggctgcgtttcatgatgcattcaacagaatgtgcccccttcgtgctggtggacatgagtgtggctgtttgccagtattagcaaaactggtgatggagcaatgtgtagcccgtttggatgttgccatgtttaatgccatccttcgtgaatcagcaagtgagataccaacagaccctatatctgacccaattgttgacccaaaagtcctaccgattccagctggtgatctaagctttgggtcaggcgcgcagctgaagaactctattggaaactggtccagatggctgacagataagcttggcatagatgatgatgattctgatgaaataggagatgttgaagatgaaagaagagggagagctgaaacaaaatcgtttcaactgcttaatgaattaagtgatctcctgatgctcccaaaggacatgcttcttgaaaaatctatcaggaaagaggtctgcccttcaattggccttcaattagtgacaagaatcctgtgcaacttcaccccagatgagttttgccctgatgcggttccaagcacggtcttagaagagctgaattctgagagcttgttggagcgtcacaccaacaaagacgtgatcaatgtgtttccatgcatcgctgctcctatagtgtaccgagcaccttcaacgttggatgcggcagagaaagtggcagacataggagttggcgcaaagctggacaggaaagcttcaatggtgcagaggagagggtataccagtgacgatgaccttgatgacctggattctccgcttgcatccctaatcgacaggagcgctccaccttcgccatcaaatggtttcacacatttcagttctcagagaggagtttccatggagaatacaagatacacgctcctaagagaagtatggctggagcaacggtgatggatgaacctgtaaaacctaaaatctcttctacagctgccccatgagaccaaaagaaggccctatttgcgtaggcccttcggcaatctctacactaaaaatgcgccactttcttgtacagtacattcccacaatcttatatatgttagctcttttgtagtatagtggcaagtcagcaactcagatacatacgaataacactatggacggtgcaagtttgtgaaatgaaagtatgtttaccaggccactgttgtgtaggcctgtagggtgtcggcaaagatacttatgcaatattgagcaacaattgtataatgatatgacattctcctcacctaacaatttgatgtgcacttgagacacttacc

SEQ ID NO: 182 - DNA, 3826 bp, Sorghum bicolor
ccactccactccactccacgccgccccatgccgacgccggtgcccgccgcgcgccagtgcctcgccccgcccgccgtcacggcgctcgacgccgccgtcgcctccgcgcgccgccgggcacacgcgcagaccacatccctccacctcatcgcctcgctgctcgcgcccaccgccgcgccgctgctccgcgacgcgctcgcccgcgcccgcagtgcggcctactctccccgcctccagctcaaggcgctcgacctctgcttcgccgtctccctcgaccgcctcccttccagcagcaatgaccagcacgagccccccgtcgccaactccctcatggccgccatcaagcgctcccaggccaaccagcgccggaacccggacacgttccacttctaccaccaccaccaccaggcgtccgcgtccgccaccgccgtcaaggtcgacctctcccacctcgtgctcgccatcctcgacgacccgctcgtcagccgcgtcttcgccgacgccggattccgcagcaacgagatcaaggtcgccatcctccgccccgcgccgcccgtcccgctgctcgcccgcgccggcctccccacgcgcgcccgcccgccgccgctcttcctctgcagcttcgccgccgcggacgacgccgacgtaccctcgcccgcgcctgccctcgccggggccgcgccgggagaggacaactgccgccgcatcaccgacatcctcgcccgcggacgcaaccccatgctcgtcggcgtcggggccgcgtccgccgccgcagacttcgcccacgcgtcaccgtaccgcgtcctccccgtcaatcatcagacggacctcctcgccgccgtcgcggcggcaccgacgacgacgcccggttctgggatcatcttcaccatcggtgacctcaaggacctggtgcccgacgaggccgacctgcaggacgcggctcgcagggttgtggcggaggtcacgcgcctgctcgagacgcacagagctgccgcccgccagacggtctgggtcatgggctggtcggccacctacgagacctacctcgccttcctttccaagttcccgctcgtcgacaaggactgggaactccagctgctgccaatcaccgccgtgcgcgacgccggccctgcgcccggacttgtgcctcctccagctccagtaaccacggttcctgccttgtccatgcctgccactacaagcttcgtggagtcatttgttccttttggaggttttatgtgcgatacctatgaagcaaattcctgccctcaggccctgcgatgtcaacagtgcaacgatagatatgagcaagaagttgcaactatcattagaggaagtggcattacagctgaagctcaccaagaaggtctaccttccatgctgcacaatggcagcatgatgggtcctaacaatgggtttgatgcactcaaggttagagacgatcatatggtattgagtacaaaaatacagaatctgaagaagaagtggaatgagtactgcctacgactccaccaaggttgcaataggatcaacagagatccttgccagttatttcgacatcacatggatgttcgagttgacagggaaagatgtgcaaatccaaaccaaagttcacagtcacttgcacttcaaagggaggttattagaccttctgcagtgtcttctctacataccaacacaactgcaaagagtatttcggcgccatctatttccacccaaatgaatgcagaccttgcattgaaccttcaagtcaggcaatcaaagagtgatgaacccctccaagatagggctgtgccatcccaacatagcaactcatcaaattgtgacaaccctgaagatcatgtgtcaccatcatctgctgcagctgtgaccactgacttggcgttggccacccctcgtggatcttcttccaaggattcaagtaatgcactgcgtaaacatgtagaggatgctgaagggtcgatccagctgatgcccaagaaggttgatgatctgaatcttaagcctcctcacttctctgcacagccttacacttgctttaggagttcctcaaattgggatcaaacttcacctagtgctctgcatccagcagcttcaggaggtgcttctgcctttggccaatggcagaggccttcacccctcgcagcacaaacttatgatttgagcaattacaagctactcatggaacgactgtttaaggctgttgggaggcaggaggaagccttgagtgctatttgtgcatccattgtgcggtgcaggtcaatggagaggcatcgtggtgcaaacaagaagaatgacatatggtttagtttttatggcccagatagcattgccaagcggagagttgctgtggcacttgctgagctcatgcacagtagctcagagaacctgatatatctggacctaagcctccatgactggggtaaccccaatttcagaggaaagcgtgccactgactgtatctctgaagagttgagaaagaagcggcgatcagttatctttcttgacaatgttgacaaagctgactgccttgttcaggagagcctgattcatgccatggagactggcaggtacaaggacttgcatgggggacgggtggctgaccttaatgactcaattgtggtgttgtctacaagaatgatccaaggatatcaagatgcctctcttgggatggaacaggacaatgctttttcagaagaaaaggttgtggcagctcgtggacatcaactgaagatcatagttgagccaggcacagccaacatcggtggagactctggaggcaaagttgtagtttcctcaaggcattccttgagaaacagtcaagcatctttgttgtctagttctttgagtaagcggaagctccacatctctgatgggcaagaaaagacagcagaatcaccgagcacttcaaagcgactgcatagaacatcaagcattccattcgacttgaacctcccaggtgatgaggccgaagcccatgatggtgatgatgacagcagtagcagccatgagaactcgtccagtgatctagagggatatgtgggcaacctcttacgttcagtggatgagtcaatcaatttcaaaccatttgactttggcaaactttgtgaggacatcatgcaggaatttagcagtactatgagcaagactctaggctccaggtgcaggctggagatcgatgctgtggctatggagcaagtagtggcagcggcatgggcatctgattcacatgagaagaggcctgtgcggacgtgggtggagcaggtgtttgccaggagccttgagcagctgaaagtcaggtgtaagaatttgagcagctgtactctgagattggttgcctgtgagaatgaaatgccggtgaaagaagatggttttggagctttccttccctcgacaatagttctggattggtgatggtgatatgtgtctgtatagggtttgcattattgctagctgtaagtattggttagcacataagtagtggttagcccaccccacccaccatagtgcatagtagcatatagtagtgtactagtatagcatcatatcattatttgggtatcttaaaaataatgtaattaagctgtatgtacgtacgtagcctagcaagctactcgttgaagtcgatgacttggggcttcacagattaggtagggtctgccatcagatcatgacgtccagacttggctgcttcggagcatcacatgatgtattgtgatcaatgatcatggctcatccctctgattgatggctctcaataaattgtattgttgctcgtacatgtgtatatttgttaatgtatttgtacggccgtgatggcctttca

SEQ ID NO: 183 - DNA, 2080 bp, Sorghum bicolor
aaggaaagaaaaaatcaacagaaacggggaagaaaaacggaaaaagaagagcagcgcggcggcgggcccaaactctgcgacgcgccgcaggaagaagaggactggctctaccgcaatcccgctatcctggcggcatccacgactccgatttccgttgtgcttccttttgctctaaaaggacctcatgacttgctctgctcttcagttgtctctctttctcggttctatatgccatagccagatagccttctagccttattttcctgctactttacttaagggcattcattcctacattttcctgttactttacttaagggatttattcctaattcattgcgcattggttatcctgacaaatgggagcattgctagcagatctctcttctctggataaccacaccaatcatgagggaatcgcctccaacgcagggggagccatctacatcttctgcggttgatgatagttactcagccgacagggttgaagattcacaactattcctctccgtacctgctttaaaccaagctgcatcttatcttgctcagacggcttcattcctcacccaatgcctcccagtacctggttatgtgggtctgtctgaggagggccaagaattagcaacacttccacctgcatcggcctcaggcaggctttctgttcagacttcttcagtagagcctgctggcaccaattcatcccttggtcaggcagattgtggtggaagcccctctcaagaaaacacaggacaaatggtgccttcgcatgtttttcagaatggagcttcactgttccaaggccttgttgagcgtgctcggaaaacggtccgtggttcagcagatgatattggctggctccagcgggatcaaagcttacctacaactgaggatggtacagccagattcttggagattttggactctgtaagaaaaaatgagcacaagctacctgattcagtggtttacttgttggttccaggtctgtttagtaaccatggaccactttactttgtcaagacaaaggcatatttctccaagatgggtctagcttgccatattgccaaaattcatagcgagtcttcagtgagtaaaaatgcacgagagataaaggaatacattgaagaaatatactggggatcaaggaaacgtgtgctacttcttggtcacagcaagggcggtgttgatgcagctgcagccctctccctctactggccacaactcaaagacaaagtcgcaggtttagtattagcccaaagtccatatggtggaagccctgttgcttcagatatcctgcgagaggggcagcttggtgactacgtcaggctgcgtaagatcatggagatcttggtatccaaggtccttaagggtgatctgcaggctctagaagatctgacttatgaaaggcggaaagaattcctgcgacagcacccgttgcctcaggatgttccgatcgtttcgttccacacggaggcaagcatcactcccagtgtgctcacagcgctctctcacgttgcacacctggagctcccaattgctgccgacggcaattccaccaggatcccagttgtaatgccactttcagcggcaatggcagcatgctcgcaactgctggtggcaaggtatggcgagaagagtgacggtcttgtgacgcggaaggatgctgaggttcctgggtcagtggtggtccgtcctgagcggaagctagaccacgcatggatggtgtattcgtcgctgaaggaagagcccagggatcaggcggacacgtcgcaggtatgcgaagccctgctgactctacttgttgaggttgcacagaagagaaggcatgagatggccatgaaagacgagtgaaagtagctttttggtagattttcggtgttggccggagatagtgagatgagatgtgtatcctccctgtaatcgtacactggttgttgccgactgtacagaattgttctgctcaaagtgcttggggacatttttttgtttggctgacagaagcttgtgaataattctcttgcatatatcatgtgaagttcagaggtggatggaaaaggctctggcagggtattgtaggtctttt

SEQ ID NO: 184 - DNA, 1977 bp, Sorghum bicolor
tcaatttagccggcccggcccataatcccttgtaagagaggcttttgctaggtttttgccccaaccgcccgcccaggttcgtgcttctgcccacccacccctccactcccggcgggcggcggctgcctcgccgaagcggtccagccggcgcgcccgagatggcgaagggcgacgacgcgctggcgcggaagcgcaaccgggtgcgccgcaagcgcctccgcagcagcgagaacgctgtctccgcgcgggtcgcggcaatcatcgcctccaagcgccgccgcaagtcggggaagcgccgcggctgcgagggcatgtgcttctcgctccctacgcccgacgacccattcaacgagcgccacggcaagaagcgcaaggtcgatgacgagccgaccgaggacacagccgccgccaaggacggcgacgaccccaagaagaagggcgcgaacaccaaaaaggagcagccggtggcaaaggccggcgccgaggccaaggccaaggccaaggccaagtcgaaggcagttcgcgagagggcgacgggagcggatgagggccgcgtggacttggaccggccctccaagttcctggtggtctgcctcaacgccatccgggacacgctggcgcccgaggacggcggcggcagcattcacggcgccggcgactggggcgtggagctctggcggtgctgctccgcccaggcgccgtccgacgtgctcgacgctagcggcgcgtgcgccacggtggaccagaccgcgtggctcgtctccaccgcctgcgacatcgtcgctaggaaggagaggcttgggatggtcgtgtcctgccccttcctgctgtacctcgtcccgtcccaggagaaggccgcgcaggtgcgatcgatatgcaaacccctgaagcctcttgggattcattcagtgagcttgcatcctggcgcatccattgaacaccagatttctggactgaaaacttgtgagccggagtttcttatagctacccctgagaggcttcttgaacttgtttcgttaaaggcgattgacatatcaagtgtatcaatgctggtcattgatggactgaaatgtttcgtggaccacaatgccagtgacaaaatattttctattagagacgccatatcaaacaatcctcagattactatcttcaccgatccatctgataaaaaggttgcagcaatggctaaaagcctactccgtggaagaattacaaagctttctatcaatgattctgtttcttcacgaagtgcatttatagcccagcatgtacacttctgtccatcagaggagctgaaaacatcaaaggtcaaggaaattcttgaggggatattgcaaagtcatcctaaaaagacatcgaaggttcttctagtagtcgcaaacgatcaaaaagcgcgatacatgtcatcgtcacttaagctgaaaaattgcacagtgattgatgattcacatggcagctcttttacgatatgcagcagtttggggctgatgaatgtcattgtgaaagatcgggagaacatggcagtgacagatgcagaggaatttgaaacagtgctggtggtggatctgcctccttcagtcgacgaatatgttgagatcctcactggggttgctcttcatgtgattggaggcgaagtgcatagtatattctgtaacgctgatgcgtctattgcaaaacctctggcggagcttcttgcagattgccgtcaggtggtgcctgagtttttcaaaaacctggagtcttcatagcagacttgtgtacacaatcagaatagtcagatcatatcgtggtgcggttgtggcacttaactgtcaccaatcaattttgttattttttgtgttgggttctacatgtaattctcatttgtcagccaacattggtattcaggcctcgaccttgatatgtgtactaatgtactattatctcatacattgtgaaatgtgaatgccctgaagccctttacctggaagaactgga

SEQ ID NO: 185 - DNA, 2801 bp, Sorghum bicolor
gcgccaagcccttcatccagctgatgtagcaatagttactcacctttgatcctcactatactgatacttcaagatggaacaaatttcacttggcaacagatacaaggagtgcaggccacgaagaactagcagctgtcaaacaaaaatacttgttggaaaggatgtattgcatgaactagagcaaaggcgttcatcaccaagtgtgattgcaaaactgatgggaattgatgtgttgccacctaatgtggtcaatagtcggcatcaagaatttaaggatgtttttgaagtgtcagaggagccaccagaggctgtcacaaaagagaggtcccatcatttcccaaaaggcttgccaagcttgaaacaaagtgcactaagattaaaaaagcttatgccatcaaaaacactctacagagatgatacacatgattgtcatgtggatagcacagatggcttgggtcgcttgaactcagtggaaataaataatcctttatttgagaagcgccctcgtgacatgaactattctgcaaattatcagtacgagaaaaatacatcaagtgactgcaggacttaccctgtgggtttagccaattcttcactcagcaatttcagccttttatcaagaggaaaaaacaaagattttaacaacattgttcttctggaaccaccatgcttggacaaagggcatgatccagaaaacgttttttccattccatacctatctcctctcaataagaactgcaggagaggcatgaaacataagcaatctgagtttcctgtaatggagaatggaagagattggcaacatatattaagtactgaagataataatgtgcctcgaattagaaaagaaagattcttgactagtgaccccattgatcgactgcaaattggacaggaagcatcagttcatcagtttggcaatactgatgcgagttgtcctggatcatcacagaggtatttttgtggtaatgataactttaatcaaactaataggtcatcatcaaacagcacgctgttgaaaatacgccggcatgcggaatctgctgttggttcaaaaactcttgcacaaatgtttgctctatctgattctgaaagactcaagctaaattcaaactcacgtgctccaattcggcgtaatatgattgaccgtgataatggtcatagcaaggatggatgctttatagttttaccaaagcatgcacctctgcagtctatccgaagctcaatggacaggaattcttgctcggaaggctcctctcagggtaaaaaaaattcaaatatatccaatatttacaacaacgggaagtgtcagtttgattatttccgggataaaccaagactgctgaagcaaattggcagtggcagtgaagctcactcagctcacttgagcaatgcttgctgtttccaaaacctgacagcagataacttttcaagtcctgattgcttaaatgagaaagtattgttcacaacagatgaagacttagtgctacaaccaccagaatccgtagcttctgggttcaacttgcaggtttctaggaaacaacgggtgacaatactgcctttccgttgtcacgaggatgaattaatatctgtttcggatcatactgacagtacaaaatcttgtaaaggctcaaaagaggttgagcaaccgagcccagtgtccatccttgagcctccaattgatgacgatatttgttttccaggatgtttggactatgatgacttgcaagggatggctaagaaacaaagagatggccatcaatatcacaatgaatctgaagttgccatgtcaagtgatgatgaagaccattctttttaccaatctttggaagcatttcaggtcgaggaaaactgggacttctcatatcttcttgacatacttatatgctctggtatcatagttgctgactggcagctcatctgcaagtcatggtacttgcctggttgccctgttggccctcatgtctttgatagacttgagaggaagtacaacaaaatcgccacatgggcaaagcctgagaggaggcttctgtttgacctcgtgaattcaatcctttctgaggtccttgcaccatgtgttgatgtgcacccatgggtgcggcctaatagacactgtgtggctctttggggtcctgaaggtcctgttgagaaggtttggcagacaattgttaggcagcgggaagattgtgtcacagggcaacctgatgagatggttcttgatacaaaatggctggaagtaggcaacgacatcaatatggtggggaagcagatagctatgatgttacatggcgacctcttggaagaagtcatagtggacttcctgtgatgagttggtagtttcttgaggacctaattaagaacttggcaatggtagcagaatactatggcgacatggggttcgcccaaacttcaagcagattatgctgaagtatgtaacagcttttcaagtgcacatatgctgcatttttcttctggttataataggagctatgaatcgtgccattacactggagagcagaatatacaggccaaaaaaacactaatgcaggtatttctggattctgtactgataagctgtcctatctgatgctttgatgtgtgtagtaaatgtaagctagaaaaatacctatccgccatccaggtttgaggatgtcagtagatatttaggattcaatatttgctaacgtgcagcacatattagagggttctatcatcttaagcctataggcattcgacatgtaatgtaatcgacagttgcagagtatacatatttaggatctgagttaattgtcctgtttctg

SEQ ID NO: 186 - DNA, 1585 bp, Sorghum bicolor
gctcgtatcttatctctactaccgcggccgtagtgccatcgtgcgagcgcagcgcggagagagtagaaggaagcaagtgtgtgtccgtctcatacctactggggttggctggtgtggtgtttgagacgtgcggtcgggagagcggatggagaggaagggagggtgctgcctcgcgccgaggtacggcgccgccgggcctgcggccgcgcagcagcaggcaggcgcggcgtggcagatgggcaggatcatgctcaagttccgcccgattgcacctaagccggcggccatggcgcccgtgccggcaccgacgccggtggtggctgggccgtccgttggtgcggccgggagagggaagcgaaaagccgtgtgcggtgcaggcggcgggaggagggggcggaagcccaagaaggcggctgcggtggtgactgcagcgcctgcgcttgcagcggcggcggcgcaggatgcgggcgactgcaagaaggactgcgagaaggagaagtcgtcgtcgtcgcggtcctcgtcctcgtcggggatgacgtccgtggactcgtcgccgccgccgccgcagcaccacctcccgacgctgctgccgctcatgcccgtgacggcggtggaggataagggccccgctgctggtgctgcgacagaggagcttccggcgcctgtgccgtctcaggtggccgcggcagccacggggtcggcacggccgtttgctccgcgggcgttgcgcccaggctccgcggcttgggcggcttcgttggtgacggtggaggaggtgaccgcgacgtggcgcgacggcgaggcgccgccgtcctccgcggcgtgcgtcgccgacgacgccccggcgttcgtgtcggaccagtggggccgcgtcacgtggaggaacgccgcgttcgtccgggctgtacccgcggacgacggcggcgacgaggtggagacgcagacgcccgtggcgctcagcggcgcgctcccggcgtggggcacctgctcgggattcacgtgccgcgtccgctggcactcgagcccccggcgcgtgggttccacttcctccgtggtggcgccctgcgatgtgtggcggctggacgccggcggcagctacctttggcggctggacctgcaggccgctctcactctcggcggccgcctgtgactgtgaaaacccgcctgtgactgtcaagttctgaaccccagcaacgaatatgctgtagtactcctacgtgcggattagtagtgttttattctgagattggaaaccatatgcgttcttactgacgtacggtatggtttaatcggcgtattgctatcctggtcgggcttaattaaggatgtttgaagccagattgggtattactaattatggattagtttagatcccttggaatgggagtgagtgacttgccaggacttaagaagaaaccaaagcatgtgacgaatgcttctggatgtgcagagttcagtcttccttcttcagcagcacagaatcttgctcttctcatttgttttccttttcttctcttgagggcacccttaacgtaaactatagtttttattatgaatatttattataatgttacttaagtgtttt

SEQ ID NO: 187 - DNA, 1634 bp, Sorghum bicolor
gccgttcgttaccgggtcagtgccgccgtcagtagcagagcagtaggtggtccgtcagtcaatcgtccgctcgtccattcgatccagctttcttgctcttgaccggccaaccatccatccatccaccggcgagctcacagccaggcgatcccgccgtgaacataaaggcgagcgcgagcgcgagagcacactgttgcattgctgattgctctgtctcctccgacctccgcctcgtctcgctcaacatgaggagagcaggcgggctagcgcgcgccggccatggcgcggcgacggcggcggggcgtgcgacgaaggtgatgcgggcggcggtgtccgcgttcttcgccgggtaccactgcttcacctccgtcgcggcgctcctggcgctgccgttctcggcggcggtgctggcgtcggaggccatggcgccgtcgtcggggatcctgcgcggcgtggcggcgcggctccgcgccgtgttcgccgcggccgggttcccaccttccccgttcttcgcgctgctcgaggccaagctgtcccagaccgtcttcacgttcgccgccacgctgccgttcgcgctcaccttcttgctcctcgccaaggcctgcgtcgccgccatgctccgggacgacgtcgacgacgggcaccggcggcggcggcggctcgccgtcgccgtcgccaagctcccgccgtgcggggccgtggcgcgcgcgtacccggcggtggtggcgacgcacctgctcaacgcgttcctcatgctgtccgccaacgcggccgtgttctcgctgctgctgctggcgttcggcgccgccgacctgctgggcctcacctcccacttctggacgctggcgctgtcggccgccggcgccatcgtctactcgctggcggtcggcgtggccaccgtggtgtgcaacctcgccgtggtcgtggccgccacggagcccgggtgcgcgggccacgccgcggtgctcagggcctgcgtggccatccgggggcgggtgtccacggcgctggcgctcgcgctgcccaccaacctcggcatggcggcggccgaggcgctgttcggactccgcgtcgtcgcgcagcggcggaaggacggcggcaggctcgcgccgggcgtcgctggcgaggccttctcgatcgcttacatccatgcgatctgcgtcgtgctggagatcatcgtcagctgcatgttttacaggagctgcaagaggagtgaagccgacgagctcagagagctcgagccagaggagaagggagatctccaggcttgatcagtgatcacctctcaacttcagcttcagtctggtgcatgaacaaggaaaaaaacatacaaatagtagaatcatagtttgtttgtctttctgatgagaagcaagaggatcagatcatagggtacagagctgatccagagaaatatagtggtaagccaagatagattttctgcaaaaatgtttcttttttatgaaaagaaaatggtaaaaaattgagttcaaataaatggttatcttgtacataaggagatactctcttcaactgaaataagaaagcagggaattggagattgtttggagttgttactttaggaaaaataggacagttgtagacttcgcaaatttcatacattctgttctttg

SEQ ID NO: 188 - DNA, 643 bp, Sorghum bicolor
tgacagacacggcagcaaccaacagctcatccacatccaaagcctttccattccatctcacgcacactctgcgtcggatccaagcaagcaaagcgtctccatggcttcgacgacggcgtccaacctgggcggggcgtggttcggcgagctggcttcagcgctgcaggggacgtggcaggcggtggccgccaccgccggcgaggacccgcggcagctccagcagcagaagccggcacgaggcggcggcagcagcaacaaggcggcgcagggcaaggaggagggggacgtcgcgaggtgcggcggcgccatgtccgacaccacgctctacctgctgctcgaccggttcacgcccaactgagctgaccggacccccttggtcgcccgtcgtgtccgtcggcgcgtgctgtagtactctactgtactgtacaggcggaataactgcgcgccatggttttgtgtaaatgctgtaaattgcaatgccatgtttctaatctgatgattactcactttcccctgttctttcgctccatgagcaggccattgtttagttccaaaaaattttataaaatttttcagattcacatcgaatcttacggcacggaacattaaatataaataaaaagaataactacttacacagttt

SEQ ID NO: 189 - DNA, 1617 bp, Sorghum bicolor
ctactcccagcctcccactcccaccgccgcccgcgcgacacctcgtccccggaatggctgcgggctcgtccgtggtctgggccgcgcaccacccgtcgccgtcccactcccaccaccaccgcccgcgccgcgtcgtcctcttacccccgccgccgccgctaccggcgaggcggggcggcgcgtccctcgcgcgttcgccgcgcgccagcctcgccgccgccgcacccgcggtggcggtgaggacggcgtcggaggaggccgtgtacgaggtcgtgctgcggcaggcggcgctcgtgaagaccgcggcgccgcagcggacgacgcggtgggcggaggaggagaagaaggaagaggaggaaggggtcgtcggctggggcctcctcggcgacgcctacgaccgctgcggcgaggtctgcgccgagtacgccaagaccttctacctcggcacacagctcatgactcctgagaggcgcaaagctgtctgggcaatctacgtgtggtgcagaagaactgatgagctagtggacggtcctaacgcatcttacatcacgccaactgctcttgatcgctgggagaagcgattggaggatctcttcgaaggccgcccgtatgatatgtacgatgccgccctctcagacacggtctcaaagttcccggttgatatccagccgttcaaagacatgattgaaggaatgaggctggacttgtggaagtcgaggtacatgacctttgatgagctctacctctactgctactacgtcgctggcacggttggcctcatgacagttcctgtcatgggcattgcccctgactcaaaggcctcaacagagagcgtgtacaatgctgcactggctcttggcattgctaaccagctgacgaatattctcagagatgtaggcgaagatgcgaggagggggagaatataccttcccttggacgagcttgcacaggcaggtcttacagaagaagacatattcagagggaaagtgacagataagtggaggaggttcatgaagggccagattcagcgtgccagattgttctttgatgaggctgagaagggcgtcgcccatctagactctgctagcagatggccggttcttgcgtctctttggctgtacaggcagatccttgatgccattgaggcaaacgactacaacaacttcaccaagcgtgcgtacgtcggcaaggccaagaagctgctgtcattaccggttgcatatgcaagggctgctgttgcatcatgaaccatctgtagatcagatgttttttttcttttccaaacccagtttgttaccccctcacctcccatttttttgcttggtttctttgctcttgtatataatcagcttcagctgcctgcatggcataatccttgcctgtcacatacagttcttagttcagaggggactgattccatgtccctcaatactcggctcttgttaccagaaggaatgaagaattagaattcgagaagcatacttgccaattgtcttggatgatctctgtgcatttatcttcagaattcagactcaccagattgattactgtgtgagaggctgttcaggtgttctgctttgggtaaaaaatcacaatgaccttaatcttacatttctc

SEQ ID NO: 190 - DNA, 2083 bp, Sorghum bicolor
ccaccaccatcactccctccctcagtgcagctctcctctcctctcctttcacgaactcccccctcctccgctagccgccgacactccattactgctccacccatatccagccagagctcggcggccggcgatggacctgcggcggcggcggctggcgctggctgtgttggcggcggtggccatgtgcgccgccacactgacggcggtggtggaggggttcgacatcctggagatcctggggaagcacgacgagttctcgcagttctgcaagctgctcaacgagacgcacctcgccggggacatcaaccgcgaccggaccatcaccgtgctcgccgtcgccaacggcgacatgggccacctcaccggcggccactactcgctcggcacgctccgtcacatcctcgagctccacgtcgtcgccgactactacgacgataagaagctcaagcagctgtcgcacgccgccaccgccgcatccaccatgttccagcgatccggatttgcccccggcatggcaggatacgtgaacataacgcagcaccgcggcggcaaggtgtcgttcatcgtggatgacgcagcggacagcgtgaagcccgtcacctacgtgaagcagatcgagagccaccggtacgactactcggtgctccaggtgagcggcgtgctgtcgtcgccggaggcggaggcgcccgtggccccgccggcgcccgtcaacctcaccgacatcctctccaagaagtactgcaagagcttcgcggcgctgctggccgccgacgccaaggtgttcgacgccatcaatggcaccaaggacacggcgctgaccgtcttctgccccgtcgacgcggcggtggcggcattcatgcccaagttcaagaacctgacggcgaaggcgaagacagccatcctgctgtaccatgccatcccggactactactccatgcagttcctcaagtccaacaagggcaaggtcaccacgctcgccaccaccaacaccaacaagaaggactacacgtatgaggccgagagcaaggatgacacggtcacgctcgacaccaccgtcgtcacctccaccatccaggccaccgtcagggacgacgacccacttgccgtctatgctgtgtccaagttcctgcagcctaaggagctgttcaaggcgaagacggcagaccttgcgcctgcgcctgctccggaagggccaaagaagaagaagaagaagaagcccgccagcggctctgcagccgctgcgccttcggacgatgactctgcagatggcccgtctgccgacgactcatccgatgacgccgccgacaaggccgccgctgcgccggcgtccctgtttgcccggtgggtgacgatcgccgtggcgctggcgctggcgttggcagcctaagtaaggtgtgcgctcatgtgctatgtttttgttttgtttagcttattttggaccctatcttcttttctttgtccaattcgtgtcccttccttgttggtgcagaaaataagaagggctatttttaattttatatttatttattaccgcattccataaaaaaaagagagaaaaggtgagaggtgtgtgtgagtgatgtaactcttttgattttgttcattgggtttgtggtgatcattttgtaatgatagtggccaattggagagtgggttaagttttcacatatgagtcatcatatggagtttagaaaagcagcagtgtttgttgcttgctttcattcaacctgtctgtgcttgagctttcggagtcacatgcctcaaaattgtcgcaaaaccctcatggaaaagttacaaaaggggtacaaagaagacattagcatgtgaaggctttgcttcctcgggttgtaaagggatatatgcctatgtgatttagtcactttagctgctacgatgatctgttctggtacaattataaacagggatgttaatgggagtttcttcattacgatatgggaagagatgggcaaatgggtttcagatatattttcgtgattcacatgatcactcaaaaacaaaaagaagaaacacgatcctcattatctgacaaagcaccttggaaaggcaggtgtaggagttttac

SEQ ID NO: 191 - DNA, 1086 bp, Sorghum bicolor
ggtggccacaggctctggtagcacgacacggtcccccccacaaccaccacccggcccaacgcctccaacgacctccgtcctccgcccaaaatactccgctcgctctccctgttcctgtttctcggtgttgccccctcggctcggccctcgtcggcggactctgctgctcctcatggcgccgtcctcctcctccccgtcctcgttgtcgtcgtcgggcggctcccacgcgggcctcgccatcgcggccaccgccatggcgctctccggcacgctcgtcctctactccctgtgccgcgccaagcagccgcacctggtcccctccgacgccgccccgtcccctcgtctccgcccgtgcctcgcctcgtccgacaagcggaagaagaagaagcgggagatggcgcggcgagggaagagccagcagaagcgggtgcgcttcgcggacgacgtcgtggacaccaaggacaatggcgccgccaacgccgctgccgccggggcggcgcgggaggaggcggaggcggaggccgagccgtcgtgctgtaccgcggcgctgaggacgacgcccatgccggccaaccgggaggcgctgtaccgcggcatgctccgcggccggtccatgctcagggtcacctgctcctactagctaagctagcagggtagcagtagcaccacctgccggcggccccccgacgtaaccactccatcatccattaatctagacctctccgacctccagcaagcttgctcctctccgtgtctcttctctactcttgtgtgcgcgtgctgtgctgtgctgccaactagtggcggcgctgctaattagttgcccggaattaattaatcgggcctagatagctccctccctcgcccatttgtttgctgggaaagttttgtaattagtggccgtccccgcgaggcgagggagctgatccgtgcgtgctttactgttgatgctgtgttgcttgtatgtatggtagcttctttgcttgtactacattagtgttgtactgagtgatgatgatcagtgaaacgattcttcactgttccaagctaaccatctttctttcactcgtacagagactctcttca

SEQ ID NO: 192 - DNA, 1441 bp, Sorghum bicolor
gagagagagggggagcagagagagagaggagggagtggcgtctgtcgtcatgctgctgcggagcgcgtcctcgccgctgctcaactgcgtacgtgcgccggctgcgtcggcggcggcggcggtcgagcacctcgcggtggtttcgccgttgctgtcaccggcggtggcggcggcgccgaggcagggggcggtgctgtgccgcgccatgtccgagggtgacctcgcggcgccgctcgtcccggccaagaaggaccacgagggactgcacgggagggcgctgccgaggctgtcggcgtcctcgtcctcgtccgcctccatctcgctcgaggaggacgacagcgagggcgttggcgaggaggaggaggaggaggagaccgtggtcgcggtcggcgccgacgtgccgctgccgctgcgtcggctgctgacgagcacggggctggacgtgtccgcgtccgtgtccgtgtccgcggccgcggcgcgcgaggcgctggcgctcgtggagctgcagggcgtcgggggcagcagcgggggcgggaacgggaaggctctcggcagcagcggtggccagggtggtgtcggggacggcggcggtggcggtggcgacaaccgcgccgccacggacacgcactaccggcagatgatcgaggcggacccgggcaactcgctgctgctggtcaactacgccaggttcctcaaggaggtggagggggacgccgcgagggcgcaggagtactgcgagcgcgccatcctcgccagccccggcgacgccgaggcgctgtcgctctacgcgggcctcgtttgggagaccagccgcgacgctgcccgcgccgacgactactacagccgcgccgtccaggccgcgcccgacgactgctacgtcctgggctcctacgccgggttcctgtgggacgccgaggaggacgacgaagagaatgacaactccgagaccttgccaccgccttcgctgttccagggggcggttcagcatccttccatcacagcggcatcttagatgaacatgaactcgatctagatctcaccaccgcttgtgaacgaagctgaatctggaactctgaagagcaccatgcgagaaaccagaccggccccctacgagtcaccgacatcgctggccggctcctcgccgcttgtgaactgatgaatcacggctgatgaatcacggcacatgtaaaaactgaatctggcagagcacaaacgcgtaagcctcttaaggtttggcacctgaagaatttgcagggctatgtatagtagacatgtagattgagaccctgcagagcttctacatgcagaatgttattggtcacttgtgtatcagtactagtaatgcagtatcccttgtgaaataaaggttttcctgctgcttcgtcagtactagtaatgtagtatccctttgtgaaataaaggttttcctgctgcttcatca

SEQ ID NO: 193 - DNA, 1029 bp, Sorghum bicolor
atgggtcacggccacggcggcggctgccgctgctgcgagctctgcggcgcgccggcggccgtgcactgcgcggcggacgcggccttcctctgcgccgcctgcgacgccaaggtgcacggcgccaacttcctcgcgtcgcgccaccaccgcacgcgcctccacctcgcgggaacgccggacgaggaggagtacgagtccgccgcggcgagctcctgcgtgtccacggccgactcggcgtcgtcgtccgcggcgccgcggcggaggaggcgccccgcaccggccgggagcgggagcgggagcccgaggctcaggcccccgtgcgaggcggtgctcgaggcgtgggccaagcgggcaggcctcgcggcgggagcggcggcacgccggcgcgccgcgcgtgcggtccgggcctgcgcccacgacctcgcctccgcgcgcgtcccgccgcgcgtcgccatggccgcggcgctgtggcgggaggtggcggggcgcggcggtgggatcatcggtgccggcggcggcggcggctgcggccacgacgaggcgctgcggcggctggaggcgtgcgcgcacgtgccggcgaggctcgtggtggcggtggccacgtccctggcgcgcgcacgcgcgcgcaggcggaggagggccgccacggacgccgtggagggttgggacgagtgcgcgtgggccgggcccaagtccagcccggcacgttcttgatcttgttccgtcaccgtcaccgcatcttttgttgtgctcgctgaagaaacaacacgagacgagcatgagtgatgagaggaacagatttcgtaccggatttgtggaccttgtttgtttgatttcgtttgcccaagatccaagcaaactgagaaaaacttgtggttaggaataggggaaagagcatacataaagttgggggtcttaatgtaggtcagcagtgtatttgattagagcatctccaagggttttgcaaataaactttgtattactttatttgcaaaaaagagtagaaagtatctctccaatggttttgca

SEQ ID NO: 194 - DNA, 1676 bp, Sorghum bicolor
ccacgggccggactcgagattcggcccacccacgtgttctggtggatcacgcgtcttctcctccaaccgcaccgatatcttcctctcccgtagggcaagggcggtggggcgatccgtcggcggcgtcggtggtggtggaggaggatggccgacgtgcagggagacaaggaggcaggcctggaggacgacgattttcccgacgacgggcctttggtgccggaggatccaggtgaaggaggagaaccccgcagcggaggcgacgaggaagaggaggacgacgtcgacggcctcgccagcttcctcgagtcggagatcctctccggatccaacgacgaggatcctattgatcaggagcagcggaagcaggaggaggacggtggtgccgcgaagaataagcggaagcagggctcgggatcggacgggcatggctgcagcggcagcggcagtgagggggagcagaccaagagggcgaggagggaggagatgaggaggcaggcgaaagggaaggccgtggcgcctcagatcgacacgggcatgttcagcaacatcccccctgagctgttcctgcagatcttcaagttcctctcctccgaggacctcatctcctgcgctctggtctgccgcttcatgaacgctgctgcgtccgatgagaccctctggcgccgcttgtactgcatgaggtggggactggcatccaatgccaaattcagggagtgcgcttggaagaacctctacatacagagagatagagaggatatggttgaatttgtgaggaatacccctacagagttcaaggagtactatattcagatgcaggctgcaaaaaggagtcaaactccccatccgtcagaagtcaacgacgacaaggttatgcttgataagacagtagctgatcaagtatctagttggaaaaacagccgggggcttactgatgaagctgtcaaggggcactcttgttctggaaatacatgctcgtacacccagattggcgatgcttacatttgtgagaagactggtcgtgtccatgtttgtgatgacgcttgtcgtgaatttgtcttggaccaatctagtgggctgcttctttgtacaatatctggccactgctttgagaggtggctgtgtcctgatgatgaatgggaagctgatgataatgatctgcaacaagctggtgtagtggatgaagcagagccattcatgggatctggacgctacgcgcgagcaattatgttgggttacaactgcaccgatgagaaggaacttgaggatgccttgggtctctgttgatgtgtttctgtcgatatgtccttcactcttgctacatgatcgagtttctacttgtgaagatgaaacaagcagaatgcaggatgtatagccctgtgctatgttttaccatatttcaccctccaggatgtacctaagaatagaacttacttttgaggtagatcgctgatatgttttgatcagctgagggagtttgttatgttgtcgtatggtttcctaaattatcgagatgtatgcctgtaataaaatgcttttttacataatgagttttttttgtttgtatgatatgatacgatgttggcacttcggtagatgcatgtaataaaagtgctaagatgtagcatgcggagcaccaaaggcttcattttgcaggtcagatctacgtcttctgcatg

SEQ ID NO: 195 - DNA, 1194 bp, Triticum aestivum
ccacagatcttccccggcaaccacttgctatgcacactcaaatcatggacatggcctctcctccgagcggagcctccagtgagcaggacggcatccccgtcgtcgacctggccgtcctcctcaacggcgacgccggcgaacggtcgcaggcgatccggcacctcggccgggcgtgccaacactggggcttcttcatggtgaccaaccatggggtgcccgaggctctccagagcgcgatgatggacgcgtgcagggagctgttcggcctaccaccggaggaaaatgcggagttcatggacgccggccccatggaccccgtgcgcgtcggcacgggcttcaactccgccgtcgacggcgccaggtactggcgggactacgtcaagatgttcgcgcaccccgagctccactgccccgccaagcccgacgccctgcggggcgtggccgcggagtacgcggcgcgcaccagggccctgctgctggacctcacggcggccatctccgagagcctggggctccacgccggccgcgtcgctgagcgcctcgacctggggtcctgcttccagatcctcgtcggcaaccattacccgccgtgcgctgccggcccgggcgacgacgacgatggggctgtcgggctgccggctcactctgaccacggcctcctcactctgctctgccagaacggcgtcgatggcctccaggtcaagcacgacggccggtggctcctcgccaagcccatccccggcgcattcttcgtcatcgcgggcgatcagctcgagattgtgagcaatggaaggtataagggcgtgctccaccgcgcattggtcgaccgcgagcaggcgaggatgtcgtgcgtgagcctcatcgggccgtgcctggacgccgtcgtcgagccagtgccggagctggccgtgccacccctgggcggcctcgagttcaggggggtcaagtacagggactacatggaacaccagcagagcaacaagctcaacgagaagggagcgctggacctcgttcgggtgcagaaacgcccagcaattctttatacctaatttatactagagcatgattcctcaggttaaaattctcaagttgaccaaaaattccgtgtccatatttgttttattttagcaaccgaccagacctctggcttttcatcattaataagaattgcgagaattgacagtaaaaaaaaaa

SEQ ID NO: 196 - DNA, 1928 bp, Brachypodium distachyon
gggggtgccacagccaccgcgttaccgcagccatgcgtcgtctcagccactttctcctcctcaccgtagtcctcgccgccgtcccgcgcccagctcacccgctcaccgagctcgagtcctcccaaatccgccgcttccaggactacctccgcatctgcaccgcacacccttccccggactacgccggtgcgtccgctttcttcctcccctacgccgcgtccctcggcctcggcgccaccacgctccacttcaccccttgcaagtcaaagcccctcctcctcctcacctggccgggcaccgacccctccctcccttccatcctcctcaactcccacatcgactccgtcccagcggaacccgagcactggatccacccgcccttcgccgcgcaccatgaccccgccaacggccgtgtctacgcccgcggcgcgcaggacgacaagtgcctccccatccagtacctcgaggccatccgcggcctccaggccgccggcttcgctcccccccgcaccgtccacatctcgcttgtccccgacgaggagatcggtggcgaagacggccatgagaagttcgtccagtcggaggagttccgggccctcaatgtagggttcatgctggacgaggggcaggcgtcgctgacggacgagtacagggttttctatggggataggctggtgtggaagctaatcgtgaaggctacaggggctcccggacatgggtcgaggatgttcgacggcgccgccgtggagaatttgatggatatcattgagactgtggctgagttcagggaggcgcagttcagtaaggtgaaggctgggaagaagggtcccggggaggtggtgtcagtgaaccccgtgtacatgaatgccggcacgccgagtcccacgggctttgtgatgaacatgcaaccttcagaagcagaggtgggttttgatatccgcattcctccaaccgaagatattgaacaaatcataagaagaatcgaagaagaatgggcaccagctcataaaaacttgacttaccagctgatgaagaaaggaccagtgagggatgtggcaggacgtcccttagttacccaaaccaatgagtcaaacccatggtggtctgtgtttgaacatgctattatctcttcaggtggaaaactagctaagcctgagattttatcttctaccacggacgcccgcttcgtgaggcagatgggtgttccagcccttggattttctccaatgataaatactccaatattacttcacgaccataacgagtttctggaagataaagtattcttgaggggcattgaaatatatcaacatcttattagagcgctaagctccttcaaaggctgattcaatataggtgtacagtgtactaccattgttgtattgtcatcccacgtcaattctatgttgccaatggaagccatatggccacaactatgatgcgccagtctacaacggaattggttcaggctcaagcacatcagaataaacatgtttgaaataatagaaatctgctaagattaacaaatacatttttatgtactatgtaaattatactttactactacctccgtccaacaatagggaacatattaactttcctttgaccaatgctttgaccacaaattactctattaatatataattatatgacatagttttatatccattatattcctacttaagaatatttgcttatggttatgattttgatcacattagtcacatgaggtcacatattcatgaagtaatttgtggtcaaatgcttggtcaaccgaatcctaatatgtcttttattgttgaacggagggagtacatacgaagctacaaacggtagcaagagcacgcaaggtccgcaaggtccaccgtgggagccaacgctatatgttcaaaaagcgtccaagaaattgctctgtttgttcgcaaaaa

SEQ ID NO: 197 - DNA, 5732 bp, Sorghum bicolor
tgtaggctgtaccggactcctgcagcttgagccgaaaaaatggtgacggccggctaaaccccctttccccctttcaaatcccatctccctctcgccgccgccgccgccgccgccgccgcggcctcaccgtcccactctcgctcacactgtccaacccaccacccgaaccttaaaccctgcgaacctcgcccaaaccctaaacctcgccgagccgccgccccagccatgccgaaggtctttggcaccggcgtcttcgagttccggcacccccgggcggccgagtacccgctccccgcggacgccgcccccgccacggccgcggcgcccgacaaggtccccgcatcaaccggcggcggctccatcacgctcctcgacatccagcgggaccgcctcacccgcgtcgccaccgagcattggggcacgcccgccgccgcgtcggccttcgacgcggaccttgtcaggaagatctatgccaccgagctccgcgtcgaggggcggggccggaagaccgtgccgctgcagcgcgtcatgatcctcgaggtcagccagtacctcgagaactacctgtggccgcacttcgacccggcgcacgcttccttcgagcacgtgatgtccatcatcctcatggtcaacgagaagtttcgggagaatgtggcggcttggacatgtttccatgaccggaaggatgcattcaaggggttcctgtggcgggttctcaagctcaaggaagagagcatggataaatctgggtgttggcaattatatgtatttcactttggacaagatgaaagggctcttaatatggcggagaaaacaaattacctcctgttcatgataaattcatttcagagtttggaggacgagcttgtccgggaaacgatacttcagttagtaagcctaaagctgtggaatactctatcttttggacgacttcagatggaactctgccttaaccctgaattgattaagaagtggaccaaaatcaaaagaagagaggcaaaggaagcaaaaaaggctgaccaacctattgacccttctgaaatgctcgagaataaattccttaggaatctaattgaagagttcttggagattctcgattcaaaggtcatactatccaatcaagatgctggtgaagaatctgtattgaacgagtcgctcagtgggcagatcgatgattcttgtgtcctatattgtgagagatttatggaatttttgattgacatgttaagccagcttcctactagacgatttttgaggcccctagttgctgatgttgctgttgttgccaagtgccacttaagtgcactctatactcatgagaagggacgcctttttgcacagttggttgacttgctgcagttttatgaaggttttgagattaatgatcactctgggacacagctcggtgatgatgatgtcctgcaggcgcattattcccgtttccaagcttttcagctactagcatttaaacaagtgcctaagttgcgagattttgccttgtctagtattggttcactccataagcgagctgacttagcaaaaaagctacttgtcttgtcagatgtggaactgcaagatctggtttgtaacaagcttaagttaatctcagcgaaagatccatgcagtggaaggcgtgattttcttattgaagtcctagttgctttttttgagaagcggcaatcccaaaaagatgcagtaaacgcacttcctctgtatccaaatgagcagatcatgtgggatgaaagccttgttcctagcattaattactccggagaaggctgccttgccctcccaaaactcaatctccaattcctgacgcttcatgattatttgttaaggaatttcaatctgtttcgtcttgaatcaacctatgaaattcgtgaagacattcaggaagctgttcctcatctacatgcttatatcaacaatgaaggagagactgccttccgtggatggtccagaatggctgttccgattaaggaatttaagattacagaagtgaagcagccaaacattggagaagttaagccttctgctgtaactgctgatgttactttcagcatatcaagctacaggcatcagataaaatctgaatgggatgctctgaaggagcatgatgttctatttttgctgtcaatccgcccctcttttgaacctcttagccctgaagaggctgcaaaatcaactgtgccagaaaggttaggattgcaatatgtacgtggatgtgaggttattgaaattcgtgatgaggaaggaacactcatgaatgacttcacaggaaggataaagcgagaagagtggaaaccacccaaaggtgagattcgtactgtccgagttgccttagatacagcacagtaccacattgatgttactgagacagcagagaagggcgcagaaaatgtgtatggaacatttaatattctaatgagaaggaaacccaaggagaataatttcaaagcaatcttggaatctatacgtgatctaatgaacgaaacatgtgtagttccagaatggttgcataacatattcttgggctatggaaatccttcagctgcacagtggatgaatatgcctgatcttctggaagttatagatttcaaggacacttttcttgatgccagccatgttcagcaaagttttccagattaccaggttacatttatcaattctgatggtacagaaaacctgcatccaagtcccccttttaagattaggctatccaagaaaatgagggaaagcagtcatgctctacctggcaacgtgaactccaatttgactgttaagagtaataatatcgctgatggggagcctcagaaagagaaactgattgttgaaagttacattccagctgatcctgggccatatcctcaagataaacctaaacagaactcagtgaggttcacacccactcagattggtgctataatatcaggtattcaacctgggttgacaatggttgttggtcctcctggtacgggaaaaacagatacagctgtgcagatattaaatgttctatatcacaactgtccttcacaaagaacactgattataacccattccaatcaggctttgaatgacttatttgagaagataatgcagagggatgtgcctgctaggtaccttctccgccttggtcagggtgagcaagaactggccactgatcttgattttagtcgtcaaggtcgtgtcaatgctatgctggtccgacggctagagctgctcggtgaagtttctaaattggcgagatctcttcgtcttccagaagatgtgggctacacatgtgaaactgctgcatatttttggttattacatgtttatgcccgttgggaacaattcttagctgcctgtgctcaaaatcaagacaaaccctctttcgtcaaagatcgcttcccattttcagagttcttttcagatactccgcagcctatttttactggcgagtcatttgagatggatatgcatgcagcgaaaggttgtttcaaacatctttctataatattccaagagctggaagagtgtagggcttttgagctactcaagtcaacagtggagcgagcaaactatctaatgactaaacaggccaagatagttgctatgacttgtactcatgcagcattgaagaggagagactttcttcaattaggtttcaaatttgacaatttgctgatggaagaaagtgcacagatattggagatagaaacttttataccgatgctgctgcagcggcaggaagatggccatgctcgccttaaacgttgcattttaattggtgatcaccatcagttaccccctgttgtgaagaacatggcttttcagaagtacagccacatggaccagagtctctttacaaggtttgttcgacttggtgtcccttatattgagctcaatgctcaaggtcgtgcaagacctagtattgctgaactttataactggagatacagagaactgggagatctgccttatgtccgtgagcaagcaatcttccataaagctaacgctgggttctcttttgagtatcagttagttgatgttcctgattataagggaaaaggcgagtcagcaccttctccttggttctaccagaatgaaggcgaggctgagtatattgttagtgtgtatatctatatgcgcctgattggctaccctgccactaagatttcaatattaaccacctacaatggtcagaagcttcttattcgtgatgttatcaacaaaagatgcaagccatggaatattgagccccctaacaaggttaccactgtggacaagttccagggccagcaaaatgatttcattttactctctcttgtccgtacccgttttgtgggtcatcttcgtgatgtcagaagacttattgtagctatgtcccgtgctcgtctgggcctgtatgtgttctgccgtcgttcactgtttgaacaatgttatgaattgcaaccgacattccagctgctcctccaaagacctgataagctcgccctgaaccttgaggagtgcactccttttaccgagcgacctttggaggaaactggaaacattcattacattactggtactgaagacattgatcatctagtgaagttcaggctggaacatcttcgtcagatgcaatacatgcagtattatgctcctccagcaaatgaactgcctcaagcagtgccagaaaatattgctgatgcaatcccttctgaaaatgggaatgctggtagtgctctgaatgatgcaaatgagcacatggcagtggaagaaaatggtggtgcgactgacacagtgatcgataataggatggaggaagatggtgttgaggcaaaggatgacatgacacaggaagggaacaagggtgaagggagtggcgagggtcacatggctacagaggatacacaaggggaagtacaagctagcacaaatgacaagatggaggatgcagatgccacgtcgacagacaaaatggaagaagcaaatgccatgccgactgacaagatggaggaagcaaatgccacgtcgacggataagacggaggaagcaaatgccacgtcgacggacaagacggaggaagcaaatgccacgctgacagacaagatggaggaggaaaattctgatctgaaggacaagatggatgaagagtgaggtggtggggtagccagttttgaaatagaggtagacctgtgctgtctagccacagatttcgatttggaacatcatatattcaactctgttaccacagatgaaggctgataacatgcccccccaagaggtgtagccgtgggcagaaccaaggttgacgtatgatggcctatgttcctgcggttaatgatggtgaaagtttgttcgctaccatcttggccatgctttgctgataaatgtgccttttcttccaaccaacggcgtctccatgtatcccacatgtgtgtaaaagtgtaaactgtagagattttttggcagtttgtctgaatcactcagatatcagaggccctgtgcagcttctcaacagcttacggtgaaaaaaaaatcagttcagttaatttagcgtgcacaagttccaactatagttgtctccgtagcataacacagctggaacgttgcttttgtatacttgattgactatattgtaattttggcacaagcgttagatttttgcagatttgatagaccttattggtctgctgatataaatctatcaggcaaaatgtgactaagagaaatgttatcatatgtttgagctaactgcatctttt

SEQ ID NO: 198 - DNA, 1499 bp, Brachypodium distachyon
gccgcttctcctcttcttccgcggccatggcgacgcccgcgcctgcgactctctccaccgcccgcagcttgcgcccgcgctgctctcccttgcgcggcgccctcgctgtacctaccgcccgcctcggccgctggcgccgctcgctgggctcgctgcgcgcggaggccgccgcggaggacgccgcgggggcgggggtcggggtcggggagcagctcaaggccggggtggccgtctacaagccgcgatcgtacgaggtgctcgtcgccgacgccgcgcgctccctcgcctgcgccatcgacgacggcaggacccgcctcgagatcgagttcccgcctctgccgagcaacatctcttcttacaagggatcttcggacgagttcatcgatgccaacgtccagctcgttctcgcggtcgcaaggaatctcaaagagctcagggggactaggtcatgtatagtgtttcctgatcaaccagaaaagagaagggcttcgcagctgttccgaacagctatagattcgattgagggcgttacagtcagttccctggacgatcttccctccggacccatcaacaacttcttcaaatcgatagttagtaccctggatttcgacttctctgacgacaacgaagatcgatggaaatctgacgaaccaccatcgttatatatcttcatcaacagcagtacacgtgacctttcatcaatagagaagtatgtggaaacttttgctccatctacaccttctgttctctttaatcttgaactagataccttgcgttctgacttggggattctgggatttcccccaaaagatttgcattaccggtttctttctcagtttacaccagtattttatatcagacagcgtgactactccaagacaatcgcagtcactccgtacatagtgaactacagtggtgctgtcttccgtcaatacccagggccctggcaagtcatgcttaagcaggctgatggttcttatgcatgtgttgcagagagtgcttctcggttcactttggggcaggccaaggaagaactattgagagttctcggtttgcaagaagaggaaggaagctcgcttgaattcctcaggagaggatacaagaatgccacttggtgggaagagaatgtcgatcaggagaagtcgcccgcatggcgaacctgagttgccccccgctggttagatgccgaaccgttgatctgactaggcaaacagagatgtacatgccaaagaatgttcataaaataggaaaaaattggtgtttggaaaaggaccagatgtgtacttttcagtgttcatggatctttagctgatggtgtagctgaaattacagaaagaaagcccacacaccacaaatcatacagatacggtggagacattgcctgagctgctatttctacttttatctcagttctgagatgaatcctcctttgcttttttttttgttgtatatattgagtcagtgcatgtgactccaaaaatcattgaaaaaaacaatta

SEQ ID NO: 199 - DNA, 2466 bp, Sorghum bicolor
cccagctcgaaaacgaaggcgccaaaccattccccaaacgcgcccgcgcccgcgcccgcccgcccagctccgcccgcgccctcccattccgccgctgctggggtcactcgcccccgcgccggcgaagtccctcccgcgcggacgccccgccgccccgtggcgcggcgtcgacggtcggttcccggcctcgcggaggctcctccccgtgtcgaatcgaggtatttgtcggcaggatcctaggccaaatgcctctctttgataagaaaccattctccttactggagccccctaaggacctggattcaaaggagaaggtgttccaaattcgattcacaaaggagatattccgagattatgaagaatacctaaagaggctaaacctttatcgccagagagtttggacatgtaagatttctggaaaatctaatttaacttttgaagaagctttggtatctgagcataaagcgatggagaaggctcaaaatttgccaactgagctaatggctcatgttcttcggatgactcaatacagcactattggtttacatgaacttgtcaataagatatatgctagtctgctggaagaagtatttgaaggaatagaactacatgctaataaggatggtgctgtggcaccttgcaagatcttgaagattttagattctggttgcacaaagatgtgtgaagttggttggattcgacagggtaaagctgtaaccaacacatcagtaatcaaagctgcagatctgttttaccggagggcacctgttagcaggaataccctgaagatttttattaaagatgctacatcacaaagtaatccatgggttatccatgagaatctcgccaaaaaatttggcatatccatggacccccctgacagcataatgaagaaagggagaaaaagacaagaggatggaactattgaagatgggaggaaaaggctcaagacagatgaagaacaggcatatgtaaagtatccaatagatgatctgctagtaaggcccaatgcagatgatccggctttatttaagagacctcctctggctacagattttagagtaccaagatgttctgtgggagatctccttatggtatgggacttctgctcgtcttttgggagggctctgaatctgtccccatttccactaacagatctggaaaatgcaatttgccacaaagaaagcaatgttcttctcgtggaaatacatgtggctatgtttcacttgcttatgaaggatgaaggtgactatttcactgttgtgcagaacaagaaacggaaattaaagctaagttcagtaacatgggacgagtatctatgtgatttcttggaaatgacaaaaaatgaagaactatccactaacattgcaacagtaaaaagggtttattatggtgttattgacactgatataaagcttaagatcctccgggaactagtggaagaagctattcaaacctctgccataagggagatactaagcgaccgtgtggaccagaaacaagtccttaatgcaacaaaaagagagaacaccagaagggacaaacaagagcaaaatcttaacactgaaattgcaatgaaaaaggaggagaatcagacagatgctgtgcaaggtggccatgagggtgtagatgagctggttaggggaaaagaaaatgacaagagcaatatttctcggagtaggacagaagggaaacgacacctggtacgacaccttgataccgagatcgataaattatccatccgttccagccctcttggtaaagacaggcagtacaataggtactggtttttcaagtgtgaaggaaggctttttgttgaaactgcagattccagagaatggggttactacagcactaaggaagagcttgatgcgctcatgggctcattgaatgtgaaaggtataagggagagagctttgaaacggcaactagagaagttctataataagataagtaatgccctagagaaacgatcaaaagatatcgcaaacaagatgttgcttgaagagggtgtgctgcgccgttccacacgcgtccgggctaacccaaaggacaacccgtccatggcattcctcaagtatgtcaacaagtggaaggataactgaggtactctgagatggtgatccgccagcacagtgggaggataactgagccttgggcgtgaccctcttaagttatgtaggctttgcttggttaggtcgtcgcagtggggctgccatactcatggctggtttattgacccctcattagctagtgaaacctgtatcagaacccacttttcttttttctttttccttttgcttttcatgtgttggacaccggttcacaaatgagaaccctttgctccttaactgaactgtgtcaggctttacatttttttagaacagttactaatcttttgcacgaacgatgtaaacgtgatgaggccggcgtggagatgcttcgatttgcaacttgcaagggtgg

SEQ ID NO: 200 - DNA, 5610 bp, Sorghum bicolor
gaccgcgctccgcatctcgtcgacgacgaagcgaaaaccctcacaaatcctcttgatgcggggtgtagccgcctccaccgtgtagcaccaatcggatcgaagaggtacaagcgcttcgggtcggcgtgcctctccttcatggcgccggcgcgaggggtccgatctgggggctcggctgccgcggcggcgctggtctcggttctgctcgtgggttgcctcgtcgcgggcggcgagggggccgagatccgccgccaaaaaaacgtgcagactgcgctccgggccaagtgggctggcacgccgctgctgctcgaagccagtgaattgctttcgaaagaatggaaggatctattttgggactttattgaccactggaaggaactggagaaaggctctgaatgtttaacggcaaaatgctgtgtccagaagattgttgaggatgcccgcacactactcaatgaaccactctcttcaatttttgagttttctcttacccttcgatcagcatcgccaagattagtgctgtacaggcaacttgcaaaggagtcattatcttcatttcctattgatgattcaccagagcaaatttccggtcatggcactggaaaaacttttgatggagctgtggatcctaactcttctggaggaacttgctgctgggtagacaccgggaatgttctattgttcaattcagctgatctacatgaatggcttggtggattgggcaagctagctatggattccactgaacagcctgaactctttgactttgaccatatatatcctcgcacaaatattactgctccggttgctatattttatggggctgttgggacaaattgcttcaaagagatgcatgttcaactagcagaagcatcaaagcagggaaaagtcaggtatgctttgcgtcctgtcctaccatctggatgtgggactacgtccaccttttgtggttcagttggtactgtagatgcagtcaccttgagtggttatggggtggagcttgccctaaaaaacatggaatacaaagccatggatgacactgctataaagaagagtgttcctctagaagatcctaagacagaggacctcagtcaagaagtcagagggtttatattttcgaagattttggaacgcaagccagagctaaatgctgagattatggccttcagagattatctattatcctcgacagtgtctgatacacttgaagtctgggaactcaaagatctgggtcatcagacagcacagcggatcgttcaagcatccgaccctttacagtcaatgcaggaaatcaatcaaaatttcccaagtatagtttcttctctatcacgaatgaagcttgacgattccatcaaagatgaaattattgcaaatcagcggatggttccacctggcaagtcattgatggctttgaatggtgctttgatcaatattgaggatcttgatctttacctgttaatggatatggtccatggagaattatcccttgctgatcagttcgtccggttaaagttgcctcaaagtgctgcccacaagatcctgtcagctcctccaccagcagaatctaattctttccgtgtggacttccggtcttctcatgtgcattgccttaataacttggaggaagatgacatgtatagaagatggagaagcaacatccaggagctcttgatgccggtcttccctggtcagatgcggtacatccgtaaaaatctattccactctgtttatgtgcttgatcctgcttcagcctgcggtgcagaggctagtctcttgcttacaaccattgacatgatcctatctctatatcaagatggtgtccctataaggtttggtatcataatgtattcttcaagattcatcaatgtcattgaagaaagtgatggcactcctacaaataatggagaagacacttccattttgataacaaggcttttcttgtacatcaaagaaacatactcaacacagttggcattccaatttctcagcaatatacataaatcaaggaatggtgaagatgactacaatgaagagcttgtggaagctcatcaagttgaaggggcatttgttgaatcactattgtcaaacgctaaatctcatccacaagatgtgctgctaaagttgcaaaaagagaacgtgtataagcaggaggctgaagaaagttctcgttttgttcacaagcttgggttgtataaactccagtgttgtctattgatgaatggatttgtccatgaagccagtgaggaagcaaccatgaatgctatgaatgatgagcttcctaggattcaagaacaagtttattatgggcatatccagtcccatacagatgttttagagaagtttttgtcagaaaatagctacaagcggtacaacccatcaattactggcaacagtgcagagaagaaatttgtttcgctctttgcatcatatcatcaggacagctctgtatttaatgacatgaagtacttacagtctcctggaactacagatgatgcaaaacctattactcatctacttgctattgatctttcatcaaaagttggaacaaaattgctttctgaggccatacgttacctgatggatggatctgatagagctcgtgttggtctgctactttatgtccacactggtggttcatcacctattttacttctgaaagatatcttcgatagaactatttattctttcagctataaagaaaaggtattggtcttcctgcatggactcttgaaattttatgaagcccaacctttgcctgcctcatctgttgctgacgattggactagaaatatgatggaaaaggtctataccttagctgctgaaactgctttgcctgttgatgactacaaagcatggttcaaaagtttctctgctgatacagttctcaaagggattgataagttatctgacttcttatttgggcaattggggcttgtgtttggtagtaatgctgtgatcaccaatggacgggtttttattatgaatgaaggagaatcatttctagccaatgacttaggtctccttgagtctatcgagtatgatttgagaacaaaatacatatttgaaataattgaagaggttgagtttgctggtgttgaccctgatgacctgacaagccaattctacagcgacattgccatgttgatctcatcatcgatgtctgttcgtgaaaggacatctgaaagagcccgttttgagattttacatgcagaacatagtgctatcaaattgaataatgcaaattcaagtattcacattgatgctgtcattgatccacttagtcccattgggcaaaaacttgccccacttctacgcatactctggaaacagattcagccgagcatgaggattgtacttaatcctattagttcccttgcagatcttcctttaaaaaacttctacagatttgttcttccatcgatggatgattttagcagtacagatcattctgtacacggacctaaagctttctttgcaaacatgccactgtcaaaaacacttacaatgaacatagatgttccagaaccatggcttgttgaaccagttattgccatccatgatttagacaacattcttttagagaatctcggcgatgtcagaactttgcaggcagtatttgaacttgaagctctcctcttgacaggtcattgcattgaaaaggaccgggaccctccccgtggtctgcagtttatccttggtactaaacaaagaccacacttggtagacacacttgtcatggccaacttgggttactggcagatgaaggtctcacctggtgtgtggtacctacaactggctcctggtcgtagtgccgatctgtatgagttacctccaaaactcattgccattgatagcttgagaggcaaactaatgcacattgaagtacaaaagaagaaaggcaaggagcacgaggagttgctaaatgctgccgatgactaccacttccaggaaaagacggataacaaaggctggaataacaaccttttgaaatgggcttctagtcttatcagtggtgatgcatcatccaaaaacaaagctgataaaatcaccgaccgtaaggatgcaagacaaggggagaccataaatatattctctgttgcttctgggcatctgtatgagcgtttcctcaaaataatgattttgagtgttctaaaagagacacagaggccagtgaagttttggttcattaagaattatctatctccacagttcaaggatgtcataccgcacatggctcgggaatatggatttgagtatgagctcatcacatataaatggccaacatggttacacaagcagaaagagaagcaaaggattatatgggcatataagatcttatttctggacgtcatatttccactttcactgaggaaggtgatttttgttgatgctgatcaaattgtgagagcagacatgggagaattgtatgacatgaacctgaagggtcgtccgcttgcatatactccattctgtgataacaacaaggatatggatggctatcgattttggaagcaaggtttttggaaggatcatctgcgaggaagaccataccatatcagtgcgctttatgttgttgatctggccaaatttcggcaaactgcttctggggatactcttcgtgtcttctatgaacaactcagcaaggaccccaatagtctctccaatcttgatcaggatctcccgaattacgcccaacataccgtgcctatattctctcttccacaagaatggctgtggtgtgaatcttggtgtggaaatgccacgaaggcaagagcaaagaccattgatctatgcaacaatccaatgacaaaggagccaaagcttcagggtgctagaagaatagttccggagtggactggtcttgacagtgaagcacgccagttcactgcacgaattttgggcgacgatgtcgagtctgcagaagccacacccccaccatctgagacaccaaagcccgaagataaagacactgatcaggaagtcaaagatgagctatgatcgcaagctgtttccctagcttgaccttactgacagaaagtttgatgccttggcagtcagcagttcaggacactggcacatagctagtggagtgcagagggatagtttaacgcaggtacctgtctacaatttgtcaaaaagactatacctggaatcctggaccacgttgattttgcgcctgaagtttttgccatcaaacatgcaacacaatttaggtattttgtttacaccaatagtttcaatacctttaacccaatcaaatgtggggacgctacgtcctgtatggctatcttgtcagaataggttagcaagtcagccagctggggtgaagaactcgtctgctctctgctgcatacacatacactgtaatggtcaacaattcatacatttaagatctttgagacgctgtagaatttattggctgccactcgaaagctaacagcaaggtggcagctaaaatgcccgagaattttgtagtagtcatcaaatgggtgtttgaaagactcagtaagacaataataatgcctctggcatgtaatttgtgtacatcaaaattgtataccttaacagcaggctattgtgggaagggcatctactgttatactgtgttaa

SEQ ID NO: 201 - DNA, 1730 bp, Hordeum vulgare
cactcactgagcttccttcctctctcgcaagaaccagacgcgcacctagccgccgctcatcttagctctccctcctctctcgcaagaacaagacgcgcgacgatgtgtgtctcacaaccaaatctctgcccaagtaagtaagatattgaagagatcctagctgccatgtgcgtggtcttccaagttcgaagacatggttcatgcatggcgttgtggttcctcgcaactggtaactcggtttgttccacaaattttctgaggttggattctttttttgtttagacctgggattttctgagattctgcgtgatgtgaatatgtgatcagtggagggatggttcgagtcccacacgaggcaaccagtgtctgttggattttcagtcggccagtaaggacaatgttttgagtcggctagaaatttaaccggctataaacgcaattttgtattggtgatggaagcagttcatcatctcttatgggaccattttcttcctcttcttaatattcttccaataatgttagacctagaaaggtttacttaaccttccaaactaattctctctcccccactgattttccgtcctcatccctctattatcaatcacattcttccacctcagtttgtttgtatgtaaaatctgtttgtagatgtagcattactcagattcttctaatcacgtcgaaactagtctagaaatgagttgttacctttgatttaatgcactggactgaactatctttgagcaatttagagatttgttcatcaggcctagctagctaatggaattatgtacccactggctagctgtggctgtgagggagttaatctgggattttaaaaaaggtagcaactaattaaaatttatgcaaggttaccacacagtcgaaaaaggaagtaagaataaagaagagcacatgtgcattgtggaggacacaaaaatactgctgtttgtttctgataagcgagagcaaaggtgaaccttatataggctctaacattcagttagaaacatgtcacgttctgcaatcgtacgttgcaaggggatgtaatttcctcccttctctacctgagattctataaatagtgtacccggtgccacacaacaacacacggcgcacaaactcaaaccaagacacacacatcacacaagctcgctgtaagatggctgctcgtaaggcgatggggctgctctttctgctgcttctttcgagcagccagctgatgatgctggcccaggccagcgatgatgacatcttgccatccgatgagctgagcctggaggttctagctcttctggaggacatcatgaagtccaagctgtgcccggctgcctgcgtctcctgcttagtgcaggtcgggaagacctgcccgctgacgatgacgctgtttgctccctgcgtcctcgggaaggtgatgtcccagggttgcttcggcaagcagtgaagccatgagtggcttgctagcactgtgtgcgggtgcttcaggaagcagtgaagccatgagtggcttgctagcactgtgtgcgggtgtgcatgttgttgtggtgccttcttttcgtttccttgtgtgtggtcggtccaggcttgtgtcgtgtgtgtgactagtttcttattcttccctcaatctcactctcttgtgtgtgcctgtgtggtttcgaggacccgatcctctcctgttgtgtgtttcagttgtctccacttaataaataccatcgatgattgtggtttct

SEQ ID NO: 202 - DNA, 645 bp, Hordeum vulgare
ctggcgccgtcaggaggcggccccgagctcctcctccgccatgactggcccctggtgaggtcgtcgccatcaaactcgtcgccttccttcctacccgacagcaccaggagaacgcagtgaaccaggaggatccattcccgctgcaaatagccgtcgatcgcctctgcatccacgacgtccacgacggccttcttcctcctctgctccgacgagatcttccgcagagcctattcttcctcgtcgtcacctgcctcctccacgtcgatcctgctacctctcctcgacgcgtaggcaccgggatcggagagagagtacgtggattctggagagtacgtgcaggacgatcaagagcagttccaagctgaagacatcacaggtacatgaacgcctgatgcaggagatcgagacggcacgcagctggcgtgatagtaaaatgaggagaacgaccgtctgtacatgaactacccagaggactgaggccgtggtcgtgatcgtgggccagcatgcgggatatcatagtattttccttgttttatgtagcccgtagcgggactatcttgtctgaataattgtgtggatgtaaccctgatattatactatgtgagatggaaaatgtatgccctatttgtcaatcaaaaaaaaaaa

SEQ ID NO: 203 - DNA, 620 bp, Hordeum vulgare
aaaaaaacgaacacgagcagagcagggaggggaggggaggggcttcggtgctccggcggcgggcctcgccgtcgccgtctgctccggcggcgtcccacgggtaccgacgtgcggtgctccgaagtccagatgacagcccgctccatccccgcgccgccatcccccacctcggcgccggccccggcgccagatccgccatccgccgacgccggaggagagagctccatccagccttgagaagggcacggaggccatgcttggttgatcgtctacaggttgtggagcctctactcatcatggatgaggatggcgacggggcaaaatttcaaaaagccatcctagggtccagggccttcatggtcattttgcagccaggcatggtgacagatttcagaaacccgcctctggagggaaaaaggaaatagaagacttgcgggcagttgaagctgtttcctcctagctctggattgagccccagacataattgtacatctctctttcttaatacgggatgggtatacgtttccccttctacattttgttgggggttgtaccgaagcaaaagtgaaaaaactatcagtttgtcttggttggatctatatttttatttattcacgtga

SEQ ID NO: 204 - DNA, 5614 bp, Sorghum bicolor
cctcgcgctctggttttcttcctctcttcgcgtcggtgttgaaagcgcctcgcctatcccgtctcgcccttcgtcgcctcggcgcgtttgcgttttccatttcttcactctcttcctctcctcgtttcttctccggtttgatttgttccgctgctgttgcgcttccgtgctctcgcagattcccttgggggcgtttcgctttcgtgcggcgcgaggagagcgagagcctgagtttggttggcggggttgttcgggtttgcagcttattgttccttgcgtattgcgattcgtctagcttttgtgtcgatcctgtttcgtcttcgccttctcagcgtgtgggttgcaggattggatccgattgggtgttgggagttgcgtcctatggcgtcgtgtggcgaggagatggaggcaggtcagtcttctgtcagatccggcggttcattggttttgtcacttggacatggattcggtggtttcaggctcaactgtctctcggtgtgatacagtcagttgccatcctagcctacacacaaggtggatttggcatcagatacagatagtgcgcaaggtggattcgagaccttcggtccattcgagattttaacggctgatctcgcttgtggcctttttgggtgtttgtcctcctcttactttagatgcagatgcagaaggaagggtccctgctggttatggagagattagttgaagggtggaggtttgcttatggttccttcctcgttttctatttggtatatggctgttttgatgtcatcatggtggtggtgtgaagatcgccaccggactaactagaagcttgattgtccttcattggaaaaatgttgttagctggatctgcagaggcaagagaggtgatgttttgggcgttgactggactggagttggtagcatcgggagaagatcgtttggatatatctaactatcactcttctattgattcatcatcatactcttaaatttctgtccgctgctattcttatttttttatattggggctggtggttttctccagcaactggaactgtccagggttccctgtgtttgttcactaaccatcctctctccccagtcattgttcttctaaaattgacttccttcataggctccctttgatacttcgttagtaaatctgcagttttgggagacatcactatagagtttgtcctcctatatgcaaaaggaatggtccttggtggttatgtgagagcagttgaattcaagggtggaggtttgcttatgttcgttatttttgatttgttatatggctattctgatgtcaaccatggtggtgtgaagattgccaccggactaattagaagcttgattatccttaattcgtaaattgctgttagctggatctgcagaggcaaccgagggtgatgttttggaggtagattggagatttgattgatgattggactcatgagttcatagcatttggagagacggagaacatcgtttggatatatctacctttcgctctttcattggcgcgtttaaatttcttgtttcttatatttgtgctggtgcttttcttcagcaactggattatatggatggattggagcctgagtttgatttcgctcctgcatgagcaataagaagttctgaactgttcagggttccgttcaataacaatcctctcttgtcaatgttctttgaaaattgaattttcccgtaggctaccattaatgcttctatagtaaatctgacagttccgggagacatcgctacagagataggacttacagctgacattattggcgattgaccaggctttatcctaaacccacatttaatgaagtgttcttgctttttaagtgttctcatctcacaatcaaatagatagttacagaggatggtctcgctgattgcagatctctaggtgataacttgcacgggcacaaaaggaaccagtctctgcgtctattcaaacatacaaccttcaactctcattgtgtttgttcagtttcttcacctcaaagtagataatgatcggggtcattattgcaggtctgatattttttgcatgggcttgtcacatggaatatgtgttaggagtacttctaaccttatcaaatttacaaaattgtatatgaatcatgatacttctattgagttaaaaatcgggtatttctaatttaatctgcagtggtagaaggtactgagcatgtttgggacttgggagattcaagcagagatgggtagaagcacaactttcatttaataatcaacttatttctgctttatcatgaccgaagctttaattcttgtgctactggcatttctgtgtttcgcagatcattttagctcaagtaattggtagtccaacaatcataatgtttggtttgggatttctatctgtggatgctttgtctggctttatcaatgttttcgtgctcgcttttacatgtggttgcaggatgagtttggcaattggaaatccctgttgcaggatgagtctagatcattccggttattttagtttcgtcacttgttttcagtgatttcagatctgaatggtggctaacattctggctctccaaggatattttgctggtagtaatagtaaaagcaaggtttgagatcctggatttattaagcactgtatatagctcaacttggctgtggtatgtgttcgtgtcctttagagatgcaggaggacattggagttggattttcctcaatcggagataacaaattgggaaaaaattgtgactagacctcgcacttctcaacttctgtctatttggtttgcatagctttccattcgttctgatctgtagtcccttattatgtttccagcccacttaaactataaggatggcagggggatgcctaggagttattttgtgctgcaacagtctaaataacaagggggcttctaattcttcgtttctatcaagtcctatccagttacttccttgaaccagtaactctttgaagtttgtgcagatgcgacaaacagaagctgagatagaattttcaaccattggtgctgtctccaaagcccatccctgctccactggccatttgattcgccttggatttgaaggttttttaagcctatccctgaaccaaaatagacagaaatcatggatgagctctttggtaaatataggttttgcttacaattttgaagttcaatctgatcgtgatcataaaatgtgcctatctttcgaattctgctaccttcacttttgctaaccagtgagtttctggatagagtgcattaatgtcaagcttgattacttcgacttacctgctgttcagatgctttgcactagttagtaacctgcccagagtttgcgctaactactattctgactattgactgcacatcactttccagttaacttgattgatttggattggtggtggtttgcttggtttccagttatttgagagcgttaatgcttggatcttaggagtgatgggggcacagccacaccttataatatttttcaattaaccagagtttacgcctaatactcttgctcataccggtcatttattttggatccacttatctgatataataagttgatggatgtttggttggattctcgcagttggagctaaagtgtggatggatggttagccattctgagttctagacgtttccacctatggagtcttccttccagtgataaataaacctttgcactaactttattttgaagctgtccttaacctacatgcctcatccaatggtgcaggttcactatttgcctcttgcttgacatccataccttcattgagcaaaattattcagattctaagaggatattttacctgagcatatgtggtcaccatattctttatggtcccagatttccaatttctccgtaggacccctactaatgtttaatctagttcctggtttgcttctggttttacttagtttggtataacccctactcgctcaatatatgtctttcattatcaagttcgtcttattgcacagttccttttaggttacttactaattatactcttgtttgagctctaatatctgaaatcaaagagagattgatcttatgtgacactgttatttaattttgttggttatcatgagaatgattgcctgggactaaccgaacacctcttttactgcatcctttatgccttcatctctattttgtgcagactcaagtctggtgtttgtgacattggccctccctttctttaactgtgttctgcaatttccccactttggacttccatctggtgcatcttatctgttgtggatcaaaaccaagaaagaatgttgctctgtgttcctgccaaaagaaaatctgtctgaacaaacttgtttggctgaacgattgttgcctcctgattatgccagcctatgtgcccgtctcggtgatgcaatgcaagcttctttgtactttgggatggaactggagtcttctgtttgcttgctgtttggtcatttctgttgtggactagcagtactgcttataaacatggattttcaatttcaaaagttcgggttgaagtttgagtcaatcagattattcagggtgttgcattgatattcagtgtttaaagtggaagatctttaggatttgactgtagcagtaaaaactcagtggaagtgggtttcttgaccttgagtgaacttgaatggttggttccatttgtgttatctgtacagtttggtgtttggtcaacttgaatgcaagctaggatgggattgtttctgtctgtgcaactctgtattgtcgccaacttaatatatgttctatagtggttgagtagttaggttaacttcacactaggatttgcatttggttttggttaggtggaaccaaactgcgtgccttgcaaaatggtccaggcaacataggcaatggcaatagtatattaaatattaaactctgaaatgtaccatgtccatgttgcataatctgcacttgttggagctgagaaatgaggatgctagaacgaagaatatcagtttatcaaactattaaccaatgattctaaaccatatttttttatacttcgattgctggttatcaattaatatttggacattgggaggaaacttggtactttagactcgagctggcacctgtgtttccctatcagttctcgtgaagcttcactgtggtcagatttttgtgatatatatgttggatatcttaactgtacaaaagactacatgagtttacactggctggtttttagctacgcccttcctgaaatttctatggtgttgcccttcccatggcatggtttgattggagtctgttcatggaatgatttttgttggagctggttattgtggcaattgagcatcttctgcctagtccaaattagctgaaggactagttttattggacaagattaactgcatcttctgcctaggccaaggtagctaaattagctggagcactagttttattggacaaattaagtggaagcatgtgattgttttacgattggcacacaatgatgcaatatcccagatacctgctcacaacttcacatatatttgaactaggtttacttattattgattattgattgttctatcaaagttatagcctgcaaaagaatcccctgaatgttttattggtttttc

SEQ ID NO: 205 - DNA, 973 bp, Sorghum bicolor
aaaaaaaaagagagagcttctctcctctcggcctcgctcccgaccccgacctcgacgcccctcccgcaccgacgcgcctccgcccccgccttcccctcctcttcctccctctcccaccctcttcctctccctctccccgccgtcgcgacgtgctggctgggttccaccgcatccgcgtgagacacccccggcctgcggcgcggtgacgcgcctagccccataggtggtcctctccgggcagggcgcggcgcgcgcggcccccataggccgccgccgccgtgcctgcccctcagagttatctcctcccgaagatctccatgtcccacgctccaagaaaccctagcttcatctgctcgacggccgactgcgtcgtgaccttcccccggctatgtcgcgagcttccgccggcggcgcgtggactctttgtcggttgcagcggcggcacctcagctcggcgtccggatctgtaagtatattcccccaacatatcagaacttggaaggaaatgctccaatggacctatccgacgcagttcttatatctgaatgcaacccaaagcttgttatggaattgggtcacttctagatcggaatctaatttttctggaggcctcaactacatgctcggcctgcggctatctcaccagggtgcagtactaagatggcaggcaaagcaacttccccaattctccaggatatgcacaaaaggtagcctcccaaagtcccagttaggtagttaggcacaacacaatacataccgcgcatttggtttatagattttatcggacatgctttgttggtagttacatcagagttttcactttataagacatgtccaaatattaactgaaatttataaggtcgagttgtccacaaaatggtcaaaccatgtggatttgtaatttccgctatatgaatatcacattcaattgaatcttgttattccatatatgcacaaactgcaaagatgtacc

SEQ ID NO: 206 - DNA, 670 bp, Sorghum bicolor
aaagtcttgatgaatggttgggtaaatactacatatgttttaccttttcttttgtgtcgcatctttctataccaatattctttttggagctcctttagtttctttgtttttctattttacacatattccatctattaatgctttggacataattatatgtggccttttttacctaaaatcaaaggggggttaagtcaatgatctcttggtacagatatctgcagcactagaattgggattgggagcaactatgccatattaaatatctggatcagtagagaagatggtgcttgatgtttgaagctctaataccaagggtagaggggacctactaactggtgcatcttgagtcattggacatcaagaaaaagcaccagctaattgaagctctaaaggcaccttctgaagacagtggagtttgaagacatgaagccatcttgctgcctagtcatgtgctcctgtgcctaggcatgtgctcctgcaggagatgtatttctctatgtattgtcccaagacttgcaatatcttattggggctttctgtttataactatcaatactgtaggattgtagagctagcatgtgtgactaggtgatgtttgttatttgaaattgtttaaactgctttttgtatgaattataaatattttcccaatctatgcttcattact

SEQ ID NO: 207 - DNA, 847 bp, Sorghum bicolor
atctttctaccgcgccggcatgtggggcctacgtgcgagcagctcctgtcccccatcctcgccctcgtagatttctgggatccacgccaccatcaccttgcgaacttcctcgaatcgatgctgctcggagcagctcctgtccccaatcctcgccctcgcggatttctcgaatccacaccgccatcacctcacggcgccatcaacttcctcggatcgatgtcgtagctcctgtccccaatcctcgccctcgcggatttctcgcatccacgccgccatcacctcacgacgccatccacttcctcagatcgatgccgctcggaagacgacgcataagaatatgtgctattgggaaagagttatttggagtttatgatatttttcacagcacaagtgaccatactttctgtgaaagaggctcaatagcaaagatcactcgtcgcttacgacttttgtgcctcttgtgctgatacaagagattgcaacaataatgaaagttactgagcaaggggcgggggtgcattttcttgatcatgaggataatagcagtagtgatggtggcaatggattaaaggggatagggactctagatgaaataactcagtgcaggggctttcatttttgtcttctatatggtgcatcagttgtaggctcaagaaggtgaacaacagtttgcaaaatccaatcataaactgaattagcaacgtgtcatcttcagcgtaactattttaatgctcatgtagttgctcgatttccagtcatttgtgttaattttgtaagcttgtgacgctgcgctctttgtgactatgttaatttcacaaactttgctttttaaattaaacgtcacttt

SEQ ID NO: 208 - DNA, 914 bp, Sorghum bicolor
acagacgcatcttccccataagccaccccttcccagcaccgctcgtcctccgtcccgattccgtcgcgccgcccgcctcgtgcggtctcccacaaaggccgaatgccccctgccggatttggggcttgtgccgccgctgggtggctggcccaacgagcatcgcgcaatggcgacggctggtgagccacctcccagatctacatcaaggagtaggcggtggtggcagtcgtattcgcaaccagaccctggtagcagcattcgcggagctaggaggaggtggcggctccattgctggttgaccgtgcagcccagcagagtgttgaaatcgagcccagctacgcacagtcctatgctgagagctccacacttgctgagctctaaggatccagctgccaaggccctgcacacgtgcagaccgaagctcgctctgttgctcatatggaaaaaagcaggtacttccctctaagtctctaatcgtgtgtgacggctcactctgttgcccaatggaaaaaggaagtaaagatgcaactcagatggccacctctgtcctaactcctgaaaatgatagtatttattgatgaaatattgaatatgtagttgtttgttcatccttttttggcgtgagatcacaaggctctgaagcttgaaactattttgcaatttcgaacaaccaaaaaggctttggtgtccctactggttataaggtgatgctatcgtccttcagattcagttaaattattatcagatgaagctctggactagtcatcagtggaccaacttggaagttgtggacaacacatgttagtttgtttttgttcatcagttatatatgttgagacaaggatagcttgatgttaagtgacatgattaaatatgtactccagtttgataaatgaatgagtatggttaatgtg

SEQ ID NO: 209 - DNA, 1459 bp, Sorghum bicolor
agccagcaatcagtccagccgaatggggcctactagccatacattggcgacttctgcccagagcccagacaaccacaaattgatgcagacacgaagaacttcactcgatgactcagtaaaacatatatgtatactcacaagtcacaagcaggtgcatatttatatttatatttatatttatatttttaactctagagactgcgtggggttctcaaagagaaaccgtagccacgtcagcctaaattcgttggctcgttcgatctcccaatccaacggaccaatcatctcccacgagattctgttactgtggacttctgattttactgtgctagattctctgcttcttgcccgttcccttctgtttgaagctgatattactggcttctgctattcggtaacaaaggtccaccgtatagactaggattcctgcttttaacatctcttctccactcttctcgtggtttccgtcctcgtccaatcgtcctccgccgctgtcgcgagccctccgtctctcccctacaccgctcctccctctcgtctctctccttccctctcccactcggatctccctcagcactcgcagaggctcgctgcgatggggcccatggcggggctccatgccctcgcccacctttccctacgcatggcggcggcgctgtcgccgctcgcagtgactgggctttcaccgtcgtctttgccgtactcgctgtactcctctccactggcgacctacctctgcatagcttcagccactacctcactaatgactggatccgcggcgtcttcgcggggcgtccataggttaaagctccaaggtagcgacacacagggtcttcactttcctgtccactcgaaggcgaagctgacccagtctgctggtgtatggcctgagggccttccttcaaatctaaatggtgggaaatccgattgttgatttgaggtctgtcgagtgggacaacgagctgggagttgtgaatttgtgccttaaccaagttccgtattcaggattgttggtagcagctggtagcctggcaacttctgctaatcttgaacatgaagtgacaagtcgcaaaaaacgagcccaaggacggaggcctgaagccatttccaacaggtcgagcagctaagtgaagatacattctgcttaagtcttttctatgttttgatagcaccgcatcatcgtacaagagatacttttaacaactcctcaatggacacctcagacaatgacaatcaaggttgagaatccgaccaccacagcaatgttccattgatcgtttgtacaactacatccaaatgtacaagatgctccaatcaagttgctactaaccttgtatactatctgtacctagcactctgaaatacttttccatagttactacaagccccactagacgccgctgcatctacttgctcctagccctgtattatattttgacccgatgaaccgtagtgcttt

SEQ ID NO: 210 - DNA, 1361 bp, Sorghum bicolor
atttcttatgcagatagaaagcaatcgtccacatccactcccctcgccaccggccaaatcgtcacacatccactcccctcgctcccgcattagaaaggcgaagacttcgaaaacggccgacggcgcacctccgcctctcccgcactgcatcccgcaccgtctcccctcgcatcgcagccccgcctctctccatcgttcctggccgttggccttcttctccgacgccggatacactcgtgaagagggaggaggacccgcagcggcgtccgtcccaacgccccgcacctacccttcaatccggtgagcgacgatgcgcgcgaatctgcctctccgacaccggctacgctcttgatgagggaggagccgcaactcgtggatccaggggcagcggtgtccgtcccaccgccccacacctcccactgccctgcacctcccgtccagtcctctaaagttcaagcggcgtccgagtggaggagacgacgtaggcagagcgtccgagcagaggtggcggcggaggggcgtcagctagcctgcgtcacgaacaaatgctgctcaggtgccctgcccccgtgtctaattttatacagacttctaagcagtgtcacggaggcagatgcggcacggcatacccatgatggaggcagcaagggcaagacgtcgcggctcttcctcacgtctctgatcgatgcatcagcggtgcgcggcacaatgagggcaaggcagagcggcgcgagcagcacgggggcacagtcacggctcctccaccggtggcgctcgaccctcttcccctactagcggcaccatccacctgctggctagcggcagtgcacaacgagctacagagcactgtcaccaaccttttctccagtttggatttgaaccaggcgagtccctttcttctaggaactccaacgaaggtggagcagcaagtcaccttggggagcattccagctgacacaacaacgacagggagctgacgctgagggacttcaggaagatgactacctctcaaagttaacatatatttacagatgcactgaaagttcaaaactgtatggacaagtttcattgagtttgttgtactattttgccaagaagtttcatgctttcttatgggacctttgcagatgttgtaagtttagttctaaatactcctggtgatcttgccattatccttactgctagcaactcaataagttgagaagacatgctcaaattttatttggttacttggcatgtttacctgatggttgtaagtgtaaattagccttgtattaatagcttttgtaagtgtagatcaaacataattaagaattgagtgtccttaaaagcttgtttgcttgtcttataagccgtgctta

SEQ ID NO: 211 - DNA, 1495 bp, Sorghum bicolor
gttgttgttgcgatctgtgatcagttgatgtctagggctatgcagttactttgattcgattgttgttcattctggtggtggaggataaggctattctgttgcgacctgtgttggtagcatgctgtgttgggtcagatctgtttgattggttagcgtggatgtttttttgacatatcggaataagacagtggcgaagccagaagatttcaggagcccgggcaattctcattaagtaaaaatatttaactataaaatcacagaattctatataaatataaagaagatttcttttgcattttagcgaggagcccggccggccgcccggggtggccgggcggtggctccgccagtggaataagatgaattgaagattcgtccatgctgtgtgatctgttcagtcggaggttgttgattggctggttgtatcttccttaggatgctgatttcgtggagaaaaccagtgcctgttggttgttataggaaactactggactgctcagaattatgcactgtttgctcctgatccctcgtgatattgtcagtctagtcagaagatttcttatgtcgattcaattttttttatagagctatagcatgttatattctggggcaagttatattaatcagattgtttgatttgattgaaagccttggtaatggtcacatctgaagttctggtgattttagtagataagttgctttgtttggaagccaggacagttcatttagagctaataatatacatgatcatggagatgattctacaattatactcttcagtaactctttttgatcaattcagtttggtggtttcttctataaaaacatggagagcttgatttatactataagggttacattctcaagttctggtggttttagataagttgctttcagtgggagtgagaacagttcatttagagctaatatagacatggttatggagatgattctacaattctcaacaatatcattttcgatcaattcaattcggaggttccttttaagattaccacatgggtgccgagttcgatttgcttctgtaaggtgtgatttaatgctaggatgtggaaccaagattatataagtttgtcagtttgaagcttcatttgagtaagccatggaagaatacttcagttgtggctgctttcctaattttctgtcggtatttgtttctctggtggtatcaattatcataaggccttatatgtggttgcgggacattgatttacctggatcttttatttctcagacattgtcttcagtattggattggacacgactttttagcttctgttactggattatgtggtcattcaaatgttgtggtgatttttaattttgttggttcaatagtattgtaatatatttgtatatatatagtatgtatgatgttaaaattattttcgcctggagctgtaatttattatatgatatggatattggtaatagaaaacggcacgacccggaccctgcttattataatttccttgtg

SEQ ID NO: 212 - DNA, 676 bp, Sorghum bicolor
agctcatttccaccccgcgccgctgctcccagcacgcacccaagcgctgccgccggccggggcatactccgacgacgcaggccacatcgaccttcgcccacaccgctagctccttcgcgttggagcctccaagccggcgtcgctgccacctcgcaccaaggcctcccatctctgatggctcccacacttcaggtccatagggacccgggacatgacgatggagcatgcatggcaatggccacagcaaggcacagcatatctatggtacccatgcaacgaagtgcccttcagcattgtataggacatgtgaatctaagtttggacccgagaaggctagcactttgaacatgtatgctataatgaagtctggattcaaagaagtggacaattctcagccgtagaccacaaaaccatcttgtagtggacaatttagatctatataggtgctaggacttatgtacgttagctatgactgagatattctttccttttagcgtaatggttgaacattttttaatctgattggagtgtagttgttggacactttaatttgtaatatgtttcaactaaattagttgaatatatttatgtattggattttgattgtatttatgctggattgacatgtcatcattgtgtcaattgagtttagttaccagaatcttaaaatttgttg

SEQ ID NO: 213 - DNA, 2699 bp, Sorghum bicolor
atcctcgcatgaggcaaaggcatagagcttggggatctcgtgctacctcaagccagaagccaaaccccacatctgctcactcttctaggcaatagtcgcaagctcgacgccctctcgattccgccggtctgccctgcgaccgcagaagagtccagggactcctcgtcggcgaacacgattctggttcccgctgctgtggaagactacaacaaacgtcctcagccttggcatctacggactcctgccctctctcctcatcctatactgccacagttcttggcacggaggcggtggtcgcggcgccacgcgcgctggtgacagtagctgcgtcgacagctaatgcgctggatactgtgcgtcaatttatgaggtggtggccattgtgacgatgggctcatcgcggtcggtaggtagaagaaggcgaagaggacgtccctgaggtacccgagctcccgcgccggtggcaggaacagcgcgcgcaggaggactgtttgcgcggcagcggcgcggcgtgggtagctgtgctggagactagggcggtggaagctagcaggagagctagctctacctcaccgcgattcagccggcagctgacgtccgccagaggggagctcggcgctgaggtggctggcggtccctcgagccactcgggggcgtttgcacgccatctgttcgatgctttgcggctccgcgactgaagtggattacagtttctccgacatggacccagtagaaaaaatggtggtcatactccactaggagatttgacaaacactaccaacggagttgatgacgctaagcaacgaaaaagggaaagggaaagagcacgatatgcaacaaggactgaacaacagaggaatgaatacaacaagaagcatcgtgaacaatatcgaatgaaaaaggcaaaaactacacttgtgcatggggcaataggtgacactgcaaacaaatttaaacgaagcaatgtgccttacccttctgtatattatttatatttattttttataataactatcttgtagctggtggggttgcattagacaaggatggcatgaataatagtgaaaatgacgattggttgcataaaaatgattcataccaacccatgcagatcggtaaagagagtctaggtactatttattttattgttattagtttttttcctagattacggtgtcattgcataatatatgttttgtacaaataagagagattcctagagagatttttgaggaggctagcattgaggctaacgaggatgatgtggctctgtcagacacccttaatgaggaggcagcaggctgcatacgatgagattatgtcctcagttggtaccgaacatgggggtctattttttgtggatggtcctgatgggaccggaaaaacttatttgtacaaagcacttcttgctactatacgcagtcagaaaaagattgctatggcaacaactacatctggtgtcgcaacctcaataatgcctggtggcagaaccgcccactcacgcttcaagattcccctcaccattgataatggagccttttgcactttcacaaaacagagcggtactgccaagctgcttcaagcagcatctctcataatttgggacgaggctagcatgacaaagaggtaggctgtcgaggcactagacaatagtctccgtgatataatgaaccgaccagagctgccttttgaagggaagactgtggtgttcggtggagatttcagacaagttcttcctgttattcgaagagggtcaagggctcagatagttagtgcctcgctacagatgtcttatctttgggattccatgcgacatctaaaattagtgtgcaacatgagggcaaagagtgaccaatggtttgcagaatacttgttgcgcatcggtggaggttctgaggaggcgactattgatgatcaaatttgtcttcctcatgatgtatgtgtaccgcacaccgggaagatagtgaccttgatactctaattgattgcatattccttaatctcaatacaaatatttcaagcaaagattatatcacctctcgagcgatatttacgcggaacgactcggtcgatatgattaatatgaagatgatagatcgtttctacggggatgagatggtgtaccacaactttgattgtgcggtgaatgatccgcacaactactacccagaagaatttcttaacactttgacacccaatggtctacctccacatgtgctaaagctgaagattggttgtccggttatattgcttaggaacattgaccctgcgaacagactttgtaacggtactagacttatcatacaggggttcaaaaaaataccatagacgcagaaattgtgttgggacaacacgctggaaagagggtttttctgcctcgcataaccttatgcccatcggatgacgatatgttctctttccaatttaagcgaaagcagttccctattcggcttagcttcgcaatgactgttaacaaggcataggggcagactttttctaatgttggggtatacttgccagaaccagtggcgttatcaagagctacggcaagatcgaacattagaatcctggccgtgccagctgctgagaagaacgtgaacaagaaaaaaggaaaagggaataagaaactaacaaaggatatattcacaaagaatatcatatataaagaggtcttaactctataaaagaggtaatatctc

SEQ ID NO: 214 - DNA, 827 bp, Hordeum vulgare
gcggttccagcagcatcctcgcccacctgtggcgcgccaccacgcgcgcaaggggacttcgccacaacgagacctccaagatccgtctgtcggtggacggacgagaccgcctcggcgtgccggccgagtacgccggtaacctcgtcctgtgggcgttcccgcaggccacggccggcgacctgctgaaccggccgctgaagtatgccgcgcagaccattcacgacgaggtggccagggtggccgacgccgagtacttccggtcgttcgtcgacttcacgagctccggcgtcatcgaggaggaagggctggcaccaagcgccgcgttgaacctgagggaagtgctgtgcccggacctggaggtgcatagctggctcaccttcccgttctacgacctcgacttcggcacggggacgccatcgtacatcatgccctcttacttcccgttcgaggggctcatcttcctcatgccatcctacatcggagacggtagcgtcgatgccttcgtacccgtctttcagcataacctcgaggctttcaagcaatgcgtctactccatcgatgatctccatgcatgaaccgtgagatgcatcgagtagcagccaatccatcacaagaatatgcagcacaacacgtacgattcaagttaaattactttcgtgccaaaataagtctccatgccatgcatcaatgcatgcgatgaagctccaaaaataaaactgcatatatatgcatgcatgtgatcgctatatgcggtgcaatagcttgcgtccattccttgttatatatgtgcaatagttccgcgccatatatttttgtttccttgtttg

SEQ ID NO: 215 - DNA, 1775 bp, Arabidopsis thaliana
atgtcgaactcaacgccctgcatcactccctttccggtcaccaagactgccgtagcggcaccagccactgtggtggagggtgtcaacgacgcgaactcaacgcccatctctccctttccggtcaccaagactgccgaagcggcaccagccacggtggtggagggtgtcaacgacgcgagcaggaagagagaaaggccgaagacgtatcgtgattataaagggaggtttatcacagcatctgggacatttacgccgaggtcatcgttgaggaagaggagaggtgacatgtctatgaggcttggaggaggggacttcacgccgcatagcttcacagttaataaaggagaggatataatcaagaggatcatgtccttcactgcaaatggttctcgtgggatcagtgttttgtcagtaaatggtgcggttgctaacgttacgattctacctcacggttcaagccgcagggtcatgacgtttaaggaggagtatgagatagtatcgctgaccaataatacaatggcgatatctgagagcggaggagtgaaaaataagaccggagggtggcggattacgattggtggagctgctggtggacgtgtccatggtggtgctttggctgggagtctcattgcagcaagtccagtccaagttgtgattggaagtttctggccgttgatcacaaattcgcgtcagaagaggaagtatgtgtccaaagctatggttgctccatccataacaccaaacttggtggcttcctcatccacaagaccggtccaacaaccagagatggttggcccttctcactctcagaagaggaacagcgagtccaacagaactatggttgttctttcagccacaccaccaaacacattggcttcctcatccacaggaccggtccaacaaccagagatggttggcccttctcactctcagaagaggaacagtgagtccaacaaaactatggttgttctttcagccacaccaccaaacacattggcttcctcatccacaggaccggtccaacaaccagagatggttggcccttctcactctcagaagaggaacagtgagtccaacagaactacggttgttttttcagccacaccaccaaacacattggcttcctcatccacaggacaagtccagggaccagatatgattggcccttctcactctcaggagaaaaaagatgagtccaacaacgctatggctgttttttcacccacagcaccaagcttcttggcttcctcatccacagaacaagtccaacaaccagatatgattggcccttatcactctcggcagaggaacgatgagtccaacgatgtgattcttctacccacagttcaatacttactggcttcctcattcactagacaagtccaacgtcaaccagagatgacaggcccttctcattctcagaagaggaatgatgagtcgcaagctgcggttgttacaccagcaataccaaactcattggcttcctcattcactggacaagtccaacgtcaagcagaaatgacaggcccttctcattctcagaagaggaacaatgagtcccaagctgcggttgttacacctgaaatacctaacttattggcttcctcattcaccggaccagagatgataggaccttctcattctgaggagatgaacgatgagtttaacccttctcagtttctgactctagggtggtacagctctacaccggagcaagacaagtaatctcatcaaaaaacattggacttcttaagttcataaaagtttctttaaac

SEQ ID NO: 216 - DNA, 597 bp, Hordeum vulgare
ccgaggccaaggacctgatgcgccgcatgctctgcaaggacgtctcccgcaggctctccgccgaacaagtcctaaggcatccgtggatcgcgagctgcggcggggatgcggtcgcaggctgaagagatcgatggaccaacataatctccacgcgctccatcctcctatagatagaagatcttctccgcaaacaacgacggctcggtctatgcggctctgctctgtttctccggcaaatcggcgatgggccgaagcagcggtggtgccggagttgagttcagtaagtagatcctttactctaggtctagagatctgtggtgaagctgggactgcagaagctttcacccgagttagcctgaatgtgtgtttgttcgtcgtgtttgttatgtgaatctctgtacatgcagtcttgttcagtcgtagctgaagaagagagagggttagtagtacctcgtggaacttggtaggcaagctttgttaaagaagaatgaaaatggagcaaaaaatatgtgcatgttcttgtacaaatggagcaaaaaaattctgctttatttaattccagcaactattccctatagcaaaaaaaaaaaaaaaaaa

SEQ ID NO: 217 - DNA, 1028 bp, Hordeum vulgare
cggcacgaggaagcaactttttatgcattcactactgtcagatttagtaattcaagttatgatgtagtagttccagacttccagtacatcttgccattttgcttttaaaagtataatagattaattgtattctacttcagagttagtttcagttatttgttgttctgcgacatgcaggattgctacctagcactgacaggtcctacccgtgctattgccgtgtcggtggatccttcgtacattgaggtttcactgaaagtgaagggcacaactgaagctgaggatacagatttaagcgatcttgttctgatgtacagaactggatgctgtcctggaagtgttttccctagcaggcttagcacgctggaaattgaatttcgccacattaatcgctcggtggaggccactgtccatataaaagtcattggcgggtcgtggccagatggttttcatggtgaatttagtgctggcatcagtagtagtgacgacctgcaagtcaagttacttgactttgaagatggtggattgcctgtgaatgctgatggcgagatcaaactctcacgccgagtggtctctgttggagttgagagtaacctgaaggtttctgtaagggcacgcccaattaacaaggaccatgctgctgagagcagcgaagcagttttgaaatgtcagagagccggtacaagcccctcgggcatcaagctcagtgttggttcctgtaatatggaagttagtgttgcttggtcctgtttccgtcgagcgtggtgacacgaaactattttaactcgattaatttaatccatgagttatatagtggtgtagcgtagtgcatgccagaaacctgttccaagttatgtagtagtgttgtagtggtattgtggcatttggtctagtggtgtatgccagaaaccttccgactgttgttttgtattacttcctccattctaaaataagtgtcgcttattttgtactccctctgtacctaaataattgtaattgaagagaactagactagttttctcaactgt

SEQ ID NO: 218 - DNA, 963 bp, Hordeum vulgare
aagagagtccacggcttcgacaaacttggctccacccgtggcggcctcggtacaatcatgcatccccggggctgcacgaattccgcacgaggctcaggctcaggctcaggcaggaggactccctcatcctcccttatcctcctcttccgcggtcacacttgacattcccggcttcttctgcgtcccccctcgatctggatccacaagaaatcagccctgcgatgaccggcgttggcggcgatgccaagaagagcctgacgcagtggctcggggacaaagggttcgacgaggaggccatcgggcgcatgtccaagcggtgcaggaacctgcccaacctcgacgccggcgaggcctccggcgtctgggactacctcctcaacgacgtcaagatcgagcagcgcaagctgcggtacgtggtcaccaagtgccccaaggtgctcaccatgtccgtcaacgagaagctcatccccacggtccagtgcctcaccacgctgcaggccaagcccggggagatcgcccaggccatcatcaagttcccgcccatactgttccacagcgtggaggagaagctctgccctctcctcgccttcttccagacgctatccatctccgagaagcagctcgccaagctgctcatggttaacccgcgcctcatcagcttcagcattcaggccaagttcttccaagagggtgactttctcgtcggccctggcattcacagggagggcatgatcggcaagatcctgaccaaggagccatacatcatgggatacagcattgccaaaccggtgcgtcctaatggcgaggtcctcaaatccccgggcggggtgacagggtccaatcttcaaagggcatcatgaaatttcctaagatacatgggcgagaaagtcacaagaaatttggcccccaattttgggtccttggaagcgctcggtttcaccaagggttcaaaccattaaaatg

SEQ ID NO: 219 - DNA, 1102 bp, Hordeum vulgare
cggcacgaggccgctctcgtggaagaagcggctcgagatctgcatcggcgccgcccgggggctctactacctgcacaccggcgtgaagcacaccatcatccaccgcgacgtcaagaccaccaacatcctgctcgacgacaagtgggtcgccaaggtctccgacttcgggctgtccaagacgggccccaacatggacgccacccacgtgagcaccgtcgtcaagggcagcttcgggtacctcgacccggagtacttccgccggcagcagctctcggagaagtccgacgtctactccttcggcgtggtgctgttcgaggtgctctgcgcgcggccggccctgagcccgtcgctgcccaaggagcagatcagcctcgccgactgggcgctgcggtgccagaagcaaggcgtgctcggccagatcatcgacccgatgctccaggggaggatcgctccccagtgcttcgtcaagttcacggagacggcggagaaatgcgtggccgaccgcagcgtcgacagaccgtccatgggcgacgtgctctggaatctcgagtttgcgctccagctgcaggagagcgacgaggacaccagcagcctcacggacgggatgctgtcgtcgtcgggcgcgtcgcctctcgtgatgaccagactgcagtccgacgagccgtcgacggacgcaagcaccaccacaacgtccacgaccacgatgagcatgaccggacggagcatcgcgagcgtggactcggatgggctcacgccgagcaccgttttctcgcagctcatgcgtccgggtggcagatgaagttggactctccgcagattcatggtcatggacaacattcttggtccacattcatgttgcaggtgccagtaattagtaattagagtgcgtataatatgatacacgccttatgacaattcaggtacggagccacttattaggactctgtatgtatattgtaccatgtaccagacagacatcatcgtcatagatgtcgccgaggcactggagttgcggttcttactactggttgctggttaatctgaattttttgaatgcaaagccaagatatccccttttaagaaagaaaaaatgtaaggtaag

SEQ ID NO: 220 - DNA, 2068 bp, Hordeum vulgare
tacgcctccgtgctccgcttccagctcgaggaggccgtcgaaggccaggacttctccgaggccgccgccctcaagcgcgccctcctcgacgccaccgccggcgacgccgtctcccgcgtcatggccgagctcaagagcgccatcgaggagcagcgctaccaggacgcctccaggctcaccaagctcgccggaaccagcctcgtaggttggtgggtgggatatgccaaggacaccgatgactcgatcgggaggattgtacggataacccctggtgtcgggagatacgtcgccaagagctacagcccaaggcaattgatcactgcatcttcagggagcccactatttgaaatattcctcgtcagagacgaagacgagacgtacacaatgaaggtggtacacttgcgaccgacaaaaggagcttcaagcgcgtcgtcgtccgtgccatcaacagccaccgaagatccagctaaggcagagactgagagttcaccggacagcagtgttttatctgaagccattgcagaggaagcaaacacggataccaaattaaaaggaaatgaagatgtcgaggagaaagcgcaggatactggaagaaccaaggaaagtggcgttgaagggttgaaaagtgttctgaatttttttaagtcccggattcccgagttcaaagttcaagtcataaacgtggaggtgcccgaggaagctgagttagttgcggattcgtcagaagagttagtgcaagatgatgtgaagagcacgtcagagagttcgttggaagagcctgtcgccgaggaattccaggaggaagatgtttccgacggagattcagactcgaacgacgagagtaaggggccggaagtaaagcttttcatcagcggagtagttcataataaagaggaggctggagcaaaatcttatgttcgagttcctgctgaaataaataacctggaaagggactcctttgaactgtacattcctggaaaaggttctgatcgggatctgagtgaaacaaaggccgcgaaacagaaagttgcggatatggccgctaaattggcgtcagagctcatgccctctgatgttgcaaaggcattatggggcaccaccaagagttcctccaagataaataaagaagtccaggagcttttgaagcttacactgagcaaggcccgagtcaagctgactgagaataccattttcaatcggattgttacggactctaatggctcagatccattcaatggtctctatgtaggagcatttagtccgtatggccccgaagttgtacagctccgtcggaagttcggtcactggaatagtactgatgacgtggagtttttcgagtatgttgaagcagttaagttgactggtgatcttagtgtccctgctggacaggtaacgttccgtgctaaggttgcgaagggcagtcgtcttgagaatcgtggtgcatacccagaagagtttggtgtgactgctagttataaaggtcaggggagaatagcgcaacctggattcaaaaacccgcggtgggtggatggtgagctgttggtgctcaatggcaagagtgcaatcccgcacattggtggtgccgagctcggtttcctgtacagcgtgcctgagcagagcttcctggttctctttgaccgccttacgcttcccgagtgagcgagatctcgctgatatgagctggttctctcatgggtattccatggagacacaaactggccggccaagtaggttccgcgcggcttctccgtctccgtcatcctcatcctcatccacatccacagagcgagcttcctgaggtagcctggctcctcacaggatccaatcggttcggcatttttgaggatacatagaaagatggcagcctggttcctgggaacatggctggtatattgagctgtcatgtgacgtgctacaacaaaacaaaacttaggctgtcaaacaaggggcgcggttatagacgtgtcgggcgcgaccttttcgcgggtttctttcgtttgctcgtttggatgaaaccagttttggtattgccttgatgctacaaaataaaataaaagttgataccatt

SEQ ID NO: 221 - DNA, 2124 bp, Hordeum vulgare
cggcacgaggctgatccgaaagaggcacgtgctggtattcaagaagttcattttctgccattcaatcctactgacaagagaacggcgctgacatacattgacgctgatggcaaaatgcaccgcgttagtaagggtgcacctgagcagattcttcacctcgctcacaatacatcggagatagagcggagggtccatgctgtgattgacaaatttgcagagcgtggacttcgatcgcttgctgtagcgtatcaggaagtaccagatgggaggaaggaaagccctggtggcccatggcactttgccggtctgatgccactttttgatcctccaaggcatgacagtgctgaaacaatccggagggcacttaaccttggtgttaatgtcaagatgatcacaggtgatcagctcgccattggaaaggaaacagggcgtcgcctggggatgggtacaaacatgtatccttcatccgctctgttggggcagaaaaattcagacgagtccatttctgctttaccagttgacgatctcattgagaaagctgatggttttgccggcgtcttccctgagcacaagtatgagattgtgaaacgcctgcaagcacgaaagcacatctgtggaatgacgggtgacggagtaaatgatgctccagctcttaagaaagcggatattggtattgccgttgctgatgcaactgatgcagccaggagcgcttcggatattgtcctcacagaaccaggcctcagcgtgatcatcagtgctgtgctcaccagccgtgcaattttccagcgtatgaagaactacactatctatgctgtctccatcacaattcgtattgtgcttggatttatgctacttgccctcatctggaatttcgactttccaccgttcatggtcctgatcatagcgattctaaatgatggtaccatcatgactatatcaaaggatcgggtaaaaccatctccactacctgacagctggaagttggctgagatttttacaactggagttatccttggtggttacttggcaataatgacggtcatcttcttctgggctgcgtacaagacaaactttttcccgaggctgtttcacgtcgaaagcctcgagaagacagctcaggacgatttccaaaagctcgcgtctgccatttacctccaagtcagcaccatcagccaagctctgatcttcgtcaccaggtcccgcagctggtcatttgccgagcgccctgggtttctactcgtctttgcattcttcgttgcgcagctgattgctacactgattgcggtgtatgctgactggaagttcgctgcgatcaaaggcatcgggtggggctgggctggcgtcgtgtggctctacaacatcatcacatacttcccgctcgatatcatcaagttcctcatccgatacactctgagcggcaaagcatgggacctcgtcatcgatcaaaggatcgcgttcacaaggaagaaagacttcggtaaggaggagagggagctcaagtgggcgcacgctcagaggaccctccatgggctgcagccgccggacgccaagatgttctcggacaaggggggctacaatgagctgaaccacatggctgaagaggccaagaggagggccgagatcgcaaggttgagggagcttcatacgctcaaagggcacgtggagtccgtcgtcaagctcaagggtctcgacatcgagaccatccagcagtcctacaccgtctgatgatctgcgctgtccacgaagaaaaaaagggggaaattcctaattaaatggctggttaccgacacgagtgaagagtggatctgtgaactcggctactgtaatcgtccgtgtagtgctcgagacataactactgtagtaaaacgttgctcgttggtgatgcagtttggcaccacctaagttatcgcgcatccgttcttcttttgtttgtttttttatgttttcagctagtatgtatattatgtttttccccttcatttttagctcgctaccgacatgtagataaatctagtatggtggcatgtgaccttcttcggtgcatggtcatgaaatgcttccttcctggagtctgtctgctttcagatctgtaggtgtggtttggctcaaatatatttacctgcc

SEQ ID NO: 222 - DNA, 479 bp, Hordeum vulgare
ttcggcacgaggcagctcccccgggtactacgacggccgatactggacaatgtggaagctgcctatgttcggatgcaccgacgccacacaggtgcttaacgaggtggaggaggtcaagaaggagtaccctgacgcttacgtccgtatcatcggcttcgacaacctgcggcaggtgcagtgcgtcagcttcatcgccttcaggccaccgggttgcgaggagtccggcaaggcataaactacgaggtgaaacaatggcctatgtcgtatgaaggtcttctgtgaacttcacttttgtccatgactctgctttccgactagagcataattttcttctctatgatctgtgtatgtacgagcataggttgtgcagcatatatgcatatgtaaattctagcaccgcctacacatatccaacacctgtgtcatatttatctttacctaataataaagaggctattaattccgtcggaaaaaaaaaa

SEQ ID NO: 223 - DNA, 1066 bp, Hordeum vulgare
gcgggaagctgtcattgatagggcattcagctgggggctggctcgcgcgcgtatatatggaggaattcgggacttctgacataagtttactgctcacgcttggcactcctcacctgccacctcccaacggtgtttctggcgtaattgaccaaactagaggactactaaactacgtcgagaagaattgtgcccctgcagtttacacaccagaactacgatatgtatgcattgctggaaggtatattcagggtgctcctttaactggaagctcccttgctgctaccacagatgagcttgtcgccgtggatgccccgtcagaagtagctgaagcagtcatggtcagtgccgataacaaaaccgctccgacaggccccaccttccgggcccgtttcgtcggacaaggctacaaacaggtgagtgacacccccaagcaatgccatgctgtggaatattccacatttattttccaaacagaaactactgaacaataccctaaatcccatactaggtttgcttgtggccgcgccgacgtctggggagatggggtcgtccccgaagtgtcagcgcacctggagggcgcactgaatataagcttcgacggcgtgtaccattctcctgtaggttctgatgatgaagagaggccctggtatggctcaccagcgatcctagagcaatgggtgcaccatctccttagttgattccacagaagctttaccaactccaaaagtttgtcaacaaaatggtgtactgccatgccccttttcactagtgaacagcacagcataacatcatatatacagtaatcatgtacagaagatgcagctgtactctcttctcatactgttccagagtgcgtctagatgtctcaggcctcggcgctccttgtatcgtgtaaccatgattctcaaaaaagaagaaaaagatgcagtctgtgtctgtacacagcttaggccggtgttttcctttcccttttgacaaattgttacactgtagtataacattgcgcaatgttcaggcccattcaatatgtatgaaattgcatatacaatgcgagctaaaaaaaaaa

SEQ ID NO: 224 - DNA, 613 bp, Hordeum vulgare
gctcaactcatgcccgacggtggtgtcgatggctcgtgaattggacccttcgctcccgctgtcggcggcgcagttggtgaggaagctcaagtttgcgtctccatggccggcagaagctgaggtggtgcaggagcttctggcagcctcatcagtgttgaacaaggcgatggtttggtcagaaactgaggtgaagctgaacctgcatgggttcagtataacatcagcctatgtgctgatgctgcagtgggtggacgcagtgagagggggccgcgcattgccattggaagtgtctgtcgtgtgcggtgtcgggaagcacagcgacgtccgaggcgagcccaaggtgcgagagcttgcacaggaggttctgagccggatggggagccccctgcggctgtccgcgaggaacaaaggccggctcgtggcgaagcgagacagggtgaaacaatggctggccactgagtggacttctgtggtgcctgaggagagcacggatcagccgccctatgcgagtgatcagcaaccatttttgcccaatcttttaagaaaactcgggcagtttttttcctcatttgtggcagtttccagatgaatggcaagctgtttattgtagagt

SEQ ID NO: 225 - DNA, 638 bp, Hordeum vulgare
gcacgaggcacacgagcagagcagggaggggaggggcttcggtgctccggcggcgggcctcgccgtcgccgtctgctccggcggcgtcccacgggtaccgacgtgcggtgctccgaagtccagatgacagcccgctccatccccgcgccgccatcccccacctcgacgccggccccggcgccagatccgccatccgccgacgccggaggagagagctccatccagccttgagaagggcacggaggccatgcttggttgatcgtctacaggttgtggagcctctactcatcatggatgaggatggcgacggggcaaaatttcaaaaagccatcctagggtccagggccttcatggtcattttgcagccaggcatggtgacagatttcagaaacccgcctctggagggaaaaaggaaatagaagacttgcgggcagttgaagctgtttcctcctagctctggattgagccccagacataattgtacatctctctttcttaatacgggatgggtatacgtttccccttctacattttgttgggggttgtaccgaagcaaaagtgaaaaaactatcagtttgtcttggttggatctatatttttatttattcacgtgatatgcattgtttttcccagtgtcc

SEQ ID NO: 226 - DNA, 667 bp, Hordeum vulgare
cggcacgaggggcaagggagccatcgtcttgtttcctctcctctctcccgagtctcgatttgcgccggcggcggaagcaatcgatctccatggcggcgacagcgctccggaccatctgcaagcggatcggcggccgcgccatccggccatcaccctccacctctcgcctcttccacagcacgagaaaagaagagctctaccgcctgatgtccgaaaacagggccaggatagaaaaccagaagggtccgatcaagcacctctcatcccatgtggagcgtaaacccgaggaccccgtctggcgcttctatcgcagggccaaatggtaccatttagtcatcatgtatagcccaacaatcctttatgtctgcatgtctgtgtgtggtgtgcctgatggcaagaaggagatgacaccagctgagaaggaggacggctagttccatagtgactaaccccagcactttatgtagttgccattgctctgtttggacaccgtggctttgttagactaaattatctgtcatgtttagtgcgtttgtgtgttatggtaaggctgaactagctgtggtgcttggtgtaaagtgctatcttaaaagttaagactgagttatcagtgagaatgttggctcaagtggtatagtagtatgttggtgttattttggtgtctctg

SEQ ID NO: 227 - DNA, 806 bp, Hordeum vulgare
aataccacatcgccggctggcctctccctctccctcgacctcgacctcgacctctcccaaggattcgggttggtggctgagcttgaggaagcagtttgctgcagtctttggctttggggcggcgagcgagcgagtgatttttagtatcggcgaatggcgactcagtggttctccaatatggtgatggacgagccgagtttcttccaccagtggcagacggacgcgacgctggagcagtacacggagcagcagatcgccgtggccttcgggcagggggagatggaggcggcgctgatgcagcagcagtacgcggcggcggcggtcggtgagcaccggccgcgcaaggcggccaaggtcaacaccagctgggactcgtgcgtcacggagcagggctcccccgccgactcctcctctccgaccatcctctccttcggcggccacgccgacgcgttcgccaaggcgccgcaggccgggagcgccgccgcctactacggcgccgcctccgctcctgtggcgcccgtgaagcccaagcaggaggtcgacgcggcggccgtggtggcgccgttccagcaggtgaagcggagctacgacgccatggtcgccgagcccgccagagcgccctcccggccggccgcccagaaccagcgacacatcctcgccgagcggaagcggcgggagaagctcagcgagcggttcatcgcgctgtccaagatcgtcccggggctcaagaagatggacaaggcgtcggtgctgggcgacgcgatcaagtacgtcaagacgctgcaggagcaggtgaagggcatgga

SEQ ID NO: 228 - DNA, 1868 bp, Brachypodium distachyon
tctgactggacgcgcgcgccatgaggagggcgcagcagcagcagcagcaccagggggcgtcggcgccgggcgtggtgcgcgtggaccaggcgtcgcccgcttccaccttccgccagctcgacgacgccttcctgcagaaacaaacgaaaatctggcttggtgaagttctccatgttaggtttgacgaagacattttggtcgcagaccttctaggcgatggcgagttgctatttcaagtttcgaaagtaatatggaaaaggttactgagaaagaacaaagagcaactcaagcaatcgaaagtttatatttatgagagaacatcttttggtaaaagcaatgggaaatatacgccctatccaaaagtcgactcgtttctaaagatatgccaaatccttgggttggctgggattgatttgtttaccccttccgatgtggttgagaaaagaaatgttcggaaagtctgcatgtgcatacgttcgctgtctaaaaaggccgggatgatgcacctgaatgtacctgattttgatgttgtaactcacacaatagccatgcccaattatatggttggagttatccgcagaagtctggagcaaccacggtgcagttcatcttgttcgagtggatatagcccgcatgcgaattctgagagcatatttggacagaatgaccaacaaggtgacacgcattatgactctgatgaagcagagagcagtctctatgtgctagaacctcaggaaaatgttggtgaagacaacctttcggaacgtttgcaaataggcaatgcccccaaggaacaaagagaaggctatggagatagtggacatggcaagctggaagagaagtcagtggctgaaccagtgggttcacttgactttggcgttatggatgctgattctgcggattcagctccttttcacgacaaccaactgtgttgttctactcactcttcaactgaccagtgctcaagaactagaacaactaaatgttcaatgagctcggaagagtcagactccattagcagttacttagcgttcgacagtagcaagaatgatctggacgctcctaaggtcaaagtttctgaaaggattcatgatgaacatgacgaaccttcacattcttctattcaaggaaatgggaaaatatttgtcgatcatccaaaaaaagaaggtgatgacctcctaaaggacactagcgccatggatcaacattgtgatgcttttatctgtgatagggaatctgttagttcaagttctgaagaacccaggttcggattaaatggagagtcatactcaggtttaaccccaagaaattctacgggtggtcaattgccagcagtttctgaagatactacagcaagtcgagggctgaaacatgaaatcagcactaaggatcacattgatgcttccagatccgaggacgaactggcgaaaccactagatacagctgaacacaacaacggaaatgctcagaggaatgaggacgatcctcccaaatcagggaaaggcgtgctgaagtcagtggctggaggaatcacgctcgttggcgcagtgttctttatagctcatctcaggagaagcaaggggagaatcttcacagcaattttacctccactgtctgaaaaatctattcagagcgactcgaggacgacgaacgtggacaaacgaaaggcagccgagctgtatcccggcggatggctgaaggtttaacaggatggagtggacacggccaattaatagggcagcgcaatttggaattctgtgtatcatgtaaatccatatagcagaacaccttgatattcttgatacggatcaggcttaatatttactgaagaagcgatacataatacaagtagcttctagcttatactc

SEQ ID NO: 229 - DNA, 1740 bp, Brachypodium distachyon
cggcttgccgacacccaatggacgcgcggcggcggctgtgcctggtcgcggcggtgctgctcgccgcggcggcggcggcggaggggtacaacatcaccaagatcctgggcgagcacccggagtactcgcagttcaacaagctgctgacgcagacgcggctggcggcggacatcaacaagcggcgcaccatcacggtgctggtggtagccaacggcgatatgggcgcgctcgccgccggccgcacgctgcagaccatccgccacatcctccagatgcacgtcctcgtcgactactacggcgccaagaagctccaccagctcgcccacggcgtcaccgcctcctcctccatgttccaggagtccggcgctgcccccggcatgtcaggttacgtgaacatcacgcagcaccgtggcgggcacgtgacgttcacggcggaggacgcgtcggacagcgcgtccccggtgagctttgtgaagtccgtaaaggagatcccctacgacctgtcggtgctccagattagcaaggtgctctcctccccggaggccgaggcgcccgtggcggcaccggcgcccgtcaacatcacggagctgctctccaagaagtactgcaagagcttcgcgggccttctggccgccgacgccgacgccttcagcactgtcaacgccacaaaggacaacgggctcacgctcttctgccccgtcgacgccgccgtggccagcttcatgcccaagtacaaaaacctcacggcgaaggccaagacggccatcctgctctaccacgccgtgccggactactactcgctccagctcctgacgtccaacagcggcaaggtgagcacgctcgccacgtccagcgtcgccaagaaggactacagcttcgacgtgtccaaggacggcgagacggccgcgctcgacaccaaggttatcacggcgtccgtcacggccaccgtcaaggacgacgacccgctcgccgtctacgccgtgtccaagttcttgcagcccaaggagctgttcaaggtcgccaaggacctcgcgccggcgccggcgcccgagggccccaagaagaagagcagcaagaagaagccctctgccgcctcatcgccctccgacgacgacgacgactcagccgcggactcgccagacgacgactccgggtccgatgttgacgctgccgacaaggccggcgccgcaccgcccatgcttgccaggtgggtcacggctgcagcggccaccgtcgcggcgttggccttggcaacctaaattaaggtttgaattcgtgtattctgtgctggattctctcgttttttgtctgtcgattctgtcccctgttagtgcaaaaaacaataatgaggagggccgtttatttatattaatttattattgctgcatccagagaaaaagaaaagaggaacttcgacggcatggttctagcagtttgaatttttgtttattttgttttcttgtaatcatagtggtcaatgggattggaccattgaaatgtgtgtttatatatatactctgcatatatatgaaaaaacattgttgagtttagaatgccacattactcgtactttattttattttgccctccttttaagctgtacgcaacacatttgttgagataggcggttagatgcaaagtggagcttgcgccatgtgattagctttgcttgttcggcttgtaaaggggatgatgcccacttttttcagattgataatgtcagttttgtttgtgttctct

SEQ ID NO: 230 - DNA, 1584 bp, Brachypodium distachyon
atggcgaggtcgacgacggcgaggtggctgctgctgcttgccctggtggccgcgtaccatggaggaggggcttccgtccgggctgccgtgggcgctggcgctcattggctgggcgggctgagccaggcgtcgttccccaagggcttcgtcttcgggacggccacgtcggcgtaccaggtcgagggcatggccttctccgacggccgcgggccctccgtctgggacgcattcgcgcacaccccaggtgctcccaaagccccaattgctattgctgcttattatgcttaccacttctgttgtgcttactgcttacgagagtccggtagattttctgataaggaaatattgtggggaatcaaaatgcagactgtcacaacagatcaatatcatcactacaagaattgccaagaaagaatcccagggacttacgtttttatgctggcacaggaagatgttaatctcatgaaaggattaaattttgatgcctaccgattttctatctcatggtccagaatcttcccagatggcgaaggaaaagttaacgaagaaggtgtagcgtattacaacaatctgatagattacttgcttcagaaaggcattactccttatatcaatctttaccactatgatctccctcttgcacttgagaagaagtatggcggatggttaaatgcaaagacggtggaactattcgcagactatgctgacttctgttttaagacctttggcaatcgtgtaaagcactggtttactttcaatgaaccaaggatagttgtgcttggtggttatgatgtagggtccaatcctcctcaaaggtgcaccaaatgcgctgccggtgggaactcagcaacagaaccttacattgtggcacataattttatcttagcacatggttacgcagttgcaagataccggaataagtataaggcagctcagcaagggaaggttgggattgttctggacttcaattggtatgaagctctcaccaattcaactgatgacgaagcagcagctcaaagagccagggacttccatgttggttggtttgttgatccactaataaatggacactacccacagataatgcaagaccttgtgaaagagagattgcccaggttcactcctgatgaaactaaattggtcaatggatcagcagactatattgggatcaatcaatacacggctaactacatcaaggggcagaaactggtgccgcagaagccaactagctactcagccgattggcaggttacttatgcttctgaccgtaacggcataccaattggaccaaagggagaagtatggaaatccagcagtcgtcataaccgaaaacggtaccgatactgctccatgtatcttcgaatggatcaacctgggaacctcacccgtgatgagtacctgcacgatatcaccaggattcggtactaccggagttacctcgccgagctgaaaagggccattgacggcggcgctaatgtgcttggctactttgcgtggtctctcctcgacaactttaactcaaccgaacttgaacggcacccgaaggctttggcctactggttcagagacatgctgaaggtctga

SEQ ID NO: 231 - DNA, 1077 bp, Gossypium hirsutum
agagttgaaagatagaactgatcaacctcgtggaacctgggaggacgtatatcgaaatgccaagaaggcggaccgtatgagaaatgacttgcacgaaagggatgaaagggaactcgaaaggattggtcaaccattgtgtatttatgaaccttattttggtgaaggaacatggcctttcctgcaccaaaattctctttaccgtggaattggattgtccaccaaaggtcgaagacctgggatggatgatgttgatggaccgtctcgtctgcaacttcttaacaacccatactaccgagacactcttggtgaatatggggccttctttgctattgctaaccggattgaccgtctacacaggaatgcctggatagggtttcagtcatggcgagcaacagctcggaaggcatccttgtccggaattgctgaaacttcattgttagacgccattgaaaagcaaaagaatggtgacgcactatacttttgggttcggatggacactgatccaagaaacaacatgcagagggacttttggtcattttgtgacgccataaatgctggaaagtgcaagcttgcattctctgagactcttaaaaggatgtatggcttagggcaggatttcaactctttgccacccatgcctgaaggagaaggcacatggtctgtcatgcagagttgggccttgccaacaaagtccttcctagagttcgttatgttctcaaggatgtttgtggatgcattagatgcacaaatgtatgatgagcactatcaaagtggtcactgttatctgagtttctcgaaggacaagcattgctactcacgggtgcttgagctgcttataaatgtttgggcatatcacagtgcacgtcggattgtatacgtgaatcccgaaaccggtgcgatgcaagaataccacaagttcaaggatcggaggggtaaatgtggatcaaatggttttcattcaacactttaaaggtcatggatgaggatttagccgacgaagcagattctgaccacctaaaaagacgatggctatggccatcaacaggtgacgtcgtctggcaaggtattcttgacaga

SEQ ID NO: 232 - DNA, 727 bp, Zea mays
atccattaggcccgtttccagtttccaccgtcaacagacgatggctatcgccgccgttcgccggcttttgtggcgcgagctggggactgcggccgccgccgcggccttggggacggacgggaatctgttcgctcgcctggtctcggagccggagtgccgtgtcaaggcgaccatggaggaggctgcctcctccgggacccaccgcgacggcgccttctgggagccccccgtcaccgcgctcctccgcgcgtcgtctcctaccaaggcgcacctcgactaacagacactaggctgcaaactgtgggccatgaaaaaatggagagacttgatgaatccatgtgacatgcagcaccaaccaagtggtccactttgcacctgatgttcagaaacagtaacagtaaccggtcaccagatctggtctacagatcatgctccaccaaatcttatccgccatgataaaaatccaagttgcgtcgagtgggcacacaaacaccgcacagtttgtttatctagaaatttacatctgattttagggcaaccaaaggtaatccacagtagctggttctcacatgcttgagaagagaagcaggaggaagagaacatagctcatgaaacatcgcctgtctgtctgtctctgatgcgaagcagggaaggggaaggcaacgtgatgaacagctagcccatcttaatttaccaaaaaaagaaagaaagatggcaagacattact

SEQ ID NO: 233 - DNA, 1088 bp, Zea mays
cgcgtcggtcgtgtcacgttttgctccagtccctgaaacgaaagagttgcggggcaaaaagaaaaaaaatctagaaccttctctcgttcaagcccacagaatccaccaagccacggcgtcaccgccagcgcgactgccatctcggggaaggaaccgaaccgacccctgaaaagaattcggtgcgtcggaaggaagagcaaccctgcggtggtggagcgaggacccgggttgagggatgtggtgggagtgggagggcgacggtggtgaggcgccgcgggaggagactcctgtcgacttcgatttcatcgccctcctcgccaagcccaaggattactacaagatactggaagtagattactatgcgtctgaggagacgatcaggtccagctatatccgccttgcactgaaatggcaccctgacaagaagcaggggcagggcgaagagaattcaacctccaaatttcaggaaattaacgaggcataccaagttctgagtaatccagcaaaaaggcaagagtatgacaaaaaaggcattctatacgttcaagatcagaatgtagtggattacctgaaccggcacaaggggctaatacttacgtgcaatggtcttggtataagaatggcatatatggatttttgtgtgtatgacaggtggggccagtggggatgaaaataatttctgatgacatacagggaagcctttgatctgaaaatggtatagtgcagcagtgccatgtttgaaagccaaatattgaccacttgagttcatcctacaaggctacaacagagttgatttttatttgtcgatcagctgttgttgaatgaaagaggcagatatgttcctgctgctccttgtatgtaacatactgttcctaaccatgcaatgtaagcgtttgtttctgtcttggcgctttgtattgacgttatgtggacctgaatgtctgtggaaaaacagagtggtatcatgctccttccccggaaactagtacatctatatcctcattaacatactctctccgtttttattagatactgtgttagctttgtcattgattttaaaaaatatatagattcatgttattggttca

SEQ ID NO: 234 - DNA, 2950 bp, Zea mays
atggatttgtttacaattgactcggatagtgagtcatatactgggaccagtgacagtgaagaccaagaatgtgaatttacatatagtgaccatgcccaaaacatcttgtccagtctggatgagagcattggcaagattgataattttttgacttttgaaagggggtttctgcatggggatatagtctgccctgtttctgatccctcaggtcagctgggacgtgttgttggtgttgcaatgtttgttgacttggagacaagctcaggtgacataattaaagatgtaaacagcaagaagctatcaagagtgagatcttttgtttccggtgactgcgttgttatggggccatggattggacgagtgataagagcatttgatcttgtcacacttttattcagtgatggagcaaagtgtgaaatcctgttaagggattcggatgtactgaagcccattcctcctgttctttttgaagatgcaccttacttttattatcctggccaacgtgtgaggatagtcgatccgtcagtttccaagtcagcaacatggttatgtggatcatggaggcccagtagagatgatggtattgtctctcatgtcgatgtagggctggtgcatgtgaactggatcacatctgtaaccaatgtttggggagataaatcatcaagtcctccaaacattcaggacccaaagaagctcaccttgctgtcatgtttcccttacgctaattggcaactaggtgattggtgtgctcttatgactgacaacaatggatgcctctggatggattctggcaagtcttgtattcttagtgaagaccagaagtgtgactctcatgcacacatgtattttgaaagttatggttcagattgttctcaaacatttgttgttgccaagacaaagagcactgttgatgttctgtggcagaatggaactgtatctcttggtctagaaccccaggcattactccctgtgagtacccttggtgaccatgatttttggccaggtcaatttgtcctagaaaaactgactgtagaagatgctgcaagatgtccgcgaacggcaatagtgagtgatgtggatgcactggagcgaacagtaaatgtaaaatggattggtccagcacatagtgacattgtcagctatggaagtgaccctgcagtggagactgtaagtgtttatgagctagtagagcacccagatttctccttctgcactggcgaggtcgttatcaggtcagctatgaacatagacaagtctgaagcagatcccacaaatgggtcattggcaagcaaagaatcattggttacctcctctggcttcttatcatgcaccggaaatgtacttgggtacaaggacaatggaattgaagtgcaatgggctaatggtgttatatccaaggtgcaacattttgagataattggattggacaagcttcttgataatagttctgtagaatcaatgaatgaggaacatacaattggtgattcattagacgaggctgagcaggaggaattgaaccatgaggtctgtttgtttattgctctggagtctactgaagactgcactggctccttgtgcaaagccactgcttttctatttcccaagacagcttttgacttcctgacaaatgtggctgctagtttgtttggtattcatggttctccatctccaagctcagttttggtagatcctcgatatgaaattgtgaagatggcagaaatgcagccatgtgcagaagaaacaccaaaagaagaacagatagtgaagtttgtggcgcagattgacaagccaattctctcttcagaagatgccatctcaaaaagattcgatgtagtcactgactgtttggatcatcattttgtgaaggaaaatggccatgaaagtgttacaagaggttggttgaagaaggtgcgactggaatggaacatcctgcaaaatgacctaccagatggtattcatgtgagagtttatgaggaaaggatggatcttctgagggcttgcatcgttggggcacctggaacaccttaccatgacaatctttttttcttcgatattttctttcctcctgattacccccatgaaccaccttctgttcactatcactctggtggtctccgcctgaatccaaatctgtatgagtcgggaaaagtgtgcctcagcctcctgaagacatggacaggcactggtaacgaagtgtggaatgctgaaagctcaactgttcttcagctgctgttatcgcttcaggcccttgttctcaacgaaaaaccttacttcaacgaggcgggatacgacaaatttgtgggcaaggctgatggagagaagaactccatcacgtacaatgagaatgccttccttctgtcatgcaaatccatgatgtatgttttacgcaagcctccaaagcattttgagacgttggtcaaggagcatttcacctgccgtgccccgcaaatcctggatgcctgcgaggcttatcttgggggcgatctcgtcggacatgcgcacgacaaagcatacgtagcagaggacggcaacaagaactgctcaaccggtttcaagataatgcttggtaagcttctgccgaagcttgttactgccttctgtgaggccggtatcaccagcgacccgtaaaaccagcgcaagcctgctctctgctgcatcagcaatggaattgggacccttctttatattgcgcgtgtatattcgatgcttgtgtattccaaataaaatggcgcctggtttgtgtgttacttgtgcctgtcttgtaaatgtgaaacagtattcacagatgattgctgaactgatatgattggtcttgtaaatgcggaacggtatgtacgcatgattgctggtgtttatgttgctaagctgaaggcagctaaacactcaagtgtttgggtttgggctgtcttctgcggtcagtgtgaaataaaatgtaaatgtgtgttgttca

SEQ ID NO: 235 - DNA, 3065 bp, Zea mays
ggtcggaggatcttgctgcactttgaagctgttgattctgcattctttgcttgggtaaatggagtactagttgggtatagccaggatagcagacttcctgctgagtttgaaattactgattgctgccatccttgtgattcggacaaggaaaatgttcttgctgttcaagttatgaggtggagtgatggctcttatcttgaagatcaggatcactggaggttgtctggtattcacagggatgtgctcctactatcaaagccacagatttttatcacagattacttcttcaaagcaaccttggatgaaaatttcagtttagccgatattgaggttgaggtggagattgactcacacaagcaagaccaggagcacgtcccaactttgtctattgaagcaacactcattgataactctggactatctaacagtatagatgctgatctttcatccgctaatgcagtcaatttgaaaccgaagccaaaacgaactcgaagcccttgtcttggttttcatggttatgtacttggtggaaaaatagaaaatccaaaactttggtctagtgagcatcctaacttatacacgcttgttgttctccttaaagatgccaatgggaagcttattgactgtgaatcatgccaagtgggcattcgtaatgtggtcatggcacacaagcaaatgctcgtcaatggatgtcctgttgtgctaagaggtgtcaacagacatgagcaccatccacgccttggaaagacaaatttagaagcatgcatgatcaaggacctgattttgatgaggcaaaacaatatcaatgctgttagaaatagccattacccacagcacccaaggtggtatgagttatgtgacatttttggtctttatgtcatagatgaagccaacattgagacacatggttttgatgaatctaacactttcaaacatcctacacttgaacctatttgggcaaatgcaatgcttgatcgtgttgttagcatggtggagagagataagaatcatgcatgcattattgtttggtctctaggaaatgaatcttcatatggacctaatcatgcttccatgtctggttggattcgtgaaagggatccaacaagactcctccattatgagggaggtggttccagaacatcatccacagatattgtgtgccccatgtatatgcgtgtctgggatgttgttaagatagcaaaagatccatctgaaacaaggcctctaattctttgcgaatattcacatgctatgggaaacagtaatgggaatattgatgcgtattggatggccatagacaacacttttggactccaaggaggttttatatgggactgggctgatcagggtttactgaaggaggactcagatgggtctaaattttgggcatatggcggcgactttggagatactccaaatgactccaatttttgcctcaatggcattgtgtggcctgatcggacgattcacccagctcttcatgaagtaaaataccttcaccagcctatcaaaatatcatcagcagataatatgcttaagattgaaaatggacacttttttgagacaacagaagctttggacttcagttgggttcttcatggagatggttgtgtcttgggctctggtccattgaatattccaactttggcaccacaaactagtcagctcatcaacatggaatcatcaccttggtttgccctttggagtgcctgtgcagcaaaagaagtatttttgtctgtgaatgtgaaacaaaggcatgaaacacgatgggctaaagctggtcatctcttggcttcagcacaactgtgtttgcctcagaaaaatggctttgtccccagcgtgatagcattgtccagtagccctttggtctgtgaacgcattggtgataatgtaaccatctgcaagaataatgcctggaaaattaaagtaaacagtcagttgggaacaatcgacagctggaaggtcaacgacgttgagcttatgagcaaggggatactcccatgcttttggcgcgcaccaactgacaacgacaaaggaggtttcttcaccaagccatatgactcgcgatggagagaagccttcctcgacaatgtctcgttccacagcagccagttctctgtcaaggagttgccggacaacaccgtggagttctccaccctctactacggtgttcccgggcacctacccaagcctgacgacgaagcctccgagtccattctcttccgggtgaagatggtatgccggatccacgggtcaggcgacgtggttctcgactacgaggtaaaccccaggagcgacctccctccccttccccgggtgggcgtcgtgttcagcgccgggaggtccctgagccacgtcacgtggtacgggcgcgggcccttcgagtgctacccggaccgcaaggcggcggcgcacgtcggcgtgtacgagagcagcgtggaggagctgcacgtgccgtacattgcccccgtggagtgcggcgggcgggcggacgtcaggtgggtggcactccgcgacgccggcgggctcggcctgtacgcgtcggcgcacggcggctccccgccgatgcagatgagcgcgagctactacggcgccgcggagctggacagggcaacgcacgtccacaggctggtgaagggggacgacatcgaggtgcatcttgaccacaggcacatggggctgggcggcgacgacagctggtcgccgtgcgtgcacgagcagtacctgctgccgccgacgcggtacgccttctccctgcggctctgccccctgctgccgtcgtcgtcgtgccatgacatctacaggtctcagctccccagctgatggtgccgtgtgccggaggcccgtcgatgtcgagccttgggaaacaacaatgaacgcaatggcctggccagtgaatgaaagtatataatattgtaataaagcagagacgtattagctcctgcaacggcctcgcgatcgcctggatatgtctatgctgagggggtgtttagttaactaataacctaactacatatggcgccaagttactaaaacttaataaataactattactaactaaaaaa

SEQ ID NO: 236 - DNA, 2321 bp, Zea mays
atgcctcggaagtcgcacaaggcgaggggcgcggccgcgcacgccgccgttggtctcacggccgggccgaggcctcccctgaaggccacggccccaaaccctagcgccgccgccgagcttccccaggtcgtcgttgccgaggcagagggcctcaaggtacctgacgccggggcgtccgccgccgctgacgccctggagcgcctccacgtcgcccctgctcccgacggtgatccgccgcctcccgagcccgtgcacgagcccgccgcgccgcctcagcccccgccggccgaggcgtcgtcttctgggaggtctgcggcgggcgggagttgggaggaggaggctgtaaggaagctgcgggagctggcggaggttagtcgggatgagacggagttgaccgaggaggaggtgcgcgccaatgatcagaggcaggaggacgaggttcttgtgcatattgaggttccagattatatagatgtatcaacaaagctcagttatggtgatggaacattaaattatgcggcaacacatgatgatgatgaccttttctacaagttcagagttgagcatttgcctccgatcctgctaacatgtctcctgcctacatcatacccaagtcaccgtcctccctttttcactatatccacatattggcttgataaaggcatgatttcaccattatgtcgcatgcttgacatgctttgggaagagcaacaagggatggaagtaacatatcaatgggtgcaatggctccagagttgttccctttctcacttagggtttactaatgaagtagttttgagaaagagttatgtaacatgttatgcagatggtgaagataagcgtgcttgtccagattatgcttcaccagatgttataattccaaggatgatgagatacaatgacaataagcatcatgaagctttcttacatgctatccatgattgcatgatttgtttaagcgagtgtcctggtgttgatttcatcaaacttccgtgtcaccatttcttttgctggaaatgcatgcaaacttactgcaaaatgaatgtcaaggaaggaaatgtagtgaagttgctatgtcctgatacaaaatgtgaaggtgctgttcctccgaatgtattgaaaaggctgcttggagaggatgaatatgaacgttgggagggattattgcttcagaaaacccttgatgccatgaaagatgttgtctactgtccaagatgtcaaactgcttgcttggaggacgtaggtaatgaagcagtatgttcaagttgtttgttcagcttttgcactctctgtagaaatcgccgccatattggagagcaatgtatgtctccagaagagaaacttatgatcttggagaaacgccaagaatctgggaatgtgcaaggagatcagatgaaagttctacaggaactacgcagcctgaaggaaattatgaaggattcaaaacagtgtccaaaatgcaggatggccatatctaagacagaaggatgcaataagatgcattgtgagaactgtggggagtacttctgctatcaatgcaaccgtgcgatcactggatatgagcatttcaggggttcgtgtgtgcttttccctcaagaggaattggacagatgggaaatgcaaatgaatcaaagggtcggacgccaaattgttgcacatgctcatgctgcaatacatgggcagaatggtcaagctcatccttgccctacatgtcggcaaccgtctccaaagatcggaaacaacaaccacctcttctgttgggcatgccagaagcatttttgtgccctgtgtcataaggctgtccaaaagcccgcacagcattatggccccaaaggatgcaagcaacatacggcagatccctaaatgaggttttcacacatgtgcatcaacaccgtggtgccagtgcagtttccaagtgttctgtgcaagtacagataaatacttgtcctgggacgtacttcactcctggattccattattattattatttttttgctgcaagcatgttttgaagtttccgtcgtcgttgtacctacagtaacagttgtgcagtttacattcgggaacatgaacaggaactgttcattcattcgttcagtaccagatgaattgttgagaatactcgggtgttgaagttgagaatactcgcgtattaaagatgcgattgaacacaagtctaaaaccgatagaaccttgtaaaattctaaaagggaagattatttgttgtactgttggattgatcttatgccaatacaaaggaagctgtcattgtttggttatatggtttcaaattttaacttggcgttcccgatggtcggacc

SEQ ID NO: 237 - DNA, 1789 bp, Zea mays
acctctactctcactagaacagaaccctaaacccgcatcccgaacattgacgccggcgatctccgccgccaccgccatgttcgggaccccatccatcactcccgctttcgggaacccctccagcaccccggtttttggcacgccatccgccacccccgcatttggcgcgacgtcgtccaccccggccttcggcaccctctcgtcgacgcctgccttcggcaccccttcgtcgactcccgctttcggtaccccgtcgtctacgccagcgttcgggaccgcttccacgacccctgcgttcggggcatcgtcgtcgacgccagcgttcgggaccacttccacgaccccgccgttcggctcgctgaatttcgggacgccctcgtcgacctcagcattcggcacgccgtcttcggcgccggcgttcggcgcactcaatttcggaacaccctcgtcgacctcggcattcggcacgccctcttcggcgccggcgtttggcgcgactccttcgccctcgccctttgggttccagcagcaggcgacgccgtccccatctccgttcggcttgctaggaggtggcggcgcgcaaatcaccacccagatggcccccgttgcgccgctgccgctctccccgtccgaccgcgacatccaggccattgtggatgcgtacaaagaggaccccggtaatccacgttatgctttcaggcatttgttgttcagcgtgacagaaccttcccaaagggtgaagccagttgctgcctcagatattatgtgggcagaagcaatggggaaacttgaatgcatggatagtgcagacagggagaggctgtggcctcagcttgtgcagggttttaaagacctttcccatcggcttaagcttcaagatgaagtccttgtttcggacactgatagattgagcatgactcactctaatgttaaaaagctgcaaaggcatttccaagctgacacgtatccttggatccagcgattgaagcaacaagagctggctattcagagacgtcttttaaggtttgttagaatagtggaggcattggagaatcggggctaccgctgtcctttaacaaaggaggaagctgacttgtatgaaagattggttgctatattaaagcggctaaaaggacataacgctgatcttgctaagagggtcaatacacttgtttcgacgtcgcgtcttctggctagcagtggtggtgctggtggttccgtttatattcccagttctgcaaaagttgatgagcggagtgttacagagcttcttgaggccttacaacaacaaacagaggcagttgccaagctaggtaatgtgttgaagagggatatcagggacatggagatcatccagtcagaaggtacggatatggctgaagacaatgtggggagaagggcacagaaaatataagattgaagcatggtctttgtcgtagctaagtaataagcgggtgatggaagggatccatcgtcgctagaaggatctgagcctccaacttatttggagtaatgggccagggaaatgatatccctgtgtaactgctgcaggcaagcttgattctgcattctttgggaagctaaccatggtcaatcagtagtggtatgtgtagattgtatgttgaactgaggcagtattcttagaactcagctttctcctcgtgccaactacattttcagtgctgttttgttgctcaccgtgattcgttgagctgttttgtaaccccgcggatggtgttgtggaatggacggagccctgcatatgcttggtccttgtcctcgacgttgc

SEQ ID NO: 238 - DNA, 1559 bp, Zea mays
atcgaaatctccgcctcctccagtcctgctcgctccccacctctcatggcggcgccggcggccacccgcctccactccccgttcctcctgcttccttccccaccgcacccccacccttcacttcgcctccgcttcctcctgccgtccccgccgccgctccgcctccgccgccacttcccgctgctggctgccgccgccgtatccgccgcagccggcgccggcggtggcggggaggaggtcgccgctaggaaggacgacaaggccaggcagctgcagaagcgggtcctcgtgggcgtcgccatcggggtgggcgccggcggcatcgtggtcgccggcggccgggtgttcgccgccgccgtcgcggccgccgttcttgccggctcccgggagtacttcgagctcgtccgcagcactgtagccggaggcgggaccccgccgccgcgctacgtgtcccgcgtctgttccgccatctgcgctctcatgcccatccttacgctgtactatggacgcatggatgttactgtggcgttttctgcattcgtcattgcaatagcattgcttttacaaagaggaaaccctcgttttgctcagctaactagttcagttttcgggttattttactgcggttatctaccttctttctgggttaagcttcgatccggactagctgcccctgccttaaatacaagcatagcatacaattggccaattcttcttggtggacaagctcactggacagttggacttgtagcaaccttgatggctattagtagcatcattgctgctgatacatctgctttcctttgtggaagggcatttggtcgtacccctttgactaacataagccctaagaagaccttggagggtgctttagctggcctagctggctgcgtactgaccactgtgctgctgtcgactgccttacgctggccaaggtcgcttttgagtgccacagcttatggaatcctgatcttcctgggttcgttattcggggatcttgttgaatctctgatcaagcgcgacgctggtgtgaaggactccggatcgctcattcctggtcatggtgggattcttgaccgagttgacagctacgttttcacgggggcactttgctactcttttgtcagagtggctctacccctgtacggggtctgattagagcaccggccttcttgttgttttgcctttctccttccatcagcaatgcggtcagtcaccatacattttaacatgcaacgatgagtatttgctgggatgccctagatcagttcttcatctcaagacaacgtggtcttccctccaagcgaatttggtggccactagctcgtcatcgacattgcttcttgctttgggtttgagatggcctttccagctcaaccagtttcttgcaagccttgtaactctgtgtgtacatagtttattttttcatatagagagagagtaaaaaggaaaggctaattattcatcacaaaagctgttaacagtgcattgaggcagcttatgtcaatatgtaccaaactacacttgttttaataattcaaggcactaaattccctatc

SEQ ID NO: 239 - DNA, 1323 bp, Zea mays
actgtggcaactacggccacaactccaggacctgcggactaggactaggactaggacacagagaaataatgctctgcgaaggtggcgacgacaataatggccgcagcggcctaaggctcttcggagtgcaggtccgtatcggcggcggcggtggcgcagggtcggcgtccatgaagaagagctacagcatggactgcctgcagctcgcggctcctcatgcttgttcgtccctcgtctcgtccccgtcgtcgtcgtcgttgtgctcgtcctcgtccccgtcgtcgctgctgctgtcgattgatgatgggttgcagagaggggcggccgatggatacctgtctgatggacctcatggcagagctgtgcaggagaggaagaaaggagttccatggagcgaggaggagcacaggcagttccttgccggcctggacaagctgggcaagggcgactggcgaggcatcgccaggagctacgtgccgacgaggaccccgacgcaggtcgccagccacgcgcagaagttcttcctccggcagagcagcatggggaagaagaagcgccggtccagcctcttcgacatggtgccgatctgcgagaacagtgcgagcatctccgatccgctggacgtggcacgccatggcgtcgcctcggcagactccgagagggcggccgtggacgtggacctgatgaattcgacgacggagggtgacgacggcaggagcagggacgtcgtgtcgtcggcgtcaggtgcagggaccgcactgcggttcccggcagcggcagctcagacggagccgctgcatccttcgtcatcgcatggccatgggcgcggccaccactgctctccgttggacctggagctgggcatgtccctgcccgccccatccgtcggaacgtgatggagatgaggcgaggccgaggccgtgcgtgactgctgtctccctcagctgtgtgtgtcagccagatggagatgatgcgctagccaatacagtactgttcgtgatcgtgaaaacggtgtgcaaacactagcacagcggcactaaactaggatgtcgctcctcgcaccatttgtgtactgtaaccacgttgatccacgtcatctctatctcttcaccaccgttggatcataggctgtcagtttcatctatccgtccatgtgtcatactcattcacgatgcggtggcttaatgatccagcagtaatttttcttctttcgtgacttaagggtatatacggtggtatttaatgtagaggcttttgatgtatttaaaggggtatttgcaaaaaaattatggagccgtctctgcatgaagaaacgcatctgtc

SEQ ID NO: 240 - DNA, 2020 bp, Zea mays
taatcttcgtttacctctctctttctctctctgtgtgtgtgtgtgtgcaggaaaaagaagggagctgtgctaaaatttcttggaggggagggggtagatgacgtttggtagcgccgacatggaggccggcggcggcgagcaccgccacgcacaacaggaggaacagtcatccgacgagcggcgcgcgcggttcgcggaggactggggctgctgcgcctgcgcctgcgcggggttattcctggggcccaacccgatggtggcgcgctacctgtacgcgctcatcttcctcgtcaccaacctcctcgcctggacgctccgcgactacggcgactccgcgctcgccgagctgcagcggctgaaggtctgccagggcgcgctctactgcctgggcgcggagggcgtgctgcgggtcagcctcggctgcttcgtcttcttcttcgtcatgttcctgtccaccgtgaaggccaggaaggtgcacgactgccgcaactcgtggcactccgagtggtggccggccaagctcgccctctggctcggcctcaccgccgtcaccttcctcgcgccgtcgccgctcgtccagctctacgggaaggtggcgcatttcggagcaggggctttcctggtgatccagctgatcagcgtcaccaggttcatcatgtggctcaacgactggtgccgcgcagagatgacccagaagagataccacttgcagattcaggcggtgtccatcgtcacgtacgtggggtcgctcctggggatcgtgctcatgtacgtgtggtacgcgcccagcccggcctgcaggctcaacatcctcttcatcaccgtcacgctggcgctcgtgcagctcatgaccttcgtctccatgagctccaaggtgaaggcagggtacgtggcgccggggctgatggggatctacgtcgtgttcctgtgctggtcggcgatcagaagcgagccgcacacggaggtttgcaacaggaaggcagaagtcgccacgagcgcagactgggtgaacatcgcgagctttgtgatcgccgtcgtcgtcatcgtggcggcgaccttctcgacggggatcgactccaagtgcctccagttcaagcaggcggagggggagtcggaggaggaggaggaggacgacatcccctacggcctcggcttcttccacctggtgttctccatgggcgccatgtacttcgccatgatcttcgtcggctggaacgcgaacgcgagccacaccatggagaggtggacgatcgacgtcgggtgggcgagcacgtgggtgcgcgtcggcaacgagtggctggcggcaatcgtgtacatatggatgatgatcgcgcccgtcatctggaagacgaggcaggtgggatcggcggcggagacgtgagcagtttttccgctgattctgagtttctgacagccggaatctatatatacatacaaacacaagagcaaatcaaagggacgggaaacgggaagaggtggtgcgtgctaactcctatgcatcgcattcctggatgttcattggtcaatgatgatgctgcactgctgcagctcgggtagtttttgttaagctggaggtgcagcagacaagacaacaagaaagaggaggcaactaaggagtagtactatactgatgccactagtccatcgtggagctcggttcaggaagctcatcgatctcgttgtacttgtaccgaactatctcaaaaaacatagtgcctgtttgtctggattgctgttcggccacaagcacagctgtctggcccggggcaccatccaaacaatcccatatagagcgtgtttggacgcagtcatgcgcttgggttttgcttttgcctgtctgtgcccggcagattcatgggcctgtaagcaaacacgtcccaattatctgaactcggaattatttacgcctcggcaagattcatcaactcaatttttttgtgaacaatcttattgtgttactaggtgaatgcccgtgcgttgctacggagtaaacatattatgataagatatattgaaattc

SEQ ID NO: 241 - DNA, 839 bp, Zea mays
tttcatgcagtgggcatggtcctcggggccgtcacgggcgcgctgatcgggctcgccacggagagcggcctggtgcgcggcgccggcatcgggtccatctccggcgccgtcgtgtccatggaagttgtcgattcctccgtcgccatctggcgctccgacgagtccgggatctggagcgtcctatacgtgctcgatgtcctctggagcctgctgaccggccgcctggtgcgagagaaggtggacccggccgtgcaaagcgccgtcgacagtcagatgaacgccgcggactcgcaggacatggcgccgacactggcggacatgttcgagacgggcgccgccgacgccaagggcatgccggccgccgctgtcgcggcgctccccatcatggccttcaccgagcacaccgtcgccgacggctccggggagcccatcggctgctccgtctgccttcaggacttcgaggcaggcgagacggcgcggagcttgccggagtgcgggcacacgttccacctgccgtgcatcgacgtctggctgctccggcacgcctcgtgcccactgtgtcgtcgcgcggtctaagccggtgcgcacacttttcgttaggatgtctttgggcaaccgtgagccgatgcgcgtgcacacgtgtcccagaccaggagcacagtatagtagggtagtaggagtgcaggacacctggttctttcttgcataccttgattatttttttccttcttttttctacgtcttgagcacgcatgtacagatacagtacgtggctcacattgtctcacacacactgtggatgtaaatatgtatagggtaaatgttgtaaacaatgtaat

SEQ ID NO: 242 - DNA, 1303 bp, Zea mays
acttagatttttccagcgacgctgtcttcttcccctgttgcgcgccgtggagctcccacacgcgtttcttcccctgccgaagccctcccatggcgcccggctctgcttgcccgtggccgtcgttcctaggatcagcctccatctccagttcgtctctctccctgcgcgctttcccagacgcgcgcctagctcctcgcgcgggtctctggtgctcagcagcccagctccctctgctcgcgacgcacgcccagcctctcccaagaactcgagttcctctgctttttccccaaccgcgcgcggtacttctcctctgctcgctcgtcgccatggcgatggccaccgagctcccttgtcgtggcttcctgcttcctcgtcgcgcgcgtagcgttccgtcgttccctgccgtgaccccgtcgtggtgcttcctcgcgcgcagctcaccccaactcccattcgtagtggtcgccagtcgtcgacctagctcggattccatttcgccaacacctgctcctagtcgacgcttgctcggattcgcgtccctgcgcccagccaagttcacccctgcgtgcagccgtgggtttctctgcacagcgttcctgctccccggcctctgtcgtgctcgacagcatgtaattcatgtcgaagcagcagcttcgatcccttgcgtcatgctcaccagatcgagtctcacgtcgtcgatctgtgccattatatttggctatcggtttcgccggttgtcgattttcctattcgctatggtcatcacgacaattgttcctatccgagctagcctcgctcgccagccgtcacgccatctttacctgttaggccgtgcgttgccgcgttcacttcgttgtgttgccgcgttcacttcgttgtgtcatcgtgaacttgtcgacatactgttgtggtacctggatcgcgcttgctgttgggcctatgcttcgtcgccgaaggtcttctaggaagaagcgaccttcggctgaagctgtttgtgtaagatggccgaaggtccctcttcatgaagcttcggtatcacaaaccgacttaaagatagaataaccttttggtccataaaggtctgagtcaatgttgtaaactttcataagggacatacttgtaatctctcacaggctgcgccctgtgcctataaatagtgaacagtattcctttactgttcacgtattcctgtatctgcaatcgcatcattcggaaaccaatctttgccaaggcagaggtataactgtattcaataattaaatatactgagtaaatgcaatgtggttcgtttatgattcgttta

SEQ ID NO: 243 - DNA, 4439 bp, Zea mays
gggatgtcgggggcgtggggcggcaccacgcagaagtgcgcgtcgtgcggccggagggtgtaccccgtcgaggagcttgccgccgacggccgcgtctatcaccgcccctgcttccggtgccaccactgcaagagcacactccagtttagtaattattcttccgtggaaggtgtcctatactgcaagcctcactatgaccagatattaaaatcaacaggcagtttggagaaaagttttgaaggtgtggcccgatcagctaagtcagaaaaatcaaatggacataagggccaacaaagcagtagattctctaatatgtttgtgggcacacaagagaagtgtgttgtttgcaacaagactgtgtacccgcttgagaaggttgctcttaatggaaattcttatcacaaatcatgctttcgctgcacccatggtggttgtacgctcagcccatccaatcatatcacacatgaaggcaaactttattgcaagacccaccattctcaactgtttatggttaagggaaatttcagtcagtttgaggacaattctgggaatgcaaaagttactattgagaaactgccagaaacagaagaagccaccaagaatcctgatcaaggtgatgaagccacaaggaaaccggtagaaaatgagcctacagatgagaaaacttcaaaaaataatgttgcagctgagaaacaattgcaaagtggtgttgatgtcacaaaaccatctgagagtaccacagcagaaaatgaacgaggaaacagtgcagccatgagaaaaccctggcaacgaagtatgcaaacagataaaccgtttctgagtagcacaagcactgtgaatccatcatcgagcagtgataccactgagaagctatcatcaagtaatggggttgatatgaaacagtctgaaagcagcacattagtaaaaacaacatgtaaacaaaattcaccaactgagaatccaccacagagcgttttaccatcggataagccatcagcgaccagtgtagatgatgcaaagccatcagaaagcagcaaagtgataaaaaaaccatggcaacgcaatatggctgccgagaagcaattacagaacagtgcaccatcacagaaaagtgtagctactgataaaccatcaccaacaaccggcatgaagtcattagataacaccacagaagttaaaagtccatgggggcgcaggatgttcaataacaagtcactaaagcgcagtgtagatactgagaaatcttctgaaaccagtgtggttgatgtgagacctggggaaaccagtacagtagcccctgtgccacagcaacaaactgaaaatgttgagaaaccttcagctaccagtgcagatgatgcgaagagtgcagatgatacgaagagtgcagatgatgtgaagccatcggttgccagtccagatgcgaagagcacagatgatgtaaagtcatcggagaataatgcggcagtagttagaaagccatggcaacgcaacataggcactgggaagcaacccctgaccactgtagttggtccaaagacgactgaaacaagtggaactgtcaaaaggttgtggcagcgcagtgctgcaactgcatcaaaaagtggtacggctgttgtgacaccattgcaaagcagtgtggttgtctccaagccgttccaaagcaacgtagctgtgaaaaagacatggcaaagaagtgtaactccagaaaaccagctagagagtaatatgtctagcaataagccattgccaagcaaggtggttgttgagagtctactgcaaagcaacaccgttgagaaagtgtttcagagtactgtacctactgaggaaccacagaaaggcatcatggccactgaaaatcaatcgcagaccatcaaagttacaaagaagagcaatgaaacatccatggagctatcagtaacaagtgagacaaccaaaccgccaccacttgctgcaaccgtgttgcaaagtgatgtttccacagaacaaccatcacaaactgatatgcctaccatggcacctagtcagatccctgagcccaccgagaagccatcagaaagtgattttaatgctgagaagttatcagaaagtgttgttaaagctgagaagtcatcaacgactgacactgctgctgagaaaccacttccaagtatgatcactgagaaggtagaaagtgtagcaggcacattgaagccatctcaaagtgatacagcccttcaggagatcttagagaggaatatggctactgaggaaatactgcaaactgccatggctgttgaggatgcacctccaaccaatttgatcaccgagaagtcattaatgaaagatgcttcagaggagccagttcaaactaacgaaccatctgagcagccactgaaaactgaagagattgagaagccacaacaaagtgaaaagattgctacggacacgagagggagtgaagtatctactgaggagatgctagagcttgaaagtaatgccactaaattaaacaaggatcaatcagaacttgaagggctttcatctggtaggaatcctccaaacttccaaagcaatccaaatgctgggcagcgatcagagtccaaaggcattgtggccgagaaggcagctgaccatataatggaagctgaagatgatgtggatgctgagcactcatcagaatctcaaagcgttgcacctgctgaggttcgaaaggagcaaccatcagaacatcaaaaggatgtggatatggagcagctattggaacctcaaaatcaggatcatccttggaatccactagatcctgttagtgatacagctgccaaggattcatcagagcctaaaagtgacatagctacagaaaaacctgcagaatctcaaaacaatgcagaacagtcagttgagcagcaatcagaaccgcaaagcgataaatcaactgagaggccagaagtgcatcaaagtaatacatctaatgatgagctttctaggcttcaaaacgatgcaggtactgataaactatcagtacagtcatcagatcctgagagcaatgcatctgtcagtaagccatcagagtctcaaactgatgtggctaccatggaggcactggaacctcaaattgatgctcctcctgataaggcaactgaccagccagtgaaacctcaagatgatgcatctgctaagaatccaatgggaactgaaagtgatgctgtttgtgataaaccttcagaaagcagctcagatactgaaacacttcttgtatgccatcagaacagcagcataaccactgatgaacctgtacaaggtggcatttcttatgatacaccacatcagagaagtgcacccatagaaacaacaccaggaagtgaaacagttgttgacgattgcatacatcacgaagataccagcagcaaaccatcagaggaaaacaaagctattgaggagccagaagaggccgatgaagtgagtgccaacccatcagaggatattgcaactcctgagaagccactggaggaaggtgtgggaagtgtggaaccatcagaagacaattctgttcttgataaaccattggaggaagaagaggttgatgccaaaccggtgaaggacgttgtaactcccgagaagccattggaggaaggctcaacaactgcagagccattagaagacaatgctgcccatgaggaagcaaaagaagaagatgaggtgattgccaagcccctgtccagtgtggcacttgagaagtcactggagggaagtgaggcaagtgtagagccatcggaagacaatgctgctcttgagaaaccatcggaggacgacgaggcaaatgccaagtcatcagaggacagtgtatatgtggagaagccacaacaggaagaagatgacaacggtgtcaaggcattagaggagggcgtgtcccctgagaaatcagccgctggcaaaccattagaagaagacccagtccatgagaagccagcggacgcagtagctgagccgtcatctcaggacgacactgccactgaaaagccctcagctacaactgacactgcagaaactgcatgagacatcagttagctggttaaagttagttagcaacagttttaaacggagtgtggatcgaatactattggtcatagttcggcgtggcttctgtttgttttttttttggtggggtgggggtggggtataatgcttgagttgtaaaatttgagggaaagaaactatagtattgatttggtctttttacaagcaataatcccctccacatgttaggaggaggataccattgaagttctatacataggatttgtgtgcggtttgattttttgtttggaagttgtactttgtaatcgattttgtgcaaatatgactgtgcttgctcattattcggttttctgcgtgtaaattgatctagcaagattttatgtgcaaatggtgtggctaagctttcaataatactagaaaaaaaa

SEQ ID NO: 244 - DNA, 1129 bp, Zea mays
atccattatcacagtgtctcctactatttctttttactcactgtggtggactcgtctctatatattgcaagggtaatgacacttgtctgactcccctcacatacagatacagtacagttcacacactctcctgtctcctatccatccagccaccgaagctagccaagaccaagatgtctcagttgctgcacctgccggacctcgcggcgccgcggaccaggatgggctcggcgctggcggcgggggcccgcgtcaagcagggggaggcggggacggcgagggggcgggtgctcagggtcgccgaccccgtgcggcgggagtgcctggtgccggtcccgccgccgccggtcctcgccgcggggaggcgcggagacgacgacgacgtcgacgaggagaggcagcggtactacctcaacctgggctacgcgatccggacgctcagggaggagctccccgacgtgctctgcaaggaccacagcttcgacatctacagagaagacattgtcttcagagaccctctgaacacattcaagggcctgggaaactacaagaggctcttctgggcgctgcgcctcaccggccgggtcttcttcagggcatcgtgggttgaagtggtcagcatatggcagcccgccgagaacagcatcctgcttcgctggaccgcccacggcgtccctcgggtgccctgggggggctgggacgccccccacgcccgcttcgacggcgcgtccgtgtacaagctcgacaggaacggcaagatctacgagcacaaggtgcacaacgtcgctacgaacccgccggccaagtccaaggtcctgccggtccacgagctggtcaggtcactcggttgcccctccactgcccaacccacatgttctgacttctgaagctttcgtcgtcgcagtgctgtgccatcttatcttattattcgagattaattagcatggataggatgctacgtcgagattaattatctggaagaaggattggcgtgggtttaacatgataccctccattttttttgtttttcagtgtgatttgatagcgcacaaagttacagagcactcctgcaggctgcagttgtatatatgtacagttatagaataagaacatcagttattgattgtta

SEQ ID NO: 245 - DNA, 1651 bp, Zea mays
gcttccagcttgctttccatcgttcgatgtcaccgccgacgcagatggcttccctcgccgttctcgtttgcctcgtctgcgcagcgctcgcctccgatgcggcggccgtccgcgtggagctcacgcgcgtacacgccgaccccagcgtgaccgcgtcccagttcgtccgcgccgccctgcaccgcgacatgcaccggcacaacgccaggaagctagccgcgtcgtcgtctgacggcacggtgtccgcgccggtctcgcccaccaccgtccccggtgagttcctgatgacgctggccatcggcacgccgccgctgccgttcctggccatcgccgacacgggcagcgacctcatctggacgcagtgcgcgccctgcagccgccagtgcttccagcagccgacgccgctgtacaacccgtccagctccaccacgttcagcgcgctcccgtgcaacagctcgctgggcctatgcgcgccggcgtgcgcgtgcatgtacaacatgacgtacggcagcgggtggacgtacgtcttccaggggaccgagacgttcacgttcgggtcgtccacgccggcggatcaggtccgcgtccccggcatcgcgttcggatgcagcaacgcgagcagcggcttcaacgcctcgtccgcgtccggcctcgtcgggctgggcagggggagcctgtcgctcgtctcccagctcggcgcccccaagttctcctactgcctcacgccgtaccaggacaccaacagcacgagcacgctcctcctcgggccgtcggcgtcgctcaacgataccggcgtcgtcagctccacgcctttcgtcgccagcccttccagcatctactactacctcaacctgaccggcatatccctcggcacgactgcactgcccatccctcccagcgccttctcgctcaaggcggacggcaccggcgggctcatcatcgactctggcaccaccatcacaatgctgggaaacacggcgtaccagcaggtccgcgcagcggtcctctccctggtgacgctgcccacgacagacggatcggcagccacggggctcgacctgtgcttcgagctgccgtcctcaacatcggcgccgccgtccatgccgagcatgacgctccacttcgacggcgcagacatggtgctcccggcggacaactatatgatgtcactctcggacccggactcggactccagcttgtggtgcctggccatgaagaaccagaccgacactgacggcgtggtagtaagcattctcggcaactaccagcagcaaaacatgcacatcctctacgacgttgggaaggagacattgtcgtttgctccggccaagtgcagcacgctgtgatcagaaatctattccaattcaaatgctgaaaaaatcgaactagactacgacaatgaacaggtaagcgccagacttgtcgatcgggcagtcgcagtgctacttcccttgtgacagtctagctgtactttagtttgatgttttttttttgttttagaaaaatgattttttgggacgttttacctttgttgtgttgctagggttgtgatgtaaagcaggaaatatttaaacttatcagttactgtgtatgttattttccatattcatattttccctctctctacagagcacttacgtgtgcattattc

SEQ ID NO: 246 - DNA, 1042 bp, Oryza sativa
aggcgactctcggccgcactccgcccactgcgagtctgcgacggtgcgacctctctacctctctctctagtctctccccccgacgagagctcccccctcgatggcgtcgcagagcaccaagcccgcgcaggccgccgccgagccgtccccgccggcggccaccgcagcagcgggggaggcgccgccggctccgaaccccgcgtcggccgccacgccagcccaaaaccctaccgctgccgcgggggcggccgctggcggggccacggatctggagaagaagatgcgccgcgctgagcggttcgggacggccgtggtgatgtccgaggaggagaagcgcagcagccgcgccgagaggtttgggactggatcttcaaatgaaaaggcggaggaacaaaagaggaagtccagggctgagagatttggccttgcctcatcttctgctgacgaagacgctaagaaaaaagctcgtttagaacgatttggtcagagtacaaatgttgacaagggggaagaagagaaaagaaaggcacgagctcttaggtttgcagaaacatctagtggaccatctcaagaaaatggcaaagacagctccaagccgacgcaggacgcggccactgtggcaggcacggcataatggaagcactccctgccttttgtgagatctcggacatggcccttacttttggggtgaagccgtagtttgtacaacactaacgacatcagtggcatcatgttttctcctagccatgttgagtgctatttactgtgttgacttgcttacggtacttccctagcagtgtagcttgacttgctgcttggtttgggataatactgtacttttgttacctccctcttttaatgaccatggctccttaggtatgtaccagtagtaacttatgttgttgtagttagcttttaagacgttatcgtattctaagttttagatgcttccttcgtgttacaaaatgacatacgcaacaatgccaatgtcttggcagcggggcatgtgaatatctgatgatgcatttcgttagtgcataca

SEQ ID NO: 247 - DNA, 4950 bp, Oryza sativa
aggggacgccggtgaacatcatcgtcgggtcgcatgtctgggcggaggatcccgacgacgcgtggatcgacggggaggtcgtcgagatcaggggcggcgacgccaccatcgtcagcaccgatggcaaaacgattgtggcgagcctcgcaagcatttaccccaaggatacggaagcgccacctgcaggagttgacgacatgacgaagctggcttacctccatgaacctggagtcttgcataacctcgcttgtcggtacggtattaacgagatatatacatacaccggcaatatcttgattgcagtcaaccctttccggaggctgcctcatctgtatgacgtgcacatgatggagcagtacaaaggtgctgcatttggggagctcagccctcatctgtttgcgatcgcagatgcttgttacagggcaatgatcaatgaacaagggagccaatcgatattggtgagcggtgagagtggtgctggtaagacagagacgaccaagatgctcatgaggtatcttgcattcatgggaggaaggtctggaacagagggtcggactgttgaacagcaggttttagagtctaatccagtactggaagcatttggaaatgcgaagacggtgaagaacaacaactcgagtcgattcggtaagtttgttgaaatccaattcgacaaatatgggaagatatccggggctgctgttcgaacgtacctccttgaaagatcgcgagtatgtcaggtctctgatcctgaaaggaactaccattgcttttacatgctatgttctgcaccaccagaggatgtgaaaaagtttaaggtgggagacccaagatcattccattatttgaaccaaacaaactgctatgaagtagctaatgtggatgacgcaagagaatacctagaaacaagaaatgctatggatgttgttggcattggtcaagaagagcaggatgcaatctttagagtagtagctgcaatccttcatctgggaaacatcaatttctcgaaggggcaagaaattgattcatcgaagctgagggatgagaaatcagtctatcacctgaaaatagtagcagaacttctaatgtgtgatgaaaaggctcttcaagattcgctttgtgagcgtgttattgtaacacctgatggaaatatcacaaagccacttgatccagattctgcagcactgagtcgtgacgccttagcaaagactgtgtattcacgactgtttgactggattgtggacaagattaacaactcaatcggtcaagatccagatgcaactaatattataggagtacttgatatatatggatttgagagtttcaagattaacagcttcgaacaactatgtatcaacttgacaaacgagaagttgcagcagcactttaaccagcatgtattcaagatggagcaagaagactatacaagggaggaaatagattggagctatgtggaatttgtggacaatcaagatgtgctggacttaattgagaaaaaacctggaggaataattgcactactggatgaagcatgcatgtttccaaagtccacacatgaaacatttgcccaaaagatgtatcaaacatacaaggcacataagcgcttcagcaaacccaaacttgctcggacagcctttacaatcaaccactatgcaggagatgtcacatatcaagctgatcagtttcttgacaagaacaaagactatgtggtggcagaacatcaggctctacttaattcctcaaggtgcccttttgttgcaaatctctttcctccattacctgaggaaacctctaaacagtccaaattctcttccatcggtactcgctttaagcaacaactacaagctctcatggaaacactgagtacgacagaaccacactacattagatgtgtgaaacccaatgctgtacttaaaccaggaatctttgagaatttcaatgtccttaaccaattgagatgcgggggtgttctggaagcaatccggatcagttgtgctggctatccaacaaaaaggacatttgatgagttcattgatcggtttggaatgcttgcagcagagcttgtcgacagctctgatgagaaggctgcctgtgcagcaatatgtgataaaatgggtttgaagggatatcagataggaaaaacaaaggtattcctaagagctggtcagatggcagagctggatgctcgaagagcagaagtattggccaatgctgcacggcttatccagagacgtataaagacacatcttacaagaaaggaattcatcaacttaagaaaagcctcaattcagtctcagaagttttggagggcacgcctagctagaatatttttcgagcatatgagaagaaatgctgcttcaatcaggatacagaagcatgcacgtactcattcagccaggaaatcttaccttcaaatgtatgagtcagccatagtaatacagacaggattacgtgcaatggcggcttgcaatgaacacagattcagacgagagaccaaagcttccataataatccagactcgatggcgccaacacaaagcttatgttgattacaaaaagcaaaaaagagctactttgattcttcagtgcctgtggagagcacgtattgcaagaaaggaacttcgaaagctcaaaatggaagcaagagagactggcgcactgaaagaagcaaaagacaaacttgaaaaaagagttgaggaactcacatggcgattagatgttgagaaacacttgaggattgaccttgaagaagccaaggggcaagagatttcaaacttgaaatctgtgttgcaagaaatgcaagaaaagctttcggaagcacatgcagcaatagaaaaggagaaagaagatgcaaaactagcaattgaacaggcaccaccaaagatagtagaggtgccggtggtggacaatgcaaaagttgagctgctgactagacaaaataaggaacttgaggatgaacttgttacatttagaacaaaggctgaagatctagaaaagagacttctagaggttcaaaaggagtccgatgaattgtcgagggaaattctagaaaaggactccaaacttaatcaacttcaggagatgatagaaaggcttgaaacaaatttatccagcttggaatctgaaaaccaggtcctacgtcaacagtcactacttgcatctgcagatgacgataaatcaaagcaaatagagagtctggaaagcaagattgccatcttggagtcagaaaaccagttgctccgcagtaaatcttctgtagctgttcaagcagtaattactcctgaagtgattcagccatcagcaatggagggccttgtgaatcgatatcagcttgaagaacataaaatcctcattgaggaggtggttgttcctcctataaagaatttaagcaaacaaaagtcgctcacggatcgacaacaagaaaatcatgatgtcctgatcaaaagtctggctgaagacaggagatttgacaacggcagaccagctgcagcatgcatcgtgtacaaatcactcctgcactggcactcatttgaagcagagaagactaacatatttgaccgaatcatccatacaattaggtcatcaattgagcacgctgaaagttctacagaactggcttattggctgtcgactacatcaactcttctctacctattacaaaatactcttaagtctagcagttcagcaggtaaaggatcaaatcgcagccgaaccacaacaggcaacctgttcagtaggatggtgcagaatgctcgatcgtcgtcattaggatcaggcatatcaagtggatatagtggaatggttggaaggcctgacactgcatcaaaggtagaggcaaaatactcagcactacgtttcaaacagcaattaacagcatatgtcgagaagatatatggaatgatcagagataacctgaagaaggaaataaacccgttcttgattatgtgcatacaggctccaagggctgttcgtgtgagatcatccaggggatcgttgaaaagtgtacattctaattcactatcaaggcaaacatcaagtgtgcattggcaaagcatcattaagtgcctgaaccatacactcgaaacaatgaacaataatcacgtacctccaatgataatcaggaaaacattcaatcaagcatttgcctttatgaacgttcaactcttcaatagtttgctactccgtcgagaatgctgctcctttagcaatggggaattcttaaaggctggtttacaagaattagagcagtggtgctctgtaacaactgaagagtatgcaggaacgtcttgggatgaatttcagcacatcagacaggcagttggatttctggttttgcatcagaagacacataaaaccttggaggaaatcactgatgagctttgcccagttttgagcatcactcaaatatatcgcattggaacaatgttctgggatgataaatacggtgcacaaggtctatctcaggaggtcattggaaagatgagaacaatggccactgatgactcaataactactccaaatagttcgttcttgttagatgacgactcaagcatacctatatcgttggatgatatagcacgactgatgcttgacatagacctatctgacgtggaaccaacaccactgctcaggcagaactctcagttccactttctactgcagcaccacgccacacagactgatggcattgtttgttaatgcaaagttgaaaacataattaaacaggttccgctattttgtgaagttcctcggtggtgatttcccttttttttatgggagtgcaggcttgccttttttttgttggcaatttcaggtgggagattttacaagaaagaaaaatatagaagatttttttaccattcttttcatttgttctgattgtttgaaagaggaaaggttgtatttttaatgtaaaagtgtacaagcgaaagtaaatatatgtatattttcagct

SEQ ID NO: 248 - DNA, 850 bp, Oryza sativa
actgtactagcaaccaggcttgatatattttagtacttccccctttttttttccgagtgtgtggctctcagatggagttagttcatcgttatcctaatctgatttcaattcaaaattgttcaattgattgttggttatatgcgtctagtatatgcagaggctggtttccaagaaggaggagacgaagacgatcagggtgaagccgggttggaagaaggggatgaaggtgacgttcgaggggatgggcgacgagcggccgggctgcctcccaggcgacgccgtgttcaccatctcggagaggaagcacaaggtgttcaagaggaaaggcaacgacctggtgctcaaggccgaggtgccgctggtgagcgcgctcaccggctggtccttctccttccggctgatcggcggcgagaagatgagcttcacgttccgcgacgaggtcatctcccccgggtacgagaaggtggtcgccggcgagggcatgcccgtcgtcgccgccggcggcggcggcgagaaggccgccgccgcgcgcggcgacctccgggtgaagttcgacgtcgtcttccccaagaacctcaccggcgagcagcgcgccggcctcgccagcatcctcagagcctgtccgtgatcgaattaccacacgcatagtagtacacatttttacaagttttttttttttgtttctactcgtgtagaaaattttggtttcattttttggtgttgatatactagcgatggatcgatcgatcgatcaccctgcaggtgagtacataaagatcgagtatgagatctgagcgaccgttttgacgcatatacgtatataaatacgggatggttgttgcaggaacaa

SEQ ID NO: 249 - DNA, 5448 bp, Oryza sativa
cagaatatttcaccaaatatgaagctatggggtgttgtaattgaagttaaccaaaaagacattgttgtaagtctacctggtggaatgagagggtttgttcgatcagaggaagtgcatgacattacttcgcaagaaactcgtaaggtactcaccgcccaagtgaaaagtattgaggatcatggttacattcttcattttggagtatcctcctttagtggtttcatgccaaaggctgacagagaaagcgcgaagattgagagtggacaacttatacagtgtgttgtgaaggcaattgataaagctcgggaaattgttcacttgagttctgacgaagatttgctttctaaatctattattaaagatctgaaaggcctttctattgatcatttaattcctggcatgatggtcaatgcacgtgttcattcagtcctcgaaaatggagttatgttatcatttcttacttatttcacaggaacagccgatatttttaatttgtccaactccttcccctctggtagctggaaagacgattacattaagaataagaaggtaaatgctcggatattatttgttgatccgtcaacaagggcagttggacttacattaaatcaacagttacttcgccttaaagtaccctctattaacgttaaagctggagaaatctacgacaaagcacgtgttttgaggatggataaaagggctggtctttttcttgaaataccttctccaactccatcacctgggtttgttagtatacatgatgtctcagacaaagatgtgaaaaatgtggagaagaagtttaaagaaggtagcatggcacgtgtccgtgtgcttggagtgcgacatcttgaaggagttgcaataggcacgctaaaagaaagtgcttttgaagggtctgttttcactcatgctgatgttaagccaggaatggtattttcgagtggcgtgaaagcactttgcccacttccacacatgtctgagttagaacatgttgtaaaaccgccgaagaagtttaaggttggagttgaattaactttccgtgttttgggttgcaaatccaagagaataacagtgacattcaagaaatctctggtcaaatcaaaacttgatgtattggcctcatatgctgatgctaagattggtttattgacgcatggatggattactaaaattgaaaagcatggctgctttgtgaaattctacaatggagttcagggttttgttagcagatctgagcttggattagagccaggtactgaagctgaaaatgtttaccacgttggtcaagtggtcaaatgcagagttgtgagtgtagtccctgcttcaaggaaaataaatgttacttttctgatatctacaaatagggttattcaagctgacaccccaaaggtgggaagtattgtatctggtgttgtggagcgacttactcctgcagcagttgttgtcagtgtaaatggcttctgcaagggatcaatacttaatgaacatctagcagaccatcgtgatgttgaagggcaaaatttagttctttcagccaagcaatcactcatcaactgtgcaagtgacattccatcagaaatatctcagatgcatgcaggatctgtatttcatggttatgtttgcaacatcatagaagctggttgttttgttcgctttcttggacatctaactggtttttctcccaaggataaagctgttgatcgttcagtagaaaagctgtccaatgccttctatgttggccaatccgttcggagtcatatcctaaatgtaaatgcagaatctgccagagtgaagctttctcttcagcagtctatgtgctcttcagcagactgttcatttgttcaaggatactttcttctagatcagaagatcacagaactgaagtattcagatccaagtagttctttccatgactggttgaacacttttgccattggtaacttggtggaaggggaggtgggagcgatcgaagaatatggcgttatcctgaacttccaaagccatccggatgttgtcggtttaattgaacatcatcaacttggtgacagtagtgtagaagtgggctcttctgtgaagggtcttgttattgatttatctgatggagttgttaatatatcccttaaatcagaacttgttcgcagtgtcagcaaagttggaaaaaagaagaaacgtcacagagctgcagttatggacttggagctacatgaggaagtgaatgcaatagtggagatagtcaaagagagtcatgtggttctttccatccctgagtataattatgcaataggttttgcaccactgatggattacaactcacaactacttccttgctgcaactatgaaaatggacagcgcattactgttgttgttggaagtatgccaagttctggtccgacaggaagacttctcctactaccaaaagcatcaggcaagaattctagtgttagcagttccaaaagagcaaagaagaaaagtgacttcaaagttggatcacttgttgaagcagagattattgatatcaagccacttgaacttcttctaaaatttggttccaatcttcatgggagaattcatattaccgaggtatttgatgatgattccaatgattgcccttttagtgaactccaaattgggcgaagtgtccaagcgagaatcgttgctgaggctgaacattcaggaaaaggtggcaaaaattccaaatgggaactatcaattagaccatctttgcttcaaggagggttagaagactttactcctcctaaagcagaattaaggcattcaattggtggcattgtgcatgcttatgttgtcaaggtggatagagaatggatctggttaactgtatcaagagatgttatggcccatttatttattcttgatagttcagctgagcctggtgaactagaaaagttccaacagcgctatagtgttggccaggcagtgaaaggacgcattattggtgtgaacagggagaaacggttgttgagactgaaagcacttgacagtcagagtttgccagagaatataggcgaaacacaaaaaccactctctgctactgttgaacatacaaaacaaggagatatcattggtggacgtattcaaaagattctacctggtgttggtgggcttgtcatccagattggacctcatcttcatggaagggttcattatactgaaattgttgattcatgggtgcaagaacccatatctggatttcatgaaggtcagtttgtgaagtgtaaggtcctggatgtaagccgttcatcagaagggtctgtcagagttgatctatcacttcgctcatcaatgtgcgcaaattctaaccagtcaagaagattgtttgatgattcgagaattcgtacctcccgatttgagaagatcaatgacctgtgcccgggaacagaggttaagggctatgtgaagagcgtgaattcgaaaggatgtttcattatggtttctcggactattgaggctaggattattctgtcaaatttatctgatgaatatgtggaaaatcctcaaaacgatttcccagttggactgcttgtacatggaagggtcttgtcctcagaaccacaatcagggaaagttgaggtatcacttaggaagaatactggtagcaaatctcaaaaatcagatgatattagttacagcgatctgcatgttggggacataattgctggtcaagttaagagggtagaatcctttggactatttgtgacaattcagggcagtgaattggtggcattgtgccatgtatcagaactttctgatgaaccagtccttgatattcattcttgccacaaagctggtgataaggttaaagccaaaattttgaagattgatgaggaacggcatcgagtatccattggaatgaagaaatcttacatcggacctgattctacgggtgatacaagtgatgatgaggatgacgaaatagttcctgaggaaatcagtcgtaatcctgtgatgggtagagatcggaaccatgcgttagttcttccgaaaccagaatccagggcttcagtgctgccactccaggtctccttggatgaatctgaaggttcagaccaagagaatgataataaaggtcaagaaattgctaatggaactgaagtagatgataaaaagagcaacaaaaggttgaaggagaaggcgagaaaacaaagagaattagaaatcagtgccttggaggaaagggctttacaaagagatataccccagactccagatgaattcgagaagttggttaggagctctccaaacagtagcttcgtctggataaactacatggcatttttgttagacctagcagatgttgataaggcccgtgcagtggcggaaagggctttgagaacaataaacatcagagaagaggaggagaaacttaatgtttgggtagcatattttaatctggaaaatgaatatggcagtccaagggaggatgctgtcaagaagatattccaaagagccttgcagtattgtgatcccaaaaaggtgcacttggctcttcttgcaatgtatgagaggacagaacaatacacactagcagatgaacttcttgatagaatgacgaagagattcaaaacttcctgcaagatttggttgcgctgtattcaattgtccctcaagcaaagcaaggatgttgagtgcatcaaattgatagtgaagcgtgcacttctaagtctacctcagagcaagcgtagaaagttcctatcgcagactgctatcctggagttcaagtgtggagtgcctgaggaagggagatccagatttgaactgatcttaagagagtaccctaaaagaacagatctttggagtgtttacctagaccaagaaattcgccttggtgatacggaaattatacgggcattatttgagagagtaacatgccttagtcttcctccaaaaaagatgaagtttttattcaagaagtacctggaatatgagaagtcgcaaggtgatgaggaaagaatcgagcatgtaaagcagaaggcactggagtacgttcagagttcactggcctgatattcgcaagaccaataatccctctgaacctaagctgttgctgctgctatccgctattcggagtcgtggctgcagaaattgcgatcagcaacctgatgcgacgactcctgataggtttctgcgaggatcggcggtgtaactgtctgaatagctgaaggtcaagtccttggtcgatgcagaaactgaagagtgctaatcatagaaacggtgataggtctgatgtattttgtgcgttagtgctatggttgcatatttttgattagtgatgcgaacacgaacgttgttaagagggaaatgcagcccattcagttttgtaggaataagtgttctacgcttggaattgtcaaaagtttttaccaaaatatgatgtatacaaaccttttcttatcatggaatgttgcaattacctcctggttctcatga

SEQ ID NO: 250 - DNA, 1388 bp, Oryza sativa
ctgcgtgcgagacggcgtcgcgtcgctcgccacgacggacatgcagcacctgcacggcgacgtgctcgagtcggcggtggagcgcgtgccggcgcccgatctcgccgccgcggcgctggtgtcacgggagtggctccgcgcggtgcgcgccgcgctgcgacggcgcatgctgcggctgccgtggctcgtcgtccacgtgatccatctccggggccagcggcgcctcgccgcggcttacgacccgcgctccggggcgtggctcgccgtgcccacggcgccaccggcgcgccacggcgcgacgtcgccgccgcagccgcactcgcacgtccgcctgatgcggggcgcgagcggggaccgcgtctgcgcgctctcgctctccgggctcgccgtggcgcgggacgctctcgggatggacgacgacgcgctcgtcgtcgcgctcaaggcccccggcgtgtggcgcgtcgatccggtgctcgccgcggtgggtgaccgcgtggtcgccatgggcggcgcgtgccggctggcgctgggtgacggggaggacacctcggccgtcgaggtccacgagcgcggcggctggacgcactgcggcgcggtgccgaccgcgctccgggagtccgcggcggcggcagcgacgtggctctcgacggcggcgacggatcagagagtgtacgtcgcggacagagccacggggacggcgagctggttcgacccggcgaagcagcagtggggacccacctcccgcctccgccctgacgccaccgtctccacatggggcctcgccgccggccgcgccggcgccgagaagatcatcctgttcggagtgaagcatgcagacagccgagtcgtcatccgatcatgggaggtggacggcgacagcctctccctgtcccatggcgcggcggcggcgcacgacacgatgccgagcgagatgtccgagaggctgttcccgcacggcgacgacggcgaggaggagacgtcgtcgccgtcgatcggggtgtgcggcaacaccgccggtgggtacgtgtacaatgcggccgtgccggcgacgggcgccgtcctctacgagctccggcggggcggggtggagggcggcggcgtggagcggtgggcgtgggttgcgtgcgcgccggtggtggccgaagcggaggcgttgggacgcgtcatcctcgcgtgttcgccggtggggctgcacgagcttgcggacgaacggcttgcacactgaactaataatggctatcgtgacatgttgtcgatagccagttgagcttgtaataagcatatagggctgttacactctgaaaaataagtttggatactcccaccggttttataataattctcgttgttttggacaataataacacggcatattcactacatgacaa

SEQ ID NO: 251 - DNA, 1062 bp, Oryza sativa
gagcgagtctgctcagtcgccggtatgcaactgaacagggaacaccgttttttctgcacaggatttgcacgccacccttctcacgtggccgctctcgcggcgctcatggccgccgtggccgcgacggccggcgccgtgacgttcgacgcgacgaacacggcgtcgaacaccgccggcgggcagcggtcgaccgggaggtcggcgtggactacgcgaagcagatgctcgccgacgcgtcgtccttcatctgggacaccttcgagcagcccggcgacggcggcgaccggaagccggtggacgcggtgaccctgaccgtggaggacatcgacggcgtggcgttcaccagcggcgacggcatccacctgagcgctcggtacgtcggcggctacagcgccgccggcgacgtgagggcggaggtgaccggcgtgctgtaccacgaggcgacgcacgtgtggcagtgggacggccgcggcggcgccgacggcgggctgatcgaggggatcgccgacttcgtccgactgcgcgccggctacgcgccgccgcactgggtgcagcccgggcagggcgaccggtgggaccaggggtacgacgtgacggcgaggttcctcgactactgcgactcgccggcggtggtgcaggggttcgtggcgcagctcaacggcaagatgaaggacggatacagcgacgacttcttcgtccagatctccggcaagaccatcgaccagctctggcaagattacaaggccaagtacggcggctagctgacgtgacgtcagctccggcgaggtggccatatatatatatagtactatagtagtactgtagttagtatcagatatgtggataataaggcaataaataaagccatgtttgatgtccgagggactgtttagattgtagctaaaataaatcttaccaaatttaggtaaagttgttaaatatatgcatccatttagttcattattaaactctgataaatacataagaaatcctgtcaaaacttaacaatattgttaaattgctaaaattttagcattaataaaatttaataatgtttatttt

SEQ ID NO: 252 - DNA, 1544 bp, Sorghum bicolor
cggcgaggtcccgtccaccggtcagtttgcctacttcaacggcacatccttcgccggcaacgctgggctctgcggggcgttcctctccccgtgccgctcccacggcgtcgcgacttcgggctttggctccctctcttcgacgtccaagctcctgctcgtgctcggcctcctcgcgctgtccatcatcttcgcggccgcggccgtgctgaaggcgcggtcgctgaagcggtccgccgaggcgcgcgcgtggcggctgacggcgttccagcgtctggacttcgccgtagacgacgtgctggactgcctcaaggaggagaacgtgatcggcaagggcgggtccgggatcgtgtacaagggcgcgatgcctggcggcgccgtggtggccgtgaagcggctgccggccatcgggcgctcgggcgcggcgcacgacgactacggcttctcggcggagatacagacgctggggcgcatcaggcaccgccacatcgtgcggctgctgggtttcgcggccaaccgggagacgaacctgctggtgtacgagtacatgccgaacggcagcctcggcgaggtgctccacggcaagaagggcggccacctgcagtgggcgacgcggttcaagatcgccgtggaggcggccaagggcctctgctacctgcaccacgactgctcgccgccgatcctgcaccgcgacgtcaagtccaacaacatcctcctcgacgccgacttcgaggcccacgtcgcggacttcggcctcgccaagttcctccgcggcaacgccggtggttcggagtgcatgtccgctatcgccggctcgtacggctacattgctcctgagtatgcctacacgctcaaggtggatgagaagagcgacgtctatagcttcggcgtcgtgctgctagagctcattgccggtcgcaagccagtcggagagtttggggacggcgtggacatcgtgcagtgggtgcggatggtgaccgggtcgagcaaggaaggcgtgatgaagattgccgacccccgactctcgacggtgcctctgtatgaactaacccatgtcttctatgtcgccatgctatgcgtcgcggagcagagcgtcgagcgccccacgatgcgagaggtcgtgcagatactagccgacgtgcccggctcgacatccacgtccattgacgtgccccttgtcatcgagccgaaggagaatgggagcccgggggagaagaagcaggagcagcaggaagggtcacacgactcgccgccacagcaggatcttcttagtatctagaagtgcagttgcaagaattgatcgtactgatagtagtactttgtagcatccttgttcgtttcagtgaagcgttggaacgtggcggtatcagtgtgtgtgtgtgtggaagaggtgatttgtgcatgttcccgttagctagattgccactattacgttaagtatggtgagttggttgggccttgtaatctctgtcccatgtacaaatcaaatcaagctgtttgagcttccatttgagttcttaaatctctcaagttgcagaaatggtttg

SEQ ID NO: 253 - DNA, 1444 bp, Sorghum bicolor
acactttactactaccacctaccccctacctcgttcccgtcgcttcagaaacccacaaaacggcggccatggcttcggcgcagtctacctcgaccatctcctcaacctaaactcagccacacaccttccttcagaaaatcacctaacctattagcagcaacagtcgacccctcgtcctttccaacatcaactccatcgccaatacagctaagtccatggcgaacaccctactaaactgaagacgccagattcacaccagcttcaatacgtccagatggcgcagcaccggttccagaacctcagaatcatcgataatacagagctcagagacatcgatgccactatgtccggcaacacagtcttcgcaacagtcccggatactatctcggacacattcaaccactatgacctcgcggaggcaatccaacaacagttccagataaacatcgaggtagaagacatatccaggtataacgaaggttacttcttacgcgtgcacacacagcaggccagaacaaacatgctacaccgaggctttatcattgttcgaaactacctcattggtctgagaccatggaatccagaacatggatcaacagcagtctccttacaaaccgtgctaacctcttgtccactcaacatacacctagctacatacatacccttatcagatccatatgaacacctaaccattcacattaccggcgtaccaccgcatctatgctgcaactccctcatacacaaactgttccacaaaatctgcatcatccattcagtcaactttatatctgctacaactgaatatgagattagcgcccgcggaagggtaacaatgatcccacagactgctcatttaggaattagaaacctgagcggacagagtgaggtaatcaacatatggcagttatcttaccagacattcacagacgaaatgctaggcagacaaacaccaccaggagaccggcgatctgacctctgcggatactcagacatcgacacagagcaacgactggaactggttgacagcaacggaaataacgaagcaacctcccgactccaagtcgcctccgatacttcgacaatggacacatcagacaacagtattgaagaatgaaagtgaagccacaacaacaggtcaaaacccagctacgaacaaaagaaccaaaatggtccaccagaccatatagacacttactaatctatttcgtatctaccacgatgctatgtttgtaatcagcaacctatcaaactttcctatgtgtactctatatgtccctttactagattaagcctttccatgtacacataaaggcctactaaagaccatgtatccctagctttatgcagaagtatgtttacttaacccatgtgtaatatctatgctattcgcttcaaacagactgctacagaacgttgaatgctcaattagtaacttcaaaatcag

SEQ ID NO: 254 - DNA, 692 bp, Sorghum bicolor
agagccgccgccgccgtcgcccaaggcagagccgcgccagcgctcgcgcctgccacggcttccgtgcgaccccgcatccaccgccgcgtgtcccgctgcggacacggacgccgaggatggccgcagcgtccctggagccctagcgcccgcgctataaaagcggcagcagccgctcgcccttcttctacccgccgccgccgccatagccgactcgaagctccgcaccctcaccaagcgcctcgaccccgacctcgccccgcgcacctgcaccaccgagctcggtcacgccgtgacgccgtcgatcgccaccacgatgtcgcccgcaactgcgtcgcccgagcgtctcgtcctcggcaccacctcggcactcgcaccgcgccctcgccgagcagcagcagagccgcggccatggcctcgccctgccgacgccgccaagcaccactgcgcccgcctcggccgtgcccctacctctgtgtcaagcttcatcaccacgcgggggtcagccgcggtgccgtcctcgctgcgcagcggcctcgcccggcgacgtcgagcccgctgccctcgccgcgtcgagcttcgaccacggccggccgcgtggacgccacagcccggccgagcctctgcctcgccaccgtgggagtcgccgcggccacgacgccttcagccccggcgcccctccgcgtctacgacgg

SEQ ID NO: 255 - DNA, 1023 bp, Sorghum bicolor
acagacgcatcttccccataagccaccccttcccagcaccgctcgtcctccgtcccgattccgtcgcgccgcccgcctcgtgcggtctcccacaaaggccgaatgccccctgccggatttggggcttgtgccgccgctgggtggctggcccaacgagcatcgcgcaatggcgacggctggtgagccacctcccagatctacatcaaggagtaggcggtggtggcagtcgtattcgcaaccagaccctggtagcagcattcgcggagctaggaggaggtggcggctccattgctggttgaccgtgcagcccagcagagtgttgaaatcgagcccagctacgcacagtcctatgctgagagctccacacttgctgagctctaaggatccagctgccaaggccctgcacacgtgcagaccgaagctcgctctgttgctcatatggaaaaaagcaggtacttccctctaagtctctaatcgtgtgtgacggctcactctgttgcccaatggaaaaaggaagtaaagatgcaactcagatggccacctctgtcctaactcctgaaaatgatagtatttattgatgaaatattgaatatgtagttgtttgttcatccttttttggcgtgagatcacaaggctctgaagcttgaaactattttgcaatttcgaacaaccaaaaaggctttggtgtccctactggttataaggtgatgctatcgtccttcagattcagttaaattattatcagatgaagctctggactagtcatcagtggaccaacttggaagttgtggacaacacatgttagtttgtttttgttcatcagttatatatgttgagacaaggatagcttgatgttaagtgacatgattaaatatgtactccagtttgataaatgaatgagtatggttaatgtgatcacttgtgtatgacgtcctaaatctgtgtaaatattgcattggtcttatgtttgatccagtgtatgtgagttgtagatatagaatgttttaatttttcttatcttct

SEQ ID NO: 256 - DNA, 1005 bp, Sorghum bicolor
ccgtctgccttgccacctgcgaacatgcccccgcacgcgtgattaggaaggttcatcaatcacggcatctctttcctatggtgcggcatctctttccgtcctcttcctccgcattcgccctccatccgctggtgcccgccgccgaacccggccctccgtctatcactcgcgtgtggtgccttcggtccccttgctccaccgtgcaccctcccccccccccgcagtcctcgccatcggccttgctcccccacgattcgtacgttgcccagcactcttgcacttgcgatgcactcgctagccctcgccttcggcctcgtgccgccgccagccatcacccttgccgtcgtggtgagggtggcgcacgcgtggagaagcgtgaggtcgggttcgagggatctgacgatgacagtgcaaggacaagggctggcaacgccggcgcaagggtcggggccttctactcagcacttgtgcgattgccataccgtacaacctcctcatcgatgtccaacctcgccacatgtgtcgatctcgatctggatcttcgatggtccaacctgaacctcacgttgtactggaatctggaaacggaggcggccagttggtggagcacttaccttccaagcatatacatacaattgaccaacactgcacggaagtacacttcatcctaccatggtgaaaacatgtagctttgccactgctggcctctcaccatcgatatgcttggtcgccggcatggtagtgagggtgccactcatggataatatctgtgttttaagcttgagaatgtatctgaaactaatgctacacatggctacttctctcagtaatctttatttgactttgtatcatctttaggcttgtggcacctctagcggtattatcagtttggtgtatttttctcatatgagtgcatctttaatttgggttatcatattgtacaaacatttattgcttgatagtaagtgagtatttttccctctatctccatttacactgtctaaa

SEQ ID NO: 257 - DNA, 1196 bp, Sorghum bicolor
ctccacggcgtcctcgtctccacccatttccgttgcagagtagctcgacagtttctctcagcctcgagcggagcggggagaggatcggatcggatcggatcggagagcctacgacgcggcaggagctggctatccctcgaggtcagggagcggcggcgtcgccgcgcccgcacgagacggcggagctggacgcggcggcggcgttcgccgggggggagtcggcggagcagcgcaaccgcttcctggtgctgcgtctgtacgaggcgctcaacgcccgcgacgcgcgccgggcgcaggagctgctggcgcccgacctcgagtggtggttccatgggccccccacgcgccagcacatgatgcgcctcctcaccggcgcggaccagcgcgacaaacagaaccgcggcggcggcggcgggttcgtcttctccccgcgctccgtcgacgccttcgggtccaccgtcatcgccgagggcgccgacgacgcgcgccagctctactgggtgcacgcctggaccgtggggcccgacggcgtgatcacccagctcagggagtacttcaacaccgacctcaccgtcaccctcctctccggctccggcgccgtctcctccaccaagaaagctgacattgcaggcgctctgcctaagctacaggacgctgcgtcttcttcttcttcctcctccccctcggcagctgcagggcccaagtgcctgtggcagagccgccgcgccgacagcgcacacaagtcgctgccgggcctcgtcctcgccatctgaagagacttgagaccgcaagatccatctgctaccctccagtataaccgtataataaaaatcctaaagttccaaactattatcgcagaaataatctggaacggcactagtcgtagtatgtactgtactgtactgtactcagagccagtcagtgaaaacgtaatgacgtttccgtatgcgtatggactgaactgaactggtccgtgctgtgaggttccggattcttgtacctagttagcttgtgtcctgttgtgtcgtctgtgtgtgtggaaattgtagtttgttaagtcatggcttatggtgcgcgctgccattgccgctactgtaatggtctgctgttatggtgtgatgatggatgtgatgctggtatattgttgtggctgaataaaagtggcatgagttggagggttaagaaattaattaacg

SEQ ID NO: 258 - DNA, 721 bp, Sorghum bicolor
tccgcccccatttcccgacccctataaaacacaaggctgcccgcggcgcccccatcatccattcccacagcaccaccaagagcaagagcaaacagcaacacaagccaaggcaaagagaaggaggagaagcaagcgcgaagcagtcgtctcgattcacatggccatggcggcagcggagggcaagagccggaggttcgcgctggcctgcggggtgctgagccagtacgtcaaggccgagcagcagatggcggccgccgcagcccctgccgctcgcgccccggccacgacgctgagcctcatgcccggcgcggacgtcggcgccgagcaggagccgaccccggccgccgccacgaggggcgaggagatggctgggcccgcctccacggcggcgccgctcaccatcttctacggcagcatggagaaggaggaggcggagaagacgaagcagccggcgtcctcctcctgggtcggtctcggcggcagcacgacggacgccgagcgcctcaccatcgcgctgtgatttggggagttcgcgtcgcgtcatgtggatcgattaattcggtgggttcctgccttcctcaggctggattggtttgtatggaaattgaaatgggttgtagagagatgctattcttcttgtttttttttttcttacgagagagtttcgctgctcttgtaagatttgatgattcgataatactagaaagaaagatggagattc

SEQ ID NO: 259 - DNA, 732 bp, Sorghum bicolor
aatggtgggtcggaagccgatgcgccgccgccgaagtgaccggcaaccgccgccgcaatccttcggcgccacggctcgcccgagttccccacgctcgctcgcctccactcctgcctccgctgccgcggtcgccgccgacctggacgagctgctgctgacggcgcccccgccgtccgcgtcggagccccggagcttctcgtacgcggtgaagcagcagtgctgggagaaggcggagcgggttcccggacgcgacccggagaggtggcgccgcgatgcgctcggcaacatcgtcttccgcaagctcgtggggtgccccggctgtctctgccacgactacgaccacatcgtcccctactccaagggcgggaagagcacattggagaattgccaggttttgcaggctacggtgaatcgatctaaaggcaacaagactgagatatccaaatctgagctcatacagaagagtgcatattgtagggtttcaggacgggacatggatcttgttgaactctctgcctatggaaatgtccggcgagggccagattcagggggctgcaaaatccaatgaagtagatatatctgaggaatcacgtcaatcagttcgaagtagttgcctgaacctgaatggaatgtttgtactatgtagcttaacacttcaagtgatttacccgagaaaagaaattgtgatatataatatatttgaatcaatgattgtctgcattcatactcagt

SEQ ID NO: 260 - DNA, 1674 bp, Sorghum bicolor
gccgcgcttgtgacagcaatgctgcgcaagtcgggcactgagcgccggcagccggcgttatggcggcgatgccgcagcctccggcagatcaagcaggtccacgcgctcatggtcctccggggcttcctctcggacccctcggcgctccgcgagctcatctttgcctcctctgtcggcgtccggggcggcaccgcgcacgcccgcctcgtgttcgaccgaatcccgcaccccgaccggttcatgtacaacaccctcatccgcggcgccgcgcacagttacgcgccccgggacgccgtctccatctacgcgcgcatggcccggcacagcgccggctgcggcggtggcgtgaggccggacaagcgcaccttcccgttcgtgctccgcgcctgcgccgccatgggcgcgagcgaaaccggggcgcaggtccacgcgcacgtcgtcaaggctgggtgcgagtcggacgctttcgtcaggaacgcgctcatcggcatgcacgctacctgcggggacctaggtgccgcggctgcgctgttcgacggcgaagcgcgcgaggacgccgtggcgtggtcggcgatgatctccggcttcgcgaggagaggggacattggtgccgcccgggagctgttcgacgagagccctgtgaaggacctcgtgtcttggaatgtgatgatcacggcatatgcgaagctgggagatatggccccggcgagggagctcttcgacggggctcctgatcgtgatgttgtgtcgtggaacgccatgatctctgggtacgtgaggtgcggctcgcacaagcaagcaatggagctctttgagcagatgcaggccatgggagaaaagccggatactgtcacaatgctcagcttattgtcagcctgtgcggactccggtgatatggacgctggccgcagactgcacaggtttctgtcagggaggttttctagaattggtcctagcactgttcttggaaacgcgctgatcgacatgtatgcaaagtgtgggagcatgacgagtgcactagaggtgttctggttgatgcaagataagaatgtctcgacttggaactcgatcataggaggattagcattgcatggacatgtcacagaggccatagatgtgttccagaagatgctgcaggggaatgtcaagccagatgagatcacctttgttgctgtccttgttgcgtgcagccatggcggaatggttgacaaggggcatgagtacttcaacttgatgcaacaaagatacatgattgagcccaatgtcaaacactacggttgcatggttgacatgctgagtcgtgctgggctgctcaaagaagcgtttgaattcataggcacaatgaagatcgagcctaatcctgtcatatggaggacccttcttggggcttgtaggatccatggtgagctcgaactggctgagcatgcgaatcaggaacttctgaaggcaaggagtgatgcaagtggggattttgtgcttctgtcgaatatttatgcttcagttggagaatggctggggtcagagaatatgagaaagttgatggacgacagtggtgtcaacaaggaggcaggctgtgcagttgtagacggcagttcaaaggatgtaattgactaatacaatcttgtagactgttctaattgcattctgtatttaaaaagtttttcatctgtctat

SEQ ID NO: 261 - DNA, 1097 bp, Sorghum bicolor
gcaatgccaaatctagagggctgtttcgagggggagaaatcaggactcgatcgcgggcgatgggggccggtgaccagggcacgtcgtcggagggggttgacatcctgaagaaccccacggcggaggagccccaggcgccagccgggaccaggaagaaggggaaggaggcgagcgcgccggagggcggtgaccttggactcaagctgaaggaagcgagcacgttgggcttgggcggtaagatcctgaagaagaggaaggaggcgatggcggcgttggatatcatgctgccgacgaagcccgcggcgaggaaggcgcagccggccggggtcgagaagaagaggaagaaggtggtcaggaagaagctgccgcaggatgtcatcgactcaattgtagcaaagccgtgtaagattgtgtatgagctctccgatgaagaccttgccgacaaatcccagcaattccgcgaagcctataggagagcaatgttagtccatgagaaggtccgcagctacgagcaggccctcatggagcagtacagagccacgggctccgtggaggatgaaattgaggtcaccgatgatgaggacgaggggacgggagaaaatgtcactggtgatgaggagacgtcagcgaacaaggtcacgggctctgtggaggatgaaattgaggtcaccgatgacgaggacgagaggacgggagaaaatgttactggtgatgaggagacatcacacatcagtgaacaaggtcaccggtgactaggaggagacggtggagaataagcccagaagttgccagaagttgcccgtggttatccaagatccagctaggttttgagtactattttgtctgtgatccagctaccctaagttatagtattgagtttgtgttatccagataccctaagttggagcagtatcatgtctgtgtgatcctattaagtgctcattattgtgttgtcaacccttttttgtcaactggtgattcctatatctatgttagttattatcacatcttgctgctggtgattctatgctattaattaaaccaacagtgttgcaattgtattcgatttgattggtgcgttttatgctactgaagca

SEQ ID NO: 262 - DNA, 1116 bp, Sorghum bicolor
ccatcagtcatcacacagagtgcgccatggcgtacaggacgctggaggtgactctcctgtcggccaaggacctgaagagggtgaacctgatctcgcgcatggaggtgtacgccgtggtgaccatctccggcgaccctctgacgcggcagtgcacccagccggacccctacggcgggcgccacccgtgctggaacacctcgttccggttcaacgtcccgcccagcgccgcgacggccaccggctgcctccacgtgctcctccgcaccgagcgcgccctgggcgaccgcgacgtcggcgaggtcatcgtgcccctggccgacatcctcgccggtggcggcgccgcgtccgaccccgggtcccggccgccgcagctcgcgtcgtaccaggtccgcaaggtgcaccgctgcgagccgcgcggcgtgctcaacgtgtcctaccgcctcggccccatcgtcgccccgcaggccagagccgtcgacgaggccgccggcggcgccggtgccttcgtcgggtatccggtgccgcggcagttctacgcgccgtcgtatgcctatctgccctcgccgctgtccctggcgccgccgccgcctccggcgcaagctgccggtcgcgacgcccagctgcacccacctccgcagtacagcttgcctgctgctacttattcgcaggcttatccacagcagccggctgctaattatccacagcagccggctgccgggcgcgctgctctgccggcgccggcgagcggggagagcaacggcaagctggacttcggggtgggcctcggcgcggggctggtcagcggcgcgatcggcgggatgctggtcgccggcgacgtgatgatgtctgacgcggcggcctacaattccgggtaccgcgctggactggccgacggcggcgcggcggcggtgtacaagaattcttatcgcgttcacgacaaagtcgaagcaaaacgggcggcggtgtgactcacttgaatcgatgcatactgtgtgattgtcattagtctcgtcttgttaacaacccataatagtacttgccgtgtgtatatggaatatataattacgtatatatcataattaataatataagataagagaaattttacgaccctcg

SEQ ID NO: 263 - DNA, 1601 bp, Sorghum bicolor
ggaagaacttcaggtgcgcgggccaatccgccgctgggaacaactccaccaccaccttgtgcagttgtgccgcccgaggcccgacgcttttttaaaaaacgcggcgccgagtgaccgagaatcccaagtccgcctccgccttcctccgcccacgcaagcgcacggcgcgcgcactcccacgaaaaaagaaaaaaaaggaaagtgaaggagaggaaaaaaaagcgagcaagtggtaatcgtagagcacgccccgactggggatgacgcgcgcccgccgccaatggccgcaccgccgcagacgatagcgctcgcggggctcatgctcctcaacttcgtcctcgccgtggcagcgctctgccttcacgtccttggccgacgcaggcctcggcagcaagtcccgtcgccgccgccgccgccgctcgagccggccgtcgcgggggaggaaggcggcggcgaggagaggccgcataaccagcggcggaggaggaacggcacgcaggaggaggaggaggaggggtcggcggcggcggcggcggcggatggtggtggccacggcgcggacggggaccgggacgccgccgcgaaggcggcggggaaggaggcgctgctcccccgccggccgcagttcccgctcgcctccgtggcaggcgcgctgcagcggcggatcaacgcgcggtacgacgacctcgcgcgggccagcgaggcgcagtgcctcaccatcgaacaggttaatgagtttgttaacagtctcatagatgctagaaacgagctgctgcagaggtatgagaatgtagaaagaagcttcaaaataaagaaggcaatgctatccaaccatcgaaactataggtcttcatatgaacggctctttgaacaggtacgcagattggaaaccgagcgtgataacctaaagaaagatgccgccatctacaactacattcaagagcgtcttcagaagtcagcagcatacaaaatgatcatggagctcggtactatggagatggaggcccaagagatatcattcgaggagctgctggctaaggagaaggaggacaccgccttctggcagcgcaacgggaagatgagatcattctcatccaagtaggacacaatgtccctacctgggctcactgacgatggcagatctcaacatcggtagtctaaacatgaaatcctagcctgctccttgagagcagctgctgtatgcggtatgcctgcataccgtttggtgtaacgctgcgctcgtctgacaagatgttgggcccctgtcactcaggagtctcctggcatgattctgggcagattaataaaagagctgtgtcgtgatagtcgtccctgcctccctggtatcacactattcctcactagggcttctggtgcccggcgagttctgcagttgacggctcactgctgctgtggccttgtgctcagcttggctgtgacgtgcggtgaactgaccattcgactgaacaagagacgtgtgcgtgtttggaattctggatacgtggcttcagcattcaggatctaatctgaatttgtcctgtataacaaggcgtaaattgcggtgatcgggtgcatcatcaagaaatttcaatatttgggat

SEQ ID NO: 264 - DNA, 1599 bp, Sorghum bicolor
ctgctttccattgctagctcctatagtcctaggctagctccgagcccccggcctcttccagttccagcaacacgcaacgctgcacctgcacttggcgtagccatgaaggagttctcgtacgaggaggtggaggcggcgacgggcggattcgcggcgaagaacctcgtgggcaagggcagccatggcagcgtgtatagggccaggctgaggggaggcggcggcaggatgacgaccgtcgtcgccgtcaagcggccgtcgcacgcgcagggggtggccaagctcgccaacgagatcgccgtgctctcggccgcgccgcgccacccgggggtcatcggcatcgtcggggtgtcgtcgtcgtcatcatcgccccagccgccgccgccgccggccgcgtcggggcctcggctccccccgctgctcgtcatggagttcatgcccaacgggtcgctgcacgacctgctgcaccggtcgccgaggccgcccccgtggccgcgccgcgtggagatcgcgctggacgtggcgcgcgccgtgcatgcgctgcacgccgccgcgccgcgcgtcatcatccaccgcgacgtcaagtccgccaacgtcctcctcggccgcgacggccgcgcccgcctcgcggacttcagcctcgccgtcagcgtcaaggcggacgacgacgaggaggaggacgaagaaggcggctcgtcgtccgcggggccagctccggcgggcacgatcgggtacctggacccctgctacacggagcctggtcggctaggccccgcgagcgacgtgttcagcttcggcgtggtgctcctggagctcgtgagcgggcgcaaggtgatggacgtcaactcgtgcccgtcgtccatcgtgtcctgggcggctccgctgatcgccgcggggcgggcgcgggaggtgctcgacggcagggtggccgcgccgcccacggcgcgcgcgcaccgcgcgttggcccgcgtcctcgccgtggcggcgcggtgcgtgtcggagaccgtggagcggcggccggccatggacgaggtggtctccgagctgcgcggcgccctcgagagcgccgggtggcggtggcgccaccaccgccgcggcgacagcggcggaggcggcgtggtggagcgggtgtgcaggcgcgtcgcgtcgtgggggcagcgcgtgcggaggaggagcaagagggtggtgagggcgaccaaggtcgagtgcaccgagcactccgacagcggcggcgtcgcgaccggctcgtcgtcgtgcgcggctgctctgccgtcgcatcggagcaacaacggcatgatgagcggcgccggcgcggcgcactcaaacgaatcatccaaagcaaaagagaacgctttgaatcgattcgagagcgaattggatctcgttttcagtagttgattgatgataaaccttggatggatttggattgaggataaaccttagactgttactgtcacaagtagttacgagactaattaatctacggctgtgttttgctcgggtttgttcgttgttcacctcgtgcaagatatacacgtacgtcagtatcgagatatggattgacgtggcgatgatgtatatacacttgataattcacgtttg

SEQ ID NO: 265 - DNA, 2643 bp, Sorghum bicolor
atggcgactcgcggtggagggccggctgcggcagccgtccttctgcaactcctcggcttcctgtttctgctgcggggagttccgtcgcgagccgaggacgacaccgtcgccgccggacggccgctgtccggcgggcagagcctcgtgtccaagcgtggcaagttcaggctcggattcttccagccaggtgcaacagacaactcgacccagcgctggtacctgggcatctggtacaaccagatctcggtgcacaccacggtgtgggtggcaaaccgggtgacgcccatctccgacccggagtcctcgcagctttccatctccggcgacggcaacatggtcatcgtcgaccacagcagcaggtctaccgtcgtctggtcaaccaacgtgaccgccaccaactcatccacggtcggcgtcatcctcgacaacggcaacctcgtcctggcggacgcgtccaacacctccgccgtgctgtggcagagcttcgaccacttgggcgacacgtggctccccggcgggaagctgggccggaacaagctcacgggcgaggtgacgcacctcgtggcgtggaaggggtacaaggacccgacgccgagcctgttcgcgctggagctggacccgcgcggctccagccagtacctgctcaactggaacggcagcgagcagtactggagcagcggcaactggacggggacggcgttcgccgccgtgccggagatgacgcccaccggcgcgtcgccggtgtccgagtacaccttcggctacgtcgacggcgcgaacgagagctacttcatctacgacgtcaaggacgagtcggtggtgacgcggttccaggtggacgtgacggggcagatccagttcctgacgtgggtggcggccgcaaacgagtgggtgctcttctggtcggagcccaagcggcagtgcgacgtgtactcggtgtgcgggccgttcggcgtgtgcaccgagaacgcgctgccgtcctgcacctgcccccgggggttccggcagcgcgacctggcccagtggctgcaggacgaccacaccgccggctgcgccaggaacaccgccctgcagccttgcagcgccgccgccgctcgagacgggcagaagaagcacagccgcaggaacgatgataggttctacacgatgcccaacgtgaggctgccgagcaacgcgcagagcacggcggcggcgagtgctcacgactgcgagctcgcgtgcctccgtaactgttcttgcaccgcgtactcctacagcggcggcggcggctgctcgctgtggtatggggacctcatcaaccttcaggacacgacaagcagtggcactaccggaggcagcagcagcagcatctcgatccgcctcgctgcgtccgagttctctagcaacgggaacaccaagaaactgatcatcgggctcgtcgtcgggggtttcgtcaccgcggtcaccgccatcgttctggctacaacgttcattctaagaaaacgaaggatcaagtcgttgaggagggtcgaaggatccctggtggcattcacgtaccgcgacctgcagttggtgaccaagaacttctcagagaagctcggcggcggggccttcgggtccgtgttcaaaggggcgctgcccgacggaaccctcgtggcggtgaagaagctggaaggcgttcggcaaggggagaagcagttccgtgccgaggtgagcacgatcggcacgatccagcacgtgaacctgatcaggctgctcgggttctgctccgaggggtcgaaacggcgcctcctcgtctacgagcacatgccaaacggctctctagacaggcacctgttcggggccagcagccaaggccaaggtgtcctaagctgggacaccaggtaccagatcgccctgggagtcgcgagggggttggactacctgcacgagaaatgcagggactgcattatccactgcgacatcaagcccgagaacatcctcttggacgacgcgttcgtgcccagagtcgccgacttcgggctagccaagctcatgggccgcgacttcagccgcgtgctcaccacgatgcggggcacggtggggtacctggcgccggagtggatcgccggcacggccgtcactgccaaggcggacgtgttcagctacggcatgatgctgttcgagattgtctcgggccggaggaacgtcgggcagcgcgcagacggcacggtggacttcttcccgtccacggccgtcagcctgctcctcgacggcgacgtgaggagcgccgtggacagccagctcggcggcagcgcggacgtggcccaggtagagcgggcctgcaaggtggcgtgctggtgcgtgcaggaggacgagagcctgcggccaagcatggggatggtggtgcagattctggaggggctcgtcgacgtcaacgtcccgcccatcccgaggtcgctcaaggtgctcgccgatccgtccaagtacgccgtcgagttcttctcaggcttgccgtcgacctgagattgggccactgtctgttagcggcatcaaacttacagtagggcgtgcagtggtgtatatacggagtatgagctaatgagtttgccaagaacttactcgtgccacgagcccacgaaccttgtggtagaatagaacttcttcaggtagccaagaagattt

SEQ ID NO: 266 - DNA, 3241 bp, Sorghum bicolor
aaaacgttcgcgtggtacgcggagaggacggcgttcgagcggccgctcacgagcggggtcgcgtatggggtcaaggtcacgcacgccgagcgggagcagttcgagcgccagcagggatggagcatcaagaagatgtactcctccaaaaccaagaagcagtcgcagggacaagggaacggcgaggacgccgaggtgcgggagccggcggaggagtatgctcccgtaatcttcgcgcaggacgcctacaagcacgtcatctccttcgacttgctatccggcgccgatgaccgcgacaacgtgctccgagctagagaatctgggaagggtgttcttactgctcctttcaagttgctcaataatcgcctcggagtgatctccacctacgctgtgtacaagtatgagcttcccccaaatgccacgccacaggatcgcattcaggctgctataggctatttaggtggcatatttgacattgaagcgcttgttgataagtcgcttcaccagctcgcgggcaagcaatccatcatggtgaacgtgtatgatactactaatgagaaaccgatcagtatgtatggttcaaatgatacaggaagtggcatgtgccaggtcagcacactgaactttggtgatccgacgaggaagcatgagatgcactgcaggttcattcagagcccaccttggccttggctggcaataacgacatcaattggaatttttgtgattggtttactggttggatacatagtttatgctactgcaaaacggattgccagagttgaagatgactttcaggagatgagtttgctcaagaagcgcgcagaggatgcagatattgccaagtcacagttcttggctaccgtttctcatgagatcagaactccaatgaatggtgttctagggatgctccaaatgctcatggatactgatttggacacaacacaacaagactatgttagaaccgcacaagccagtggcaaagctttggtatctctcatcaatgaggttcttgatcaggcaaagatcgagtctggtaaacttgagcttgaggcggtaccattcgatcttagaacagtttgtgatgacattttgtctctcttctgtgggaaagctcaggagaaaggactggagttggcagtgtttgtttctgaccaagttccacaaacactaattggcgatccaggcagaataaggcaaatcattacaaatcttgttggaaactctataaaattcacagagaagggtcatatctacttgactgttcatgtcgttgaggagattatgcattgtttggaggttgagaccacaaataccttaagtaggtacccagtggcaaacaggaagcgcagttgggaaaactttcaactttttagtagggaactgaactcctccgagatgccttttgcacccggtgcatcagactcaataagcttgataatatcagttgaagatacgggtgttggaatcccgcccgatgctcagtcccgtgtcttcacccctttcatgcaagtaggtccatccattgctcgcatccatgggggcactggtattggattaagcatcagcaaatgcttggtcggcctcatgaagggagagattggatttgcaagtaaaccccaagtcggttctactttcaccttcactgcagtgcttacgagggcccactccagtggaaatgagaataaatcatcagagtttaaagagatcaatgcattggtggtagatcatagaccggtccgtgccaaggttactaagtaccatttgcagagactgggggttcacaccgaattgacaactgacctagatcagtatatttctaaaattaattgtggatcacagattgcaaagcttgtgctcattgacaaagaaacctggctggaggaatcccactctatgcctcatttggttactaaattgaggaacaaagatcagccagactctacaaagttatttcttttggagaaccctaaaagttctgtcaaaagcagtttgcatatattcagggaatataacttgaatgtaattatgaagccacttcgtgcaagcatgcttcaggtttccctacaaagagcattgggtgggatagataaactgcattgcaggaatggggtagttggcaattcaacacttggcagccttcttcacaagaaacgaatcatagtggttgatgacaacattgtaaatctcaaggttgctgcaggcgctctgaagaaatatggcgcagaagtaacttgtgctgatagtgggaagaaagcaatcacactgctgaaacctcctcacagatttgatgcttgtttcatggacatacagatgcccgaaatggatggatttgaagccacgagaaggattagagtgatggaaagagatctaaatgagcaaatagaacgtggagaagccccactggagtgcgcaggggtccggcagtggcgaactccaatattagccatgacagcagatgttattcaggcgacacatgaacaatgcttaaaatctgaaatggacggttatgtttccaagccattcgagggcgagcaattgtacagagaagtagctcgctttttcctaaatcaagaccaagttcagtaggtaggcttatatggagtgtaaaatagtggaggatatcggcaacggttcacctgtcgaggctgaaagaattttgtcagagatcttagttcttgagagtgggcatcaattcgcagagttaggggccctattaaaacactagaaatgctgggatgtggcctccagttaggtggaaacactttaggctggagatggaaccacccatgttcggttccttggtacacctgatcaagctgcaaaactaaatgggcagtgtcttgaaataaagatgcatgtgcagcaatttactcgacaatttgctgaggtcaaggcgtgtgaaaaacttcagctgcattcactaacagcagatgtcctctgccactataatatagagtagggagagaagttttccttcccccggaaggtacggctgtacatattaggtattggttgtttgtgcaggcatttttgtatgcatcatcttcggtctgtatgggtcgaagctgtaaattgtaaatgacacattcaaagatggaagttttgtttgacaaaacatcagctgccatcagcttgtcgtcctgagtttctctcctgctactggttctctcaaccagccaattattacactgaaaactgcctgttggtgtggctttatctgatgaaatagcttttgcctgatgtc

SEQ ID NO: 267 - DNA, 1997 bp, Sorghum bicolor
atgccattgccattggcggcccagagcgctctcgtcgcggcagccgtcgccatagccacggccaccgtcctcctcctcgtcccatggacgccaacgccgcgggaccgcttcgccgacatggtgctggccaacgccaccatctacaccgccgaccccgcccgccccttcgccgacgccatggccgtccgcgacggccgcgtgctccgcgtcgggacctacgagtccgtcaaggagctcaacggccgccacacgcatgagctgagtctcagtgggaacgtggtactgccagggttcatcgactcccatgtccacttcatcgatggtggattccagctagcgagggtgccacttcgagggatcagaaacaaagatgacttcattggcagagtcgaggaagctgtcagagataaacatcctgggcagtggattttaggaggaggttggaacaatgatttttggggaggtgacctccctgctgctgcttggctggatgatatgtcacctgataatccagtctggctctctcgtatggatggtcatatgggagtagccaactcattagctatgaagattgctgggattgacaaaaacacagacgatccaattggtggaacaatcatgcgaacaaccggaggagagcctactggtcttctagttgatactgctatgaagcttatatttgatgtcattgaaaaagtttctaaccatgaaagaagagaggctcttcttagagcaagtaaacatgccctaatgaggggagtgactactgttgttgatgttggaagttacttccctgggacctcaacagagaaaacatggcaagattttgcagacatctatgaatgggctcactcaatggaaaaaatgattatgagagtatgcttattctttccaatgcccacatggtctcgtgtttctgatcttattgatgaacatggtcgatcactaagtcagtggatccatctaggtggtgttaaagcttttcttgatggttctctgggttcttcaagcgcattgttccatgagccttacgagggtgatcctggtaattatggtctgcaagtgacagatttggacagcctacttaatagaacactagaatctgataaatctggactccaggttgccatacatgcaattggggataaagctaatgacttgctactggatatgattgacaaggttgttgatttaaatggagtgaaggaccgtagattccggattgagcatgcccaacatctggctccaggtgcagcaaatcgctttggcaagcatggtatcattgcatccgtgcagccagatcatctattagatgacgccaactcagctggaaacaagattggggtggaacgggctgaacgaagctcctacacatttcgatcactgttagatggcggtgcacagctagcttttggctctgattggcctgtttcagacatcaaccctctacaagctatccgaaccgcaatgttccgtaagcctcctgggtgggaggtcccctggatccctgcagagcgcttgaccctagatgaatcactgaaagcgcatacgatgtctgctgcctacgcctgcttcttggaccacgccgtgggcagcctttctgaagggaaatacgcggattttgtggtgctgccctctacatcgtgggacgaattctccaacgatgtgccggggcaggtcctggcgacgtacgtgagcggcaggcaagcctatccatgaaccataatagatagcagttctaggaagatcacgttgtgtagggttattgctaccattctttggaaatcaatggctgcaatactgtaatcagcattctcgaagatacgatctgcaacattttttcagagagatttagttactactacaaaagaaaggttcacttggaagtaaggccttgtttagtttgtaaaaattttcaagatttcccgtcacatcgaatttttggtcgcatgcatggagcattaaatataaacaaaaataaaaactaactgcacagt

SEQ ID NO: 268 - DNA, 3680 bp, Sorghum bicolor
atgaaaatgagccccccggctctcgccgccggcaccacctcactgctgtcgcctcccaccgctgccgtctctgcccaccccttccctcccacgaaccacaagcctcacagcgcccgcatccgcctctcctccgccgccgcggctacctccagctccaggtgggtcaacccgcgggcacccccgccccggcgcggcgcgggcaggagcggggctaaccagcggctgcaccacctcgtccacctcggcgacctggacgccgcgctcctccttgtggagtccatgcgggatcccgagcgacccgccgcggttccctgtacactcctcatcaagaagctttgcgcagcgggccgcctcgacgacgctgagcgtgtgctcggggcctccgagcgcgcgggcaccgccgatgccgtcacgcggaacaccctcgtcgcggggtactgccgcgcggggggtcgtctcgccgacgccgagcgtatgctggcctcccttgccttgtccggctccgccgatgtcgtcacctataacaccctcgtcgcgggttactgccgcgagggccgcctcaacgatgcccggcgcctcgttgccgacatgccgttcgcccccaactcgtacaccaatagcaccctgctcaagggcctgtgcagcaacaaggagtgggacgatgccgaggagctcctctccgagatgatccggagtggttgccccccaaatgatctcacgttcggtatgataatccattcgttatgccaaaatggattggctgaccgtgcaatgggagttcttgatcagatgtccaagtgcaggtgcacacggggcgtgattgtttacaatgaaatcatcagttgccttgcagagctggggcgtgttgaggaggctcttcatttattcgaccaaatgccctgcaaacctgacatctttagttacaacactgtgatgaagggtttgtgtagagatgggcgctgggaggatgcaggaacgcttattgctgggatggttagaaaggattgccccccagatgaagttacattcaacacagtaatcagttacttgtgccacagagggttggttgactgtgcaatggaagttgttgagcaaatgcccaagtatggatgtaaacctgataatttcacctacagtgccctagttaatgccttatctgaacgtggctgtgtggatgatgctcttgagttactaagaactataccatggaaacctaacactgtttgctatcgatccgtactgaagggactgtgcagagctgatcgatgggatgatgttgggaagcttgtagctgagatgatcagaaaccagctgaaccttgatgaagtcacattcgggttgatcatcgactgtttgtgccaaaaagggctagttgactatggtgctgaagttttgagggaaatgacaaagtttggatgctcacctgatattatcatatacaattctcttatcaatgggttttctgaaaatgggagtgtggatgatgccctcgagctattcaaaaacatgtcctgcaaacgaaatgttgttacctataattatatgttgaagggtttgtgtagagctgagcaatgggaagatgctgggaagctcgtagctgagatggttaaggatgaatgtctccctaatgaagtgacatttagtaccctaatcagctatttgtgccaaaaaggttttgttgagtgtgcaattgaagtttttgagaaaatgccgaagtacaattgtatgcctaatgttataatctatagcacccttatcaatggcctttctgatcaagagtgtgtagatgatgccttgaagttactaaatgacatgccctgcaagccagataccatttgctatagtgctgcattgaaaggcttgtgtagggccgagcgatgggaggatgctggtgaactgatactggagatgattagaaagaactgtcttccagatgaagtcacattcagtatactaatcaataacttgtgtcacaaagggtttcttgagtctgcaactgaagtttctgagctaatgcttaagtatgaatgcatgcctaatgttttcatttacagttccctcattaatggctttgctgaacaataccgtgctgaagatgctctccagttactaagaaacatgccatgtgagcctgacaccatttgctacagcgctgcactgaagggtttgtgtagagcaaagcgatgggaggatgccagggagcttatagctgagatgtttagaaagcagtgccccctagatgaagcaacattcagtatgctcattggttcattgtgccagaatgggctggttgacatggcaactgaagtttttgagcaaatgtcagtgtatggatgtagccctaataggaagattcatagttcccttgtcaatggctattctgagcaaaggcgtgtggatgaaggcctcaagttattgagcagtatgccatgaaagcctacaatcaattcctgttgtctgtgttgaagagctttgagtcctgaggatggtaaggattcaaagtaaccaggctggagttcatcattgatttgatgaatttacatctggtactcattaattacttgtaccagaagaaagtttggtttgagttcttgagtattggaatggatgatgtcatgtgatcataattttttttttgagatagcctgcatggatgctttttcaagaatgaattatggcaggtaattgagatgggtactacatgtgactttttggctgtaatcaaacaaacaaaagcaccaatctttagtcataaaagaggttcagcattgtatcatggttttggatggcaatagaaggacagtagctgaagctctaaataaccggagatgggtggtagatatcaaaggagcacttactgtccaggtcttggaggtttatctcaatatttgggatctagtggaggtgtggccctgcagcaggtggtacctgatcagtttagatggaagttaactcagtcaggtacctacaacagcaaatcagcttatgctgcattctttggcaggaccatcaaatttgcaccatagaaaaagatttggatgagtagggctccactccggtgcaagttcttcatttgtttggctatcaataatcgttgttggatggtagaccatcttgctaaaagaggcttgccccactcggaggctgcccttttttatgataaagaggaagaaaccatacagcacatctttgtgggctgtgtctttaccgggcaggttttgttttaagttctacctgctctggtgccctcaacttcagacaccaaattttcaagttggtggaggaaaggttttcagcttattccaaaggaattgcaaaaggggttcaactatttagttattctggtagcttgggaaacctagaaacacaggaagagcatgccaggcctagcataccgatctgctccgagtgatagctgatgaatgcggttttttgggatgacaggagcttcaaaactccaagagctccttgcctggttgctgtccttggctgcttagaactgtggctaggttggtcaggggttttgatgtggtttcttttattgttttgtaagtgttagctactggttggtgttgtgtgagtggggggttgagtttttgtacttggaccggttcctgctggccctttggttctttcttcttcttaatgaaatgacacgcagctctcctgcgttgttcgag

SEQ ID NO: 269 - DNA, 606 bp, Sorghum bicolor
gccgacctcgacgcgtgcccgctgcctccgccgccgcgccgcgtcgcgccagcggcgccgctacctccgccgccgccgaggaagcggcgcggccggggttgctgctgccggctcctctgctgcgcggtggtcaccgcggtcgtgctggcggtgctcgccgcggcggtcgtcggcgcgctgtacctagcgctcgaccccaaggcgccgcggtactcggtggaccgcctctccgtgtccgcgttccaggtcgacccgtcgacggtgacggcgcgggcgaggttcgacgtgacggtgacggcggtgaacccgaactcccggatcggcatccagtacgagcccgggtccagcctcggggtgtggtaccggtcgtaccgcctggcgcgcggcgcgctgccagcgttctaccagggccaccgcaacaccacggtgctgccgctggcgctggccggggaggtgcagctggccaccgccgtcgtgtccggtttgcaggacgcgcagcggacgggcgccgtgccgctcgtgttccgcgccgacgtccccgtgcacgtcgaggtcggcagcttcaagctctggaagggcagggagaaagatcgcgtgtacttcaac

SEQ ID NO: 270 - DNA, 3506 bp, Sorghum bicolor
ttatgcctatatcttatcaatgtatttataactgagacggaggatcctcatttgtttgtcaaggatatgcaattagctgccgctagagcattctcagcattgtgtttcattgcatataaggcccaacctcagttgatggaaaatgccagctttactggtgatgtttctgagattcggagattggaatcaagtatatcctacattcttgatgaggatgataaaactaatgattgtttggttgttgctgtattccaccttttgacatctgctgctcgttatcaggttttataattaacatgtgaattacggcatatttcttttgcagcctgcttttcttatttccttgatagagcagagtatgaagacaactgatcataatgcttccaccaatgatcatggcaagggagtttctgttacttcaaaaagtaatactgaacttgctgaccaaatcttggactatattgaaaggtccgtcgagctcatgaatagatctcccttggtgttactaagtattctcgacttgttgaaggcattatgggaaagtggtatacagtttttgtacattttagagaagctaagaagttctctaacattctgggataacttatcacggtgtattcgtgctacacttgatatctgctctattgacaatgtcaatgccgttgatgagaaattttcattaaggtaccattgtcagggtaagatatttgagatcatgtcacatgagttattcttgcaaggaaaattgcttgcagagacttctaatactgtccgagatgatccaaaggggcaaaaagagcataaaagtgggccttgtcatagcagtgtagtcttgaaatggtttgataatgctattttggacgatctgatcagtaacttgtcaagtaatgcatacaaaaaggaacttcttcatcatgcaaaggtagctgcctgcctatgtatcatccatttaataacaaagttgtcaactggtgattctgggagcttgtctttctcattcatgaagaaaattcagatcatatcaacaaaattgtcacagcaccatgcattcttagctctcctgtcgcagtattcccgtaatggatatagtggtgaacaagaacttaataatttggttatcaatgatctttattatcatatatgtggagaactcgaaggtcggcagattagctctggccctttccaggagttgctcagttttcttctggagtttaaactttttgaacacaatcccttggagcaactacaaaatacatacctgatgccaaatgaaaaatttgtatttgatgtggagcacatacatgacgagcttggagttgatctctggactgattcagaccggaagaggtctaaagaagtagctaaaaaaatgctggatattatgcgtaaagcaaatttaatgaagtgttatgctgatgcaaagctttctgcattgaggtccttcttgacatttttatctgtctacacaggagcggtttctaacaaaaacttggacttacctggtggaggcatatcagtagcggccacacaatcagcaattagatgtgcatgtaaatcattcgagtcagctgttgattcactgcttcctcaagctgacacaaatgaggttttgtttcctctcttgtccggacaagtggaattattgctaactcttgcccgaatattatttcatcaagaaaagaagaacaagaaatcaagccatctctgcccagatattgtacttctaatgaaaacttcagttgccagcacttctttttttgttgatctcatgccatctgctcatgctcttaagaaaccagtgaaggcacttcttgttctgcttttgtcgtcatatgagttcatgtacagcaaggttcacataaaagacctaccaaatgatgttaacatgtttggcgaattagcccttttaagtgtgagcttgctacctatactgtgcaaattggcacagaatagggaatgctctgatcttgctgttgcatcaatggatctaatattgaagggatttataccttctaatgtatgggtgcctattctgcaaaagcattttcatctccaggctatactgcataaatgccagaatggtgatttattatctactcaagttatacttaatttcctcttgaccttggggcgaacaaaggatggtgctaaagttcttcagtctgccaatatttttgcattcttgaaggtacttttgagtcagttgtctctggatgactcctgtttgagaaattccttgagcacccaagtgaaggatgtgaacctatggggcttgggtctcggtattgttgcgtccctgaaccattgtttggatgatgacatttctcataacaatgtcgcaaacagtactatcagcttcctttcaggacaggtgcctttgatgtcatcatatctgtctgcacagagtgctgctactcatcagagcaagaaacgggcattgttgcagaagtcacagacatcactttcagcccttagtcttactgagaatattctcatacttctatgtatcttggcgaaatatcattttccacgggacactggaaagaaggaagtagattcagaactaagagagattattatccacctgctagcatttataagcaaaggaagtgtaaagactggtgatgcctctaactggaactcatcgtttttctgccctgctgttatcaaagaggaagtagcgctcaatgagaaaccaccactcatttgtagcaagtatggatggttcaaatttgctgcaagttgtactttgtcaactgcagctgtttcagtttctcccagtgcagctttattggtggtgagaagtgacaagagttcaggagattctgattctataaggcaaactcgttatactgagatattagctgttcagatttacaggattgcttttcttattatgaagttcctctgtagtcaagcaaaagaagcagtaaaaagggcagaagaactggagtttcttgaccttgcccattttcctgagcttcccatgccagatattcttcatggtttacaggatcaagtggtttgtattgtcaccgaagtatttgaggcaaatgggtcaagcactctaaatcccgagacagagaaggtatgccagctcctattggtgacacttgaaacgtcactttacatggaactatgtgtatcccaatcatgtggcatcaggccagtacttggtcgtcttgaagatttctgcaaaggaatgaaggctctgcttcaagctatagagaagcactcccgctttaaaccatttgtcaggtcgctaactgaaatcactacacttctgtaccccgggcttttgcatagtaaccttctcatgtgactcttgtaaattgtctctttgttaaagaaatgtgttgtggactttacatactcagtcgacgtcgtaacgtgcagaatctgtgttacacgaaaccagacctcgtccctacggcatatgcatgttttgtaagggctctccagctgcaactctattcacttggcctagtttttggcctggcccgcgg

SEQ ID NO: 271 - DNA, 5798 bp, Sorghum bicolor
ttttcgcaacccacgccgcgtcccttgggagtccagtggagtggaggaagtggaaccgtcaaaatgtcgtcgtcctcggcgatgccgccgccggcgtcgccgcgggagcacgtggagaggatccggcgggagcgctactacatcgggcgcggcgagcagaacccgctggcggaggacatgcaccaggccgtcaactacctctcgcaggaactctactccaaggacgtccacttcctcatggagctcgtgcagaatgctgaagataatgaatacccttctgaagtagcaccttcgttggagtttctcattacatcaaaggatattactggatgtggtgcatcctccactttactcatcttcaataatgagaggggattctcttcaacaaatatagagtcaatttgtcgtgttgggaaatcaacaaagaagggaaacagacatcagggttacattggagagaaaggtattgggttcaaaagtgtgttcttgatatcaagtcagccctacatattcagcaatggttatcagatcaagttcaatgagaaaccttgtgcagaatgcaatattgggtacattgtacctcagtgggtggaatccacgcctagcctttctgacatcgaagcaatatatgggtgctcaaaagtcctacctacaactaccatcattttaccattgaagagtgagaagattgatgcggtgaagagtcagttgtcaagcatgcatcctgaaatgctgctgttcctgacgaagatcaggaagctctctgtccgggaggataaatctgatcccaacaatacaactgttagtgagatctccatatccagtgaaaagaactaccaagccaggaagaacatgcatgctgagtcgtacacactccatttatcttctgaagagactgggaaagatgaagctgaatgtggttattatatgtggaggcagaaattcccagtaaagccagagaacagagtcaataagcgtgctgaaattgatgaatgggtgataaccctggccttcccacatggtgagcgtctgtcccgtgggaagcagctatcacctggcatatatgctttcctcccaactgagatggtaacaagcttccccttcatcattcaggctgacttcctcctaggatcatcaagggaggcaatactgttcgataatccatggaataagggaattctcgactgtgtcccaagtgctttcatgaatgcttttgtaacacttgtgaagtccaaagctgatgcgccagcaatgtcgctgccatcaatgttcagtttcctacctgtcaattcgtcactaatcccactgcttgagccggttaggtctggcatcaaatacaaggttctcaccgagaatatagttccattagaatcttatgcttcacagaagatattctgtaaacccagtgaagttgcacggctgaagccagccttttgggctatccttggcaaagcacgggaattcggtgtagatttgaagagtctgtcaactcatggaacctacattcttagttctcattttgacaaaagtagatacaacagtgtgcttgagtttcttggtatcaaaagcgtgagcactgaatggtatgcaaaatgcattgaagggtctaaccttgtcaaggaggtagatgagcagctttacctggaaattttacactttgtcgcgagtaattgggaaaactgtttttctggtacaaatatgatgtctgttcccctactgaaatatgttgataggaatggtgttctctctttttggagcatatccagagctagtcaacagaaagatcggttgtgcattgcatctgatatgaaatacagatcatggctaatcagctggaacaaggagtttctgtcttctaataagttctttctccatccgagcacacaggctgctctggatggtttctcacagaagatgacagtggaaagctggcttcggaaccatgcacgagtggaggttgtctctgtctacagttatggatcgactgttgttgattccttgagtaatgatcaaaggtctgtccttgcttttgcacactttctgtaccactcatttaagatggagcacatagagagcttctggttatcaaagctctgctgtgccatgccgatagttgacagatatggcaatgttgtcaacaaaacagaaaacattatagttccagctaaggggagcaaatgggttggtttgctgggtacatacccatggaggaatcaaggctacattgaattgtcagcagattacaagtcagtaggccactttgctgggaactacacatctgaggatcagctgttggaatttctcaagatacacctgcatgcctcagatgtgccattgatacgcccaccaaatgtgaggttccatactgtctcatcacctctcaatgtggacaatacattcttgctactggaatggatacggaatatcaggtcaaatggtgtaactttaccagatcaattcctggcttgtgtagaagaagggagttggctaaagacatcagttgggtacaagccaccaaatgaatcatttctgtccagtgctaactggggaagtcttttgcaaagtggaccttcattcattgatataccaatgattgaccaacaattctatcaaaacaagctgcatatttacaaacaggaactcaaggtaattggggtgagatttgaatttgaggaggcatcatcttacattggaagccgcctcatgtctatggctgcaagcaacgtgttaaccagagactgtgtgtactccttgctgcggctaattcggttcctacgagagaaggttctatctccaagtcaattgattgacagtgtcaaagatggatgttggatgaagagtactgttggatataggcgtccttctgattgtatcatcaaagattcagaatgggcagtggcatcttgtatcagtgaccaaccattccttgatgtcgagttctatggcgaggacatcctttcatataaatcagagctggagttgcttggtgttattgttgggttcaaaaacaattaccatcttgttattgataacttcaagttcagatcctctgctattacttctgagtctactgtattaatcctcaaatgcattcgttatgttggatcatgtcaagatttcataaggaagcttagagatttgaaatgggtgaagactaatgtgggattttgtgctccaaatgtctcttttcttgtggattctgaatgggaatgccttgtgaagatcttcaaaggagttccaataattgatttaggattttatgggagtgtgatcagttcatacaaagaagagttgaagaaggccggtttgatcacacgatttgaggaggcatcgatggctatagccaatgttttcaagcgcatggtatcggagtcatcacttacgaaggctaatgtcctagctcttctactagcttaccggcagctgagaacacacagcccacttcctgttgagcttttcaactgcatgcgcacagagaagtggatacacacatcgctagggtttcaatctccatcaaatacaatcctatttgataatgcatggcaatatctatctcccatatcaatattaccgttcattgatgatggtgacacttgtaatggtttggggatggatatatacggctataaagatgagcttagggagttgggtgttactgttgaagtgaaatttggtgccagatttgcccttgctggcctcagcattcctgatgatccttccattttgtccaaagctaccattttgtcgtttctggagtgtatcaagaactactttgcctctgcaactgaacctccaaagggctttaaagaccagatttgcaagaagttgttgaagacatccttgggctaccaatatcctgatgaatgtattctcttcgatgcaaaaaattgttttctacagatggaagatggccctttcatcgatgaagcattctatggttcagatatagcttctttcaaacatccccttgcgatgattggagtgactgtggatgttaattctgcacaagatcttattgcccggtatctgaggaacaaaaaagatatagatactatttcccggatctacatgtatctgaagaaatgtaactggaagcctgacaaaaacaacaacaacaacagaaattggatttggataccaaaggaaacagagggtggagactgggtgagctcaagaagttgtgttctgtatgataagaacaatctatttggcctgcagctgcatgttctggacaaatattatgacagaaagctgcttgacttcttttcacttgctttcagtgtgaggcatggaccttgttctgaagactattgcaaactatgggccacatgggagagttcagtgcacgagctacccatatctgattgcttggctttctggaaattcatagcaaagaactggaccaagaaaacagaggaacttctttctggttgtgtcaaggttccagtatgtattgatggcaagatcattttatcaaacaaggagaacgtgttcattcctgatgatctgctgcttgcggatttgttcagaaagcatcctaaacaatcactcttcatctggtatccttcttctgccctaccttccatgtctcgagcaaggtttaacagcatatatggcagtattggtgtcaggacaatctcagaagcagtggccaagaatgattctttcacttcagcgaatagccatttcaaaacagctgttctgagtaaggtgatcaaggttggcttgctccaaatagtcctcgcattcctttccaaccctaattttgacattcctgctaaagataggcatcatctggtttcatgccttctgaatgtgactatcgaagagaccgatgaaccaatcacaatggcatatagtgtgagtttgtcctctggagagatggttgaggtgaaggctagacgaatgcttcggtgggaaagggagaattcaaagctgtacatgcagagaagtgatggtgcatccagctatgaagacaagattgaacttgcgacctactttgcacatgagatatctcatgggttgctctttcagatgccagatcagatatcttcactcactgaactcataaaaattggcagcttagtggacttccagcaggccgctgttgcgttcttgctgaagtccaaaaacctgcagctgttccctgaagatgaagatttcctgaactcttctgtgctaggtggcagcaaaaaaccagtggacaactagcagcctgcagattttactcttctgtacttgttcaaggttgctgatggcctgcaattcctagaaaaatccggtgttgcgcttgcgcttgtgcagttgtgcctagagatcccggaatatcatcaacgaacgtggtgtcttctatgatgcatatgtatcgttagactaatatctcctgaatatccagtgcctcctggtacaaaacttgtcagttgtttcggtgcagatgcttatctcagtgttaaatgacaccaagtacttgaattactgttactattattatcgtcaatgccttgtgtgtgctccgatttatggtcctgctacatgagttgtgttttagatttgtggcagtgacagtgatctgttaattgcacgggttttgcttgtactggaggccaaatagagttgtttccgtcggtgtataggcttggcgtatcagttgcatcttgccaatgaatgttgtcacgtttctgtaaccaagatagcatatttgttctttcacgtctcatgaaatgcactactagatgtcaaacaaatttatttgacactggtctagaagcattgaacatcctaaattagatgctcttcta

SEQ ID NO: 272 - DNA, 1269 bp, Sorghum bicolor
tgatgattctgatgaactagatccagccaattttatgggaagagtatattgcccaacaaaatatcctaggatccattgctaaacagctgctagacacctacaactcaggaccttctcatcgcctaagtggtccaaggaagtgtatccaaagggaccatgaaggtgctcaccaacgtcttgtaactgactactttgctgaaaatcccctctaccctgaaagaatgttccgtactagatttaggatgacaaagcatctcttcttgcgcatcgtcaatgccctgagtgaatggtctccatacttcactctgagggcagattgtgcaaatcgccaagggctctcgcctctgcagaagtgcacatcggcaattcgcatgcttgcatatggcacacctgctgatgcccttgatgagtacctgaagattgggaagagcactgcattggagtgcttagacaagtttgcacaaggtgtgattgaggtgttctcaggggagtatatgcgtgctcccagagttgaagatgtgcagcgtctacttcaagtcaatgagtctcgtggctttccaggcatgttgggaagcatcgattgcatgcattggaggtgggaaaattgtcctgtggcttggaaggggcaatttacccgtggcgactatggagtcccaacgattatcctggaagcagttgctgataaggatctcaggatatggcatgctttctttggtgtgcctggttctaataatgacatcaatgtgctgaatcagtccccattattcattgaagcattgaaaggtcaagcacctcaagttcagttttctgttaatgggaggcagtataacacaggctactatcttgctgatggaatatacccagaatgggcagcctttgtgaagtcaataaaagcacctcagatggagaagcacctcaactgaaaaaagacttaattgagcatatttggcaaaagtttgccaataggagaaataactagttgtgtgtgcaatatcctctttctttaaaatgttcctgttgggggttcttcctgaatgctagatatggctaaataaattgagactctggatgctagatatatttccaagtcattagtgtaatagttagttgctcatggtagtagccttaagcttttaaatttgtgtgccccctttggtctatcttatgctgtgaacttgatgtaacagccattatattttaccaaggaacaatattaatgcttattgcttcagtcgataatatgtttgatttacttgtgaatatgcccat

SEQ ID NO: 273 - DNA, 1766 bp, Sorghum bicolor
gctcaaacctcaaacccccaaaccccagcggccagcaaaagcagcggcggcggccaggggctgacgaacccgccgcgagaaaccccggttggcaccccaccaacggcatgggtggtattggcgtcagcccgtgcgatctggacagggagttcgcgccccaaatcgcccagctcctcgccacgcctcctctccaatccgctcaggaatattatgatgaactcatacggtccaagaagcctgatggcattagagtgagctacagtggcaagcatgggaaaggtgtttgtgcaaatagggactttgctgaagacgaccttgttctgaaggaccaaatgttggttggtgctcaggacagccttaacaagattgactgtgttgtgtgtagttactgcttccgcttcattggttctatagagttccaaattgggcgtagattgtatttgcaaagccttggtggtagtgttgatggctctactgagagacattgccatgggagtgatgctgggccaagtactggctgctctggtgcatcaagtgggaatagcaatgctgtgccacaagaggtcctgatgtcacttatggatggtaatatgtcattgcctttaactgatcagttctgtctgccatcagttgttgcttgccctggtggatgtgagggagaactctactgcagccaatcatgtgcggattctgattgggattcttatcactctttgctgtgtgctggatccaagaccgaaccattacggaaatccgcccttcagaaatttgtagggcatgctaatggaaccaatgatatttttttgattgctgccaaggctatcactttcaccttgttgagatataggaaactcaaaagacagcatgggtctcatgaatcgagctcttcgctcctcatggaagcctggaaaccactttcaatgggcttcaaaaagagatggtgggaatgtgttgctttgcctgaagatgttgattccagtgaagaagaattgtttagacagcaaataagggatctggcatttacgtcactgcagcttctcaaggatgcaatctttgatcctgagtgtgcacccttgttttcgcttgacatctatggccatataattggcatgtttgagatgaacaatcttgatttagttgtcgcatcaccagttgaagactatttcatacacattgatgatcttccagagagtgagaaggaggaagcagagaaggtaacggggccattcctagatgctttaggtgaagactattcagtcccttgtgagggaacggcgttctttcctttgcagagttgcatgaaccactcatgctgtccaaatgctaaagcatttaagagagacgaggacaaggatggccatgcagtgataattgctctgaggcctatcagcaagggtgaagagattaccatctcctacatcgatgaagaccttccatacgaggagaggcaagcacagcttgcagattacgggttcacgtgtacatgcttgaaatgccaagaagagcaaccggtctgaaaggagaactcagtttgtattttgtggcatttgggaatcttcatgtattttatttctctgggtaatttttgaaagcttggaaaaagtgaaagtgcacaaacaaggggagtttctttttgggttgcaacttgcgaaagatgatatgttcttgttcaaatggatagtggcgaccatgttaaaatgcaacagccgatcagtctttagcctcacattatgttccacgtcataacatatgtgatctacttcctc

SEQ ID NO: 274 - DNA, 1134 bp, Sorghum bicolor
gagcgagacagaccaggaactgacgcatttgaatcggaggccaccgctgcgctccgagggccctcctcgctcgccacccgctcacggagacagggagaggtcgatggcgagctcgctggcccgcctgggagcggcgctgccacgcgcgcgcccgtgcgccacggcccgcgccctgccaccggggcggtgggacgccgcggcgctcggcgcctcccgccgcgccgcgctgaacgcttgcaggtgccaagttcattccgacgttaaagtagcccctgcatcggatctgaaggatggtagcaaatctgaaacttggaggatcaagatgctctacgacggtgattgccctctctgtatgcgtgaggtaaacatgctgagagaaagaaacaaatcctatggagcaataaagtttgttgacataagctcgaaagattactctccagacaacaatcaaggccttgattatgaaactgccatggggaggatacatgccattctttcagatggaactgttgtcacagatgttgaggcatttagaaaactgtacgaggaagtaggacttggatgggtctatgctgttactaaatatgagcctgtagctaccatggcaaatgcagtatatggtgtgtgggcgaaataccgtatgcaaattacaggtcgacctccactagaagagattatggcatcccgaagagctgcaggcgaatgtaaagatgacaaagtatgcaagatgtgagcataaaaaatggagctgttcgctgcagctaaaaagcagccgccaccgccgccgctgtaacagtgattatccgagtgaaaaacagccccagctgcagccgcagctaacacgcccaatgctgttctactgtactacatacctcacctctaggctcatatgcatagttttaacactaaaataatcgctatggtattaaaaagaaaggtgaatagcttatttaatgatttatcgaagtaaatatatacatttgtatgtacactgtactggtttgacggcaagacattttatggtgaaaacttccacgtagtgttctgtttttatcgtaagctcggtgactggtgagggattccacggtgcctcaagtcctgaactcctgatcatgggatttgtctagaatgcct

SEQ ID NO: 275 - DNA, 1682 bp, Sorghum bicolor
cccctccccgatcccccttatcgccaccatgctgtcactctcgcacccgcaccccgccgcgtccaccaccgcgccgcgccaccagcggacgccccgcgccgccactcccgtgtggcgccgccgtcgcgccagccacatcgtcgcgagcgccatcctgctccccggcggcggcagcactggcggcggtggcgggcccggcgaccggaggctccccttcacgccgcccccgatggcaccaccgggccagctctaccagccgttccacccgccgccgtcccctctcccgcccagccttcgcaacctcgacctcacccagcgcctccagatcctccgcgaccgcatgggcctgtggcacgagtacgcgcccctcatcgcctcgctctcccgtgacggcttcaacccgtcctccatccaggaggccacgggcatctcgggcgtcgagcagaactccctcgtcgtcgcgtcccaggtccgcgactcgctcctcgacgacaaggttgccgcgttcccgcccgacctgctcccgtacttcgactcctacggcggacccgacctcctgtacgagctccgcttcctgaacgcgcgccagcgtgccgacgccgccaggcacgccatcgactacaggctcgaacccaagggcgtgcgggagctggcgcgcgccatgaagggcttcccgcgctggcgcggggaggaaggctgggaggccttcgggagggactcccccgccgactgcctcgcctacgcgcggttccgccagtcgagggaggccatcgacgtggaggagcgcattgcggagctggagcgcgcgctgcaggtggtggagaccgagtccggtagggcgcgcgtggagctcgagctggagcgcgccaggaagaaggcggccggggaggaggtggtggaggaggatgaccctgccgcctcgcggcccaacgtcacggtggtgcggctccagtacggcgaagtcgccgaggcgaccaccgtcttcatgctgccggtggtcagggagacggacggcgtcgcggccatggagtcggcgcccaggcggaccaagacggacgtggaccttggcattgtggaggtggacaaggcgtgggcgcggtgggccgtgctgcccggatggggccccgtggccgaggcagcggacgacgccgtcgtcgtcgagcttgcggacggccggaggctgccgtggcgcacggccgatgaggagccggtgctagtcattgccaaccggagcaagaaggaggtcgtggagcaggggatatacgtcctcgagaaggatggccggcttgtggtggagagggggaagaagctggctgagcagggcatagccgcggcagctgccgaggtggttatcgttgtccggccgcccaaggatgaggacggcatgattagcgacgaggagtgggactgatcactgatctggagaggaggtttatcaagggttttgcttggttttggagatgccaatttctctttctccattgggtggtaattggtggtaaagctttccccttctcttctttacagtctcgagtcgatcgatcgatgaataagagcaacgaattgccgcctcatgttgtttcggtacatgccataggaactattctctgtagtcccttagccttagccttgcattgctggctattctttccccacattatatttgcaaaactacggtcttg

SEQ ID NO: 276 - DNA, 3844 bp, Sorghum bicolor
tccactccactccacgccgccccatgccgacgccggtgcccgccgcgcgccagtgcctcgccccgcccgccgtcacggcgctcgacgccgccgtcgcctccgcgcgccgccgggcacacgcgcagaccacatccctccacctcatcgcctcgctgctcgcgcccaccgccgcgccgctgctccgcgacgcgctcgcccgcgcccgcagtgcggcctactctccccgcctccagctcaaggcgctcgacctctgcttcgccgtctccctcgaccgcctcccttccagcagcaatgaccagcacgagccccccgtcgccaactccctcatggccgccatcaagcgctcccaggccaaccagcgccggaacccggacacgttccacttctaccaccaccaccaccaggcgtccgcgtccgccaccgccgtcaaggtcgacctctcccacctcgtgctcgccatcctcgacgacccgctcgtcagccgcgtcttcgccgacgccggattccgcagcaacgagatcaaggtcgccatcctccgccccgcgccgcccgtcccgctgctcgcccgcgccggcctccccacgcgcgcccgcccgccgccgctcttcctctgcagcttcgccgccgcggacgacgccgacgtaccctcgcccgcgcctgccctcgccggggccgcgccgggagaggacaactgccgccgcatcaccgacatcctcgcccgcggacgcaaccccatgctcgtcggcgtcggggccgcgtccgccgccgcagacttcgcccacgcgtcaccgtaccgcgtcctccccgtcaatcatcagacggacctcctcgccgccgtcgcggcggcaccgacgacgacgcccggttctgggatcatcttcaccatcggtgacctcaaggacctggtgcccgacgaggccgacctgcaggacgcggctcgcagggttgtggcggaggtcacgcgcctgctcgagacgcacagagctgccgcccgccagacggtctgggtcatgggctggtcggccacctacgagacctacctcgccttcctttccaagttcccgctcgtcgacaaggactgggaactccagctgctgccaatcaccgccgtgcgcgacgccggccctgcgcccggacttgtgcctcctccagctccagtaaccacggttcctgccttgtccatgcctgccactacaagcttcgtggagtcatttgttccttttggaggttttatgtgcgatacctatgaagcaaattcctgccctcaggccctgcgatgtcaacagtgcaacgatagatatgagcaagaagttgcaactatcattagaggaagtggcattacagctgaagctcaccaagaaggtctaccttccatgctgcacaatggcagcatgatgggtcctaacaatgggtttgatgcactcaaggttagagacgatcatatggtattgagtacaaaaatacagaatctgaagaagaagtggaatgagtactgcctacgactccaccaaggttgcaataggatcaacagagatccttgccagttatttcgacatcacatggatgttcgagttgacagggaaagatgtgcaaatccaaaccaaagttcacagtcacttgcacttcaaagggaggttattagaccttctgcagtgtcttctctacataccaacacaactgcaaagagtatttcggcgccatctatttccacccaaatgaatgcagaccttgcattgaaccttcaagtcaggcaatcaaagagtgatgaacccctccaagatagggctgtgccatcccaacatagcaactcatcaaattgtgacaaccctgaagatcatgtgtcaccatcatctgctgcagctgtgaccactgacttggcgttggccacccctcgtggatcttcttccaaggattcaagtaatgcactgcgtaaacatgtagaggatgctgaagggtcgatccagctgatgcccaagaaggttgatgatctgaatcttaagcctcctcacttctctgcacagccttacacttgctttaggagttcctcaaattgggatcaaacttcacctagtgctctgcatccagcagcttcaggaggtgcttctgcctttggccaatggcagaggccttcacccctcgcagcacaaacttatgatttgagcaattacaagctactcatggaacgactgtttaaggctgttgggaggcaggaggaagccttgagtgctatttgtgcatccattgtgcggtgcaggtcaatggagaggcatcgtggtgcaaacaagaagaatgacatatggtttagtttttatggcccagatagcattgccaagcggagagttgctgtggcacttgctgagctcatgcacagtagctcagagaacctgatatatctggacctaagcctccatgactggggtaaccccaatttcagaggaaagcgtgccactgactgtatctctgaagagttgagaaagaagcggcgatcagttatctttcttgacaatgttgacaaagctgactgccttgttcaggagagcctgattcatgccatggagactggcaggtacaaggacttgcatgggggacgggtggctgaccttaatgactcaattgtggtgttgtctacaagaatgatccaaggatatcaagatgcctctcttgggatggaacaggacaatgctttttcagaagaaaaggttgtggcagctcgtggacatcaactgaagatcatagttgagccaggcacagccaacatcggtggagactctggaggcaaagttgtagtttcctcaaggcattccttgagaaacagtcaagcatctttgttgtctagttctttgagtaagcggaagctccacatctctgatgggcaagaaaagacagcagaatcaccgagcacttcaaagcgactgcatagaacatcaagcattccattcgacttgaacctcccaggtgatgaggccgaagcccatgatggtgatgatgacagcagtagcagccatgagaactcgtccagtgatctagagggatatgtgggcaacctcttacgttcagtggatgagtcaatcaatttcaaaccatttgactttggcaaactttgtgaggacatcatgcaggaatttagcagtactatgagcaagactctaggctccaggtgcaggctggagatcgatgctgtggctatggagcaagtagtggcagcggcatgggcatctgattcacatgagaagaggcctgtgcggacgtgggtggagcaggtgtttgccaggagccttgagcagctgaaagtcaggtgtaagaatttgagcagctgtactctgagattggttgcctgtgagaatgaaatgccggtgaaagaagatggttttggagctttccttccctcgacaatagttctggattggtgatggtgatatgtgtctgtatagggtttgcattattgctagctgtaagtattggttagcacataagtagtggttagcccaccccacccaccatagtgcatagtagcatatagtagtgtactagtatagcatcatatcattatttgggtatcttaaaaataatgtaattaagctgtatgtacgtacgtagcctagcaagctactcgttgaagtcgatgacttggggcttcacagattaggtagggtctgccatcagatcatgacgtccagacttggctgcttcggagcatcacatgatgtattgtgatcaatgatcatggctcatccctctgattgatggctctcaataaattgtattgttgctcgtacatgtgtatatttgttaatgtatttgtacggccgtgatggcctttcatgtggaattccatatcctgatg

SEQ ID NO: 277 - DNA, 1424 bp, Sorghum bicolor
catgaggagagcaggcgggctagcgcgcgccggccatggcgcggcgacggcggcggggcgtgcgacgaaggtgatgcgggcggcggtgtccgcgttcttcgccgggtaccactgcttcacctccgtcgcggcgctcctggcgctgccgttctcggcggcggtgctggcgtcggaggccatggcgccgtcgtcggggatcctgcgcggcgtggcggcgcggctccgcgccgtgttcgccgcggccgggttcccaccttccccgttcttcgcgctgctcgaggccaagctgtcccagaccgtcttcacgttcgccgccacgctgccgttcgcgctcaccttcttgctcctcgccaaggcctgcgtcgccgccatgctccgggacgacgtcgacgacgggcaccggcggcggcggcggctcgccgtcgccgtcgccaagctcccgccgtgcggggccgtggcgcgcgcgtacccggcggtggtggcgacgcacctgctcaacgcgttcctcatgctgtccgccaacgcggccgtgttctcgctgctgctgctggcgttcggcgccgccgacctgctgggcctcacctcccacttctggacgctggcgctgtcggccgccggcgccatcgtctactcgctggcggtcggcgtggccaccgtggtgtgcaacctcgccgtggtcgtggccgccacggagcccgggtgcgcgggccacgccgcggtgctcagggcctgcgtggccatccgggggcgggtgtccacggcgctggcgctcgcgctgcccaccaacctcggcatggcggcggccgaggcgctgttcggactccgcgtcgtcgcgcagcggcggaaggacggcggcaggctcgcgccgggcgtcgctggcgaggccttctcgatcgcttacatccatgcgatctgcgtcgtgctggagatcatcgtcagctgcatgttttacaggagctgcaagaggagtgaagccgacgagctcagagagctcgagccagaggagaagggagatctccaggcttgatcagtgatcacctctcaacttcagcttcagtctggtgcatgaacaaggaaaaaaacatacaaatagtagaatcatagtttgtttgtctttctgatgagaagcaagaggatcagatcatagggtacagagctgatccagagaaatatagtggtaagccaagatagattttctgcaaaaatgtttcttttttatgaaaagaaaatggtaaaaaattgagttcaaataaatggttatcttgtacataaggagatactctcttcaactgaaataagaaagcagggaattggagattgtttggagttgttactttaggaaaaataggacagttgtagacttcgcaaatttcatacattctgttctttgggtcattgggtgtatctgtagtttcaaaaacttg

SEQ ID NO: 278 - DNA, 1564 bp, Sorghum bicolor
atggctgcgggctcgtccgtggtctgggccgcgcaccacccgtcgccgtcccactcccaccaccaccgcccgcgccgcgtcgtcctcttacccccgccgccgccgctaccggcgaggcggggcggcgcgtccctcgcgcgttcgccgcgcgccagcctcgccgccgccgcacccgcggtggcggtgaggacggcgtcggaggaggccgtgtacgaggtcgtgctgcggcaggcggcgctcgtgaagaccgcggcgccgcagcggacgacgcggtgggcggaggaggagaagaaggaagaggaggaaggggtcgtcggctggggcctcctcggcgacgcctacgaccgctgcggcgaggtctgcgccgagtacgccaagaccttctacctcggcacacagctcatgactcctgagaggcgcaaagctgtctgggcaatctacgtgtggtgcagaagaactgatgagctagtggacggtcctaacgcatcttacatcacgccaactgctcttgatcgctgggagaagcgattggaggatctcttcgaaggccgcccgtatgatatgtacgatgccgccctctcagacacggtctcaaagttcccggttgatatccagccgttcaaagacatgattgaaggaatgaggctggacttgtggaagtcgaggtacatgacctttgatgagctctacctctactgctactacgtcgctggcacggttggcctcatgacagttcctgtcatgggcattgcccctgactcaaaggcctcaacagagagcgtgtacaatgctgcactggctcttggcattgctaaccagctgacgaatattctcagagatgtaggcgaagatgcgaggagggggagaatataccttcccttggacgagcttgcacaggcaggtcttacagaagaagacatattcagagggaaagtgacagataagtggaggaggttcatgaagggccagattcagcgtgccagattgttctttgatgaggctgagaagggcgtcgcccatctagactctgctagcagatggccggttcttgcgtctctttggctgtacaggcagatccttgatgccattgaggcaaacgactacaacaacttcaccaagcgtgcgtacgtcggcaaggccaagaagctgctgtcattaccggttgcatatgcaagggctgctgttgcatcatgaaccatctgtagatcagatgttttttttcttttccaaacccagtttgttaccccctcacctcccatttttttgcttggtttctttgctcttgtatataatcagcttcagctgcctgcatggcataatccttgcctgtcacatacagttcttagttcagaggggactgattccatgtccctcaatactcggctcttgttaccagaaggaatgaagaattagaattcgagaagcatacttgccaattgtcttggatgatctctgtgcatttatcttcagaattcagactcaccagattgattactgtgtgagaggctgttcaggtgttctgctttgggtaaaaaatcacaatgaccttaatcttacatttctc

SEQ ID NO: 279 - DNA, 5543 bp, Sorghum bicolor
ccaaaccctaaacctcgccgagccgccgccccagccatgccgaaggtctttggcaccggcgtcttcgagttccggcacccccgggcggccgagtacccgctccccgcggacgccgcccccgccacggccgcggcgcccgacaaggtccccgcatcaaccggcggcggctccatcacgctcctcgacatccagcgggaccgcctcacccgcgtcgccaccgagcattggggcacgcccgccgccgcgtcggccttcgacgcggaccttgtcaggaagatctatgccaccgagctccgcgtcgaggggcggggccggaagaccgtgccgctgcagcgcgtcatgatcctcgaggtcagccagtacctcgagaactacctgtggccgcacttcgacccggcgcacgcttccttcgagcacgtgatgtccatcatcctcatggtcaacgagaagtttcgggagaatgtggcggcttggacatgtttccatgaccggaaggatgcattcaaggggttcctgtggcgggttctcaagctcaaggaagagagcatggataaatctgggtgttggcaattatatgtatttcactttggacaagatgaaagggctcttaatatggcggagaaaacaaattacctcctgttcatgataaattcatttcagagtttggaggacgagcttgtccgggaaacgatacttcagttagtaagcctaaagctgtggaatactctatcttttggacgacttcagatggaactctgccttaaccctgaattgattaagaagtggaccaaaatcaaaagaagagaggcaaaggaagcaaaaaaggctgaccaacctattgacccttctgaaatgctcgagaataaattccttaggaatctaattgaagagttcttggagattctcgattcaaaggtcatactatccaatcaagatgctggtgaagaatctgtattgaacgagtcgctcagtgggcagatcgatgattcttgtgtcctatattgtgagagatttatggaatttttgattgacatgttaagccagcttcctactagacgatttttgaggcccctagttgctgatgttgctgttgttgccaagtgccacttaagtgcactctatactcatgagaagggacgcctttttgcacagttggttgacttgctgcagttttatgaaggttttgagattaatgatcactctgggacacagctcggtgatgatgatgtcctgcaggcgcattattcccgtttccaagcttttcagctactagcatttaaacaagtgcctaagttgcgagattttgccttgtctagtattggttcactccataagcgagctgacttagcaaaaaagctacttgtcttgtcagatgtggaactgcaagatctggtttgtaacaagcttaagttaatctcagcgaaagatccatgcagtggaaggcgtgattttcttattgaagtcctagttgctttttttgagaagcggcaatcccaaaaagatgcagtaaacgcacttcctctgtatccaaatgagcagatcatgtgggatgaaagccttgttcctagcattaattactccggagaaggctgccttgccctcccaaaactcaatctccaattcctgacgcttcatgattatttgttaaggaatttcaatctgtttcgtcttgaatcaacctatgaaattcgtgaagacattcaggaagctgttcctcatctacatgcttatatcaacaatgaaggagagactgccttccgtggatggtccagaatggctgttccgattaaggaatttaagattacagaagtgaagcagccaaacattggagaagttaagccttctgctgtaactgctgatgttactttcagcatatcaagctacaggcatcagataaaatctgaatgggatgctctgaaggagcatgatgttctatttttgctgtcaatccgcccctcttttgaacctcttagccctgaagaggctgcaaaatcaactgtgccagaaaggttaggattgcaatatgtacgtggatgtgaggttattgaaattcgtgatgaggaaggaacactcatgaatgacttcacaggaaggataaagcgagaagagtggaaaccacccaaaggtgagattcgtactgtccgagttgccttagatacagcacagtaccacattgatgttactgagacagcagagaagggcgcagaaaatgtgtatggaacatttaatattctaatgagaaggaaacccaaggagaataatttcaaagcaatcttggaatctatacgtgatctaatgaacgaaacatgtgtagttccagaatggttgcataacatattcttgggctatggaaatccttcagctgcacagtggatgaatatgcctgatcttctggaagttatagatttcaaggacacttttcttgatgccagccatgttcagcaaagttttccagattaccaggttacatttatcaattctgatggtacagaaaacctgcatccaagtcccccttttaagattaggctatccaagaaaatgagggaaagcagtcatgctctacctggcaacgtgaactccaatttgactgttaagagtaataatatcgctgatggggagcctcagaaagagaaactgattgttgaaagttacattccagctgatcctgggccatatcctcaagataaacctaaacagaactcagtgaggttcacacccactcagattggtgctataatatcaggtattcaacctgggttgacaatggttgttggtcctcctggtacgggaaaaacagatacagctgtgcagatattaaatgttctatatcacaactgtccttcacaaagaacactgattataacccattccaatcaggctttgaatgacttatttgagaagataatgcagagggatgtgcctgctaggtaccttctccgccttggtcagggtgagcaagaactggccactgatcttgattttagtcgtcaaggtcgtgtcaatgctatgctggtccgacggctagagctgctcggtgaagtttctaaattggcgagatctcttcgtcttccagaagatgtgggctacacatgtgaaactgctgcatatttttggttattacatgtttatgcccgttgggaacaattcttagctgcctgtgctcaaaatcaagacaaaccctctttcgtcaaagatcgcttcccattttcagagttcttttcagatactccgcagcctatttttactggcgagtcatttgagatggatatgcatgcagcgaaaggttgtttcaaacatctttctataatattccaagagctggaagagtgtagggcttttgagctactcaagtcaacagtggagcgagcaaactatctaatgactaaacaggccaagatagttgctatgacttgtactcatgcagcattgaagaggagagactttcttcaattaggtttcaaatttgacaatttgctgatggaagaaagtgcacagatattggagatagaaacttttataccgatgctgctgcagcggcaggaagatggccatgctcgccttaaacgttgcattttaattggtgatcaccatcagttaccccctgttgtgaagaacatggcttttcagaagtacagccacatggaccagagtctctttacaaggtttgttcgacttggtgtcccttatattgagctcaatgctcaaggtcgtgcaagacctagtattgctgaactttataactggagatacagagaactgggagatctgccttatgtccgtgagcaagcaatcttccataaagctaacgctgggttctcttttgagtatcagttagttgatgttcctgattataagggaaaaggcgagtcagcaccttctccttggttctaccagaatgaaggcgaggctgagtatattgttagtgtgtatatctatatgcgcctgattggctaccctgccactaagatttcaatattaaccacctacaatggtcagaagcttcttattcgtgatgttatcaacaaaagatgcaagccatggaatattgagccccctaacaaggttaccactgtggacaagttccagggccagcaaaatgatttcattttactctctcttgtccgtacccgttttgtgggtcatcttcgtgatgtcagaagacttattgtagctatgtcccgtgctcgtctgggcctgtatgtgttctgccgtcgttcactgtttgaacaatgttatgaattgcaaccgacattccagctgctcctccaaagacctgataagctcgccctgaaccttgaggagtgcactccttttaccgagcgacctttggaggaaactggaaacattcattacattactggtactgaagacattgatcatctagtgaagttcaggctggaacatcttcgtcagatgcaatacatgcagtattatgctcctccagcaaatgaactgcctcaagcagtgccagaaaatattgctgatgcaatcccttctgaaaatgggaatgctggtagtgctctgaatgatgcaaatgagcacatggcagtggaagaaaatggtggtgcgactgacacagtgatcgataataggatggaggaagatggtgttgaggcaaaggatgacatgacacaggaagggaacaagggtgaagggagtggcgagggtcacatggctacagaggatacacaaggggaagtacaagctagcacaaatgacaagatggaggatgcagatgccacgtcgacagacaaaatggaagaagcaaatgccatgccgactgacaagatggaggaagcaaatgccacgtcgacggataagacggaggaagcaaatgccacgtcgacggacaagacggaggaagcaaatgccacgctgacagacaagatggaggaggaaaattctgatctgaaggacaagatggatgaagagtgaggtggtggggtagccagttttgaaatagaggtagacctgtgctgtctagccacagatttcgatttggaacatcatatattcaactctgttaccacagatgaaggctgataacatgcccccccaagaggtgtagccgtgggcagaaccaaggttgacgtatgatggcctatgttcctgcggttaatgatggtgaaagtttgttcgctaccatcttggccatgctttgctgataaatgtgccttttcttccaaccaacggcgtctccatgtatcccacatgtgtgtaaaagtgtaaactgtagagattttttggcagtttgtctgaatcactcagatatcagaggccctgtgcagcttctcaacagcttacggtgaaaaaaaaatcagttcagttaatttagcgtgcacaagttccaactatagttgtctccgtagcataacacagctggaacgttgcttttgtatacttgattgactatattgtaattttggcacaagcgttagatttttgcagatttgatagaccttattggtctgctgatataaatctatcaggcaaaatgtgactaagagaaatgttatcatatgtttgagctaactgcatctttt

SEQ ID NO: 280 - DNA, 1753 bp, Hordeum vulgare
ggcggcacgaggcactgagctcccttgctctctcgcaagaaccagacgcgcacctagccgccgctcatcttagctctccctcctctctcgcaagaacaagacgcgcgacgatgtgtgtctcacaaccaaatctctgcccaagtaagtaagatattgaagagatcctaactgccatgtgcgtggtcttccaagttcgaagacatggttcatgcatggcgttgtggttcctcgcaactggtaactcggttagtgccacaaatattcggaggttggattcttctcgtgtgtagacctgggattttctgagattctgcgtgatgtgaatatgtgatcagtggagggatggttcgagtcccacacgaggcaaccagtgtctgttggattttcagtcggccagtaaggacaatgttttgagtcggctagaaatttaaccggctataaacgcaattttgtattggtgatggaagcagttcatcatctcttatgggaccattttcttcctcttcttaatattcttccaataatgttagacctagaaaggtttacttaaccttccaaactaattctctctcccccactgattttccgtcctcatccctctattatcaatcacattcttccacctcagtttgtttgtatgtaaaatctgtttgtagatgtagcattactcagattcttctaatcacgtcgaaactagtctagaaatgagttgttacctttgatttaatgcactggactgaactatctttgagcaatttagagatttgttcatcaggcctagctagctaatggaattatgtacccactggctagctgtggctgtgagggagttaatctgggattttaaaaaaggtagcaactaattaaaatttatgcaaggttaccacacagtcgaaaaaggaagtaagaataaagaagagcacatgtgcattgtggaggacacaaaaatactgctgtttgtttctgataagcgagagcaaaggtgaaccttatataggctctaacattcagttagaaacatgtcacgttctgcaatcgtacgttgcaaggggatgtaatttcctcccttctctacctgagattctataaatagtgtacccggtgccacacaacaacacacggcgcacaaactcaaaccaagacacacacatcacacaagctcgctgtaagatggctgctcgtaaggcgatggggctgctctttctgctgcttctttcgagcagccagctgatgatgctggcccaggccagcgatgatgacatcttgccatccgatgagctgagcctggaggttctagctcttctggaggacatcatgaagtccaagctgtgcccggctgcctgcgtctcctgcttagtgcaggtcgggaagacctgcccgctgacgatgacgctgtttgctccctgcgtcctcgggaaggtgatgtcccagggttgcttcggcaagcagtgaagccatgagtggcttgctagcactgtgtgcgggtgcttcaggaagcagtgaagccatgagtggcttgctagcactgtgtgcgggtgtgcatgttgttgtggtgccttcttttcgtttccttgtgtgtggtcggtccaggcttgtgtcgtgtgtgtgactagtttcttattcttccctcaatctcactctcttgtgtgtgcctgtgtggtttcgaggacccgatcctctcctgttgtgtgtttcagttgtctccacttaataaataccatcgatgattgtggtttctaaaaaaaaataaacc

SEQ ID NO: 281 - DNA, 625 bp, Hordeum vulgare
cagctctccctggcgccgtcaggaggcggccccgagctcctcctccgccatgactggcccctggtgaggtcgtcgccatcaaactcgtcgccttccttcctacccgacagcaccaggagaacgcagtgaaccaggaggatccattcccgctgcaaatagccgtcgatcgcctctgcatccacgacgtccacgacggccttcttcctcctctgctccgacgagatcttccgcagagcctattcttcctcgtcgtcacctgcctcctccacgtcgatcctgctacctctcctcgacgcgtaggcaccgggatcggagagagagtacgtggattctggagagtacgtgcaggacgatcaagagcaggtccaagctgaagacatcacaggtacatgaacgcctgatgcaggagatcgagacggcacgcagctggcgtgatagtaaaatgaggagaacgaccgtctggacatgaactacccagaggactgaggccgtggtcgtgatcgtgggccagcatgcgggaaatcacagtattttccttgtttatgtagcccgtagcgggactatcttgtccgaataaatggggggaaggaaccctgatattatgcctttgtgagatggaaaatgt

SEQ ID NO: 282 - DNA, 2241 bp, Sorghum bicolor
cctcgcgctctggttttcttcctctcttcgcgtcggtgttgaaagcgcctcgcctatcccgtctcgcccttcgtcgcctcggcgcgtttgcgttttccatttcttcactctcttcctctcctcgtttcttctccggtttgatttgttccgctgctgttgcgcttccgtgctctcgcagattcccttgggggcgtttcgctttcgtgcggcgcgaggagagcgagagcctgagtttggttggcggggttgttcgggtttgcagcttattgttccttgcgtattgcgattcgtctagcttttgtgtcgatcctgtttcgtcttcgccttctcagcgtgtgggttgcaggattggatccgattgggtgttgggagttgcgtcctatggcgtcgtgtggcgaggagatggaggcaggtcagtcttctgtcagatccggcggttcattggttttgtcacttggacatggattcggtggtttcaggctcaactgtctctcggtgtgatacagtcagttgccatcctagcctacacacaaggtggatttggcatcagatacagatagtgcgcaaggtggattcgagaccttcggtccattcgagattttaacggctgatctcgcttgtggcctttttgggtgtttgtcctcctcttactttagatgcagatgcagaaggaagggtccctgctggttatggagagattagttgaagggtggaggtttgcttatggttccttcctcgttttctatttggtatatggctgttttgatgtcatcatggtggtggtgtgaagatcgccaccggactaactagaagcttgattgtccttcattggaaaaatgttgttagctggatctgcagaggcaagagaggtgatgttttgggcgttgactggactggagttggtagcatcgggagaagatcgtttggatatatctaactatcactcttctattgattcatcatcatactcttaaatttctgtccgctgctattcttatttttttatattggggctggtggttttctccagcaactggaactgtccagggttccctgtgtttgttcactaaccatcctctctccccagtcattgttcttctaaaattgacttccttcataggctccctttgatacttcgttagtaaatctgcagttttgggagacatcactatagagtttgtcctcctatatgcaaaaggaatggtccttggtggttatgtgagagcagttgaattcaagggtggaggtttgcttatgttcgttatttttgatttgttatatggctattctgatgtcaaccatggtggtgtgaagattgccaccggactaattagaagcttgattatccttaattcgtaaattgctgttagctggatctgcagaggcaaccgagggtgatgttttggaggtagattggagatttgattgatgattggactcatgagttcatagcatttggagagacggagaacatcgtttggatatatctacctttcgctctttcattggcgcgtttaaatttcttgtttcttatatttgtgctggtgcttttcttcagcaactggattatatggatggattggagcctgagtttgatttcgctcctgcatgagcaataagaagttctgaactgttcagggttccgttcaataacaatcctctcttgtcaatgttctttgaaaattgaattttcccgtaggctaccattaatgcttctatagtaaatctgacagttccgggagacatcgctacagagataggacttacagctgacattattggcgattgaccaggctttatcctaaacccacatttaatgaagtgttcttgctttttaagtgttctcatctcacaatcaaatagatagttacagaggatggtctcgctgattgcagatctctaggtgataacttgcacgggcacaaaaggaaccagtctctgcgtctattcaaacatacaaccttcaactctcattgtgtttgttcagtttcttcacctcaaagtagataatgatcggggtcattattgcagtggtagaaggtactgagcatgtttgggacttgggagattcaagcagagatgggatgagtttggcaattggaaatccctgttgcaggatgagtctagatcattccggttattttagtttcgtcacttgttttcagtgatttcagatctgaatggtggctaacattctggctctccaaggatattttgctggtagtaatagtaaaagcaagg

SEQ ID NO: 283 - DNA, 874 bp, Sorghum bicolor
aaaaaaaaagagagagcttctctcctctcggcctcgctcccgaccccgacctcgacgcccctcccgcaccgacgcgcctccgcccccgccttcccctcctcttcctccctctcccaccctcttcctctccctctccccgccgtcgcgacgtgctggctgggttccaccgcatccgcgtgagacacccccggcctgcggcgcggtgacgcgcctagccccataggtggtcctctccgggcagggcgcggcgcgcgcggcccccataggccgccgccgccgtgcctgcccctcagagttatctcctcccgaagatctccatgtcccacgctccaagaaaccctagcttcatctgctcgacggccgactgcgtcgtgaccttcccccggctatgtcgcgagcttccgccggcggcgcgtggactctttgtcggttgcagcggcggcacctcagctcggcgtccggatctgcttgttatggaattgggtcacttctagatcggaatctaatttttctggaggcctcaactacatgctcggcctgcggctatctcaccagggtgcagtactaagatggcaggcaaagcaacttccccaattctccaggatatgcacaaaaggtagcctcccaaagtcccagttaggtagttaggcacaacacaatacataccgcgcatttggtttatagattttatcggacatgctttgttggtagttacatcagagttttcactttataagacatgtccaaatattaactgaaatttataaggtcgagttgtccacaaaatggtcaaaccatgtggatttgtaatttccgctatatgaatatcacattcaattgaatcttgttattccatatatgcacaaactgcaaa

SEQ ID NO: 284 - DNA, 370 bp, Sorghum bicolor
atcagtagagaagatggtgcttgatgtttgaagctctaataccaagggtagaggggacctactaactggtgcatcttgagtcattggccatcaagaaaaagcaccagctaattgaagctctaaaggcaccttctgaagacagtggagtttgaagacatgaagccatcttgctgcctagtcatgtgctcctgtgcctaggcatgtgctcctgcaggagatgtatttctctatgtattgtcccaagacttgcaatatcttattggggctttctgtttataactatcaatactgtaggattgtagagctagcatgtgtgactaggtgatgtttgttatttgaaattgtttaaactgctttttgtatgaattat

SEQ ID NO: 285 - DNA, 870 bp, Sorghum bicolor
atctttctaccgcgccggcatgtggggcctacgtgcgagcagctcctgtcccccatcctcgccctcgtagatttctgggatccacgccaccatcaccttgcgaacttcctcgaatcgatgctgctcggagcagctcctgtccccaatcctcgccctcgcggatttctcgaatccacaccgccatcacctcacggcgccatcaacttcctcggatcgatgtcgtagctcctgtccccaatcctcgccctcgcggatttctcgcatccacgccgccatcacctcacgacgccatccacttcctcagatcgatgccgctcggaagacgacgcataagaatatgtgctattgggaaagagttatttggagtttatgatatttttcacagcacaagtgaccatactttctgtgaaagaggctcaatagcaaagatcactcgtcgcttacgacttttgtgcctcttgtgctgatacaagagattgcaacaataatgaaagttactgagcaaggggcgggggtgcattttcttgatcatgaggataatagcagtagtgatggtggcaatggattaaaggggatagggactctagatgaaataactcagtgcaggggctttcatttttgtcttctatatggtgcatcagttgtaggctcaagaaggtgaacaacagtttgcaaaatccaatcataaactgaattagcaacgtgtcatcttcagcgtaactattttaatgctcatgtagttgctcgatttccagtcatttgtgttaattttgtaagcttgtgacgctgcgctctttgtgactatgttaatttcacaaactttgctttttaaattaaacgtcactttaacatcggtatttaatttcacgg

SEQ ID NO: 286 - DNA, 722 bp, Sorghum bicolor
actcttctcgtggtttccgtcctcgtccaatcgtcctccgccgctgtcgcgagccctccgtctctcccctacaccgctcctccctctcgtctctctccttccctctcccactcggatctccctcagcactcgcagaggctcgctgcgatggggcccatggcggggctccatgccctcgcccacctttccctacgcatggcggcggcgctgtcgccgctcgcagtgactgggctttcaccgtcgtctttgccgtactcgctgtactcctctccactggcgacctacctctgcatagcttcagccactacctcactaatgactggatccgcggcgtcttcgcggggcgtccataggttaaagctccaaggtagcgacacacagggtcttcactttcctgtccactcgaaggcgaagctgacccagtctgctggtgtatggcctgagggccttccttcaaatctaaatggtgggaaatccgattgttgatttgaggtctgtcgagtgggacaacgagctgggagttgtgaatttgtgccttaaccaagttccgtattcaggattgttggtagcagctggtagcctggcaacttctgctaatcttgaacatgaagtgacaagtcgcaaaaaacgagcccaaggacggaggcctgaagccatttccaacaggtcgagcagctaagtgaagatacattctgcttaagtcttttctatgttttgatagc

SEQ ID NO: 287 - DNA, 650 bp, Sorghum bicolor
acccaagcgctgccgccggccggggcatactccgacgacgcaggccacatcgaccttcgcccacaccgctagctccttcgcgttggagcctccaagccggcgtcgctgccacctcgcaccaaggcctcccatctctgatggctcccacacttcaggtccatagggacccgggacatgacgatggagcatgcatggcaatggccacagcaaggcacagcatatctatggtacccatgcaacgaagtgcccttcagcattgtataggacatgtgaatctaagtttggacccgagaaggctagcactttgaacatgtatgctataatgaagtctggattcaaagaagtggacaattctcagccgtagaccacaaaaccatcttgtagtggacaatttagatctatataggtgctaggacttatgtacgttagctatgactgagatattctttccttttagcgtaatggttgaacattttttaatctgattggagtgtagttgttggacactttaatttgtaatatgtttcaactaaattagttgaatatatttatgtattggattttgattgtatttatgctggattgacatgtcatcattgtgtcaattgagtttagttaccagaatcttaaaatttgttgattattgtgag

SEQ ID NO: 288 - DNA, 1165 bp, Sorghum bicolor
atcctcgcatgaggcaaaggcatagagcttggggatctcgtgctacctcaagccagaagccaaaccccacatctgctcactcttctaggcaatagtcgcaagctcgacgccctctcgattccgccggtctgccctgcgaccgcagaagagtccagggactcctcgtcggcgaacacgattctggttcccgctgctgtggaagactacaacaaacgtcctcagccttggcatctacggactcctgccctctctcctcatcctatactgccacagttcttggcacggaggcggtggtcgcggcgccacgcgcgctggtgacagtagctgcgtcgacagctaatgcgctggatactgtgcgtcaatttatgaggtggtggccattgtgacgatgggctcatcgcggtcggtaggtagaagaaggcgaagaggacgtccctgaggtacccgagctcccgcgccggtggcaggaacagcgcgcgcaggaggactgtttgcgcggcagcggcgcggcgtgggtagctgtgctggagactagggcggtggaagctagcaggagagctagctctacctcaccgcgattcagccggcagctgacgtccgccagaggggagctcggcgctgaggtggctggcggtccctcgagccactcgggggcgtttgcacgccatctgttcgatgctttgcggctccgcgactgaagtggattacagtttctccgacatggacccagtagaaaaaatggtggtcatactccactaggagatttgacaaacactaccaacggagttgatgacgctaagcaacgaaaaagggaaagggaaagagcacgatatgcaacaaggactgaacaacagaggaatgaatacaacaagaagcatcgtgaacaatatcgaatgaaaaaggcaaaaactacacttgtgcatggggcaataggtgacactgcaaacaaatttaaacgaagcaatgtgccttacccttctgtatattatttatatttattttttataataactatcttgtagctggtggggttgcattagacaaggatggcatgaataatagtgaaaatgacgattggttgcataaaaatgattcataccaacccatgcagatcggtaaagagagtctaggtactatttattttattgttattagtttttttcct

SEQ ID NO: 289 - DNA, 1652 bp, Hordeum vulgare
aagaaatggaggtagctagcccactactcccggtccaatccaagccggataggtcggcaacggcaatggaggtagctaggtcactgcccccgatccaatccaagccggacaggtcgccaccggcaatggaggtagctagctcaccgtcaccgctgccgctccaatccaagccggacaggtcggcaccggcaatgaaggtagctagctcaccgctccgtgtcccgtccaagccgcacaggtcggggccgggaatggaggtcgctagctcaccgtcaccggtcccggtcccatccaaaccggacagaccggcaccggcaattgaggttcaggtcctaagctcgaagctcgtccggccggctgcgtcgaccgatgccgccgtcgacgctggactcgagtatgtccctctctccgtcttcgacagggcgacgtaccagatccaaatggccattatctacgtctttgcgccgccggccccctccacggccgccctcgagaagggcctggccgcggcgctggccaggtaccgcggcttcgcggggcagctaggggaggcgcccggcggaggtccggccgtgctgctcaatgaccacggcgcgcgcgtcgttgaggcgtatgtggacgccgacctcgtcgacgtggcaccgcccatgcccaagccggagccgctgctgctgcacccgaacctggaggaagggatggacgaggtggtggtgctgcagctcacacggttccgctgcggctccctggccatggggttcacgtccagccacgctgtcgccgacggccgtggcaccagcaacttcctcgtcgcttgggggcgtgccaccaggggagttgacatgggcctcccccccgtgtacaaccacgacgagctcttcaagtcacgttccttgccccgcgtcgagttcgaccaccgcaatcgggagtattacatgccagtgccaccgttgcccaccaacgtcgacgtccatgccaagatcaagaagaacatcgtcatccacaaggcgcatttcaccaaggaccggatagcccgtgtccgtgccagcgcttcggaaggccgcggccgccccttcagccggttccagagcatcctcgcccacctgtggcgcgccaccacgcgcgcaaggggacttcgccacaacgagacctccaagatccgtctgtcggtggacggacgagaccgcctcggcgtgccggccgagtacgccggtaacctcgtcctgtgggcgttcccgcaggccacggccggcgacctgctgaaccggccgctgaagtatgccgcgcagaccattcacgacgaggtggccagggtggccgacgccgagtacttccggtcgttcgtcgacttcacgagctccggcgtcatcgaggaggaagggctggcaccaagcgccgcgttgaacctgagggaagtgctgtgcccggacctggaggtgcatagctggctcaccttcccgttctacgacctcgacttcggcacggggacgccatcgtacatcatgccctcttacttcccgttcgaggggctcatcttcctcatgccatcctacatcggagacggtagcgtcgatgccttcgtacccgtctttcagcataacctcgaggctttcaagcaatgcgtctactccatcgatgatctccatgcatgatga

SEQ ID NO: 290 - DNA, 1435 bp, Arabidopsis thaliana
cacactctgcaacacctctcactcaaatttcattcaccatgttctctctcaaatccttaatctcctcacctttcacacaatccaccactcatggattattcaccaacccgattacccgacccgttaatccattaccacgtaccgtttccttcaccgttaccgcttccatgatacccaaaagatcctcagctaacatgattcccaaaaaccctccggcgaggcaacagctctaccaaccgttccgaccaccgtcatctcccattccaacccaattccgttcactcgactccgccggtaaaatcgaaatcctcgccggtcgaatggctctctggttcgaatacgcacctcttatctcttctctttacaccgatggtttcactcctccaaccatcgaagaactcaccggaatctcaagcatcgaacagaaccgtttaatcgtcggtgcgcaagttcgtgactcaattcttcaatctatccatgaaccggagctcatttctgcgttcgacaccggtggtgcagagcttctatacgaaattcgtctccttagcaccacgcagcgtgttgcagccgccacattcatcattgatcgtaatattgattcgaaaggagcacaggatttggcacgagccatcaaggattatcctaaccgtcgtggagacgttggatggttggattttgattacaacttaccaggagattgtctttcattcttgtattacaggcagagcagagagaataagaatccatcggatcagagaacctcgatgcttctacaagcattgggggttgcagaatcagaaaaggctaagaacaggttgaacacagagctatacggggacaaggaagcagagaaggagaaggagaagaagaagaaggaagaggaagtcaaagctattcggattccagtggtgaggcttaagtttggagaagtagcagaagcgacctcggtggtagttttaccggtttgtaaagcagaggaaggggaaaagaagattcttgaagctccaatggagatcatagccggaggggattttaaggtggttgaggcggagaaaggatggaagagatgggtagtgcttccgtcgtggaacccagtggcagccattgggaaaggcggtgtggcggtttctttcagggatgatagaaaagtgctgccttgggatggaaaggaggagcctttactggtagtggccgatagggtgaggaatgttgtggaggctgatgacgggtattatctcgtggtggctgagaacggacttaagctagagaaaggatcagatttgaaggcgagagaggtgaaggagagtttagggatggttgttttggtggtgaggccgccaagagaagatgatgatgattggcagacaagtcatcagaactgggactgaattaatagaatcaatactcatatgctgtaactgattacggagtcatc

SEQ ID NO: 291 - DNA, 1076 bp, Arabidopsis thaliana
gagctttgatcttcaccgactgaaaagtatgtctgtttccgatgaggaagatgagtgtttcgctcgattcctcgaatcagaagtctcatcggtagaggataaagaagaaacgaaagaacctgaggcaaaacggcaacgtattgagaaaggcgaaacaaaggctctagagaaggatgaagatcaaaaggaaaatggtaacaaagataaaactgatgcaaagagaatagagagtggagttttcaccaatgttcctactgagctgtttcgtcatattctcaagttcttatcttcggaggatcttgtatcatgctccttggtttgtaaatttctcaattttgctgcggctgatgaatccttatggcgtcgcctgtactgtatccggtggggtctaactcttccaagtagaaagttacgtgaatctgcttggaagaagctttatattgatcgtgatgaacaggacatgattgaacttgtcagaacctgtccgtcggatttcaaggagtattacgtacatatgcaagcagcaaagagaagccaagcacctcttccgtcccagatggtggatgaccggataattcttgacaatactgtacttgaacaagtttctctatggaagaaaagcaaaggacttactgataaggctgtcactggccatatttgtttgggaaccaaatgttcataccatcagattgacgacgtgttcatatgcaaagagacgggaaatgttcatgtatgcgatgataactgcaaggaagtaatactgagtccagagggtgacctcatggtgtgtactatctcaggagtttgttctgatactttacttgtacaaactgagccagacgcagatgggtgttatgaggaagaagctgaactagaagctgaagtattcacagataaaagccgattagcccgagcttttgaacttggctacaactgcgatgatgagcaggaactggaacgtaccctgaggttctgctgagcaaaagtctcgaccttttgtccaatttcataaggcctactttctgtaaggtcttctctctctctctctctctgacctgattctgcctgggttctgt

SEQ ID NO: 292 - DNA, 529 bp, Hordeum vulgare
aacacctgccagccactgcgagagcgaggagcctagctagacgacggccatggcgatgaggaaggagccactactccttgtggccatgatgctggcgctggtggtggcggcgcgtgcggcgccgtgcgaggtggggcagctgacggtgtgcatgccggcgatcaccaccggggccaagccgagcggtgcgtgctgcgccaacctgggcgcgcagcaggggtgcttctgccagtacgccaaggaccccgcactgggccgctacatcaccagcccacacgcccgcgacaccctcctctcctgcggcctcgccgtcccacgctgctagctagcctccttccttcccagcatatcatatgtggctcagcctcagctataggtatgtagggtacctccgtccatgacagatgagggactatatctatatgtagcttgagcctagctgagtgcgtgatgcgtcaataaaatgttgggtgatcgatgctgctgcaataaaacaagagatgttgggtgatgatggatgctggaataa

SEQ ID NO: 293 - DNA, 643 bp, Hordeum vulgare
caataatccgtagttccgatccgcaaggcctgcgacgatggcggcttccgtccgcgaggcgtcgatgaggatcctgcgtccggcgggtgaggggcttcgccggctcatccacgccccgcagcattccggatccatcagtgtctttggggaaggctaccgcgcaacgcaaatccagcagtcaaaagaggacctgtataatctcatcgctgacgcccaggccaattctgcggcttctcaggaagacaaaatggtgctcaagactctctgcacacatgtcaagcccagaccacatgaccctcaatggcgccggataactactgccaagaaggtgaccaagtggactgcaacatcaattgtgcttgctacttgtgcgatcgctttccctgccttagccaaccgccctgactatcgtgttactactgcatgtgagcagaagacagtggagcaatgcaggctgcctgagagtgtggcccagcaaggggcgcagaagctttagaagcaagtgaagggaagacaaaatacatcttgtttgatggagaagcaagacggatatcagttctattcctgcactatgttagttaggtctcttgaaatatgtctggtcgcattgtaagataatttgtgatgttgctgacatggtatg

SEQ ID NO: 294 - DNA, 562 bp, Hordeum vulgare
aaaggatcctccatttcttgtctgttccaggaattttgggaaattttgtgtctttaaaggcaatccagggtctggtcctgagctgtcggggctccatgtctaagtgggaacctgtcacatttgaggaatctcttagctttgttaagcgagtaaaggctcgtgactacttgttatacctgtcactgctcaatgtgctcacccggagtgaccagatccctttggaagcttacaacgagcttttgcttcttttccgggaccacggcgacctgctagaggagctagggaagttcaggcccctcccaaatttcccaagcactgtgtacagacacagctcaatttggatgttcatattcctgatgccctttctgctcctgagccttctcctcgcgtttgagaagcctttggatagattccttctccgacaacccgtcgcgagctgaagatgtgcattacgatgaaatgaccaaacacggaatgcatgattggactgatggtgtctcgtgatatccccgttgaagccgttgccttgttggtggcggatagtatctctgaactcgagttt

SEQ ID NO: 295 - DNA, 663 bp, Hordeum vulgare
aatccaatccaagcacatctcccggagccggcgtctttgggtgctcggttccaatggcgagctcgacttgttccgatgacaaggttgctcccctggttcagaaacacgcacccgccggaaacccggaggcgcttacgacgacgaagaagaagaagaagaaggtgttgattgcggtgccagaatatgatgtgagaagtgtcctcgcttacaaggatgaacccgtggatttggaggtgcccgactacttgatcagggaaaacccgaaacaggctgcggtcatgttcatgataaaggccaacttggccatgtacaacgagcacaccaaggcacggatgctcgaggagcagagagactttaagcaccaactaaaaaccaagggcagagtcacctacgagctcgaggttgatgaggacgatccgagatttaaagatgaatgcaccaccagctctgctggagcaggacggaggaggcaccgcccgggcgtcatgaaaaagcaagacggacagatcaagaggctaaattaaattattattttatttgatgcaagtcgtatcttcttgggttgtcaagacaagtctttatcaataattactctattagtatgtgatgtgtttggaccaaagcactgctttgagtattttctttaggcgtttgagttgtcaa

SEQ ID NO: 296 - DNA, 1138 bp, Hordeum vulgare
aggccagaccagaccagaccggaccatggtttacggcggagaggaggcgctgatgcggcagtactccatcggcgacgagatcgggcgcggccgcttcgggacggtccgccgctgccactccaacgccacgggggaggcgctggccctgaagaccacgcccaaggcgccgctgcgtgacccgctcgacctggcgctcgcggagcaggagcccaagctgcacctcctcgcctcctccccgccctgcagcccgcacctggtcgctctccacgccgccttcgacgacgcgaacgccgtccacctcgtcgtcgacctctgcgccggcggggacctgctctccctcctctcctcccgcggcggccgcctcccagagcgcgaggcggcggggctggcagcgcagctggcgtccgcgctcgcggcctgccaccgccgcggggtcgcgcaccgcgacgtcaagcccgacaacctgctcttcgacgccgccacgggcgcgctcaagctcgccgacttcggctccgcggagtggttcggggacgggcggcccatgtcgggcctcgtcggcacgccatactacgtggcgcccgaggtggtcgccggcagggagtacggggagaaggtggacgtgtggagcgccggggtggtagtctacatgatgctctcgggggccgtgcccttctacggcgccaccgcgcccgagatcttcgaggccgtgctccgcggcaacctgcgcttcccgccgcgcgccttcgccggcgtctcgcccgaggccaaggacctgatgcgccgcatgctctgcaaggacgtctcccgcaggctctccgccgaacaagtcctcaggcatccgtggatcgcgagctgcggtggggacgcggtcgcgggctgaagagatcgatggaccaacataatcttcacgcgctccatcctcctgtagatagaagatcttctccgcaggcagtcgacgacggctcggtctctgcggctctgctctgtttctccggcaaatcggcgatggacagaagcagcggtggcgccggagttgagttcagtaagtagatcctttactttaggtctaggggtctctggtgaagctggaattgcagaagctttcgcctgaattagcctgaatgtgtgtttgttcgtt

SEQ ID NO: 297 - DNA, 1399 bp, Hordeum vulgare
aagaggaggacgagcatggccgacgggagggatctgggcgacgtggcggccgcggaacccgatcctgatgaagggcagcctgatctggaagaggaaggtgagcttgaagccgccggcggcggcggcggcggcgaggaagaagaggacgtagacgtcgacggcctcgccagcttcctcgaattcgagatcctctccggatccagcgaggaagatcctctcgacctggaggagggcgaggaggagaaggagacgggagtgaacgatgaagcgaagaacggtaagaggaagcaagattcgctgtcggagggagatggcagcggcagcggcagcggcagcgaggacgagcatcagaagagggcgaggaaggagaagggaaaaggaaaggttttgacggaggggccgcctcagattgacacgggcatgttcaccaacgtccccccggagctgttcctgcagatcttcaagttcctctcctcggaggacctcatctcgtgtgcccttgtctgccgcttcatgaacgccgccgcatctgacgagaccctttggcgccgcttgtattgtatgaggtggggcctgtcctctaatgccacctctaacgcgaaactcagggagtgcgcttggaagagcctctatattcagcaagacagagaagatatggttgaattcgtgagatatacccctacagaattcaaagagtactatatccagatgcaggctgcaaaaaggagtcaagcaccccttccctcagaagtgaatgacgacaagattgttcttgataagacagtagctgatcaggtgtctagttggaaaagccgcagaggccttactgatgatgcagtcaaggggcattcttgctccggaagtacttgcttctataagcagattggtgatgcttatatttgtgagaagactggtcgtgtacatgtttgcgatgatgcctgtcgtgaatttgtcttggaccaaactagtgggttacttgtctgtacgatatctgggcactgttttgagaggtttttatgtcctgatgacgagtgggacacttgtgatactgatcagcagcaaggcggtgtgactgatgaagcagagccattcatgggatctggacgatttgcacgtgcttatcagttgggttacagctgtgccgacgagaaggaacttgagtacgctttgcggttctgctgatattctcccggtcatttgatccttcagacctccttcagaccttcactccgtgtgctcgctacacgagagcaagtttttggttggcaagggaaataagatgcaggaagctctatactacactttacttgatctcgacctctggggatgtgcctatgaatgcaaaatcagcagaaatgctggtatgcttttcaatcagtcgagggagctgatatgttgt

SEQ ID NO: 298 - DNA, 834 bp, Hordeum vulgare
tgatgtagtagttccagacttccagtacatcttgccattttgcttttaaaagtataatagattaattgtattctacttcagagttaatttcagttatttgttgttctgcgacatgcaggattgctacctagcactgacaggtcctacccgtgctattgccgtgtcggtggatccttcgtacattgaggtttcactgaaagtgaagggcacaactgaagctgaggatacagatttaagcgatcttgttctgatgtacagaactggatgctgtcctggaagtgttttccctagcaggcttagcacgctggaaattgaatttcgccacattaatcgctcggtggaggccactgtccatataaaagtcattggcgggtcgtggccagatggttttcatggtgaatttagtgctggcatcagtagtagtgacgacctgcaagtcaagttacttgactttgaagatggtggattgcctgtgaatgctgatggcgagatcaaactctcacgccgagtggtctctgttggagttgagagtaacctgaaggtttctgtaagggcacgcccaattaacaaggaccatgctgctgagagcagcgaagcagttttgaaatgtcagagagccggtacaagcccctcgggcatcaagctcagtgttggttcctgtaatatggaagttagtgttgcttggtcctgtttccgtcgagcgtggtgacacgaaactattttaactcgattaatttaatccatgagttatatagtggtgtagcgtagtgcatgccagaaacctgttccaagttatgtagtagtgttgtagtggtattgtggcatttggtctag

SEQ ID NO: 299 - DNA, 1075 bp, Hordeum vulgare
cgatctggatccacaagaaatcagccctgcgatgaccggcgttggcggcgatgccaagaagagcctgacgcagtggctcggggacaaagggttcgacgaggaggccatcgggcgcatgtccaagcggtgcaggaacctgcccaacctcgacgccggcgaggcctccggcgtctgggactacctcctcaacgacgtcaagatcgagcagcgcaagctgcggtacgtggtcaccaagtgccccaaggtgctcaccatgtccgtcaacgagaagctcatccccacggtccagtgcctcaccacgctgcaggccaagcccggggagatcgcccaggccatcatcaagttcccgcccatactgttccacagcgtggaggagaagctctgccctctcctcgccttcttccagacgctatccatctccgagaagcagctcgccaagctgctcatggttaacccgcgcctcatcagctacagcatccaggccaagttctcccagacggttgacttcctcgtcggccttggcatcgacagggagggcatgatcggcaagatcctgaccaaggagccatacatcatgggatacagcatcgacaaacggctgcgtcctactgccgagttcctcaagtccgcggtcgggttgcagggttcgtatctccagagggtcatcatgaatttccctagtatactgtcgcgagatgtcgacaagactctgcgccccaatttcgtgttcctgcagagcgctggattcagcaaggatcagatcatgaaattggtggctggataccctcctgttctcatcaagagtatcaagcattgcttggagccaagggtgaagttcctggttgaagaaatggggcgggacaagggcgaggtggtagattacccccaattctttcaccatggtctcaagaggagcctggagtaccgccacaagatactcaagcggatgaactcaacgtgcagtctcagtgagatgctcgactgtaatcagaagaagtttgccatgaaatttggtttgatcccagtagcttagggtctgatcttccgtctcttcagttcccatgtagcatgttag

SEQ ID NO: 300 - DNA, 1801 bp, Hordeum vulgare
gagccggaggttctttctaggttttagcgcgggtgcggcggcgcggtcctgccgttgcgtgttaggtttgccggagcaagcgagcgggatgcccaagggcgacgatgcgctggcgcggaagcgcgggaaggtgcgccggaagcggatgcgcagcagcgagaacgccgtctccacgcgcgtcgccgccatcatcgcctccaagcgccgacgcaagaccggcaagcgccgcggctgcgagggcatgtgcttctccctcccttgccccgaggaccccttcaatgagcgccacggcaagaagcgcaggaccgaagacgccgccgacaccaacgacgaccacgagaagaagaagagcaaggattccaagaagcggccgctggagagggccaccggttctaatgccatacccgtgcggaagaaggagacggaggaggaccgggtggagtatgaccggccgtccaagttcctggtggtctgcctcaacgcgatccgggacggggcggtggcatccgaggaggacggcggcggcatccacgactctgcctcctggggcatggagctctggaagtcctgcgcggcgtccccgccttcggacgtgctcgacaccagccaccggtacgccacccggcagcagacggcgtggctcgtctccacggcctgcgacatcgtcgctaggaaggagaagctcggagtggtcgtctcatgccccttcctcctctacctcgtcccttcccaggaaaaggcggtgcaagtgcgttcaatgtgtaaaccgctgaagtctcttggaatacattcagtgagcttgcatcccggtgcttccattgaacaccagatttctggactaaagagctgtgagcccgagtttcttatatctaccccggagaggctccttgaactggtttcactaaaggcaatcgatatatcgaatgtatcaatgctggtcattgatggactaaagggattcatggaccttaatatcatcaaagaacttcgttctattcgaggtaccatatcaggtgatgcacaggtaactatatttagtggtcaatgtgaccagagtgcggcaacagtggcaagaaatctactacatggaagaattacaaagcttaccacaaatgattctgttgcttctcgaagtgcatttgtaacacagcacgtacacttctgtactaaagaggagaagacatcaaaggttaaggaaattcttgagcatgttttagaaaaccatgctagtaagacagcaaaggttttgctagtagccgcgaatgataatgtagcgcagaaactctcttcatccctcaaactggaaattctcacagtgaatgatggctcgcaaggcagcacctttaccgtatgcagcagcatggggcttatcaatgtacttgtgaaaggctgtgagagcttggcaacatcaggtgtcgaggaatttgagattgtgttggtcgcggacttgcctccatcgtttgacgattatgtcgagatcctcaccaggacagctcgtcacacggttgcaggggaggtgcatgtcatcttctctaagactgatgctactcatgcaaagcccttggctgatgttcttgcaaacagtggacaggcagtgcctaagttgctaagacaattaatggacaagaatcactcctgatagcaatattcatttctacttatgcggttaatcatgatggacgggcagccaaattagcggtccgcaactcttcctgtcaccaagcaattttgtcagcgtccaagtgttttgcctttttcttttccatgcaattcttgtgtgtcgattatctgtcgccttgat

SEQ ID NO: 301 - DNA, 2772 bp, Hordeum vulgare
tgacgcagcggagtcaaggatcctgacgcagcggagtcaaggatcctgacgcagcggagtcaaaggatcctctggtatacaccaaccaccgcaaaatccaaaatggcgtccccaaccctaccagttaccctcacatgcctaacactcttagctctcttgtctcttgccatggcggccgataacaacaactccactggcctcatcctcgtaaattgcggagcatcaggccaagaagacgatgatagtggccggacttggggcgaagacactggctccaagttcgcgccgtcattgaaaggagttgcagccaatgctcaacgccaagactcttcgctcccctccacggtcccttttatgactgcacgcatcttcacttcaaactacacatattccttccctgtcaccccaggccgcatgttcctacgcctctacttctatccgactgattatccaaactttgccgcctcagattcctccttcagtgtcagtgtctcgacgccgaatcttgtcctcttggacggcttcaatgcttcgcagacagttcaggcgatcagttctgcctttctggtgcgtgagttctcggtgaatgtttcttcaggcagcaccttggacctcaccttcgccccatcagcacatcagaatggttcctatgcatttgtgaatggcattgagattgttcccacgcctgacatcttcacagcacctgacaccagaactgtcggtgatgacacatctccatacacattcgacaccgccatggccgtccagactatgtaccggctcaatgtcgggggccaagccatttccccgaaaggcgactcgggcttttaccgctcatggaccaatgacgccccatacatagctggtggctctggcgtaaccttctccaaagatgataatttgaccatcacttatacatccaaagtgcccaagtacacagcaccggctgatgtctatggctcagctcggtcgatggggacaactgcacaggtcaacctgaactacaaccttacatggattttaccggttgatgcggggttcagctacctcctaaggttccatttctgtgagattcagtatcccatcaccaagatcaatcagaggtccttcttcatctacatcaacaaccagacagcacaggagcaaatggatgtcatcgtctggagcggcgggatcggtagaacgacatacacagactatgttaccatggctgttggtgccggtcaggtggacatgtggattgcacttcaccctgatctttcaagtaaaccagagtattttgatgcaatactgaatggtctcgaggtcttcaagctacagaataacggatcaccgaacaatctttctggactcaatcctccacttccgcaaaggccacctgatgccattcccagcgcgccgtctgccggagggaaatctgtcggggctatcgtaggtgcagctgttggtggtttcgcagtgctactggtagcatgttttggcgtttgcatcatctgcaaacggaagaacaacaagaagaagaagatatccaaggaacctggtggtaaatctgaagatggtcactggactcctctcactgagtacagcggatcacgatctactatgtcgggaaacacggccaccaccgggtcgaccctgccgtccaatctctgccgccacttcaccttcgccgagcttcagaccgccaccaaaaattttgaccaggccttcctgctcggcaaaggcgggttcgggaacgtgtacctcggggaggtcgacagtggcaccaaggtggcgatcaagcgctgcaacccgatgtccgagcagggcgtccacgagttccagacggagatcgagatgctgtccaagctccggcaccgccacctggtgtctctcatcggctactgcgaggacaagagcgagatgatcctggtgtacgactacatggcccatggcaccctccgggagcacctctacagcaccaagaacccgccgctctcgtggaagaagcggctcgagatctgcatcggcgccgcccgggggctctactacctgcacaccggcgtgaagcacaccatcatccaccgcgacgtcaagaccaccaacatcctgctcgacgacaagtgggtcgccaaggtctccgacttcgggctgtccaagacgggccccaacatggacgccacccacgtgagcaccgtcgtcaagggcagcttcgggtacctcgacccggagtacttccgccggcagcagctctcggagaagtccgacgtctactccttcggcgtggtgctgttcgaggtgctctgcgcgcggccggccctgagcccgtcgctgcccaaggagcagatcagcctcgccgactgggcgctgcggtgccagaagcaaggcgtgctcggccagatcatcgacccgatgctccaggggaggatcgctccccagtgcttcgtcaagttcacggagacggcggagaaatgcgtggccgaccgcagcgtcgacagaccgtccatgggcgacgtgctctggaatctcgagtttgcgctccagctgcaggagagcgacgaggacaccagcagcctcacggacgggatgctgtcgtcgtcgggcgcgtcgcctctcgtgatgaccagactgcagtccgacgagccgtcgacggacgcaagcaccaccacaacgtccacgaccacgatgagcatgaccggacggagcatcgcgagcgtggactcggatgggctcacgccgagcaccgttttctcgcagctcatgcgtccgggtggcagatgaagttggacttga

SEQ ID NO: 302 - DNA, 506 bp, Hordeum vulgare
atcacgcagtgacagtatttgccagagcatgaagacgtcctgcttcctggtcgtgcttctgctcgccgtcgccacggggagcaggctctcgctggccgcccgcgaggacggcaccctgggcggcgagctcatcgccaaggccggcaacttcctcacctcggcgggccgcccgggcgcggacggctggcactccgccgcggccgcggaggtggacgcgtcggcgaagaaggcgcacggtcatccggcgggggcgaggaagcggcttaagaaggcgtccgtgagctgcatccccgccgacatgtgccggaggaagaaggtgctgtgcggcaagcggtgctacaagacggcgcacgccgccgccgccgccggcggcctcacccacgtcccctccaaccggtgcgtcgtgaggtgcaagaagtgcgtgcccacctgctagacgcgtgcacgcacgctccttcccttgccgttccgcgttccgtgccgtgccgtgtcgtggtagatccatg

SEQ ID NO: 303 - DNA, 1385 bp, Hordeum vulgare
tcgccatggctcatggcttgggcatcctcctcctcctcctggcctcctcgttcgccggctccgccttcgccgccgatgcgacggtgctcagccggaaggccggtgctggcgccattgccggggaggatcccgagctgaaggcggcgccggggaagtacgcggtgatcttcgacgccggaagcacgggcacgcgcgtgcacgtcttccggttcgacaagaagatggagctcgtcgacgtcggcgacgacatcgaggtcttcgccaaggtggagccggggctgagctcgtacgccggacggccgcaggaggccgccaagtccatcacacccctgctggagaaggccaagagcgccgtgcctcgctggctcatgaagaaaacacccgttaaactaggggcgacggctggactcagacttatcggagatgacaaggcagagcaaattcttgaagcagtgagggatgccgtccacagcaagaccaaattccagtacaatcccagttggatcaatgttctcaaggggtctcaggaaggatcttacctatgggttgctctgaattacctgctgggtaaactgggaggagactactccaagacggtggcagtgatcgaccttggaggtgggtccgtgcagatggcatatgccatctcagcgaacgccgcggctgccgctcccacggtgcctcaaggggaggacccatacgtcaccaaagagtacctcaaaggaaaagattacaacgtctacgttcacagctacttgcactacggcgcacaggcttcaagggtagagatcttcaaggccaaaaacggaccagtcagctactgcgtgctgcgcggatacgatggcaaatacacctacaacggggagcaatacgacgccatagcagcaccgcaaggagcggcgtacgaaaagtgcagagaggacgtgaccagggcgctgagaatcagcgcgccatgcgcggccaagaactgcaccttcaacggcgcgtggaacggcggcggcggccccggccaggccgagctctacgtcacctccagcttctactacatggcagcagacgtcggcctgatcgacagcgaggcgagcagcgggaagaccacgccggcggcgttcagggccgccgccgaggagatctgcccgatgagcttcctggaggccaaggccgcgtaccccaaggtgcggtccgtggacgcgccctacatctgcatggaccttgtctaccagtactccctgctcgtggacgggttcggcttggagccgaccaaggagatcaccgtggcgcagaaggtgaagcacggggagtacttcatcgaggccgcgtggccgctcggggaggccatcgaggccgtctcgcccaccaagcggctcaacgatgcatgatcttag

SEQ ID NO: 304 - DNA, 1904 bp, Hordeum vulgare
tccccatgccccccgccgcgtgcgccacgccggcggccgcgcgcccgccgctcccggtgtcgcgccgctgcccgcctccgcccccctccgccgcgcacgtgcccgccgcccgccgcccctcctccgccacggcatgccgctgcaccgccggctcctcatcctcccctacggcggcagcggcgtcggcctgggactggacccgctggagccggcacttcgcggaggtggaccaggccgagagctacgcctccgtgctccgcttccagctcgaggaggccgtcgaaggcgaggacttcgccgaggccgccgccctcaagcgcgccctcctcgacgccaccgccggcgacgccgtctcccgcgtcatggccgagctcaagagcgccatcgaggagcagcgctaccaggacgcctccaggctcaccaagctcgccggaaccagcctcgtaggttggtgggtgggatatgccaaggacaccgatgactcgatcgggaggattgtacggataacccctggtgtcgggagatacgtcgccaagagctacagcccaaggcaattgatcactgcatcttcagggagcccactatttgaaatattcctcgtcagagacgaagacgagacgtacacaatgaaggtggtacacttgcgaccgacaaaaggagcttcaagcgcgtcgtcgtccgtgccatcaacagccaccgaagatccagctaaggcagagactgagagttcaccggacagcagtgttttatctgaagccattgcagaggaagcaaacacggataccaaattaaaaggaaatgaagatgtcgaggagaaagcgcaggatactggaagaaccaaggaaagtggcgttgaagggttgaaaagtgttctgaatttttttaagtcccggattcccgagttcaaagttcaagtcataaacgtggaggtgcccgaggaagctgagttagttgcggattcgtcagaagagttagtgcaagatgatgtgaagagcacgtcagagagttcgttggaagagcctgtcgccgaggaattccaggaggaagatgtttccgacggagattcagactcgaacgacgagagtaaggggccggaagtaaagcttttcatcagcggagtagttcataataaagaggaggctggagcaaaatcttatgttcgagttcctgctgaaataaataacctggaaagggactcctttgaactgtacattcctggaaaaggttctgatcgggatctgagtgaaacaaaggccgcgaaacagaaagttgcggatatggccgctaaattggcgtcagagctcatgccctctgatgttgcaaaggcattatggggcaccaccaagagttcctccaagataaataaagaagtccaggagcttttgaagcttacactgagcaaggcccgagtcaagctgactgagaataccattttcaatcggattgttacggactctaatggctcagatccattcaatggtctctatgtaggagcatttagtccgtatggccccgaagttgtacagctccgtcggaagttcggtcactggaatagtactgatgacgtggagtttttcgagtatgttgaagcagttaagttgactggtgatcttagtgtccctgctggacaggtaactttccgtgctaaggttgcgaagggcagtcgtcttgagaatcgtggtgcatacccagaagagtttggtgtgactgctagttataaaggtcaggggagaatagcgcaacctggattcaaaaacccgcggtgggtggatggtgagctgttggtgctcaatggcaagagtgcaatcccgcacattggtggcgccgagctcggtttcctgtacagcgtgcctgagcagagcttcctggttctctttgaccgccttacgcttcccgagtgatga

SEQ ID NO: 305 - DNA, 2885 bp, Hordeum vulgare
ccgccatggccgacaaggaggccggcaacctggaggccgtcctcaaggaggtcgtcgacctggagaacatccccctggaggaggtgttggacaacctgcggtgcagccgggaggggctcacggcggagcaggcgcagcagcgcctccaaatcttcggcccgaacaagctggaggagaaggaggagagcaagttcctcaagttcctcggcttcatgtggaacccgctctcctgggtcatggaggccgccgccatcatggccatcgccctcgccaacggaggggggaagccgccggactggcaggactttgtgggcatcatcaccctgctcgtcatcaactccaccatcagtttcatcgaggagaacaatgcaggcaacgccgccgccgcgctcatggcccgtctcgcgtccaaagccaagattcttcgcgacggccggtggacggaggaagacgcggccatcctcgtgccaggggacgtcatcagcatcaagctcggagacatcatacccgcagacgcacgcctcctcgagggagaccctctcaagattgatcagtctgccctgaccggagaatcattgccggccaccaaaggcccgggcgacggcatctactccggatcgacggtcaagcaaggcgagatcgaggccgtcgtgatcgcggccggcgttcacacgttcttcggaaaggctgcacaccttgttgactccactaaccaagtgggccattttcagaaggttctgacggccattgggaacttctgcatttgttcgatcgctgtggggatgttcatcgagatcattgtaatgtatcctatccagcacagggcgtaccgccccggaatcgacaacctcttggtccttctcattggaggcattcccatagccatgccaactgtcttatccgtgactatggctatcgggtcacatcgcttgtcccaacagggagctatcacaaagagaatgactgcaatcgaggagatggcgggcatggatgtcctttgcagtgataaaactggaactttgaccctcaataagcttaccgtggacaagagccttgttgaggttttcgaaagagggatcacccaggaccaggtgattctcatggctgctagagcgtctcgaacagaaaaccaagatgctattgatacagcaattgttgggatgctcgctgatccgaaagaggcacgtgctggtattcaagaagttcattttctgccattcaatcctactgacaagagaacggcgctgacatacattgacgctgatggcaaaatgcaccgcgttagtaagggtgcacctgagcagatccttcacctcgctcacaatacatcggagatagagcggagggtccatgctgtgattgacaaatttgcagagcgtggacttcgatcgcttgctgtagcgtatcaggaagtaccagatgggaggaaggaaagccctggtggcccatggcactttgccggtctgatgccactttttgatcctccaaggcatgacagtgctgaaacaatccggagggcacttaaccttggtgttaatgtcaagatgatcacaggtgatcagctcgccattggaaaggaaacagggcgtcgcctggggatgggtacaaacatgtatccttcatccgctctgttggggcagaaaaattcagacgagtccatttctgctttaccagttgacgatctcattgagaaagctgatggttttgccggcgtcttccctgagcacaagtatgagattgtgaaacgcctgcaagcacgaaagcacatctgtggaatgacgggtgacggagtaaatgatgctccagctcttaagaaagcggatattggtattgccgttgctgatgcaactgatgcagccaggagcgcttcggatattgtcctcacagaaccaggcctcagcgtgatcatcagtgctgtgctcaccagccgtgcaattttccagcgtatgaagaactacactatctatgctgtctccatcacaattcgtattgtgcttggatttatgctacttgccctcatctggaatttcgactttccaccgttcatggtcctgatcatagcgattctaaatgatggtaccatcatgactatatcaaaggatcgggtaaaaccatctccactacctgacagctggaagttggctgagatttttacaactggagttatccttggtggttacttggcaataatgacggtcatcttcttctgggctgcgtacaagacaaactttttcccgaggctgtttcacgtcgaaagcctcgagaagacagctcaggacgatttccaaaagctcgcgtctgccatttacctccaagtcagcaccatcagccaagctctgatcttcgtcaccaggtcccgcagctggtcatttgccgagcgccctgggtttctactcgtctttgcattcttcgttgcgcagctgattgctacactgattgcggtgtatgctgactggaagttcgctgcgatcaaaggcatcgggtggggctgggctggcgtcgtgtggctctacaacatcatcacatacttcccgctcgatatcatcaagttcctcatccgatacactctgagcggcaaagcatgggacctcgtcatcgatcaaaggatcgcgttcacaaggaagaaagacttcggtaaggaggagagggagctcaagtgggcgcacgctcagaggaccctccatgggctgcagccgccggacgccaagatgttctcggacaaggggggctacaatgagctgaaccacatggctgaagaggccaagaggagggccgagatcgcaaggttgagggagcttcatacgctcaaagggcacgtggagtccgtcgtcaagctcaagggtctcgacatcgagaccatccagcagtcctacaccgtctgataa

SEQ ID NO: 306 - DNA, 1311 bp, Hordeum vulgare
aaaggatccaggcgcagtttctcatcgccccgtccaaaacctttctccttctgtcccgcaaacccccgagagatcacaggatgttcggcttcggtcaccacggccaccatggccagaacccccccgcccacgctccgcccgccgccggcggcaaccagcccaccttcaagatcttctgcaaggccgacgagggctactgcctctccgtccgcgacggcaacgtcgtcctcgccccctccaacccccgcgacgagcaccagcactggttcaaggacatgcgcttcagcacccagatcaaggacgaggagggtaaccccgccttcgccatcgtcaacaaggccactggcctcgccgtcaagcactccctcggccagtcccacccggtgaagctggtgccattcaacccggagttcctcgacgagtccgtgatgtggacggagagcggcgacgtcggcaagggcttccgctgcattcgcatggtgaacaacatccgcctcaacttcgacgccctcaacggcgacaaggaccacggcggcgtgcacgacggcaccacggtcgtcctctgggagtgggccaagggcgacaaccagagctggaagatcctcccctggggcgaagaggcctacgccggaggcagcgccaacgcaccacgcggcggctcctcagagcccaccgtgcgcatcttctgcaaggccgacgagggcttcagcgccaccgtccgcaacggcaccgtcgtcctcgcacctagcaacccccgtgacgagtaccagcactggttcaaggacatgaggcacagcaaccgcatcaaggacgaggaaggctacccggccttcgccctcatcaacaaggtgacaggcgaggccctcaagcactcccaaggcgagggccaccctgtgaagctggtgccatacaaccccaactaccaggacgagtcggtgttgtggactgagagccgcgacgtgggcgccggcttcaggtgcatccgcatggtaaacaacatctacctcaacttcgacgctctccacggcgacaaggagcacggcggcgtgcgcgacggcacctccctcgtgctgtggaagtggtgcgagggcgacaaccagcgctggaagatcctcccctggtaaacgtgtcatgctgaagctgcattgatcgccaccgtgacacgaagttggtagagatcagcctgtgatctgttgccgtgtcggtagaataaaagtcgtgtgcggtcggtggtggtgatgcgtccgtgagtttgtgtgtttagtttctgtcctgtcgttgtgtcctgctaatgcgagtgtactcgagttt

SEQ ID NO: 307 - DNA, 1713 bp, Hordeum vulgare
aaacttaggcaccaacgatactccgcactcccccctgccgccgggatgacagaggacgtgcagatgggcgagcctcagtcggcccctcctcccgccgccgcggcggcgccggccccctccaccctccaacatctgaaggagatcgccgcggtgatcgaggcggggtcgctctcgaaggaggtacgccggatctcccgcgccgtccgcctcaccgtcgccctacgccgccgcctcgccgcccgcgacgtctcggccttcctcgccttcgccctcccggcctccagcgacgcgtacgcccgcctcacccccctcctccccaaggaagatgaagctgagatggatgttgatgcagcagctccaccaactcagatttctatcaagcatggccttcctgagattgaaatatattgttctttgcttgtcctgattttcctcattgatcagaagaaatacgatgaggctaaatcatgcgcaactggaagcattgcccgtctgaagaacttgaacaggagaactgttgatgttttggcttctaggctgtacttctattattcgtatgtgtatgaacttaccaacacccttgctgaaattcgtggtaatctccttgggttacatagaatggcaactttacatcacgatgagcttggtcaggaaaccctgctcaatctgcttctccgcaattacctccactataacttgtatgaccaggcagagaaacttaggtcgaaggcaccacgttttgaagcccattccaaccagcaattctgccggtacctcttctacttggggaaaatcagaacaattcagttggagtacactgatgctaaagaaagcctcctgcaagctgctaggaaggcaccggctgcagctcgtggctttaggattcagtgcaataaatgggctatcatagtaaggctgcttcttggggagatcccagagaggactgttttcatgcagaaaggaatgaaggaagctctgacaccatattttgagcttacaaatgctgtcaggattggcgatttggaactgtttagagctgttgcagacaaatttgcaagcacattcagtgcagacaggactcacaatttgattgtgaggctccgccacaatgtcattcgaactggactacgcaacatcagcatttcatactcgcggatctcccttgctgatattgcgaagaagctaaggctagacactgggaatcctgttgccgatgcggagtgcattgtagccaaggccataagagatggtgctattgatgccaccatagaccatgcaaatggctggatggtgtcgaaagaaactggtgatgtctactcgacaaatgaaccccaggctgcattcaactccaggattgcgttctgcctcaacatgcataatgaagcggtcaaggccatgaggtttcccccgaattctcacaaggagaaggagagcgctgagaagcgccgagaaaggctccagcaggaggaagagctggcaaagcacatggctgaggaggatgacgatgatttttaagttggtccgttttttgaattgttgattttagatccctgaaatcactgaattgtcccctcaagggaggtttgaatcttgtaaactttttacatcttctgtaattctatgttgatcagcacttcattggaccgtaaatgtgttttgagtttatcttttctcttcctcgtcgaaactgggtttgaggatcgctgtaccatt

SEQ ID NO: 308 - DNA, 1342 bp, Hordeum vulgare
tagatctaccaccaacgccatctctttttgctgtggccgttgttgatttttctctgcctgttctaggttttggtttggaaaccaggcagctttctttcttgttcatctttccaagaaaacaaaacaaaaaaacaccaaaaaaaatccctagatggctgcagctatagatctgtccggggaggatctggtgagagcactcgagccttttatccgagaggcctctgccccccctccgctccactcccatcctagtcccacctcgccattctccttcccccacgccgcctacagtggttacccgtacggggtgcaggcacaggcccagaccgagctcagcccggcccagatgcactacatccaggcacgcctccacctccagcgccagaccggccagccgggccacctcggcccgcggccccagcccatgaagcccgcttcggcggcagcggccacaccgccgcggccgcagaagctctaccgcggcgttcggcagcgccactggggcaagtgggtggcggagatccgcctcccccgcaaccgcacccgcctctggctcggcaccttcgacaccgccgaggaggcggctctcgcctacgaccaggccgcctaccgcctccgtggcgacgcagcgcgcctcaacttccccgacaacgccgcctcccgcggcccgctccatgcctctgttgacgccaagctccagaccctctgccagaacatcaccgcttccaagaacgccaagaagtccgcctccgtctccgcgtccaccgccgcagccacgtcgtccacccccaccagcaactgctcctcgccgtcctccgacgaggcgtcgtcctcgctcgagtccgccgagtcgtcaccatcacccaccaccaccgcagcagaggttcctgagatgcagcagctcgacttcagcgaggcaccatgggacgaggcagccggcttcgccctcaccaagtacccgtcctatgagatcgactgggactcgctcctcgccaccaattagcacccagttcatcttcgtcagctactactaccagtaccgtcttttagcgtgtcatgatgctaggttaatgggtcgccgcgatgcagatggcattttagacattctgcgccggcctttagcggattagctctaagtctctaatccttgttcattgtgtagacctatgattcgttctctttgtggtagggtttggttagtccctcccggatgactataagccggcgtttttgtgcccggcgtctccggtggtcggtcactggtcagtgactccggccggtgaagtctgtccattgttctagctaggtgctgttccttccgctgctctgcagattgtaacag

SEQ ID NO: 309 - DNA, 404 bp, Hordeum vulgare
gcttaagcttctgagccttccagtgccggaacagagcagcatataagaatggcatccctgaaggccgtgaagccaaccggacttgaagggcaggccaaggagcctaccaaggttagtgccactaaggggcctgcaaagctcagtaacacggcgaccaagccagcagccgccaagggcggcatcaagaaggctgagtcaaagccacgggagcctaagaagaggcaggtcaagagcaccaagccagcagcagcaaaaaactgacaacggcagcaggagaacggagcttgcatagctatctccatggtgctatgaattatatatgaatcctgcctttcccttcctctgtctcccatgatattgatcatgcctacacagggtgtgcgcacaatccatgtgacgaatat

SEQ ID NO: 310 - DNA, 1944 bp, Hordeum vulgare
gggaagtaaatcatggcgacaggtcaaattttctcgaaaactacccaagcgctgttctataattataagcaacttcctatccagcggatgcttgattttgacttcctctgtgggagagaaacaccttctgttgctggaatcatcaatcctggttctgatgggttccagaaacttttttttggacaagaagaaattgctattccagttcatcctacaattgaagctgcttgcaatgcacacccaactgcggatgtgtttatcaactttgcatccttccggagtgcggctgcttcttcaatgtcagctttgaagcagccaactatgcgagttgtagccattatagcagaaggagttcctgaatcagatgcaaagcagctaattagttatgcacgtgctaacaacaaggtcatcattggacctgcaacagtcggaggagttcaggctggtgctttcaagattggtgatactgctggaaccattgacaacataattcaatgcaagttgtacaggcccggatcagttggttttgtgtctaaatcgggtggcatgtcaaatgagctgtacaacaccattgcaagagtgactgatggtatttatgaaggaattgcaattggaggagatgttttccctggctcaactctttcagatcacattctgcgttttaataacatacctcaggttaaaatgatggttgttcttggggagcttggaggaagtgacgagtattcgctcgtcgaggccttgaaacaaggaaaggttcagaaacctgttgttgcttgggttagtgggacatgtgcacgtctattcaaatctgaggtccagtttggccatgctggtgcgaagagcggtggtgagttggaatccgcacaagctaagaatcaggcactgagggatgctggggcagttgtccctacttcctttgaagctcttgaaagtgtgattaaggagacattcgagaagctggttgaggaaggaaatattcctcctgtccctgaggttacacctccccccatacctgaggatcttaacactgccatcaaaagtgggaaggtccgggctcccactcacattatctccactatctctgatgatagaggtgaggaaccttgctatgctggtgtgcccatgtctacaattattgaaaggggttatggagttggtgatgttatttctcttttgtggttcaagcgcagccttcctcgttattgtacccaatttattgagatatgcgtcatgctttgtgctgatcatggtccttgtgtatccggtgctcacaattctatagttactgctagggcaggaaaggaccttgtttccagcttggtatctggattgttgacaattggcccccgatttggtggtgcaattgatgacgccgctcggtacttcaaagatgcatatgataggggtcttacgccttatgaatttgttgagggcatgaaaaagaagggaattcgtgtccctgggattggtcacaggatcaaaagcagagacaacagggacaagcgagtgcagcttttacagaaatatgctcacgcacacttcccttcagtcaagtacatggagtacgctgttcaggttgagacctacaccctgtcaaaggccaacaatttggttatgaatgttgacggtgccatcggctcgcttttcttggatcttctttctgggagtggaatgttcagcaagcaagagattgacgagattgtagagatcgggtatcttaatggactctttgtgcttgcacgttcaattggcctaattgggcacacctttgaccagaagaggctcaagcaaccactctatcgtcacccttgggaggatgtcctctacaccaaatgaggcaccatatagtgtattccacctgtgtgtacaccataaaaataaaatcgagcataactgcatagaattcaagatggaactacgcaaggagggatagagaaccat

SEQ ID NO: 311 - DNA, 1337 bp, Hordeum vulgare
aaaggagcaggcaaatctcccgcaatggccgccgctgcatcgtcctcctcccctccggcggccatcacctgccgagcggcggtggcatgggggccggggcaggcgctggtgatggaggacgtggaggtcgccccgccggggcccatggagatccgcgtcaaggtcgtctccacctccatctgccgcagcgacgtcacccagtggcagtccacggcgcagcccgatctgttccccagaattttcggccacgaagcatccggggtggtcgagagcgtcggggaaggggtgaccgagttccaagccggagaccacgcgctcaccgtcttcatcggggagtgcatgagctgcaagcactgcgtgtcggggaaaagcaacatgtgccagaggctcggcctggagaggaagggcgtcatgcacagcgaccagaccacccgcttctccatcggcgggaagcccgtgtaccactactgcgccgtgtcgagcttcagcgagtacgcggtcgttcactcgggctgcgcggtcaaggtcagccccgccatgcccatggacaggatatgcctgctcagctgcggcgcctccgcaggccttggtgcggcttggaatgttgctgatgtatccaagggatcaagtgtagttatatttggtctgggaactgtaggactttcggtcgctcaaggtgctaagctacggggagcttccaagattatcggagtagataccaatcctgataagcaagaaaaggggaaggcttttggcgttacagattttattaatcctgccgaattgaatgaacctgttcagcaggtagtaaaacggcttactgatggaggggctgattactcttttgaatgtgtgggtgatacgggagtagtctcgactgcgttgcaatcatgttctgatggatggggactcactgtaactcttggtgtaccaaaagcaaaaccagaagtttctgctcattatggattgcttctctctggaagaacactgaaggggtctttgtttggaggatggaggccgaaatctgatatacctttgttagtggagaagtacacaaacaaggaaatccaaattgatgaccttgtcacacatgatatgccattcagtgacatcaacaaggcgcttgaactgatgctagaaaacaggtgtttgcgatgcgtgattcacatggcaaagtgacaggattgatttatacatcaatgtcatcatacctgtacaattttggtggttttcttatcagtaatttttcacttgatcttgctcctggctcgagttttcatgacatcaacacattgaagctctaacaccactatatctattggtgtctcaccttggaa

SEQ ID NO: 312 - DNA, 636 bp, Hordeum vulgare
ggcatcctcctctctacagttaatacagtaccatggcccccgccgtgatggcttcgtcggctaccaccgtcgcacccttccaggggctcaagtccacagccggtctccccgtcagccgccgctccagcgccagcctcggcagggtcagcaatggcggaaggatcaggtgcatgcaggtgtggccgattgagggtatcaagaagttcgagaccctgtcttacttgccacccctcaccacggaggccctcctgaagcaggttgactacctgatccgctccaagtgggtgccctgcctcgagttcagcaaggttggcttcgtcttccgtgagcacaacagctcccccgggtactacgacggccgatactggacaatgtggaagctgcctatgttcggatgcaccgacgccacacaggtgcttaacgaggtggaggaggtcaagaaggagtaccctgacgcttacgtccgtatcatcggcttcgacaacctgcggcaggtgcagtgcgtcagcttcatcgccttcaggccaccgggttgcgaggagtccggcaaggcataaactacgaggtgaaacaatggcctatgtcgtatgaaggtcttctgtgaacttcacttttgtccatgactctgctttccga

SEQ ID NO: 313 - DNA, 523 bp, Hordeum vulgare
catcgatccagctttgcggcgaggcagccaaccagcgctcatggcggtggaggagataacggagggtgtgaggggcctcaaggtggaggacggcgagggggcggcggcgccgcccgccgccgccggcggcggcggcggcggggacgggccgaggcgtggcgccaacggcagcagcaaccgcatccaggtgtccaacacgaagaagcccctcttcttctatgtcaacctcgccaagaggtatatgcagcagcacggcgacgtcgagctctccgctctcgggatggccattgcgacagttgtgactgtggcggagattctgaagaacaacggccttgctgttgagaagaagattaggacatccacggtggaaataaacgacgaatcgagaggccgcccattccaaaaggctaagatcgagatagaattggggaagagcgagaaattcgacgagttgatggcctctgctgctgcagatgccgaagaaggcgaggaggaagcctgaagaaccaaacagagccgttga

SEQ ID NO: 314 - DNA, 409 bp, Hordeum vulgare
ctgcgaattctagctctgaagcagctcaagatcgggcttgccagaagaagcctttctgagtaccatggcggcatcagtagcctgcgccttcttcttcgacgccgagccggtcggcgagcccggcaaccacgcgctggacgcgtgcgcgctctgcaccaagccgctggcgcgcgacagcgacgtcttcatgtacagaggcgacacgccctactgcagcgaggagtgccgccacgagcagatgcacctcgacgccgtctccgccaggcaggccgcccgtaggcagcagcggttctcggcgggagcagagtccgggtgtgcgcgccgaggggtatccgtcgggagctgaccggcgagagtggcaggctgcatacgtgcctgacgaagaaaggttattatgcttgagccagca

SEQ ID NO: 315 - DNA, 585 bp, Hordeum vulgare
ctacggcactaccaccagtacccaacgcaagcttctcggttctcatctaggaacaacaatggccgtcacttctctgcagctgccctctccgatccactggcttactcctgctagaaatggctgcacccgcacaaggccgcgcgctactcttgttagctgtaaacataaccagtcaaccattgtccaagaagcaagcaggacatctcgtagaggtaccgtggcatacatttcgtctgctttgtttgcaatgttcatggtggctgaacgtgctgaagcaagaacctccagacaagagaacaagaggaaagtaatggagaagctggagaagatccgggaggaggcactaggctcaaaggagaagaaagagaacacgagtaaggagtctgtggcgaacttgctaatccctcctactttggtcgatgcttacatctgaaaggcatcgtctcgttaatttttatgtttatgctaaatgctacttaacacttctaaatgtaaaaaaaggcagcccggtgcatgtagcttggcccggtgctacttaacacttctgaatgtactagtaacaattgagaccagacaaccttgcaa

SEQ ID NO: 316 - DNA, 1094 bp, Hordeum vulgare
ctcaaactctgcccccgtgcccccgatgtcgagcagcctcttcctctgctcttaccaggtgcgctatgccagcctcccggcacctctccggcagccgggccgccacgccgaccggctgcccccggcggctcccgcgttcgtctctcgcagccttcatcgccctcctcccctccactggaccggctcgggggttcggatgatttcttcttgcttcgtggtcaaaagaagaaggcgtaggaacggtatccacgcctctttgtttggcgttggagctcctgaagctctggtcattggagtggtcgccttgctggtttttggccccaagggtctagcagaggcagccaggagtttggggaagactttgcgtgcgttccaaccgactatcagagagctacaggatgtatcaagggatttcaagaacactcttgaacgagaaattggacttgatgaggatcccccatccatgagttataggcctcctccatctatgaataatagccaacagcctgctgttgacccagatgtcaagcctgaaacaaccgtgccttacaccagcgaggaactcatgaaagtaaccgaagaacagctggctgcatccgcaattgctgcttggaatgcacagcaacctgcctcatctgaacagcaagaagcagcagcagcagcaataacaccttctcaaagtagtgacttggcattatcaggaggaggtagtgatggtcctgttgccgtgacggaggagtccaactcagaagcagcagcagcaacaacaccttctcaaagtagtgactcaacattatcaggagggaatgatggtcctggtgccgtgacggaggagtccaactcaggtaatactgagaatgcaaagctgagagatgaggcataatactaaaaacagaaagtatgttgtatgcggagtagagcaaggcggaagctttggcatcaattggttgtagaaagaatgaaatagttttggtttccatttggtaagctgggttggccaagtgatgggtgattcgaggcttcggttagtagcggcttggtctgttgtggtgtgtagcatggagagataggtaggtgatgcgaaaccgagctgt

SEQ ID NO: 317 - DNA, 626 bp, Hordeum vulgare
cactgtgctactcccaccttatctagctcctgcgtctcggctgcagcttgaagctcgaccaggatggccgagccacggaggcgcagggcaccgcggacgcaggtcgccgccctgctcctcgccttgctcgccgctgcctccctgctccaggccggcgacgctgcttcagggttctgcgcgggcaagtgcgcggtgcggtgcgggcggtcgcgggcgcggggggcgtgcatcaagtactgcgggctgtgctgcgaggagtgcgcctgcgtgccgacggggaggagcggcagccgcgacgagtgcccctgctaccgcgacatgctcaccgccggccccaggaagaggcccaagtgcccctgagcccggtgaccaccctctcgtccgtccaccgtctctctcaacacaccaccaccgtcttcaacctccaccctacggtaatatattgtcatgtcggacgtgcgtgcttcagtgcttgtgttgtgtagcctccctgtggtcgtgctgattattggcgcgtgatatgtcgcgcgtacgtacgtacgtacctgtagttgcctgctatgctaaagtacgagtatatgttatcgttgtgctaggatgccgagtgagcttggtgcctgtaaatt

SEQ ID NO: 318 - DNA, 1033 bp, Hordeum vulgare
gcggatagagttgttcttccagaggcggacgccgcgccagcgccacggcgaggcacccaccaccgcccaccgcaggcagcgcgccatgctctccctcctcccgcccgcgcggctccgcgccgcaccctccgacgtccccgtcaccgcgccgcgccgcccggccgtcatcctcccagggctcgggaacaacacgggggactacgcgcggctgggcgcggcgctgcgggacggccacggcgtgccgtccgtcgtcgcgcgggtgtcgcgccccgactggctccgcaacgccgccggactcgccgaccccagctactggcggggcaccctccgcccgcgccccgtcctcgactggtacctgaaccgagtggaggaggcggtgtccgaggccagggagctaggctctccagatgggaagctgtcattgatagggcattcagctgggggctggctcgcgcgcgtatatatggaggaattcggtacttctgacataagtttactgctcacacttggcactcctcacctgccacctcccaacggtgtttctggcgtaattgaccaaactagaggactactaaactacgtcgagaagaattgtgcccctgcagtttacacaccagaactacgatatgtatgcattgctggaaggtatattcagggtgctcctttaactggaagctcccttgctgctaccacagatgagcttgtcgccgtggatgccccgtcagaagtagctgaagcagtcatggtcagtgccgataacaaaaccgctccgacaggccccaccttccgggcccgtttcgtcggacaaggctacaaacaggtttgtggccgcgccgacgtctggggagatggggtcgtccccgaagtgtcagcgcacctggagggcgcactgaatataagcttcgacggcgtgtaccattctcctgtaggttctgatgatgaagagaggccctggtatggctcaccagcgatcctagagcaatgggtgcatcatctccttagttgattccacagaagctttaccaactcctag

SEQ ID NO: 319 - DNA, 1517 bp, Hordeum vulgare
aggctctcacctgctactgccagctagcccctccggctcaacggaagctagcgatcgccatagcctctgcgacttgccaaagctagcacccgcgctagaacaagaagaagaagcagaaccagaggcgcaaaaggctttgcgtgtggcctcaaggaaccccgaaaaggccgagaaggaaacaagataaaaggtaatttgagcagggggcaacgatgggttgcggcttgtcgacgccggacaacgaaggcggcggcacgcggaggaaacaggggagcgtcggcgacgtggtcgtcttcctcccggggctccggacgccgacgggcgtggacctgtcccagccgctcgccgggcgcctggaaaagggcgccgtggagaggctgtcggcgctgagagcgcgcgtcgtcgacatgacaatgcaagaatcggcgtcggccctcaaaccgaggcggaaggccgccgcacggcacggatctagcaccgctaacctcctgcaggcgctggaggactacctcccacttctgctaggattggtgaaagatagtggtgagttgaggaacagcgtggagtttgtgtggactaaccaagaggacaaggcagaggagacggccatggcggatgcgtggtacgaggtgctgtccgtgctgcatttgatggccatggtctgcttgctgcaggccaactcccttctccttccaagggcttacggcgacggttacgggccacgggtctctgaagagagcagacgcgccactgtcgacgttttcttgaaagcgtctggctacttggactgcgcgattcgacaagtgctcccacagataccaacagaactaaggagacaacttccagttgacctggctgaaggcaacctcaaagctcttagcctgcaagctctgggtcagggtgttgacatgcagcttgggctggcaatcgatagcccaaaggccacactagctgtaaaaaggcgcttagcttgtgagatggtcaaatattggcaccaggttcaggagagcattccagatcttcccgtgtctgacggatgggggaaaaaacatctgctatttgtcaagtggaagtacgtcgaagcaaagtctgcagcatactacttccatggcttgatcctcgacgaaggaaacagcgagaaatctcacggaatggcaatagcagcattggaagcttcagaggaatttctgaaagaaagcaaaagggcctctgaagccttccacgcaactcctccaacatctaggagccccactccattcggaacagccaagtatctgtttgacaagatcccgaaagaggcttcaagcaaggtccggatcaaccaggatctgtatactccagaaaggatcattggagcaccacccccattgccggatttctcgttggcactaacacctgaagactacgatcttcctccattagacccactttggaacaaagaagacggccaccagtaagtgtatattcagcattcagcaagagtgccttctgatgggaaggctctggcactactgtag

SEQ ID NO: 320 - DNA, 920 bp, Hordeum vulgare
cgagaatgcagcagcagcagcagacggcgcggcggcggcggagcccgggcggcggggagtgggagggggcgggcacggtggacgaggcctccatggagcgcagcaagagcttcgtcaaggccctgcaggagctcaagaacctgcgcccgcagctctactccgcctccgagtactgcgagaagtcctacctcaacacccaccagaagcagatggtgctggacaacctgaaagactacgcggtgcgggcggttgtcaacgccgtcgaccacctaggcacggtggcctacaagctgacggacctgttcgagcagcaggcgtccgagatctcgacattcgagctcaagcttgcgcgcttgaaccagcaagtcttcacctgccaagtctatgtggacaaagaagggtctaggcagcagcaaatgatgggggcgagcatgaaacaccacaagcactacatcctaccctctacgggttataagagaactcaggctgtcgtgcacctgggaacagacactaatcaggaatcacagcctagaccttacccctcagcaaagacactttcctggcatctggcatcagacaatagcccttcagcagatggagcaaacaaacctacattcatcctagacgacacgatatcgtccaaacccgcatcggatggtttgcatcttcttggtaaggagttgcctggttctcccatgcgcaggcctctgcaactgaacaggaataccaaacctgacgttatacaaaaggctggcacaaaggatcagacaggtgtcaagcatatgtcgacgtttagttctttcgacaggcctacagggcgtgaaatccagaaggctcctgccaacactaagagcgtgctagcatctctgtttatgaaacacaagtcggcaaagatgaaaagtatctcagcccgatgatga

SEQ ID NO: 321 - DNA, 999 bp, Hordeum vulgare
atgtccatgcacaggtaaagctgccgcgtcctagaagatccaggcgatgggatgaggcccactgcggcagcaaccggaccttccttcttcctccccagatgccagtcggtcccggccccggcatcatcaagggcggcaggagtagcagcagctgccgatccatgcaagccgcccaacaaggcgatccggtcatggcgagccgcgtcggcaggcagcaacggcggcgacgagcgcggccagtccgtgtcgacggtggcgacgacaccgtcgggaaggcgggcccggctgtcggcgaggcggcgggagagcatcaggctcctggacgcgctgccggaccagggcggcatcggcgagttcctgcggcaccccgccggcgtggagtccctgctcaacacccgggcgctgcagagcttcgcgccggtggagtcggagtcggacggcaccttcaggtgcacgctgcaccccatgggcttcctcggcttccaggtcgcaccggtcctggacctccgcgtcaccccgacccgcgacgactgcaccgtcgagatgctctcctgcaggtttgagggttcggactccatcgagcagcagaatgagctcttttcagcggtaatgacgaaccgaataacatggggagacaatggtgatgaggagccatgcttggacatcgatgtcaatctggaggtcaccctggaggtgtacacgaagccattcagcttgctcccgctgtcggcagtggagaaaccaggcaacctgctgatgcaagggctgcttgacaggcttgtgccgatgctgggtgagcagctgctgagggactaccattcctgggttcagcagcagacccagtcttcctcctcatgactcactgtggaaagtctgaaactaacactatctacctagcagattcctgggcttcatggccgggtcggttttcatcaaatccagccggctgcaccaccaaggaagaatcacgaggaaaacaatcatacatacacgcagcgt

SEQ ID NO: 322 - DNA, 509 bp, Hordeum vulgare
ctgccatggcgtcctacaggctgctggtcatcctcgtcttctccgcgccgctcctcgacgccgcagccgccgacacctcctaccaggccgactgcccctacccgtgcctgctgccgccgcccacgccgccggcctccaccgccgactgcccgccgccgccctccgcgccgtccggctccggctacgggtacccgcccccgtcctcctccgggaacgcgccgccgtcgccctcgtactggaacaaccctccgccctccggcggctacattcccggctactaccagcctccctccggcgggggtggcggaagaggcggaggcggtggaggaggtggcgggaactacgggccggcgccgcccccgcccaacccgatcctgccgtggtacccatggtactaccggtccccgccgtcctcatccgcggtggcaacaacggggagcgcgtgggcggccgtgctctgcttggtggccgccgtaactgccgctgctgctctcgtcggttactagtag

SEQ ID NO: 323 - DNA, 1517 bp, Hordeum vulgare
gtaccttcatttgttaactcgcacagcctagcgcagcaatgccggcggtggcgtcactatcgccaccggcgccggggccggccgcatcgcgtcgccggaggttcttccccgcgtcggcgtcgctgcgccgcgccgcatccggagggggctcgagctggcggggcgagcggcggctcatgtcggagctggagcgcacggtgacggcgggcgccgcggagcgcgtcatccgcggctacgtcggcaccaagtcggagcgcgccgcccttgccgcgctctctcgcctcctcatggactccgaccccctcgccgtccccttctacgaggcggtgacccaggcccggtggttcaagtggagctcgatccacgccgcagccgtcgccgccttgctggaagccaacggccgcgccgacgaatccagatccctcatcgccgactccgccgggcgcctcgagtccaccgctgagctggccctcttctactgcgacctcatggcggccttctcctcgcgcgggctgaagcgccgggccatggatttctacgcgcagctccgggcgatgccgacgccgctcgccgggggcggcaagacctacatggccatgattaaatccctgtgcatgttgggcctcgccgccgaggccgaggaggcgctgcgggagatggtcgctctggggtaccaacctgatgcgtttcagttcggattggtggcgaaatgctatgggaaggcaggccaattggctgagatggagagggtgattgcgtccatgtctgaagccggcatccgcctgggcaccggcgcggcgaacattgtcctctcgtgctacagcgcttgccgtgagcacggaaagatgctagcgtggctgaagaagatgcggaagctgcgcgttgcgccgacaaccaaagcctacaatttcgtgctcaactcgtgcccgacggtggtgtcgatggctcgtgaactgggcccttcgctcccgttgtcggcagcgcagttggtgaggaagctcaagtctgcatctccatggccggcagaagttgaggtggtgcaggagcttctggcagcctcatcagtgttgaacaaggcgatggtttggtcagaaactgaggtgaagctgaacctgcatgggttcagtataacatcagcctatgtgctgatgctgcagtgggtggacgcagtgagagggggccgcgcattgccattggaagtgtctgtcgtgtgcggcgtcgggaagcacagtgacgtccgaggcgagcccaaagtgcgggagctggcacaagaggttctgagccggatgggaagccccctgcggctgtccgcgaggaacaaaggccggctcgtggcgaagcgagacagggtgaaacaatggctggccactgagtggacttctgtggtggctgaggagagcacagatcagccgccctatgcgagtgatcagcaaccatttttgcccaatcttttaagaaaactcgggcagtttttttcctcatttgtgccagtttccagatgaatggcaagctgttga

SEQ ID NO: 324 - DNA, 521 bp, Hordeum vulgare
tcccgagtctcgatttgcgccggcggcggaagcaatcgatctccatggcggcgacagcgctccggaccatctgcaagcggatcggcggccgcgccatccggccatcaccctccacctctcgcctcttccacagcacgagaaaagaagagctctaccgcctgatgtccgaaaacagggccaggatagaaaaccagaagggtccgatcaagcacctctcatcccatgtggagcgtaaacccgaggaccccgtctggcgcttctatcgcagggcaaaatggtaccatttagtcatcatgtatagcccaacaatcctttatgtctgcatgtctgtgtgtggtgtgcctgatggcaagaaggagatgacaccagctgagaaggaggacggctagttccatagtgactaaccccaacactttatgtagttgccattgctctatttggacaccgtggctttgttagactaaattatctgtcatgtttagtgcgtttgtgtgttatggtaaggctgaactagctgtggt

SEQ ID NO: 325 - DNA, 1271 bp, Hordeum vulgare
cagtttgctgcagtctttggctttggggcggcgagcgagcgagtgatttttagtatcggcgaatggcgactcagtggttctccaatatggtgatggacgagccgagtttcttccaccagtggcagacggacgcgacgctggagcagtacacggagcagcagatcgccgtggccttcgggcagggggagatggaggcggcgctgatgcagcagcagtacgcggcggcggcggtcggtgagcaccggccgcgcaaggcggccaaggtcaacaccagctgggactcgtgcgtcacggagcagggctcccccgccgactcctcctccccgaccatcctctccttcggcggccacgccgacgcgttcgccaaggcgccgcaggccgggagcgccgccgcctactacggcgccgcctccgctcctgtggcgcccgtgaagcccaagcaggaggtcgacgcggcggccgtggtggcgccgttccagcaggtgaagcggagctacgacgccatggtcgccgagcccgccagggcgccctcccggccggccgcccagaaccaggaccacatcctcgccgagcggaagcggcgggagaagctcagcgagcggttcatcgcgctgtccaagatcgtcccggggctcaagaagatggacaaggcgtcggtgctgggcgacgcgatcaagtacgtcaagacgctgcaggagcaggtgaagggcatggaggaggtggcccggaggcggccggtggagtcggcggtgcttgtcaagaagtcccagctcgccgccgacgaggacgacgggtcgtcctgcgacgagaacttcgagggcgccgacgccgggctgccggagatcgaggcccggatgtcggaccgcacggtgctcgtcaagatccactgcgagaaccgcaggggcgtcctcgtcgccgcgctgtccgagctcgagagcatggacctcaccatcatgaacaccaatgtgctccccttcaccacctcctccatcgacatcaccatcatggccacggccggtgagcacttctcgttgtctgttaaggacatcgtcaggaagctacatcaagcgttcaagtcgtcgccatgaagggcttgctcctcctgatcaagtctaatttagatctttgccttcagtttccctactctttttttgtcattagcctcgaggatttgaggctaatgggtcataggttcttcccagctggtgcttctgatgacagttcccttgcagtcccccacacggtgcccctcaaagatagccatttcccac

SEQ ID NO: 326 - DNA, 1870 bp, Brachypodium distachyon
agaggagagagcctgcctggctgcctacctagcgcgcgcgcgcggcgcccgagagtctgactggacgcgcgcgccatgaggagggcgcagcagcagcagcagcaccagggggcgtcggcgccgggcgtggtgcgcgtggaccaggcgtcgcccgcttccaccttccgccagctcgacgacgccttcctgcagaaacaaacgaaaatctggcttggtgaagttctccatgttaggtttgacgaagacattttggtcgcagaccttctaggcgatggcgagttgctatttcaagtttcgaaagtaatatggaaaaggttactgagaaagaacaaagagcaactcaagcaatcgaaagtttatatttatgagagaacatcttttggtaaaagcaatgggaaatatacgccctatccaaaagtcgactcgtttctaaagatatgccaaatccttgggttggctgggattgatttgtttaccccttccgatgtggttgagaaaagaaatgttcgggaagtctgcatgtgcatacgttcgctgtctaaaaaggccgggatgatgcacctgaatgtacctgattttgatgttgtaactcacacaatagccatgcccaattatatggttggagttatccgcagaagtctggagcaaccacggtgcagttcatcttgttcgagtggatatagcccgcatgcgaattctgagagcatatttggacagaatgaccaacaaggtgacacgcattatgactctgatgaagcagagagcagtctctatgtgctagaacctcaggaaaatgttggtgaagacaacctttcggaacgtttgcaaataggcaatgcccccaaggaacaaagagaaggctatggagatagtggacatggcaagctggaagagaagtcagtggctgaaccagtgggttcacttgactttggcgttatggatgctgattctgcggattcagctccttttcacgacaaccaactgtgttgttctactcactcttcaactgaccagtgctcaagaactagaacaactaaatgttcaatgagctcggaagagtcagactccattagcagttacttagcgttcgacagtagcaagaatgatctggacgctcctaaggtcaaagtttctgaaaggattcatgatgaacatgacgaaccttcacattcttctattcaaggaaatgggaaaatatttgtcgatcatccaaaaaaagaaggtgatgacctcctaaaggacactagcgccatggatcaacattgtgatgcttttatctgtgatagggaatctgttagttcaagttctgaagaacccaggttcggattaaatggagagtcatactcaggtttaaccccaagaaattctacgggtggtcaattgccagcagtttctgaagatactacagcaagtcgagggctgaaacatgaaatcagcactaaggatcacattgatgcttccagatccgaggacgaactggcgaaaccactagatacagctgaacacaacaacggaaatgctcagaggaatgaggacgatcctcccaaatcagggaaaggcgtgctgaagtcagtggctggaggaatcacgctcgttggcgcagtgttctttatagctcatctcaggagaagcaaggggagaatcttcacagcaattttacctccactgtctgaaaaatctattcagagcgactcgaggacgacgaacgtggacaaacgaaaggcagccgagctgtatcccggcggatggctgaaggtttaacaggatggagtggacacggccaattaatagggcagcgcaatttggaattctgtgtatcatgtaaatccatatagcagaacaccttgatattcttgatacggatcaggct

SEQ ID NO: 327 - DNA, 1755 bp, Brachypodium distachyon
ttaggatcctcgctcacccactctgctccccgctccattcgcttgtcagacaacgctagctagcgctagcagcgaagaaaaaaaaaaggcctagacgccgacacgccaacggcagcggcttgccgacacccaatggacgcgcggcggcggctgtgcctggtcgcggcggtgctgctcgccgcggcggcggcggcggaggggtacaacatcaccaagatcctgggcgagcacccggagtactcgcagttcaacaagctgctgacgcagacgcggctggcggcggacatcaacaagcggcgcaccatcacggtgctggtggtagccaacggcgatatgggcgcgctcgccgccggccgcacgctgcagaccatccgccacatcctccagatgcacgtcctcgtcgactactacggcgccaagaagctccaccagctcgcccacggcgtcaccgcctcctcctccatgttccaggagtccggcgctgcccccggcatgtcaggttacgtgaacatcacgcagcaccgtggcgggcacgtgacgttcacggcggaggacgcgtcggacagcgcgtccccggtgagctttgtgaagtccgtaaaggagatcccctacgacctgtcggtgctccagattagcaaggtgctctcctccccggaggccgaggcgcccgtggcggcaccggcgcccgtcaacatcacggagctgctctccaagaagtactgcaagagcttcgcgggccttctggccgccgacgccgacgccttcagcactgtcaacgccacaaaggacaacgggctcacgctcttctgccccgtcgacgccgccgtggccagcttcatgcccaagtacaaaaacctcacggcgaaggccaagacggccatcctgctctaccacgccgtgccggactactactcgctccagctcctgacgtccaacagcggcaaggtgagcacgctcgccacgtccagcgtcgccaagaaggactacagcttcgacgtgtccaaggacggcgagacggccgcgctcgacaccaaggttatcacggcgtccgtcacggccaccgtcaaggacgacgacccgctcgccgtctacgccgtgtccaagttcttgcagcccaaggagctgttcaaggtcgccaaggacctcgcgccggcgccggcgcccgagggccccaagaagaagagcagcaagaagaagccctctgccgcctcatcgccctccgacgacgacgacgactcagccgcggactcgccagacgacgactccgggtccgatgttgacgctgccgacaaggccggcgccgcaccgcccatgcttgccaggtgggtcacggctgcagcggccaccgtcgcggcgttggccttggcaacctaaattaaggtttgaattcgtgtattctgtgctggattctctcgttttttgtctgtcgattctgtcccctgttagtgcaaaaaacaataatgaggagggccgtttatttatattaatttattattgctgcatccagagaaaaagaaaagaggaacttcgacggcatggttctagcagtttgaatttttgtttattttgttttcttgtaatcatagtggtcaatgggattggaccattgaaatgtgtgtttatatatatactctgcatatatatgaaaaaacattgttgagtttagaatgccacattactcgtactttattttattttgccctccttttaagctgtacgcaacacatttgttgagataggcggttaggtaccatt

SEQ ID NO: 328 - DNA, 1762 bp, Gossypium hirsutum
ttgtagatcgagagcaaagcagtagtaaattagcgaagctaagcaatatttgaaagaatgggtaagcaacccagcgcatggattacaacccagcagaaaaagagatggccactgatgattctattactcctttctctatcaacgctcatggccttcctcatcagatccaccttcgattcttgcagcaacggttctagtaacaatgtcggcaatttcatccgagaaggacaagcagaagaaaaagggggtacccaccatcaagttaaccacaatgacgaagcaccgactccaaatcctctcgatttcatgaagtcaaaactcgttctcttagtctctcacgaactctccctttccggtgggcctttattgttaatggaacttgcatgtctgctaagagaagttggcgctgacgttgtcttggtaactaaccagaaacaaaccgaatctgatgacatcatttacagtttagaacataagatgttgaatcgaggggttcaggttttctctgccaaaggtcaagaagctatagatactgctctaaaggctgatttggtagttttgaacactgcggttgctgggaagtggctggatgctgttcttaaagaacatgttgctgatgttcttccaaaggttctctggtggattcatgaaatgcgaggacattacttcaagctagaatatgttaagcacctccctttagttggaggtgccatgattgattcacacaccacagcaaattactggaaaaaccggactcgggaacgattagggattaaaatgcctgaaacatacgttgtgcacttaggaaacagcaaggaactaatggaagtggctgaaaatagagttgccaaactggttctccgtgagcatgttcgtgaatctcttggcgtgaaaaatgaagatctagtctttgctcttataaatagtgtttcccgagggaagggtcaggacctatttctacgttcatttcatgaaagtttgaagttgatccaggagagcaaactaaaggtgccaccaattcatgcggtgatagtgggaagtgacatgaatgctcagacaaagtttgaaacagagctgcgtaactttgtatcacagaataatatgcagggtcgagttcactttgttaataaaaccctaactgtagctccctatctggcttctattgatgttcttgttcaaaattctcaggcccggggagagtgttttggaaggataacaatagaagctatggcctttcagcttcctgtcctgggcacagctgccggtggcaccatggagatagtggtaaacgggacaacaggcttgttgcatcctgctggcaaagaaggcgtgatgcccctctcaaataacatcgtgaaactagctacaaatgtagagaagaggctgacgatggggaagaaaggatatgaaagggtgaaagagagatttttagagcatcacatgtccgaaagaattgccaaggttctgaaggaaatactgctgcacaaggcaaagcgccactctgagtcttgaaaactttgcttcactgttcagtgccttcatcatccggtactaaagttgctctctgctgtttttgtcaggcatctgatgaataataaacttgagggtaaaatctatttgtatattatgtagcaagtggggggaaaactgtagataatcatgttatgatacccatttttcattcttttttacgtttaaatttattcttttatacgtaaatctagagacagaaaaattgtgattcttaaattggttggattca

SEQ ID NO: 329 - DNA, 1192 bp, Gossypium hirsutum
ttatccctccgatcaccctccggtctgatccatgacgttgtcagacgaagaagatgagtttttggcgaatttccttgaatccgagctctccgatgaggaggagccgaaagccaagcgattgcgcgttgtgaaggaagatgaggaaaaggagaaagaaggcaaaggagatggggcttcttcgaatatgaatccgaatccgaatccgggccaagtgaagaacaataataattggaacaatcctaggaggattgagagtggtactttcagcaagattccacctgagttatttactcaaatcctcaaattcctctcatccgaggatcttgtatcgtgctcgatggtgtgtagtttcctgaattatgccgcatctgacgaatccttatggcgccgactgtattgtatgcgatggggtttgttgcctccaacaaaaatacgggaatgtccttggaagaagctttatattcagcgtgatgaagaggacatgattgaacttgttaggaactgtccatctgaatttaaagaatactacattcaaatgcaatcagctaaaagaagccaagcacctcttccttctcaggtgaaggatgactcaataattcttgacaagacagttgctgatcaagtatctatctggaaaagtagtcgcggcctgactgataaggttgtcactgaccatgcttgttctggagaaacatgtacctactaccaaataggggatgtatttgtttgtgagaagactgggcaggttcatgtatgtgacgatacttgtcgagaagtcattttggatcccaacaatgagcttttggtctgcacaatttcaggccactgttttgataggttactgtcaccatccgaaatggaattggatgctgaacagcagcaagctggtggcacagatgaagcagaaccattcttgggatctggtcgctttgcacgagcttacttattaggatacaactgcgaggatgaaaaggagctggaagctgctttgaggttttgttgatccaaatcttttattactttcttttaggtgggtattagtaaatgtctcagtttgagattgatatgtggatgctcttaagtttttcctttattgattctatagttgtacaagatagataattatagttgataatgtatttactatcatgtaaaaaaaaaccgtccccggcttgttcgtttattgtgcaca

SEQ ID NO: 330 - DNA, 3143 bp, Gossypium hirsutum
attggatcctgtaaatgggttccttagaaaatgggatctcgttgaagagagccggtagcaggaacgaaaggcacccgttttcgagccgacccagatcgagattttctcggcttttgctcttcaagaagctagattatctccaatggatttgcaccgttgctgttttcctcttctttgttgtgtttttccaaatgtttttgcccggttcagtaatggacaaatctcaaggttccttcttagatgataaagattcggtatttggagaattgagttatttgaaagagatgggtgcgctagattttggtgaagatatcagattggaaccgtgcaagctattagagaagtttcagagagaaaataaactagtcaatttggattcttcatctggtttcaaccggagtcaacaccgtttccattatagaaaacctcagcttgcattggtgtttgctgatctattggttcacccacaacaattgctaatggtgaccattgcaaccgcattgaaagagattggctatgaacttcaggtatactcccttgaagatggtcttgcacgcaatgcttggcaaagcgtcggagttccggtcaccattcttaaagtcgaacggaatgagattgctgttgattggctgaactatgacggtatacttgttagctctcttgaggccaagagtgtcttttctagttttattcaggaacctttcaaatctattccacttatatggacaatccatgaacgagcgcttgccatacgttctagagaatacacttcaagtggacagattgagcttgtgaatgattggaaaaaagttttctgtcgtgctactgttgttgtcttccctaactatgcacttccgatgatctattctacatttgattctggaaactattatgtcattcctggttctccagctgtggtatggaaaggagagaatgcaatgaatttgttaaaagatagtcagcgtataaagatgggttatggacctgatgaagtactcattgcaattgttggaagtcaattcatgtacaagggcttgtggttggagcatgcccttattttgcaggctttattacccctctttgctgacaataattcaaattcccacccgaaaatcattattttaagcaatgattcaacaagcaactacagcatggctgttgagagaattgctctcaacttgaggtatcctagtggtgtggtgaagcatgtggctgttgaggaagaagtcgacaacgttctgagcatgactgacattgtgatatatggctcatttcttgatgagccatcattcccggaagttttgacgaaagccatgtcccttgggaaaccaatcatagcaccagaactctccaatatcaggaaatatgttgatgacagggtaaacggctatatttttcccaaggagaatattaaagttttgacccaaatcattttgcaagtgatatcgaatggaaaattgtctccattggcacgcaatattgcttcgattgggagagaaactgttaaaaacttgatggttcaggaaactgttgaaggatatgcctttctactggaaaatattctcaagcttccatcagaagttgcacctcttaaggctgttgctgaacttccttcaaagttaaaggaagaatggcaatggaacctgtttggggattttctaaattctactcttggagacaggagtgccaattttttgaacaagttagaggagcaatggaaccattctcgaagggagaagtttggttcattaattgctgtggatgattcattttcatatgaaatttgggaggaagaaaaaaggacgcatattctcgatactaaaaggagacgagaggagcaagagttgaaagatagaactgatcaacctcgtggaacctgggaggacgtatatcgaaatgccaagaaggctgactgtatgagaaatgacttgcatgaaagggatgaaagggaactcgaaaggattggtcaaccattgtgtatttatgaaccttattttggtgaaggaacatggcctttcctgcaccaaaattctctttaccgtggaattggattgtccaccaaaggtcgaagacctgggatggatgatgttgatgggccgtctcgtctgcaacttcttaacaacccatactaccgagacactcttggtgaatatggggccttctttgctattgctaaccggattgaccgtctacacaggaatgcctggatagggtttcagtcatggcgagcaacagctcggaaggcatccttgtccggaattgctgaaacttcattgttagacgccattgaaaagcaaaagaatggtgacgcactatacttttgggttcggatggacactgatccaagaaacaacatgcagagggacttttggtcattttgtgacgccataaatgctggaaagtgcaagcttgcattctctgagactcttaaaaggatgtatggcttagggcaggatttcaactctttgccacccatgcctgaaggagaaggcacatggtctgtcatgcagagttgggccttgccaacaaagtccttcctagagtttgttatgttctcaaggatgtttgtggatgcattagatgcacaaatgtatgatgagcactatcaaagtggtcactgttatctgagtttctccaaggaaaagcattgctattcacgggtgcttgagctgcttataaatgtttgggcatatcacagtgcacgtcggattgtatacgtgaatcccgaaaccggtgcgatgcaagaataccacaagttcaaggatcggagcggtaaaatgtggatcaaatggttttcattcaacactttaaaggtcatggatgaggatttagccgaggaagcagattctgaccacctaaaaagacgatggttatggccatcaacaggtgaggtcgtctggcaaggtgttcttgacagagagagaaatctccggaaccggcaaaaagagacaaggaagcagaaaagcaaggacaaactagagaggatgaggcataaacaccgtcaaaaagcattagggaggtatgtgaaaccccttccagaagatattgagatctcaaattcaacaacagtaacatcagtttaatttcatgtctgttttttgcatctttggcaatagaacctagtttgataattcgaattcttt

SEQ ID NO: 331 - DNA, 757 bp, Zea mays
caatagccatcgaggagaagggagatagaaacgggagggaacacccactcgatcgtcagccatgacccggggagagaaccaggagtcgcaaaccggtaacgtccccgccgcatccgcggcgacgccggggccgaagccggcgtcggcggggggcgggaaaggcgcggagggccagtctgtggtgcggcggctgcagtcggagctgatggcgctgatgatgggcggcgacccgggcgtgtcggcgtttcccgagggggacaacatgctccactgggtgggcaccatcgacggctccgccgggacggcctacgagggcacctcctaccgcctcgcgttggccttcaccgccgagtacccgtacaagccgcccaaggtgcggttcgacaccccctgcttccaccctaacgtcgacgtgcacggcaacatctgcctggacatcctccaggacaagtggtcctccgcctacgacgtgcgcaccatcctcctctccatccagagcctgcttggagagccgaacaacgactcgccgctcaacactcaggcggcagcgctctgggcgaaccaggaagagtttaggaagatggtggagaaaatctacaagcccgccgcgtagaggaggatgacagcgcccggtgaagatgtgggttcttcaagcactgatttcgcttggattgatcgacaagagataatatttggatggtttgggttcccagtctggtgctgtagcgggaaggaatatttgggtcgcctagagtag

SEQ ID NO: 332 - DNA, 2035 bp, Zea mays
cactcctcatcagccatccccaaaaggccaaaacccgcgcacaccggcgacggccggagaacctcctgccggccgccgccatgccgccgcctctacaggcccaccgcctactcatctcccaccgccgcctacccactccagctcgccgccggttcaccgccgcctcttccgtccaatccgctcccaccacaaccttggccccgggccccgccacatcctccatcctctccatccgcgagtcgctcctctcaggagagaggaccgcggcggacatcacctccgagtacctctcccgcctccgccgtaccgagccgaccttgcgcagcttcatccacgtcgcggacgccgccgccgagcgggaggcggaggaactcgaccggaggattgcctccggggagaaggatgcggtgggtccgctcgctggagtgctggtgggagtgaaggacaatctttgcacagccaacatgccctccacgggcgggtcgcggatactggacgggtaccggccggcgtacgacgccactgccgtgcggcggctgcgggaggccggcgctattgtgttggggaagacgaacctcgacgaattcggaatggggagcaccaccgagggctccgcgtttcaggtgacaacgaacccgtgggatgattcacgtgtgcctgggggatcctctggtggttctgctgctgcagtatctgctaggcaatgcgtagtgtcactaggtagtgacacaggtggaagtgtgagacaaccagcgtcgttttgcggtgtagtgggtttgaagccaacttatggccgggtttctcgttttggtctcatggcctacgcttcatcactggatgttgtgggatgctttggttcgtcggtttttgacactgcaaccatcttatctgttgtcgctggccatgacaagatggacgcaaccagcagttcacaggttgttccagagtatgcatcggagttggtctccctagatttactagaatcgaaaccattaaatggtgtgagaattgggattatacaagaaactcttggagaaggtgttgccagtggagtcgtatcatcaatcaagggtgctgcttcacacctggagcagttgggatctgtggtggaagaggtttcactgccttcattttctcttggcttaccagcatattacatactagcctcatctgaagcttcttctaatctatcacgctatgatggtatcaggtatggaggacaggtctcggcggatgacttgaatgagctttatggagagtcccgggctaatggttttggtcatgaggtcaaaatgagaattttgatgggaacctatgctctttctgctgggtactatgatgcatactacaaacgagcacaacaggtcaggacactggttaagcaaagcttcaaagatgctttggaaagatacgacattctaatctcaccagctgcgccgtcagcagcctacaagataggtgaaaagataaatgacccgttagccatgtatgcaggagatatcatgacggtgaatgttaatttggccgggcttcctgcattggttgtgccttgtggatttgttgaaggtggagctgcagggctcccagtgggactccagatgatgggatctccattctgtgaggggaatttgctgagagtaggccacatctttgagcagactctccagaatctcagctttgttccaccgttgttggcagagggccagttgtaacagataatccactcgctgctcaacaagcaattacctgagttacgggttttggggtggctttctgtcattcgcatgcggaggaaattggtagcacgcatgacgcatttagaaaatagaatcttttgctcgtggggtcgctgataattgtgagagagcaacgacacccatgtgatgtacaccagcaaccagcacattgcataccacacagcattttacatgccttcagaatgattgatgattttgtatcaatgctggttttctcaagtgtcaaattttgcatagaaaatattagtgtccctggcagaggtgagtattccaccacc

SEQ ID NO: 333 - DNA, 1926 bp, Zea mays
ctcacccttcaatctttcgttcccaactgcgtttcctcctctgcgtcttcaaggaggggagacctgaaacgaatccagtccaggctggtggctgccggcgctggacctgaacgctggtgcatactgcgtaggcaagagcaggcaatggcggaggcgaatgcggggaaggagaagaaggaagtggtgcggctggagcgcgagtccgtgatccccatcatgaagcccaagctcaccatgaagctcgcctacctcatcgaacatcagtctgacagagaagaattcttgaagctctgcaggagggttgagtacaccataagggcttggtaccatctccagtttgatgatatgatggaactgttcgctctcttcgatcctgtgcatggtgctaaaaaactcgagcagcagaacttcctacctgaggaaatcgacacgcttgagcagaacttcctgtcctatttctttcgggtgatggaaaagagcaattttaacatagtaaatgacgatgaggttgaacttgctcattctggacaatatctgttgaatcttcccattaaagttgatgaatcaaagttagatgacaaacttctgtcgaagtattttaaggagcaccgtcatgaaaacctgcccgacttctcagacaagtatgttatatttcgtaggggcattggattggaccgcactagcaactttttcttcatggagaaagtggacatgatcatagctcgtgcatggcgaaggttccttgagaagacgagactgcaaaagctgttctcaagaaagaaaaatagtaagccaaagatagattccaagaagaatgatgatttagctagtgaaatagaagacaaggagctttatgttgaacgcatacgtcttgaaacaatggatttaagctttgggaatttatttggcaaggtcacaattcaagagcctacatttgaagaggtgattgtcttgtataggagaaaaagtccaaagggccaggatgatagggcaattcatgtaaagcacttcaaaaatatcccaatggcagacatggagttggttctgcctgagaagaaaaacccgagcctcacacctatggactgggttcaatttattgtttctgttgtcattggacttgttacactcatcagttcactggaaatgcctaaagctgatttctgggttgtaattgcaatcctctctgcactggcaggatattgcgcgaagatctatttctcgtttcaacagaatatggcaacctaccaaaacttaatcactcaatcaatgtatgacaaacaactagatagtgggaaaggcacacttctccacctctgtgatgatgtgattcaacaggaggtcaaggaggtcataattgcctactacattttgatggagaatggaaaggctaccagtgatgatcttgacttgcaatgcgaggagttaatccaggaagagtttggcttgcaatgcaattttgaggtgatggatgcagttcagaagctggagaggcttggtgtcattacaagagactctattggaaggatttgctgtgtccctctaaagcgtgccaatgagatcatcggcgcgaccacggaagaactggttatgaaagccaggcaaagctagcaatctattattttgaacaatgtagccgcattgtagattcttgcctgatggcgctgtaacgtttatggttactccagaaagtccaaacatttaactcttgcacaccaggagataagtacattctggtcatctccacagtagttctgggagagctacaagaaaatgtggttgtatttattttttttatttttttggtggggggtactatggtttgtggaacgtcgtcgagggtgttgtaagcatctagcattcttttgataacaagcgtggtaggaaggatgtttgaagaacacatacaagggctattatgttgctgga

SEQ ID NO: 334 - DNA, 863 bp, Zea mays
cagccatggccaccgcctttgactccccgacctcctcccccgccgccgcgcccttccacgacgaccctttcctccatttcgacggctcggcccccgccgccgccgacggcttcccggcctccccggacgcctacgcgccctcccccttcggcatgccccactccaacggcgacctccacgacgaccctttcgccgcacctgctgactccaacggtgggcccatccttccgccgcccaccgagatgggccgcgaggagggattcctgctccgcgagtggtgccgacaaaatgctattcaccttgaggaaaaagagaagaaggagaaggagctgaggagccaaatcatcgttgatgctgaagagtttaagaaagcttttgttgagaagagaaagctcaatgctgagacaagcaagggccaaaaccgtgacagggagaagcttttcctagcaaaccaggaaaagttccatgctggtgcagataagcaatactggaaggcgatatctgaacttatcccacatgagattgctaacatcgagaagagaggggcaaggaaagacaaggagaagaagcctgggatcgtggtgatccagggaccgaagcctgggaagccaacggacatggcacggatgcggcagatattgctgaagctgaagcacactcccccaccacacatgaagccacctccgccacctgccgcagctaccggaaaggatggagcaccagctgccgccgggaaggatggagctaagccagcaaccgttgccaacggcagtgtccctgagatggaaaaggctgctgcggaggcatcagtgccagcggcagcaccaccagcagcaactgagccgatcgcagctgcttaataa

SEQ ID NO: 335 - DNA, 1049 bp, Zea mays
ctgccgcattgcataattcgcatcgaagatcgatgtgaatccgtggaagggagggcggaggagaaggaagaagaggggtcgaggccgaatccgccggtgagaaggggagcgatggcgaggctggcggtggccgcgagggcgttctccgctgcggcctccggcggcggcgtgtccttggtgcagggggcgtcccgggggatcggcctcgagttcgtgcggcagctgctgcgcagaagcgatggaggccgcgtcgtcgctacgtgccgcacgccgggttccgcggccgagctccagaagctcagggaggagcacgcgcccgggcgcctcaccgtgctgccgctcgacgtcaccgacgagagcaccatagaggcagctgcggcctcaatcacggagacccacggttctcttgaccttctgatcaactccgccggcatcctctcgatcccgaacgtgatacagccagagactacgctaagcaaggttcagaagtcgtccctgatgctggcatacgaggtgaacgcagtcggccctatcctagtgatcaagcacatgtggcctctgctgaagatcggaggccgctccgagactaggagagggttcgcgcttgttgcaaacatgagcgctcgagtcagctccataggagacaacgctctgggtggctggcatgcgtacagagcttctaaaacagcgctgaatcagttgaccaagacagtgtcggtggagttcggcaggaaggacaacatcgcctgcgtcctgctgcatcctggaaccgtggacaccgacctctcgaggccgtttcagaggaatgtccccgagggtaaactcttcacgagggagttctctgtgcagaggcttctctccgtcatcgacagcgtcaagaaaggcgacaacggcaagttcttcgcgtgggatggccaagaaatcccttggtgaacggtcatcgtaactcgcttgagtctatagcacagcacacagcagtcaacaacgcccctggttttaatccaacgttgtttttttttcaacaagccaagcgaacagatgcattattt

SEQ ID NO: 336 - DNA, 485 bp, Zea mays
cagggatgtcgaagagcacggaaatcgcagataaagcaatcatcttgatgcaggatcatgccaagcatatctatcgtatttgcaatgagaagctaatattgggtaaaggattgactgcatttgaggtcaaagaacttcgtgaagcacttgaattcgccgccgaaggattggaccaggactcccttttttgccaagaggaattggatgcaactgttaaggaggaacaattggagcatgacgagaaggtggcttcacagatgattgaaagcccacttcttctcctgattcggactgcttcctatcccttgaagagcacattgagaagttttggggcgttgattacaactcggaccagatgcctagctactccgactaggctcagagtttatggtgctgtgaaattctggatgtttgggtgtaatggtattttggatgtgtatgtgaactgtaattctggatgtgtggatgtaatggtgaactgatga

SEQ ID NO: 337 - DNA, 562 bp, Zea mays
tccagtttccaccgtcaacagacgatggctatcgccgccgttcgccggcgtttgtggcgcgggctggggactgcggccgccgccgcggcctcggggacggacgggaatctgctcgctcgcctggtctcggagccggagtgccgtgtcaaggcgaccatggaggaggctgcctcctccgggacccaccgcgacggcgccttctgggagccccccgtcaccgcgctcttccgcgcgtcgtctccgaccaaggcgcacctcgactaacagacactaggctgcaaactgtgggccatgaaaaaatggagagacttgatgaatccatgtgacatgcagcaccaaccaagtggtccactttgcacctgatgttcagaaacagtaacagtaaccggtcaccagatctggtctacagatcatgctccaccaaatcttatccgccatgataaaaatccaagttgcgtcgagtgggcacacacaaacaccgcacagtttgtttatctagaaatttacatctgattttagggcaaccaaaggtaatccacagtagctggttctcacatgcttg

SEQ ID NO: 338 - DNA, 1897 bp, Zea mays
gatcttgttgggcacactccgcctccgcgcgcgggaagagagagagagagagagagagagagagagagagagagaaggacggagggtggcagggccgccgcgccggtgagccgacccccagccatggcattgccggctccccccgtccgcctggcgctgctgctgctcgtcgcgctgccattctgcgccgcgcatcccgggccgggggccttcaacgctcctcgccacttccagacgcccgcgctccactctgatggatttggcttggtggcaagaaggtcgattgctgaagctcctgctgacatcaacgtcactacgaatagctcctttgtgctggcggcagataggacatatcgaagggaccctttgaatggcttcaggaaatacccgggcggctggaatatcagtgaagtgcactatttcgcttccgtcggatatacagccattccgctgttcgccattgctctcgtgtggtttgtgatctttttcctggttatgcttgggatttgctgccgtcattgctgttgcccgcatcacacctacaagtattcacgaacagcatatgctctatcattgatacttctaatactgttcacatgtgctgcaattgctggatgtgctatgttatacgatggccagggaaaattccacaagagcacaacaactactctgaagtttgttgttagccaggcaaactatactgttgacaaccttaggaacctatctgatagtttgtctgctgcaaagaaggtcgacatagcacagtcctttttgctgcctcctaatgtgcaaaatgagataaatgaaattcaaggaaagctgaactcatcagctactgatcttgctattaaaacaacagataatgccgcgaagatcaaaaaggtgctaaacagagtgcggcttgctttagttgtcattgcagctgtgatgcttcttctggcatttgttggcttcttgttatccatctttggtctggaattccttgtctctgtcttggttattattggatggatattggttactggaacgtttatcctgtgtggtgtatttcttcttctgcacaatgtcgtttcagatacttgcgttgcaatggaagagtgggttgctcatccgacagaacacacagccctggacgaggttatcccctgcgtggagcctgccacggcgaacgaatccctgtacagaagcaggcaggtgacgttcgagctggtgaacgtggtgaaccaggtgatcaccaacgtgtcgaacaggaacttccccccgcagctgacgcctttgtactacaaccagtcggggccactgatgcctctgctctgcaaccccttcacgcctgatctgagggaccgcaactgcagcagaggagaggttaccttggacaacgcaacccaggtgtggaagaagtacgagtgccagagcaccaccgtctcaggaggagccgagatctgcgcgacggtggggcgtgtgacccccagcatctacgggcagatgaccgcgggcgtgacggtgagccaggggctgtaccagtacgggcctttcctcatccagctgcaggactgcaccttcgtgcgcgacaccttcacgaccatcaaccagggctactgcccggggctggagcgctacagcaagtgggtgtacgtgggcctggtgatggtctcgttggcggtgatgctgtcgctcatcttctgggtgatctacgccagggagcggcggcaccgcgtgtacagcaagcagcaccagccgtacccggtggaggacaagccggcggcgacggtcccgggcgcttgaattgatatggcccgcccgttccagtgctccggcctactcccgtgccgctgtgcatactgtactccgcgcgctagttgggttttacgtggtggtgtaggtggatgatgtaccc

SEQ ID NO: 339 - DNA, 1362 bp, Zea mays
aaaggatccacctcgccacccaaattcatcaagctcaacacgatctcgattcgattccagttcatccatccaacgcctcccgcctgtacgtatagaagaaagaaggaagaaccgtcaccgtacgtcctcgccagtacaaataatggccctgctcaaagccgcgcgcgtcgccgatgtgcccaccctggacgtggtggtggcccccggcctggtggcggttgccaaggcgaggagcgccgcggcggtgggcggccggttctcggtgatcgggcaccgcggcaaggggatgaacgcgctggcgtcggaggacccgcgtctgcgggaggtccgcgagaacacggtccgctccttcaacgacgccggacgattccccgtcgactacgtcgagttcgacgtccaggtcaccaaggacgggtgcccaatcatcttccatgacaacttcatcttcacacaagacgatggtaagatttcacaaaagcgtgtggccgatattcagctggaagacttcctgcagtatgggctccagaatgagcaggggaaggttggcaagcccctgcttcgcagattgaaggatggcaggatggtgaactggaacgtgcaatcagaggacgctctttgcacactcgaagaagcgttcgagaaggtcaatccaaggttgggcttcaacgtcgagctgaaatttgacgacagtcttgaatacaccgatgaagagctcactcgcatcctccaggccatccttaaggtggttttcgagtacgccaaggacaggcctatacttttctccagttttcagcccgacgctgcgcagctcatgcgcaaattgcaaggcacataccctgtctacttcttgacgaacggagggacggagctatacgccgacgtgaggaggaactcgctggaggaggccgtcaagctgtgccttgccggtggcctgcaaggaatagtttcagaagcccgcgggatcttcaggcaccccgccgccgtgccaaagatcaaggaagctaacctctccctgctaacctatggaacattgaacaacgtgccggaggcggtttacatgcagcacctcatgggagtgaacggggtcatcgtcgacctggtgccggagatcaccgaggcagtctctgagctcatcgccctgcccctgcccgagcccgacctggaagtgggcagcttgagcaaccaggcggcagctagaggagccacaactccgaatttctcgcagcgcgagatctcgttcctgctgaggcttattcctgagcttgtccaataatgcctagacttcctggtgttctgtctgtctatcatggatgaattgactaatgtgttactgatgtactgatccgcatacaactcgagttt

SEQ ID NO: 340 - DNA, 919 bp, Zea mays
agtccctgaaacgaaagagttgcgggggtaaaagaaaaaaaatatctagaaccttctctcgttcaagcccacagaatccaccaagccacggcgtcaccgccagcgccactgccatctcggggaaggaaccgaacgacccctgaaaagaattcggtgcgtcggaaggaagagcaaccctgcggtggtggagcgaggacccgggttgagggatgtggtgggagtgggagggcgacggtggtgaggcgccgcgggaggagactcctgtggacttcgatttcatcgccctcctcgccaagcccaaggattactacaagatactggaagtagattactatgcgtctgaggagacgatcaggtccagctatatccgccttgcactgaaatggcaccctgacaagaagcaggggcagggcgaagagaattcaacctccaaatttcaggaaattaacgaggcataccaagttctgagtaatccagcaaaaaggcaagagtatgacaaaaaaggcattctatacgttcaagatcagaatgtagtggattacctgaaccggcacaaggggctaatacttacgtgcaatggtcttggtataaggtactcagtatggtgaacacgctcaagggcccacagtttgcactcatctgcagtcttggagaatctgtaatgtatgccatcaaaatttattttcatcccttgtgtgccatagaatggcatatatggatttttgtgtgtatgacaggtggggccagtggggatgaaaataatttctgatgacatacagggaagcctttgatctgaaaatggtatagtgcagcagtgccatgtttgaaagccaaatattgaccacttgagttcatcctacaaggctacaacagagttgatttttatttgtcgatcagctgttgttgaatgaaagaggca

SEQ ID NO: 341 - DNA, 2636 bp, Zea mays
aaatcatggatttgtttacaattgactcggatagtgagtcatatactgggaccagtgacagtgaagaccaagaatgtgaatttacatatagtgaccatgcccaaaacatcttgtccagtctggatgagagcattggcaagattgataattttttgacttttgaaagggggtttctgcatggggatatagtctgccctgtttctgatccctcaggtcagctgggacgtgttgttggtgttgcaatgtttgttgacttggagacaagctcaggtgacataattaaagatgtaaacagcaagaagctatcaagagtgagatcttttgtttccggtgactgcgttgttatggggccatggattggacgagtgataagagcatttgatcttgtcacacttttattcagtgatggagcaaagtgtgaaatcctgttaagggattcggatgtactgaagcccattcctcctgttctttttgaagatgcaccttacttttattatcctggccaacgtgtgaggatagtcgatccgtcagtttccaagtcagcaacatggttatgtggatcatggaggcccagtagagatgatggtattgtctctcatgtcgatgtagggctggtgcatgtgaactggatcacatctgtaaccaatgtttggggagataaatcatcaagtcctccaaacattcaggacccaaagaagctcaccttgctgtcatgtttcccttacgctaattggcaactaggtgattggtgtgctcttatgactgacaacaatggatgcctctggatggattctggcaagtcttgtattcttagtgaagaccagaagtgtgactctcatgcacacatgtattttgaaagttatggttcagattgttctcaaacatttgttgttgccaagacaaagagcactgttgatgttctgtggcagaatggaactgtatctcttggtctagaaccccaggcattactccctgtgagtacccttggtgaccatgatttttggccaggtcaatttgtcctagaaaaactgactgtagaagatgctgcaagatgtccgcgaacggcaatagtgagtgatgtggatgcactggagcgaacagtaaatgtaaaatggattggtccagcacatagtgacattgtcagctatggaagtgaccctgcagtggagactgtaagtgtttatgagctagtagagcacccagatttctccttctgcactggcgaggtcgttatcaggtcagctatgaacatagacaagtctgaagcagatcccacaaatgggtcattggcaagcaaagaatcattggttacctcctctggcttcttatcatgcaccggaaatgtacttgggtacaaggacaatggaattgaagtgcaatgggctaatggtgttatatccaaggtgcaacattttgagataattggattggacaagcttcttgataatagttctgtagaatcaatgaatgaggaacatacaattggtgattcattagacgaggctgagcaggaggaattgaaccatgaggtctgtttgtttattgctctggagtctactgaagactgcactggctccttgtgcaaagccactgcttttctatttcccaagacagcttttgacttcctgacaaatgtggctgctagtttgtttggtattcatggttctccatctccaagctcagttttggtagatcctcgatatgaaattgtgaagatggcagaaatgcagccatgtgcagaagaaacaccaaaagaagaacagatagtgaagtttgtggcgcagattgacaagccaattctctcttcagaagatgccatctcaaaaagattcgatgtagtcactgactgtttggatcatcattttgtgaaggaaaatggccatgaaagtgttacaagaggttggttgaagaaggtgcgactggaatggaacatcctgcaaaatgacctaccagatggtattcatgtgagagtttatgaggaaaggatggatcttctgagggcttgcatcgttggggcacctggaacaccttaccatgacaatctttttttcttcgatattttctttcctcctgattacccccatgaaccaccttctgttcactatcactctggtggtctccgcctgaatccaaatctgtatgagtcgggaaaagtgtgcctcagcctcctgaagacatggacaggcactggtaacgaagtgtggaatgctgagagctcaactgttcttcagctgctgttatcgcttcaggcccttgttctcaacgaaaaaccttacttcaacgaggcgggatacgacaaatttgtgggcaaggctgatggagagaagaactccatcacgtacaatgagaatgccttccttctgtcatgcaaatccatgatgtatgttttacgcaagcctccaaagcattttgagacgttggtcaaggagcatttcacctgccgtgccccgcacatcctggatgcctgcgaggcttatcttgggggcgatctcgtcggacacgcgcacgacaaagcatacgtagcagaggacggcaacaagaactgctcaaccggtttcaagataatgcttggtaagcttctgccgaagctcgttactgccttctgtgaggccggtatcaccagcgaccggtaataa

SEQ ID NO: 342 - DNA, 1054 bp, Zea mays
aaaggatcccaaagcatcttgagtgttcgacagcgagccatggagaagacgtccgagaacgccatcccgccggcggcatccccgctgatgctgttcgggtcgtgggcgagctcgtacacgcaccgcgtgcagctggcgctgcggctcaagggcctggagtacgactacgtggaggaggacctggggaacaagagcgacgagctgctgcgccacaaccccgtccacaagaaggtgcccgtgctcgtccacggcggccgcgcgctcccggagtccgtcattatcctccagtaccttgacgacgcctggccggagacccgcccgctgctccccgccgacgccttcgaccgcgcgctcgcgcggttctggtgccacttcgccgacgacaagctcgggccggcggtgggcgcggtgttcgcgtcgacgggggagggccaggaggcggcggtgcggcaggtgcacgagaacctggcgctgatcgagtccgagctccgcgacggcgcgttccggggccgccgcttcttcggcggcgacgaggtgggcctgctggacgtcgtcctgggctgcggctcctactggctcgccgtgttcgaggaggtgaccggggtgcgcctcgtggacgccgacgccttcccgcgcttccacgcctggctgcgcgacttcgaggccctggacgaggtccgggagaccatccccgcggtggaccgcctgctcgagtacgcgcgcggcctccgccacatgctgctcggcctcgcgggggccggcgccggcgccggcgcggacgcgccctccaccgacgcccccgccgcaccgccggcctcggctgacatcgccgtcgacatttgaacgcagggcgtcgtcgcgccgggcgtctgccagcgccgtccggctagccatcagtagctagtacgtagtaccagtatagtttgcagagtcgattgcgccatgtgtggtggctgcgtgcctgtgcctgcctgccggcctggcctggagtgcggttctgctgccgccacagttaattggcccagtttgtctagctgtcgagtttggtaccttt

SEQ ID NO: 343 - DNA, 3350 bp, Zea mays
ccacaatggctttagctcatgccagcgccatgtttcctccctcgagcccctcacataaaacttgggaggacccgtcattcttcaagtggagaaagcgtgaggcgcatgtaccactgcgctcacaggacacgctggaagcggctctgaagtattggcatgaacggaggaatgtgaactatcacaatgctgacactgctgtctggaacgatgacgctgttcgcggtgctctggaaagtgctgccttttggtccaagggcttaccgtacgccaaatctctaagcggatactggaaactccttctgtcgccttcagcggaaagtattccggagagattctattatgctcattttgatgattcaaactggtcgggtttgccagttccctcaaattggcaaatgcatgggtttgaccgtccaatctacacaaatgtcacatatcctttcccattgaacccaccatttgtgccggctgataatcccacaggttgttacaggacagtctttcacatcccaaaagagtggaaaggtcggaggatcttgctgcactttgaagctgttgattctgcattctttgcttgggtaaatggagtactagttgggtatagccaggatagcagacttcctgctgagtttgaaattactgattgctgccatccttgtgattcggacaaggaaaatgttcttgctgttcaagttatgaggtggagtgatggctcttatcttgaagatcaggatcactggaggttgtctggtattcacagggatgtgctcctactatcaaagccacagatttttatcacagattacttcttcaaagcaaccttggatgaaaatttcagtttagccgatattgaggttgaggtggagattgactcacacaagcaagaccaggagcacgtcccaactttgtctattgaagcaacactcattgataactctggactatctaacagtatagatgctgatctttcatccgctaatgcagtcaatttgaaaccgaagccaaaacgaactcgaagcccttgtcttggttttcatggttatgtacttggtggaaaaatagaaaatccaaaactttggtctagtgagcatcctaacttatacacgcttgttgttctccttaaagatgccaatgggaagcttattgactgtgaatcatgccaagtgggcattcgtaatgtggtcatggcacacaagcaaatgctcgtcaatggatgtcctgttgtgctaagaggtgtcaacagacatgagcaccatccacgccttggaaagacaaatttagaagcatgcatgatcaaggacctgattttgatgaggcaaaacaatatcaatgctgttagaaatagccattacccacagcacccaaggtggtatgagttatgtgacatttttggtctttatgtcatagatgaagccaacattgagacacatggttttgatgaatctaacactttcaaacatcctacacttgaacctatttgggcaaatgcaatgcttgatcgtgttgttagcatggtggagagagataagaatcatgcatgcattattgtttggtctctaggaaatgaatcttcatatggacctaatcatgcttccatgtctggttggattcgtgaaagggatccaacaagactcctccattatgagggaggtggttccagaacatcatccacagatattgtgtgccccatgtatatgcgtgtctgggatgttgttaagatagcaaaagatccatctgaaacaaggcctctaattctttgcgaatattcacatgctatgggaaacagtaatgggaatattgatgcgtattggatggccatagacaacacttttggactccaaggaggttttatatgggactgggctgatcagggtttactgaaggaggactcagatgggtctaaattttgggcatatggcggcgactttggagatactccaaatgactccaatttttgcctcaatggcattgtgtggcctgatcggacgattcacccagctcttcatgaagtaaaataccttcaccagcctatcaaaatatcatcagcagataatatgcttaagattgaaaatggacacttttttgagacaacagaagctttggacttcagttgggttcttcatggagatggttgtgtcttgggctctggtccattgaatattccaactttggcaccacaaactagtcagctcatcaacatggaatcatcaccttggtttgccctttggagtgcctgtgcagcaaaagaagtatttttgtctgtgaatgtgaaacaaaggcatgaaacacgatgggctaaagctggtcatctcttggcttcagcacaactgtgtttgcctcagaaaaatggctttgtccccagcgtgatagcattgtccagtagccctttggtctgtgaacgcattggtgataatgtaaccatctgcaagaataatgcctggaaaattaaagtaaacagtcagttgggaacaatcgacagctggaaggtcaacgacgttgagcttatgagcaaggggatactcccatgcttttggcgcgcaccaactgacaacgacaaaggaggtttcttcaccaagccatatgactcgcgatggagagaagccttcctcgacaatgtctcgttccacagcagccagttctctgtcaaggagttgccggacaacaccgtggagttctccaccctctactacggtgttcccgggcacctacccaagcctgacgacgaagcctccgagtccattctcttccgggtgaagatggtatgccggatccacgggtcaggcgacgtggttctcgactacgaggtaaaccccaggagcgacctccctccccttccccgggtgggcgtcgtgttcagcgccgggaggtccctgagccacgtcacgtggtacgggcgcgggcccttcgagtgctacccggaccgcaaggcggcggcgcacgtcggcgtgtacgagagcagcgtggaggagctgcacgtgccgtacattgcccccgtggagtgcggcgggcgggcggacgtcaggtgggtggcactccgcgacgccggcgggctcggcctgtacgcgtcggcgcacggcggctccccgccgatgcagatgagcgcgagctactacggcgccgcggagctggacagggcaacgcacgtccacaggctggtgaagggggacgacatcgaggtgcatcttgaccacaggcacatggggctgggcggcgacgacagctggtcgccgtgcgtgcacgagcagtacctgctgccgccgacgcggtacgccttctccctgcggctctgccccctgctgccgtcgtcgtcgtgccatgacatctacaggtctcagctccccagctgataa

SEQ ID NO: 344 - DNA, 589 bp, Zea mays
gtccctatacgtcgttgtccagctccccgcatattgtggcctggtgcagattggagatccgcccggacttggatcgagtcctcctgtctttggacattcattggagtgctccattcattgaggcagcatgcctaagataaagacaagtcgtgtcaagtatcctgaaggatgggagcttattgaaccaacaatccgtgagttggatgccaaaatgagagaagctgaaaatgatccacatgatgggaagagaaagtgtgaagctctctggcctattttccgcatttctcatcaaaggagccgctacatatacgatctttactacagaaggaaggagatatcacaggagctttatgagttctgcctagaccagggttatgcagaccgtaacctgattgcaaagtggaaaaagccaggttacgagcgcctttgctgcctccggtgcatacagacacgtgatcacaacttcgcaacgacctgcgtctgccgcgtccccaagcatctgagggaggagcaggtgatagaatgtgtccactgcggctgcaggggttgtgccagcggtgactaatcttgtcatcatgtcgttcggtag

SEQ ID NO: 345 - DNA, 2313 bp, Zea mays
tcgaatctctccaccgtgtaacacacagccttgacggcaggcccgccaccgcgagatgcctcggaagtcgcacaaggcgaggggcgcggccgcgcacgccgccgttggtctcacggccgggccgaggcctcccctgaaggccacggccccaaaccctagcgccgccgccgagcttccccaggtcgtcgttgccgagacagagggcctcaaggtacctgacgccggggcgtccgccgccgctgacgccctggagcgcctccacgtcgcccctgcttccgacggtgatccgccgcctcccgagcccgtgcacgagcccgccgcgccgcctcagcccccgccggccgaggcgtcgtcttctgggaggtctgcggcgggcgggagttgggaggaggaggctgtaaggaagctgcgggagctggcggaggttagtcgggatgagacggagttgaccgaggaggaggtgcgcgccaatgatcagaggcaggaggacgagatctgtgccctcgaagcaatttttggagatgctgtagtgattttggacagaaagggaggccagcggtctttccaggttcttgtgcatattgaggttccagattatatagatgtatcaacaaagctcagttatggtgatggaacattaaattatgcgtcaacacatgatgatgatgaccttttctacaagttcagagttgagcatttgcctccgatcctgctaacatgtctcctgcctacatcatacccaagtcaccgtcctccctttttcactatatccacatattggcttgataaaggcatgatttcaccattatgtcgcatgcttgacatgctttgggaagagcaacaagggatggaagtaacatatcaatgggtgcaatggctccagagttgttccctttctcacttagggtttgctaatgaagtagttttgagaaagagtgatgtaacatgttatgcagatggtgaagataagcgtgcctgtccagattacgcttcaccagatgttataattccaaggatgatgagatacaatgacaataagcatcatgaagctttcttacatgctatccatgattgcatgatttgtttaagcgagtgtcctggtgttgatttcatcaaacttccgtgtcaccatttcttttgctggaaatgcatgcaaacttactgcaaaatgaatgtcaaggaaggaaatgtagtgaagttgctatgtcccgatacaaaatgtgaaggtgctgttcctccgaatgtattgaaaaggctgcttggagaggatgaatatgaacgttgggagggattattgcttcagagaacccttgatgcgatgaaagatgttgtctactgtccaagatgtcaaactgcttgcttggaggacgtaggtaatgaagcagtatgttcaagttgtttgttcagcttttgcactctctgtagaaatcgccgccatattggagagcaatgtatgtctccagaagagagacttatgatcttggagaaacgccaagaatctgggaatgtgcaaggagatcagatgaaagttctacaggaactacgcagcctgaaggaaattatgaaggattcaaaacagtgcccaaaatgcaggatggccatatctaagacagaaggatgcaataagatgcattgtgagaactgtggggagtacttctgctatcaatgcaaccgtgcgatcactggatatgagcatttcaggggttcgtgtgtgcttttccctcaagaggaattggacagatgggaaatgcaaatgaatcaaagggtcggacgccaaattgttgcacatgctcatgctgcaatacatgggcagaatggtcaagctcatccttgccctacatgtcggcaaccgtctccaaagatcggaaacaacaaccacctcttctgttgggcatgccagaagcatttttgtgccctgtgccataaggctgtccaaaagcccgcacagcattacggccccaaaggatgcaagcaacatacggcagatccctgaatgaggttttcccatatgtgcatcaacaccgtggtgccagggcagtttccatgtgttctgtgcaagtacagataaatacttgtcagataaatacttgtcctgggacgtacttcactcctggattccattattattattatttttgctgcaagcatgttttgaagtttccgtcgtcgttgtacctacagtaacaattgtgcagtttacattcgggaacatgaacaggaactgttcattcattcgttcagtaccagatgaattgttgagaatactcgggtgttgaagttgagaatactcgcgtattaaagatgcgattgaac

SEQ ID NO: 346 - DNA, 1600 bp, Zea mays
aaaggatcccttgcctctgctgcgtataaagtttcttccttccttggccgcttctgcgctcgccttccttctcctcccccatcctctcccttgtggttctagatccactcctccccgtgctcacggctcatctgcgaacaggttgagcggggacgccgtggaggggcgagggggagccagattgagccatggcctcctcctgggttcttgccctggttcttgcgctgtcggcaggcgcaagcctggcgcgtggctccgagccgtggtggaacgagacgcaggtgtacgccaccaccgccaactccggtggcggcaacggcgtcttcgtcggcctcacgctcatccagtcggcggcggccaagggagcggtgtgcttggatggaagcttaccaggttaccacctccacagagggtttggatcaggagcaaacagttggctcgtcaatctcgagggcggaggctggtgcaatgatcgcagcagctgtgtgttccgcaagggcagtcgtcgtggatcatcaaatcacatggagaggcaactccagtttacagggatattgagtaacaaacctgaagagaatcccgatttctacaactggaatagagtgaaggtccggtactgtgatggtggatctttcactggtgatggctctgatgcggctgcaggcctttatttccgaggtcagcgcatttggcaggccgctatggatgacctaatggcccaaggaatgcgttatgctaatcaggcccttctttctggatgctctgccggtggtgtttctaccatacttcactgtgatgaattccgtggattgttcccatcaaataccagagtcaaatgcctagctgacgctggaatgtttcttgacactgttgatgtttctggccgccgggaaatgagatcctttttcaatggtattgtgagattgcagggttctggaagaagcttgcctaggtcttgcacctcacacatggacaaaacctcgtgctttttcccccagaatgtgttgccaaccatccgaaccccaacttttgttttgaacactgcctatgacgtgtggcagcttcaacaaagtgtggcccctagaacagctgatccccaaggtctttggtcaaagtgtaggacgaaccatgccttctgtaatagcaaccagctccagtttttgcaagggttcaggaaccagatgcttgatgccgtgaggggtttctctgcatcaaggcaaaatggtctgttcatcaactcatgttttgctcattgccagagcgagagacaggatacttggtacgcgaacaactcgccacgtcttggtaacaagaaaatcgctgacgctgttggggactggttcttcgagagggggaacgccaagtacacagactgcccatacccttgcgatggcacttgccatcaccttgtgttcaggggagaccactaagatcattcttcagcaccaacaaattcatcagatggtacaaggatcaaaccccaatgggtacagaatggaaaacagggtatagatacagataaggtgcaagtggtcggcttgcccatgtttgttcatcagtgagtcatatgattgatagtgcgaggacctcaggtaccttt

SEQ ID NO: 347 - DNA, 1698 bp, Zea mays
agaaccctaaacccgcatcccgaacattgacgccggcgatctccgccgccaccgccatgttcgggaccccatccatcactcccgctttcgggaacccctccagcaccccggtttttggcacgccatccgccacccccgcatttggcgcgacgtcgtccaccccggccttcggcaccctctcgtcgacgcctgccttcggcaccccttcgtcgactcccactttcggtaccccgtcgtctacgccagcgttcgggaccgcttccacgacccctgcgttcggggcatcgtcgtcgacgccagcgttcgggaccacttccacgaccccgccgttcggctcgctgaatttcgggacgccctcgtcgacctcagcattcggcacgccgtcttcggcgccggcgttcggcgcactcaatttcggaacaccctcgtcgacctcggcattcggcacgccctcttcggcgccggcgtttggcgcgactccttcgccctcgccctttgggttccagcagcaggcgacgccgtccccatctccgttcggcttgctaggaggtggcggcgcgcaaatcaccacccagatggcccccgttgcgccgctgccgctctccccgtccgaccgcgacatccaggccattgtggatgcgtacaaagaggaccccggtaatccacgttatgctttcaggcatttgttgttcagcgtgacagaaccttcccaaagggtgaagccagttgctgcctcagatattatgtgggcagaagcaatggggaaacttgaatgcatggatagtgcagacagggagaggctgtggcctcagcttgtgcagggttttaaagacctttcccatcggcttaagcttcaagatgaagtccttgtttccgacactgatagattgagcatgactcactctaatgttaaaaagctgcaaaggcatttccaagctgacacgtatccttggatccagcgattgaagcaacaagagctggctattcagagacgtcttttaaggtttgttagaatagtggaggcattggagaatcggggctaccgctgtcctttaacaaaggaggaagctgacttgtatgaaagattggttgctatattaaagcggctaaaaggacataacgctgatctttctaagagggtcaatacacttgtttcgacgtcgcgtcttctggctagcagtggtggtgctggtggttccgtttatattcccagttctgcaaaagttgatgagcggagtgttacagagcttcttgaggccttacaacaacaaacagaggcagttgccaagctaggtaatgtgttgaagagggatatcagggacatggagatcatccagtcagaaggcacggatatggctgaagacaatgtggggagaagggcacagaaaatataagattgaagcaaggtctttgtcgtagctaagtaataagcgggtgatggaaggaatccatcgtcgctagaaggatctgagcctccaacttatttggagtaatgggccagggaaatgatatccctgtgtaactgctgcaggcaagcttgattctgcattctttgggaagctaaccatggtcaattagtagtggtatgtgtagattgtatgttgaactgaggcagtattcttagaactcagctttctcctcgtgccaacgacattttcagtgctgttttgttgctcaccgtgattcgttgagctgttt

SEQ ID NO: 348 - DNA, 1363 bp, Zea mays
acatcgaaatctccgcctcctccagtcctgctcgctccccacctctcatggcggcgccggcggccacccgcctccactccccgttcctcctgcttccttccccaccgcacccccacccttcacttcgcctccgcttcctcctgccgtccccgccgccgctccgcctccgccgccacttcccgctgctggctgccgccgccgtatccgccgcagccggcgccggcggtggcggggaggaggtcgccgctaggaaggacgacaaggccaggcagctgcagaagcgggtcctcgtgggcgtcgccatcggggtgggcgccggcggcatcgtggtcgccggcggccgggtgttcgccgccgccgtcgcggccgccgttcttgccggctcccgggagtacttcgagctcgtccgcagcactgtagccggaggcgggaccccgccgccgcgctacgtgtcccgcgtctgttccgccatctgcgctctcatgcccatccttacgctgtactatggacgcatggatgttactgtggcgttttctgcattcgtcattgcaatagcattgcttttacaaagaggaaaccctcgttttgctcagctaactagttcagttttcgggttattttactgcggttatctaccttctttctgggttaagcttcgatccggactagctgcccctgccttaaatacaagcatagcatacaattggccaattcttcttggtggacaagctcactggacagttggacttgtagcaaccttgatggctattagtagcatcattgctgctgatacatctgctttcctttgtggaagggcatttggtcgtacccctttgactaacataagccctaagaagaccttggagggtgctttagctggcctagctggctgcgtactgaccactgtgctgctgtcgactgccttacgctggccaaggtcgcttttgagtgccacagcttatggaatcctgatcttcctgggttcgttattcggggatcttgttgaatctctgatcaagcgcgacgctggtgtgaaggactccggatcgctcattcctggtcatggtgggattcttgaccgagttgacagctacgttttcacgggggcactttgctactcttttgtcagagtggctctacccctgtacggggtctgattagagcaccggccttcttgttgttttgcctttctccttccatcagcaatgcggtcagtcaccatacattttaacatgcaacgatgagtatttgctgggatgccctagatcagttcttcatctcaagacaacgtggtcttccctccaagcgaatttggtggccactagctcgtcatcgacattgcttcttgctttgggtttgagat

SEQ ID NO: 349 - DNA, 648 bp, Zea mays
ccaagctaaggaggtgagaatctctgtaaaacgctaaaggaaaaaaaaatgaaaggatccagcgagcatggcgagacctcgaagcaggcgcccctgggcagcaggggtgtcagcaaaggagtgtccgtgcttgatctaatacttcgcttcattgccatcatcggcaccctcgctagcgccattgcaatgggcaccaccaacgagacgctgcctttcttcacgcagttcatccggttcaaggcgcagtacagcgatctccctactctcacgttcttcgtcgtggcgaattccattgtctgcgcttatctcaccctgtcgctcccactatctatagtgcacatcattaggagcagggctaaatacagcaggctgctcttggtcgttcttgacgcggcaatgctagcattggtgactgcgggagcatctgcggcagcggccattgtgtacttagcgcacaaaggcaacgtcagagcaaactggcttgccatttgccagcagtttgactcgttctgcgagcgtatctctggatccctcgttggttcgttcggagccatggtcatgctcgtactgctgctactactctccgccattgctctagccaggcgctaggcggtgcgtgttgcggttattcgactccgctatccttag

SEQ ID NO: 350 - DNA, 2717 bp, Zea mays
cgggtctatagccatgtcaccagcggttgcctctgcctcatctggcgaccgcatacgaacctacgaagacttcgtgcgggtacacgcgtacctgctggccgcggcgggcatcccgccgtcgctgcaccagaggctgtaccgcaagctcgcggacgaggtcttcgacggcggggaggtctttgccgtcgagccgtgcgaggacgggaggcagcggcgcctcgtgctcaccgccgatcagtctctaggaaaagagtccgatgtcttcctcgtcgaccatgcgtggtccttccgcctccctgatgcgctcaagcagttgcgggaagtaccaggattggctgaaaggatggcagcattgatgtgtgtcgatttggaccgcaagattgaagaagatgagcaggatgatgacgagagtgggagcttggagcatgtatcgcaagtagtcgagaaagaaagggctagagttcaggagagaagtgattctacagcttggctggaacttgaagaacttggaattgatgatgacatgctagtagccttggatctatctgcaaattttccgaatctagtagctctgaacctatggggaaacaagctgcgggatccagagaaagttatgcaagaaatcaggaagtgcacaaagctaaaggcactttggttgaacgagaatcctgttcttggcaaaagtattgacaaagctgttctcgatggcctctctggattggaaatatacaattcacattttacaagtaaagccggagagtgggcactaggtttttgcgcagacattgttggagtagataatccctgttcttctgtggaaagcacattgtttgggagcattgggactattgacctttctgatagatgcattcacaagctaccagaggtgttctctcctagtaaattgccatctctgtcaaaattgaacgttcgtggtaatcctctggatcaaatttctggcgatgatctcttaaagctatttggtggattcactcagttacaagagttggaggttgacattcctggccctctgggaaacagtgcaatctccattcttgagtctcttcctaatttatctttgctaaatggcgtggattcctcaagcataatagagagtgggaagcatatagttgactctgcacttgaaccacggcttccagaatggtcacctgaagaaccccttgctgaaagagttattggcgcaatgtggttgtatcttatgacataccggcttgctgatgatgaaaagattgacgaaacacctgtttggtatgtcatggacgagttgggctcagccatgcgccacagtgataatgcaaacttcagaatagctccattcttgttcatgccagaagggaaactgcacactgctataagttacacaattctgtggcccactcatgatgttcatactggagaagagtgtacccgggatttcttgtttggtattggtgaggacaaacagcgttcagctaggcttacagcttggttccgcacacctgagaactactttattcaggaattcaggaggtaccaggaacagcttcaatcaaatagcatttgttcttcgacaaaaatagaagatacacagacaccctcaaccaaaagtgtacgcccaagggatggtcgcgtccttcgagtatatactgacatacctcatgtagaggagtttttaacacggccagaatttgttctcacgactgatccaaaggaagctgacatcatctgggtaagcatgcaagtagattcagaagtaaagaatgctgtagggctcacagaccaacaatacacaaaccaatttccttttgaagcttgcctggtcatgaagcaccaccttgcggagaccatccacaaggcttggggctcacctgaatggcttcaacctacatataacctggaaacccatttgtctccactcattggtgattattgtgtgaggaaacgagatggcatggacaatttatggatcatgaagccttggaacatggcgagaacaatcgataccacagttactggtgatttgtctgctatcatcagacttatggagacaggccccaagatatgccaaaaatatattgaacgccctgcacttttccaaggaaggaagtttgatcttcggtacattgttttggtccgtagtatccgccctttggaaatatttctgtctgatgttttctgggttaggttagcaaacaatcagtacactttggagaagactagcttttttgagtacgagacccatttcactgtgatgaattatatcggaaggatgaatcatatgaacacgccagagttcgtcaaggggttcgagaaggagcaccaagttaaatggctggacattcatgaaagcgtacgatctaccatacgccatatctttgaggcagccgcagctgtccatcctgagatgcagaacccattctccagggccatctacggtgtagatattatgcttgacaacagattcaaaccaaaggttttagaggtgacatactgtccagactgcgggagggcatgcaagtatgacacgcaagctctggtaggaagccaggataccatcagaggccgtgatttttttaactcggtgtttggctgcctctttcttgacgagcaaacgcatgtattgcccttataggcatccgccccagaggcggctgctgtaacataggaattctttaagggcgaattccagcacactggcggccgttactagtggatcc

SEQ ID NO: 351 - DNA, 967 bp, Zea mays
atcgccgcgtataaaggttcgctgcccgcgacgagaagatgcagctcaccgccacctccacgctcgaagctcctcccgaaccggccgcgtcgtcgccatggcagccgccgctcctgcaagctccgtgaaggaagtgctgccgtctcccctgacctccgcctccgagccccctccccttttcgatggcaccaccaggttgtacgtggcctatctttgcccgttcgcgcagcgcgcttggattgctagaaactacaagggtctgcaggacaagattaagatagttgccatcgatctcgctgacaggccagcgtggtacaaggagaaggtttatccagaaaacaaggtgccttctctagagcacgacaaccaggtgaaaggagagagcttggatttggttaagtacattggcagcaacttcgaaggtccatcgttactccccgaggatcacgcaaagcagcagttcgctgaggagctgctcggatacactgacgcattcaacaaagcattttactcatgtttagtcgacagggaagatgtgtctgaggaagccgttgctgccttggacaaaatagaagacgccctggggaaattcaacgatggcccgttcttccttggtcagttcagtctggtggacgttgcgtatgtaccgttcatcgagaggtttcagatactctattccaatataaagaactatgacgtcacaaagggcagacccaaccttcagaaattcatcgaggaagtaaacaagatcgatgcgtacacacagactaaactggacccgcagttcttgcttgagcaaacaaagaagcggcttgggattgcttaaagactgtgaccaaggacgagactttcgccagaagcaccagcgtagtagatcgatcggagctcgttttagtcggttgtgtgcttggatattacatctggtcttcaataaggcatggccttctgtaatggctgtgcttctgaa

SEQ ID NO: 352 - DNA, 1220 bp, Zea mays
aaaggatccggcccatcgtcgatttatagccacaccatggccaggaagtgctcccactgtggcaactacggccacaactccaggacctgcggactaggactaggactaggacacagagaaataatgctctgcgaaggtggcgacgacaataatggccgcagcggcctaaggctcttcggagtgcaggtccgtatcggcggcggcggtggcgcagggtcggcgtccatgaagaagagctacagcatggactgcctgcagctcgcggctcctcatgcttgttcgtccctcgtctcgtccccgtcgtcgtcgtcgttgtgctcgtcctcgtccccgtcgtcgctgctgctgtcgattgatgatgggttgcagagaggggcggccgatggatacctgtctgatggacctcatggcagagctgtgcaggagaggaagaaaggagttccatggagcgaggaggagcacaggcagttccttgccggcctggacaagctgggcaagggcgactggcgaggcatcgccaggagctacgtgccgacgaggaccccgacgcaggtcgccagccacgcgcagaagttcttcctccggcagagcagcatggggaagaagaagcgccggtccagcctcttcgacatggtgccgatttgcgagaacagtgcgagcatctccgatccgctggacgtggcacgccatggcgtcgcctcggcagactccgagagggcggccgtggacctgatgaattcgacgacggagggtgacgacggcaggagcagggacgtcgtgtcgtcggcgtcaggtgcagggaccgcactgcggttcccggcagcgccagctcagacggagccactgcatccttcgtcgtcgcatggccatgggcgcggccaccactgctctccgttggacctggagctgggcatgtccttgcccgccccatccgtcggaacgtgatggagatgaggcgaggccgaggccgtacgtgactgctgtctccctcagctgtgtgtgtcagccagatggagatgatgcgctagccaatacagtactgttcgtctgttcgtgatcgtgaaaacggtgtgcaaacactagcacagcggcactaaactaggatgtcgctcctcgcaccattgggtactgtaaccgcgttgatccacgtcatctctatctcttcagcacgatcataggctgtcagtttcatctatccgtccatgtgtcatggtaccttt

SEQ ID NO: 353 - DNA, 1862 bp, Zea mays
aaaggatcccagctctagcagcaccatctctaccgccgcacccagctctagcagcagcagcagctagcacctcctcctccttggtgaaggccggcccgcgccactgcacgagcacacacgaacgcacagagacgggtggccgccgtaccgacgcccgcgcctccaggtagactagactactactagtacctggcagggggctgctccattgccggcacatcatcaggaaaaagaagggagctgtgctaaaatttcttggaggggagggggtagatgacgtttggtagcgccgacatggaggccggcggcggcgagcaccgccacgcacaacaggaggaacagtcatcatccgacgagcggcgcgcgcggttcgcggaggactggggctgctgcgcctgcgcctgcgcggggttattcctggggcccaacccgatggtggcgcgctacctgtacgcgctcatcttcctcgtcaccaacctcctcgcctggacgctccgcgactacggcgactccgcgctcgccgagctgcagcggctgaaggtctgccagggcgcgctctactgcctgggcgcggagggcgtgctgcgggtcagcctcggctgcttcgtcttcttcttcgtcatgttcctgtccaccgtgaacgccaggaaggtgcacgactgccgcaactcgtggcactccgagtggtggccggccaagctcgcgctctggctcggcctcaccgccgtcaccttcctcgcgccgtcgccgctcgtccagctctacgggaaggtggcgcatttcggagcaggggcgttcctggtgatccagctgatcagcgtcaccaggttcatcatgtggctcaacgactggtgccgcgcagagatgacccagaagagataccacttgcagattcaggcggtgtccatcgtcacgtacgtggggtcgctcctggggatcgtgctcatgtacgtgtggtacgcgcccagcccggcctgcaggctcaacatcctcttcatcaccgtcacgctggcgctcgtgcagctcatgaccttcgtctccatgagctccaaggtgaaggcagggtacgtggcgccggggctgatggggatctacgtcgtgttcctgtgctggtcggcgatcagaagcgagccgcacacggaggtttgcaacaggaaggcagaagtcgccacgagcgcagactgggtgaacatcgcgagctttgtgatcgccgtcgtcgtcatcgtggcggcgaccttctcgacggggatcgactccaagtgcctccagttcaagcaggcggagggggagtcggagtcggaggaggaggacgacatcccctacggcctcggcttcttccacctggtgttctccatgggcgcaatgtacttcgccatgatcttcgtcggctggaacgcgaacgcgagccacaccatggagaggtggacgatcgacgtcggctgggcgagcacgtgggtgcgcgtcggcaacgagtggctggcggcaatcgtgtacatgtggatgatgatcgcgcccgtcatctggaagacgaggcaggtgggatcggcggcggagacgtgagcagtttttttccactgattctgacagccggaatctatatatacatacaaacacaagagcaaatgaaaggccaaagggacgggaaacgaacgggaagaggtggtgcgtgctaactcctatgcatcgcattcctggatgttcattggtcaatcacgatgctgcactgctgcagctcgggtagtttttgctaagctggaggtgcagcagacaagacaacaagcaagaggatgcaactatatatactgatgccactagtccatcgtggagctcggttgaggaagctcatcgatctcggtaccaaa

SEQ ID NO: 354 - DNA, 2908 bp, Zea mays
caaacgaggcgtgataaagtggggctcctcggtcccggcgttggccgcatcgacactcgccgcgcaccaccaccaccgctgcggctcacggctacgcagcccgctctcccgacccccccgtgccctcctctttttgctactagcacatagagtttcgcccgaatcgatcgccgactgactccgctagggttcggcccgatcgccgcttcgtcctcccggctcccgcggggaccccgccgagatgtctgactggagctcgccggctgcgccgacgttcttcccttttggcccgcaggccgaggggtgggacgtcaccttcaaggtcaaatatggtgatacacttaaaaggttttatggttgtgccaatgggagtcattttgacatgaatttatctgctctacgggcgaggattgatactgcctttaagtttggtcctgacgttgactttgttctgacttacaccgatgaggatggtgatattgtcatgctagatgatgatgatgacttgcgtgatgcagctctccgtcagagattaaaccctctcaggattactgttcaactgaagaaaaatcaaccaactgaaaaaaaagatacttctgcaccagtgaaatccgctgctcaggatccactatcccagttaatgtcagctattgaaggtttgaagcctgttcaggaagatagtctggcccatataaaatcagctattggtgaagcaatcaagtctatcccagagccaatacctgatgcccttgcaaaactttctcatgaaatacttgatgcagcaccaccaccattagctgagctgatgaaaccttttgcacaattgatggcaccaaacaataatggcaatgggccatctgatgtgcatgctgaggggtcatctagctcttccagtgcacaggtgccagctgaagctaaaaatgagcccaaagttaggccaagtttgggtcttaagaccgtgttgaaagaggctgctggacctgttcctaatgctggagcttctcaggttcaacagccattaatgtatccatctgttgaggagatgctgttcccctgtaattcagtcgacaaatctgtttgcaaagggaagattgatgctcaaagtaagggaaaatctgttacgtcctcaggcatccaacctgctcctcattctcttcgtactcatgccccacctccaccacatccgtgcatttcagaatggtcccgagcacaaagaagccaacaccgtcaattgaaatttgaagacaatgcaaaagccactaatgattctagatggcgcattccgatgtataaaatgccctatgcaccaccacctccagcagtgccacccccaggctatgtaccttctccacattttccttatccaggccgcctcttatcttctgggcatccatacggagatctcgctggtaacatggaaaactcagcaccacatagtctgcatagatggattcagtgtgatggctgtggagcgcaaccaattgttggtccacgttataaatctaatgtgaaggaagactatgatttatgtgattcctgtttccagcgcatgggaaatgaaatggagtacaccaaaatagacaagcctattttaccccacaggtttctaagagatccccatgtgtaccggaaggtgcaccatccacgggttctaatgaagtcaagacgggagaaacttgaaagtcgcttcattttggatgtgactgttcttgatggaacactgatgacaccttctaccccgttcactaagatttggcgcatgcataacaatgggtctgttgtgtggccacggggcacacagcttgtctgggttggtggagatcagtttgcattgcagacatctgttccattagagattcctgtggatggttttcctgtggacaaagagattgatgttcctgttgattttgtggcacctacaaggccagggaggtacatatcttactggaggttggcttccccttctggtcagaaatttggtcagcgagtttgggttcatatccaggtggaagacccttcttttgttaatgacaataacaggaatgctgctattaacctgaatctgcctccagagagctatagttcaaacacaaccaacttaattgatgtgaacattgagcctgctgactcagcccttagtgcacatgctaagcgcacaaaggagttccatttctgttcaactgattttcctgaacccagtaagtctgtgccttttacgttggccactacctctttgtctgcagcagctcctacaaaccaaactggtgatgttcccatgtccagtacacctgctgctgcttgtttgccctctgttaatgtgcctatgcatgaagtcgttactactcatacaccgtcacctattacgcctgtcttgcctacaactatacacttttcagccccagtatctgctcctgcaattgcccctgagcttgcatcaggggctgttggtgtgcctccacctgttagtgctgtggtacctgagctgtcagaactggatgttcacaatgaggagaagttgctgagggagctggaggaaatgggttttaggcaggtcgatctcaacaaggaaatcctcaggcagaacaattacaatctggagcagtctgtcgatgacctatgtggcgtcaatgaatgggatcctctccttgcagagctggaagagatgggatttgatgacacagagatgaacaaggagctgcttgcgaagaatgagggaagcatcaagcgagctgtgatggagctcattgccagggagaagaaggacaagtgaagatcgtgtgctatctaagtatatattcgtaaataatgagacggctgtgccactgcggtgcagccctggtgcgtctcagagcttgcttatggtgaactcttcgtgttaggtttcttccttatatctgtcgtgtctgcg

SEQ ID NO: 355 - DNA, 2087 bp, Zea mays
gctttgggattgattccactcggaggtggccagctagccacccgagctcgctgtccttgccggtacggcgtttcctgaggaggttccgtgcgagatccgaaggccggcgtgatgcagcacgatcagcgcaaaaagggttccgtggaggcagagtttttcacagagtatggggatgcaagtcgatacaagattcaggaagtcattggtaaaggaagctacggggtggtctgctccgctgtagatgtccacactggagagaaagtagcgatcaagaagatacatgacatctttgagcacatatctgatgctgcccggattctccgtgagatcaagcttctgagactcctaagacatccagatattgttgagatcaaacatattatgttgcctccatcaagacgggaattcaaagatatttatgttgtttttgaacttatggagtctgatcttcaccaagttatcaaggctaatgatgacctgacaaaggaacattaccagttctttctctaccaactgatccgtgctctgaaatacatccacacagctaacgtttatcaccgggacctgaagccaaagaatatattagcaaattctaactgcaaactgaaaatttgtgattttggactagcacgagttgcattcaatgataccccaacaacgatcttctggacagattatgttgcaacaagatggtacagagctccagagctctgtggatccttcttttcaaagtatacaccggccattgacatttggagcattggatgcatctttgctgaggtgttaacagggaaacctttgtttcctggtaaaaatgttgtccatcagttagacttaatgactgaccttctaggcacgccatcgatggatacgatttctcgggtccggaatgagaaagcaaggaggtatctaagtagcatgagaaagaaagagacaatttcgttctcacaaaagtttccgaatgcagatcctttagccttggatcttttgcaaaggcttttagcatttgatccgaaagaccgtccaactgcagaacaggcattggctcatccatactttaaagggctagccaaggttgagagagagccatcttgtcaaccaatcacaaagatggagtttgagtttgaaaggagaagagtgacaaaagaagacattagggagctgatattccttgagatattggaatatcatccacaactgctcaaagactatatcaatggcacggagaggacaacctttctgtacccaagtgctgtcgaccaatttaggaagcaatttgctcatcttgaagaaaatagtggaaacggacctgtgattccaatggaaagaaaacatacttctcttcctaggtctactattgttcactcatctccaattcctgtcaaggaacaaccccgtatcggcccatgtagggaaaggccttcatctgatgagtcctacaggaatcctcgggagacagaacaatattccggcaatctccccagaacgtcacaggctccacaaagagtgccaacagcgagaccaggaagggttgttggtccagtaatgccttaccaaaatggagacaccaaagacccctacgacacacgaaggttggcaatgagctcaggatatcctccccaacaaatcccacaaacgtttggttattatcagacacatggtaaaccagcttgctgcgagccatcacaggctgaaaggtacacgctgcatcagcaggctgcctatgcctgcgcaaaccgtacagccgcgtctgatgttgctctggacatgagagcacccccttttcagcatctatcggcagggcagagaagtgactcttgtgataggctgacagcagagacaaacttgtacacgagatcaaccaacggcatcgctgccactgcagcaggagtggcagcaactactcacagaaaggtcggcgttgttccgtttggcatgtcaaacatgtattagtgactggatcatggccgaatcatggtgaatcctctgtgcggttgatgggtctatgctgccttcaggtggctaaacaccgacaacttgaagcggccaatcaaacctttggctggatgctgcaagtttagagtgca

SEQ ID NO: 356 - DNA, 912 bp, Zea mays
taccacgactaaaccacagctccaccgtcaggtcttcttcccctttcgtgtcctctcctgcgcgcgcaccgacaagtgaacgagcgagcgagcgagcatcatggacatggaggcggccgcgatctccgggaccgccagcgcgtcgtcgtccacgtcgcggcgcggcaggagcatctcccgcctgccagcgcgcgtcgccggcgcggtgatccggggcctggtcaccttcgtcttcgcggcagtgggcatggtcctcggggccgtcacgggcgcgctgatcgggctcgccacggagagcggcctggtgcgcggcgccggcatcgggtccatctccggcgccgtcgtgtccatggaagttgtcgattcctccgtcgccatctggcgctccgacgagtccgggatctggagcgtcctatacgtgctcgatgtcctctggagcctgctgaccggccgcctggtgcgagagaaggtggacccggccgtgcaaagcgccgtcgacagtcagatgaacgccgcggactcgcaggacatggcgccgacactggcggacatgttcgagacgggcgccgccgacgccaagggcatgccggccgccgccgtcgcggcgctccccatcatggccttcaccgagcacaccgtcgccgacggctccggggagcccatcggctgctccgtctgccttcaggacttcgaggcaggcgagacggcgcggagcttgccggagtgcgggcacacgttccacctgccgtgcatcgacgtctggctgctccggcacgcctcgtgcccactgtgtcgtcgcgcggtctaagccggtgcgcacacttttcgttaggatgtctttgggcaaccgtgagccgatgcgcgtgcacacgtgtcccagaccaggagcacagtatagtagggtagtaggag

SEQ ID NO: 357 - DNA, 469 bp, Zea mays
gaatcgcatcagcctttctcctcgtgtcgcgactcgcgagcgaaaccctcgccatggcggaggcgaccgacaccgccgcagccacgccgccgccagcgccagcgatggcgactttgtccccgcctcctaagtcggggatcccgccgcggtacgacctggacgccaagtgggacgcgtgcctcgacctctccatccgtcgagttgcctactcctccctcgccggcgccttagcgggcctcctcctcttccgtagccctactactcgctgggcatcagttacccttggggctggtgtggggataggggctgcatacactgaatgctcatacttgttcagtggtggtcctccaaattggtcacccaaagtatcaacaattccttctgcacactctgaaggagaagacaagtaaacccttgcccgttggatggtggagttgtggtgtgtgtgaagtactggctgtttgtgctg

SEQ ID NO: 358 - DNA, 642 bp, Zea mays
agtgtaacctagccacacgacgcatccgcggttcatcggcctcgcaggaaacgagcgtcgagcaaaaggtcgaattctcaactctcaagcaccagcaggaatcgagcgagcgagcgagcagtgtccgccccccatggccatggtcgcgtccacctccttcgcgtaccacaagccgcgtttcgcggtggtgtgcaggaagaacagggacggccgggacagggagcgggacggcaaggagcacaagcaccccttcaaggtcgtcgagatcacgccgcctccgcggtgcctcggcgtccgctgcttccccaccaacatccactgcggcgagagcgtgacgatcgaggggcaggcgtacacggtgtcggcggtgacgcaccggtaccagctgcgcaaggggcggtacgagccgagcgagaagcgcctcgacgtcctctccaccggcagatacatcctcaacctctacctccagaacctgctcgaccagtcctagctaccatatctgtatctgtactgtacatcagcatcgcttcactctgtatagatatacatacatatatatgttagctagtagcatcgaacacttgtcccggtgggtggcggacggagatagtgtttccctgcgtgctgctctgtgtaaactga

SEQ ID NO: 359 - DNA, 1999 bp, Zea mays
gatggaaacccagtgagacactgcggccttcgcccttccatcttcatccagctggggaagataaccctccgatccggcgcaggcatgcttaatctgtccaggtataaagcacaaaaaagtgatcctctcatctaattgagactgttgagtatctcacatattcttgtgcttgcttgctgggatcggctttggctcaggagcatgagcgaaaagatatgattcttcatttctccttctggctataagttttagtttctttatgatgggaaataaaactggtaagcctgtcttcagtgagctcaaatccacagagtttagtttattggagagcactctagtacaggatcattgtgcaatcccgacttgtgtaccattggattttctgaaggccatcacgagtgatttctctaaggagcaagagctaggaagaggtgggtttggagttgtttataagggccttcttaaaaatgggaaggcgatagctgtgaagaagctttctgaaatgaacctagatgacgatcagttccataatgaagttacttatcttttcgggttgaagcacaaaaatattgtccagctaaaagcttattgtgctgaatcacggtgggaagcaatcgaattgcgcagaaaatatgtcatggctgaatctcggaaaaggctgctgtgctttgagtgtataaataataagagccttgataagcacctttctgctgaatctcatggggttgagtggcatatcagatatgagataatcaaaggaatttgccatggtttgcattaccttcacacagattgccaaattgtccatttggacctaaagcctgagaatatattgctagatgacaacatggagccaaaaattacagattttggtatgtccaggctctttggtctacaacaatccaaaatcatcaccaaaacttgtggaggaacacttggatacatggcaccagaatacttactaaaagggttgatttcagtgaaggccgacatattcagtttgggcgttataatcatagaggtgatgaccggaggccggaattatcccacttgtgaaaaatcttgcgagcaattcgctgttgatgtggttggacgttggaggaagaggttattggaggaggcaggaaggtacacacccttggaaaaatacgttgagcaagtagagacatgcatcttgataggattgatgtgtgtcgatgatgatcctaacaaaaggcccacgacattggacattatcgaaaggcttaccaaagtagatgtcacgaacacggacagagggccacccaaaactctggaggccgcgacagggcttacaggccaccccaacctcgcaactagatcatttcttgacaggttccgccgaaccatcgtgatagggatgctgaagaaggccctgaaaatccaggacgtatcgcagttggagcagctcctggccaaggaggtgctgctggagctccacaaaatcggcacgaatgcaactggaaacagatcgttcctggagaggctccacgcaagcatcaccatggctacgctggttcaggcgctgcattccttggacttggatccatcggcggcgctgcgtatggaggtgctgttcttggcgctggagaatatgcgtggaaaaaacaactcaaggcgaagaagcgaggacgtccttgagctggaggagcggccagagcagatccggtcggtgctggaggctggcaccagggccaggctcagtgatgaggaacacatgccgtcggtgtctgtgcaggctgaagaccaggcctttcccaaaccgaagttggccaaagtacgcgccaccgccccggtgtgcgtgtcagcagtgtggttggcggccggcataggattcctgtgtggattcaccctaggagagatgaggggattaaggcggacgagggtccacgaacgcacgtgatgccaatgtgcccacatgacatggccagaaaatgtcactgcggtggaccatgcatgcacgaattaaggagcaccagtt

SEQ ID NO: 360 - DNA, 1195 bp, Zea mays
gcgacgctgtcttcttcccctgttgcgcgccgtggagctcccacacgcgtttcttcccctgccgaagccctcccatggcgcccggctctgcttgcccgtggccgtcgttcctaggatcagcctccatctccagttcgtctctctccctgcgcgctttcccagacgcgcgcctagctcctcgcgcgggtctctggtgctcagcagcccagctccctctgctcgcgacgcacgcccagcctctcccaagaactcgagttcctctgctttttccccaaccgcgcgcggtacttctcctctgctcgctcgtcgccatggcgatggccaccgagctcccttgtcgtggcttcctgcttcctcgtcgcgcgcgtagcgttccgtcgttccctgccgtgaccccgtcgtggtgcttcctcgcgcgcagctcaccccaactcccattcgtagtggtcgccagtcgtcgacctagctcggattccatttcgccaacacctgctcctagtcgacgcttgctcggattcgcgtccctgcgcccagccaagttcacccctgcgtgcagccgtgggtttctctgcacagcgttcctgctccccggcctctgtcgtgctcgacagcatgtaattcatgtcgaagcagcagcttcgatcccttgcgtcatgctcaccagatcgagtctcacgtcgtcgatctgtgccattatatttggctatcggtttcgccggttgtcgattttcctattcgctatggtcatcacgacaattgttcctatccgagctagcctcgctcgccagccgtcacgccatctttacctgttaggccgtgcgttgccgcgttcacttcgttgtgttgccgcgttcacttcgttgtgtcatcgtgaacttgtcgacatactattgtggtacctggatcgcgcttgctgttgggcctatgcttcgtcgccgaaggtcttctaggaagaagcgaccttcggctgaagctgtttgtgtaagatggccgaaggtctctcttcatgaagcttcggtatcacaaaccgacttaaagatagaatgaccttttagtccataaaggtctgagtcaatgttgtaaactttcataagggacatacttgtaatctctcacaggctgcgccctgtgcctataaatagtgaacagtattcctttactgttcacgcattcctgtatctgcaatcgcatcatt

SEQ ID NO: 361 - DNA, 1652 bp, Zea mays
ccgccatggacgacgcacctgcagccatcgtcaaggccaagggcggcaggggggcgttcctcgcccacttcttcatcgtgctccccgtcgtcaccctgtgcgtcgtcgtctacgccccacgctacttctccggtcccccaccgtactacggcggcggcgccaacgacgtcggcggcatctccgcgcccaggcccagctcgatgacccgtacgtcgtcctcgtcgtcagcgcatctcggcgggttgggctacgtcgctggccgccgcgatgcagacgaagacgaccagcagctgggtgtgggtgacggcggcgcgctgccgcagcaggtggttcttgacaaccaggtgggctccccgtgctcgtccctgcccaaccacaccatctgctgcgaccgctccgactaccactccgacgtctgcttcatggccggcgacgtgcgcacggacgccgcgtccctggccctcctgctgttcccgccgcgagcagcgtcgtcagcgccggagccacccgccgcggaggagcggatacggccctacacgcgcaagtgggacgcctacatcaccaagaccatccacgaggtcacgctccgggtggcccggccggaggaggccgccgccgccgcgcaccggtgcgacgtccggcacgacgcgccggtcctcgtcgtcacggcgggcgggtacagccacaacatgttccacgtcttcaacgatggattcctgccgctgtggctgacggcgcagcacctccgccgccgcgccgtgctcgcggtgctctcgtacagcccgcgctgggccggcacctacggcgagatactcgcaggcctctcgcggtaccacgccatcgacctgctcagggacaagaggacgcactgcttcccgggcgccgtcgtgggcacccgctaccacgactacctcgccgtcaactccacgcggctccgggacaacaagaccatcgcggacttccacgacttcctcgccggcgtgtacagcgacgacgacgtgcgcaacgacaaagctgcaggcggcagcagcagcagcaggaggccggagatggcgtggtacgagcggcgccggccacggctcgggatcgtgtcgcgcaaggggaggcgcgtggtcgagaaccaggcggccgtggcgcagctggcggcgtcggtcgggttcgacgtggacatcatggagacggccaacggcgcgccgctctcggccgtgtacgcgtccgtgagctcgtacgatgcgctggtgggcgtgcacggcgccgacctgaccacgttcctgttcctgcgccccggccgcgcggcgctggcgcagatcgcgccgctcggcatcaccatgctctcgcgcaacctcttcggcgtgccggcggccaggatggggctgcactacgtgcagtacgacgtgagcgcgcgcgagagctcgctgagccgcaggtatccgctcgaccatgtcgtcgtggccgacccggcgagggcaaggcgggagcaggggaagcaggagtgggagcttgtggagcacgtgtacctacgagggcagaacgtcagcctggacctcggcaggttccgggagacactggccaggatccactcccgactcaaggagcaacaacaaggtcacgcttccaggtccagtccagatgcgtcaccgcaaatatagtag

SEQ ID NO: 362 - DNA, 1211 bp, Zea mays
aaaggatcctctcactgccatagtgccatcgtgcgagcggcgagaaagtagaaggaagtgtgtcgtactcgtactcataccgggttggttggtttttgagacgtgtgcggtcgggagaggggatggagagaaagggagggtgctgcctcgcgccgaggtacgccgccaccgcggccgcgcagcaggcaggcgcggcctggcagatggggaggatcatgctcaagttccgcccgattgcgcctaagccggcggccatggcgcccgcgccggcaccggcatcggcaccggtgaccggatcagccgccggtgccgggagagggaagcgaaaggccgcgtgcggaggcggcgggaggaggggccggaagcccaagaaggcggccaaagttgcgatggtgactgcagcgcctgcggcgacggcggcggcgcaagatgtgggcgactgccgggagcactgcgacaaggagaagtcgtcttcgtcgccgtcctcgtcctcgtcggggacgtcatccgtggactcgtcgccgccaccccggccgcagcagcgccagctcgcaacgctgccgctcatgcccgtgacggcggcggaggataaggccgctgcttgtcctgcgacagtggggccggatcagctcgtgccgtctcaggtggctacggcggcacggccgttggctccgcgcgcgatgcgccccgctgctgctgcagcttacttggtgacggtggaagaggtgaccgcgacgtggcgcgacggcgaggcgccggcctccgcgacgggcgcagacgaggccccggcgttcgtgtcggaccagtgggggcgcgtcacgtggtggaacgccgcgtttgtccgcgctgcatccgcggacgacggcgacgaggcggcggcgcccgtcgtgctcggcggagccctcccggcgtggggcacctgcgcgggattcacgtgccgcgtccgcgcccggcactggagcgcccggcgcgtcggttcccccgtggtggcgccctgcgatgtttggcgtctggacgccgccggcagctacctttggcggctggacctgcaggccgcgctcactctcggcggctgcctgtgaaccgtacaccactgtcaagagcaagcaacgaatatgctgtgctactcctctacgtgcggagacgtgttgtattttattctatgagcgttatttactgacgtaaggcatggtttaatcgacctcgagttt

SEQ ID NO: 363 - DNA, 4681 bp, Zea mays
aaaggatcctctctatcgcgagcacgacggagcaggagggcggcgacggcaaggggatgtcgggggcgtggggcggcaccacgcagaagtgcgcgtcgtgcggcaggagggtgtaccccgtcgaggagcttgccgccgacggccgtgtctaccaccgcccctgcttccggtgccaccactgcaagagcacactccagtttagtaattattcttccgtggaaggtgtcctatactgcaagcctcactatgaccagatattaaaatcaacaggcagtttggagaaaagttttgaaggtgtggcccgatcaactaagtcagaaaaatcaaatggacataagggccaacaaagcagtagattctctaatatgtttgtgggcacacaagagaagtgtgttgtttgcaacaagactgtgtacccgcttgagaaggttgcccttaatggaaattcttatcacaaatcatgctttcgctgcacccatggtggttgtacgctcagcccatccaatcatatcacacatgaaggcaaactttattgcaagacccaccattctcaactgtttatggttaagggaaatttcagtcagtttgaggacaattctgggaatgcaaaagttactattgagaaactgccagaaacagaagaagccaccaagaatcctgatcaaggtgatgaagccacaaggaaaccggtagaaaatgagcctacagatgagaaaacttcaaaaaataatgttgcagctgagaaacaattgcaaagtagtgttgatgtcacaaaaccatctgagagtaccacagcagaaaatgaacgaggtactgagggtgagtcaaagagtaatgttgtcaacaagaagccgtcagaaagtattgtagaaaagccactacagagcagtgtggttgatgtaatgccatcaagaaacagtgcagccatgagaaaaccctggcaacgaagtatgcaaacagataaaccatttctgagtagcacaagcactgtgaatccatcatcgagcagtgataccactgagaagctatcatcaagtaatggggttgatatgaaacagtctgaaagcagcacattagtaaaaacaacatgtcaacaaaattcaccaactgagaatccaccacagagcgttttaccatcggataagccatcagcgaccagtgtagatgatgcaaagccatcagaaagcagcaaagtgataaaaaaaccatggcaacgcaatatggctgccgagaagcaattacagaacagtgcaccaactgataagtcacagaaaagtgtaggtactgataaaccatcaccaacaaccggcatgaagtcattagataacaccacagaagttaaaagtccatgggggcgcaggatgttcaataataagtcactaaagcgcagtgtagatactgagaaatcgtctgaaaccagtgtggttgatgtgagacctggggaaaccagtacagtagcccctgtgccacagcaacaaactgaaaatgttgacaaaccttcagctaccagtgcagatgatgcgaagagtgcagatgatacgaagagtgcagatgatgtgaagccatcggtcgccagtccagatgatgcgaagagcacagatgatgcgaagagcacagatgatgtaaagtcatcggagaataatgcggcagtagttagaaagccatggcaacgcaacataggcactgggaagcaacccctgaccactgtagttggtccaaagacgactgaaactagtggaactgtcaaaaggttgtggcagcgcagtgctgcaactgcatcaaaaagtggtacggctgttgtgacaccattgcaaagcagtgtggctgtctccaagccgttccaaagcaacgtagctgtgaaaaagacatggcaaagaagtgtaactccagaaaacgagctacagagtaatatgtctagcaataagccattgccaagcaaggtggttgttgagagtctactgcaaagcaacaccgttgagaaagtgtttcagagtactgtacctactgaggaaccacagaaaggcatcatggccactgaaaatcaatcgcagaccatcaaagttacaaagaagagcaatgaaacatccatggagctatcagtaacaagtgagacaaccaaaccgccaccacttgctgcaaccgtgttgcaaagtgatgtttccacagaacaaccatcacaaactgatatgcctaccatgggacctagtcagatccctgagcccactgagaagccatcagaaagtgattttaatgctgagaagttatcagaaagtgttgttaaagctgagaagtcatcaacgactgacactgctgctgagaaaccacttcaaagtatgatcactgagaaggtagaaagtgtagcaggcacattgaagccatttcaaagtgatacagcccttcaggagatcttggagaggaatatggctactgaggaaatactacaaactgccatggctgttgaggatgcacctccaaccaatttgatcaccgagaagtcattaatgaaagatgcttcagaggagccagttcaaactaacgaaccatctgagcagccactgaaaactgaagagattgagaagccacaacaaagtgaaaagattgctacggacacgagagggagtgaagtatctactgaggagatgctagagcttgaaagtaatgccactaaattaaacaaggatcaatcagaacttgaagggctttcatctggtaggaatcctccaaacttccaaagcaatccaaatgctgggcagcgatcagagtccaaaggcattgtggccgagaaggcagctgaccatataatggaagctgaagatgatgtggatgctgagcactcatcagaatctcaaagcgttgcacctgctgaggttcgaaaggagcaaccatcagaacatcagaaggatgtggatatggagcagctattggaacctcaaaatcaggatcatccttggaatccactagatcctgttagtgatacagctgccaaggattcatcagagcctaaaagtgacatagctacagaaaaacgtgcagaatcacaaaacaatgcagaacagtcagttgagcagcaatcagaaccgcaaagcgataaatcaactgagaagccagaagtgcatcaaagtaattcatctaatgatgagctttctaggcttcaaaacgatgcaggtactgataaactatcagtacagtcatcagatcctgagagcaatgcatctgtcagtaagccatcagagtctcaaactgatgtgactaccatggaggcactagaacctcaaattgatgctcctcctgataaggcaactgaccagccagtgaaacctcaagatgatgcatctgctaagaatccaatgggaactgaaagtgatgctgtttgtgataaaccttcagaaagcagctcagatactgaaacacttcttgtatgccatcagaacagcagcataaccactgatgaacctgtacaaggtggcatttcttgtgatacaccacatcagagaagtgcacccatagaaacaacaccaggaagtgaaacagttgttgacgattgcatacaccacgaagataccagcagcaaaccatcagaggaaaacaaagctattgaggagccagaagaggtgagtgccaagctgccagatgaccatgtaacttctgagaagtcgtcagaggaagacaaagaaaatgcagaggcatcagtagacagtgctcccctggggagcccattggaggtcaatgaggagagctccaatccttcaggggatactgtaactcctgagaagccactggaggaggataagacgagcgcagagccatcagaaagcgatgcatcctttgggaaaatattggaggccgatgaagtgagtgccaacccatcagaggatattgcaactcctgagaagccactggaggaaggtgtgggaagtgtggaaccatcagaagacaattctgttcttgataaaccattggaggaagaagaggttgatgccaaaccgttgaaggacgttgtaactcccgagaagccattggaggaaggctcaacaactgcagagccattagaagacaatgctgcccatgaggaagcaaaagaagaagaggtgattgccaagcccctgtccagtgtggcacttgagaagtcactggagggaagtgaggcaagtgtagagccatcggaagacaatgctgctcttgagaaactatcggaggacgacgaggcaaatgccaagtcatcagaggacagtgtatatgtggagaagccacaacaggaagaagatgacaacggtgtcaaggcattagaggagggcgtgtcccctgagaaatcagccgctggcaaaccattagaagaagaagacccagtccaagagaagccagcggacgcagtcgctgagccgtcatctcaggacgacactgccactgaaaagccctcagctacaactgacactgcagaaactgcatgagacatcagttagctggttaaagttagttagcaacagttttaaacggagtgtggatcgaatactattattggtcatagttcggcgtggcttctgtttgtttttttttggtggggtgggggtggggtataatgcttgagttgtaaaatttgagggaaagaaactatagtattgatttggtctttttacaagcaataatcccctccacatgttaggaggaggataccggtaccttt

SEQ ID NO: 364 - DNA, 1521 bp, Zea mays
tgaaagtcacaggacagcacacaccccacccacaactaccaaccttctccggaaggccaaatccccccgggccaagggaaacgagggagagagaccctccgcccctctcctctccctctccttccggtgaggcggtgagctatggagtcggcagcggccgcgaagacggtggagcggctggcgcagcgcctggtgccgccggcggagcccacccccactgccccccaccgcctgtcgtggctggaccggtacccgacgcagatggcgctcatcgagtcgctgcacgtcttcaagcccgacccggcgcgtgacgggctcagccccgcggagaccatcgagcgggccctcgcacgggcgctggtcgactactacccgctcgccggccgcctcgccgtgtccgacagcgccgggggcctgcacgtcgactgcagcgctgagggcgtctggttcatcgaggccgccgtacggtgccgcctggaggacgtcgactacctcgagtacccgctccagatccccaaggacgagctgctcccgcacccgctgccgaggcccagccacgaggaggagagcaagctcatcctgctcgtccaggtgacggcgttcgcgtgcggcggcttcgtggtgggcttccgcttcagccacgcggtggcggacgggctcggcgcggccaagttcatgggcgcggtgggggagctggcgcgcggggcggaccaggtctccgtggcgcccacctgggcccgcgacgccatcccagacccgtcgggcgcgctggtcggcagcctccccgagcccacgggcgccaagcgcctcgagtacctggccatcgacatctccgccgactacatcgaccacttcaagtcccagttcgccgcggccacgggcgggggccgctgctcggccttcgaggtcctcatcgccaaggcgtggcagagccgcacccgcgccgcggggttcgaggaccccgacacccccgtgcagctctgcttcgccatgaacgcgcgcccgctcctcggcgcccgcctcccgcggggcggcgccggcttctacggcaactgctactacatcatgcgcgtggcgtccacggccgacaaggtgtcctcgtcgtccgtcaccgacgtggtgaagatcatcagggacgggaagaagcggctgccgttggagtttgcgcggtgggcggcgggggaggagggcgccgacggcgtggacccctaccagatcacctccgactaccggacgctgctggtgtcggattggacgcgcctcggcttcgcggaggtggactacgggtggggcccgccagcccacgtggtaccgctgacgaacctggactacatcgccacgtgcatcctcgtcaagccatgggcccacaagccaggggcgaggctcatcacgcagtgcgtgacgcccgaccgcgtctcgcgcttccacgacgccatggtggacatgaactagcgccccgcctcgtcctgcgttcaccacccgccgtcgtctccgccggcctcccgtttgttcatgggttag

SEQ ID NO: 365 - DNA, 722 bp, Zea mays
ccaagatgtctcagttgctgcacctgccggacctcgcggcgccgcggaccaggatgggctcggcgctggcggcgggggcccgcgtcaagcagggggaggcggggacggcgagggggcgggtgctcagggtcgccgaccccgtgcggcgggagtgcctggtgccggtcccgccgccgccggtcctcgccgcggggaggcgcggagacgacgacgacgtcgacgaggagaggcagcggtactacctcaacctgggctacgcgatccggacgctcagggaggagctccccgacgtgctctgcaaggaccacagcttcgacatctacagagaagacattgtcttcagagaccctctcaacacattcaagggcctgggaaactacaagaggctcttctgggcgctgcgcctcaccggccgggtcttcttcagggcgtcgtgggttgaagtggtcagcatatggcagcccgccgagaacagcatcctgcttcgctggaccgcccacggcgtccctcgggtgccctggggctggtgggacgccgcccacgcccgcttcgacggcgcgtccgtgtacaagctcgacaggaacggcaagatctacgagcacaaggtgcacaacgtcgctacgaacccgccggccaagtccaaggtcctgccggtccacgagctggtcaggtcactcggttgcccctccactgcccaacccacatgttctgacttctgatga

SEQ ID NO: 366 - DNA, 951 bp, Zea mays
aagcagctcagtttcatcacaagtttgttttgggatctgtcgcctcaagtttcatctagctaccttcaacaaatccttcaatctccatggctacatcggacaagaaaacaaggggctatgttccttggaatgatgagatggataaggtactccttgatacatttgtggactattacaataaaggtgatagatgtcagaatgggtggaagtctcatgtatacacagctgctgtgaagaatgtttgtgagaagtgtaatgtcaccattacaaaggaaaatattagctctcgcagcaagacctttgataagcactacaatatcattaatggtttgttgtccactagtggttttggatgggattgggagaagaacaagctcaaagttgatagtgacactgtatgggatgagtacgttgaggaagcaaaaggatatagacataaggttgtgaagttttgggatctactcagcctagtgtacaataaagaccaagcaaatggagagggtgctaaaacaacagctgaaagttcaaaggaaatggcaaaagagaatgataccggaggcaaggatgctccatattctgtatcttcctcgagtagtttaaaaagacaaagatcagatgattcatttaattctatatggtgtgataagttcgacatgcttacatctgcattgaaagatgacggtccaaagctaccctcttccgccgaagttctcgccgcattacaagaggttgagggacttgatgaagacacagaacttgagctttatgacatcctcacctctaatgcacgcaagtttgagtcgatgatggcactcccaatggaaaggaggaagaggtggcttatgatgcagctaaggaagtgaaacaacttatatgtgaacttagatctctgtgttgaactgtttgtgtgaacttgtctttgtgaaacttttgtgtgtgaacttgatggct

SEQ ID NO: 367 - DNA, 1328 bp, Zea mays
gttcgatgtcaccgccgacgcagatggcttccctcgccgttctcgtttgcctcgtctgcgcagcgctcgcctccgatgcggcggccgtccgcgtggagctcacgcgcgtacacgccgaccccagcgtgaccgcgtcccagttcgtccgcgccgccctgcaccgcgacatgcaccggcacaacgccaggaagctagccgcgtcgtcgtctgacggcacggtgtccgcgccggtctcgcccaccaccgtccccggtgagttcctgatgacgctggccatcggcacgccgccgctgccgttcctggccatcgccgacacgggcagcgacctcatctggacgcagtgcgcgccctgcagccgccagtgcttccagcagccgacgccgctgtacaacccgtccagctccaccacgttcagcgcgctcccgtgcaacagctcgctgggcctatgcgcgccggcgtgcgcgtgcatgtacaacatgacgtacggcagcgggtggacgtacgtcttccaggggaccgagacgttcacgttcgggtcgtccacgccggcggatcaggtccgcgtccccggcatcgcgttcggatgcagcaacgcgagcagcggcttcaacgcctcgtccgcgtccggcctcgtcgggctgggcagggggagcctgtcgctcgtctcccagctcggcgcccccaagttctcctactgcctcacgccgtaccaggacaccaacagcacgagcacgctcctcctcgggccgtcggcgtcgctcaacgataccggcgtcgtcagctccacgcctttcgtcgccagcccttccagcatctactactacctcaacctgaccggcatatccctcggcacgactgcactgcccatccctcccaacgccttctcgctcaaggcggacggcaccggcgggctcatcatcgactctggcaccaccatcacaatgctgggaaacacggcgtaccagcaggtccgcgcagcggtcctctccctggtgacgctgcccacgacagacggatcggcagccacggggctcgacctgtgcttcgagctgccgtcctcaacatcggcgccgccgtccatgccgagcatgacgctccacttcgacggcgcagacatggtgctcccggcggacaactatatgatgtcactctcggacccggactcggactccagcttgtggtgcctggccatgcagaaccagaccgacactgacggcgtggtagtaagcattctcggcaactaccagcagcaaaacatgcacatcctctacgacgttgggaaggagacattgtcgtttgctccggccaagtgcagcacgctgtgataa

SEQ ID NO: 368 - DNA, 942 bp, Zea mays
gcaagcgagtcagccaagccacgcccgacccccgcctccattcccggggcggagacgcgcctgcctgccatgggaatggggccgctcgacaacgccgcgtcggccgcgctggaggccgccgccgccccctcgcgggcgggctcgtacgcggtgctgcagtgcggcgaggactcggagtacgtgcggcagaagtacggcggctacttcgccgtcttccgcgcgctgctggaggaggacggcgagaggtggcgggtgtacagcgccgtccgcggggagctccccgccgacgccgaggcagccgggttcgacgggttcgtcatctccgggagctgcgccgacgcgcacggcgacgagccctggatcctggcgctcgtggacctcacccgccgcgtccacgccgccggcaagcgcgtcctcggcgtctgcttcggccaccagatcctgtgccgggcgctgggcgggcgcacggggcggtcggccaagggctgggacatcggggtgagctgcatccacccgacggcggcggcggcgcggctgttcgcgccgctgaagctgcccgtgcacatgccggtgatcgagttccaccaggacgaggtgtgggagctgccccccggcgccgaggcgctggcgcggtccgacaagacccgcgtcgagatgttccgcctcggcggccgcgccatgggcgtccagggccacccggagtacagcaaggacgtcctcatgagcatcgccgaccgcctcctccgccacaaccacatactggactgccaggtggacgtggccaaggcgagcttcgacgtgcggcagccggacaaggagttgtggagcaaggtgtgcaggggcttcctcaagggaaggctccagtcgtcgcagcagcaaggtgtggcgctatagcaggaggaaattggggggcattggatgcctaggttaatccgtcattaa

SEQ ID NO: 369 - DNA, 532 bp, Zea mays
cgtagccgtagcgataagagtgagctagctggtgcacaccggcatggcggccacggcgtactccgtggcgctcctcggcggcgcgcgcctccccgccgctccgcgctccgccctcctccctcggcgcagcgtctgccagcttcgcttccaagatgcaccgaggctctccctgctccgtgcgaaggccgcttccgaggacacatcggcctccggcgacgagttgatcgaggacctcaaagcgaagtgggacgccgttgaggacaagcccaccgtcctcttgtacggcggcggcgccgtcgtcgccctctggctgacgtccgtggtcgtgggcgccatcaacgccgtgccgctgctccccaagatcctggagctcgttgggctcggctacaccggctggttcgtgtaccgttaccttctcttcaaggaaagcaggaaagagttggccgccgacattgagaccttgaagaaaaaaatagctggaacagaataaacgctcatggaaagttttagagcgtcctttcttctttggtag

SEQ ID NO: 370 - DNA, 812 bp, Oryza sativa
acctcatggcgtccctcctctccctcccgcgtctcactctcaccccgaccccacgcgcgaaccccggccgccgcagcgcccgccccacgccggcgagcatcacctgcggcccgcgcgacaaccgcggcccgctccagcgcggccgctccctctccacggaggccatcctcgccgtgcaatccctcaagcgcctcacctcctccgaccgctccccggccgccgccgccgccgcggcctcgacctccctcggccgcctcctcaagggcgacctcctcgccgccatggccgagctccagcgccagggccactggtccctcgccctcgccgcgctccacgtcgcccgcgccgagccctggtaccgccccgacccggccctctacgccacgttcgtctcctcctcgccggccaccgaggacggcgccgccgccgtggacgcgctcgtggaggcgttcctggaggagaaggagcggggcggcgggttcgtggatggggaggaggacgtgtacaagctgacgcggctggtgcgcgcgctggtggcgaaggggagggcgcgcgcggcgtggagggtgtacgaggcggcggtgaggatgggaggctgcgaggtggacgagtacatgtacagggtgatggcgagggggatgaagcggctgggcttcgaggcggaggcggcggaggtggaggcggacctccgggagtgggaggccaggatctcgccgccggccagagacgtgctcgacgaaatgcgcgcgcgagaggagcagcacaactgcggcttaactgtaaatctgattatcgttttagaaacctgatga

SEQ ID NO: 371 - DNA, 918 bp, Oryza sativa
ttcgcctccgatcttctgccggaacccatagccatgaggacttcccttgttcgtttcttccttactatcctcgccaacacgtttctccattccccctaccagcactcctcacctcctgaatcatcccaatgttcgacgccgcttggtagcgagagtggaggaaagaggaggcgggggaggagggggaagcagaagggcttgggtgaggtggtgtctgttcacgagaaaaaggaggcaaaaacatcacctttccccctcctgctgttgtgccgtgcaacgagacggcggatcacagaggtgtatgatgagatgtaccaaattgttcgtgctaaaaggaatgatactggcaaggttcacgagttcattaactgtttggtagatgcaagaaatgaactgctgcacaagtcggagatggttcaaagaagctgcagaataaagaaggccttactatccaacccttgtagtcgcagggctaacagttatgaccgcctctgcgaacaggtgcataaattggaagccgagcacaaaaggctaaagaaggatgcggatatctacaactatattcaagagcagcttcagatgtcagagtcatacaaactgttgattgagcttagtgcgttggtggagaaggccgaacgtgaggatgcccttgccaccgaggccgcagagatgacattcgaggagctgctggctcaggagaagagcgacgccgccttctggcagcgtcacaggaagctgacctcaatcttacccaagtagagtttgataactgaccgcgcgatttcaccatcgtcaatagtagcccgaacccgtaaccagaatttgttcctggtggagcttttaatgttgctagttgcaaccgtggtgtaatgcgcttgccaagctcttgggcgcctgaaagtccagagtccttgacca

SEQ ID NO: 372 - DNA, 1409 bp, Oryza sativa
gatgaatgatgcattgtcatctggcatatgcatgtggctggcccaccgccgcaagcgggccccaccccgtcgcctcgcctcgcaacaaaaccggagccactcgagcgagtgaaaacggacaagaaagcggcgtcctcgcatcgctctcgatcagctcagcgtcgcgccgcgccacgccacgccacgccaccccaccacccaccccggctttgaggccaatccggagtcgccgggcagccacgcagcaggcgggcatgagcttgacggggcatggcggcggcggcggcgaggggacggcgccggcgttggagctgctggatgagtactggttctttagcaacacgctggggaagaacgggaggcatggcggcggcggcggcggcgggggtaggccgccgatgctgcccaggtcgccgtcgacggtgagtggtggtggtgggcggccggggaaaggtgtggaggcggtggggacgtcgaggctgttcgcgtccgcggggcggaggctcctccggacgccgtcgctcccgtcgccgcgcgtcgggatggagatcgccaaggaggacgaggaggtcgtcgaggaggccccggcggcggcgggcggtggtggcgatcaggaagccgacgcggaggacgacgacctgaactggagctcgatatacgagggcgtgctccgcaccaggatcgccgaggaaggtgtcaggtcggcgctgcggcgcgcgccgtcgatgcccgtcacgtcgtccgcgacggggcgcgacgacgacgcccgccgcgaggatacggcggcggccgccaccgggtccacgacgccgggcatgtccaggctcaggcacgcccacagcacgctggagagacactgccgctcgcacacgcccaccaccaaggctgaccggacgccgagaacgtcgggcggcggcgacggcggccatcggaggcagccaccgcggcgagagctgcggtcgttcagcgcgaaccagcagccgctcgtccggcaccagagcctgttccacgacaagaagtggaagagctcgagcgacctggagtcgatcgaggtgcaggggttcagggacctgggcttcgtgttcgaccaggaggagctccgcgagagcctcgccgacgtcctccctggcctccgcggcaagcccacccccaccggctccggctccgccagcgacaacgacgacgcaaacacagccacaaccgccaccggcagcgacgccgtcgccgccgtgcggcggccgtacctgtcggaggcatggtaccacgtgcggcggccggcgccccgatcaccggcggcggcggcgatgaggctgcagcaggcggacgcgaggtcggcggcggagatgaaggaccagcttcggatgtgggcgcaggccgtggcgtgcaacgtccgacaagagtgttaataa

SEQ ID NO: 373 - DNA, 1349 bp, Oryza sativa
agggcatggccgccgccgccgccgtcgccgccgtcgccgccgcggccgcggccgcggagcccaccgtctccaagtcggcgccggagctggtcccgcccgcggggcccaccccgcgcggcgcgctgccgctgtcgtccatcgacaagaccgccgcggtgcgcgtctcggtggacttcatccaggtgttcccgccggcgaccggcgggcccgcggcggacggccaggaggacgccgtggccaggatgcgcgacgggttcgcgagggcgctcgtgccgtactacccggtggccggccggatcgcggagccggcccccggggacgtggtggtggactgcaccggcgagggggtgtggttcgtggaggccacggcgagctgcacgctcgccgacgtgaacaacctcgagcgcccgctcctcatcgccaaggagcacctcctccctcgccctccgcccgaggagaagctcgaggacctcatcctcatggctcaggtgaccaagttcacctgcggcggattcgcggtggggatctgcttcagccacctggtgttcgacgggcagggcgcggcgcagtttctcaaggcggcgggcgagatggcgcgggggctcccggcgccgtcggtgcccccggtgtgggaccgcgacgcgatccccgacccgccgaagcccccgccgcgcgggccgccgccgtcgttcacggcgttcaacttcgtgacccaggtggtggacgtctcgccggagtccatcgcgcggatcaaggaggacttcagcgcctccccgacgggcggcggccaggcctgctccaccttcgacgccgtgaccgccgtggtgttcaggtgccgcgcgctcgccgcgtcgtcgctccccgacgacgccgaggtccgcctcgggttcgccgccagcacgcggcacctgctcgccggcgttctcccggcggtggacgggtactacggcaactgcgtgtacccggtggggatcgcccgtcaccgcggcgcggtgcggggcgcggcgctggcggaggtggtgggcgtggtgcgggaggcgaaggaggcgctcgcggcgcggttcacggactggctcggcggcggcggcggcggcgaccactacgacgtgccgctggactacgggacggtgacggtgtcggactggagccgcgtggggttcaacgaggtggactacgggttcggcgagcccgggtacgtgttcacgctcaacgacgacgtcaacatcgtcgcgtcggtgatctacctccggccgccggcgcccaagcgcggcatccgcctcatgctccgctgcgtcgaggagccgcacgccgccgccttcgccgacgagctcgccaagttcgcctagtag

SEQ ID NO: 374 - DNA, 273 bp, Oryza sativa
ggtcaggacagaacagagcagagaagcatcagaagaatggcttctctgaaggccgtgaaacctgccggacttgccaaggagccggctgccaagctcagtgagacggcgacgaagcccgcggccgccaagggcggcgtcaagaaggctgagcagaagccccgggagcccaagaagaaggtgaagagcagcaagccggcggcagccaaaaactgatagtggcaacaggagagatggagatagtacgagggtctccatcttacgctatgctatggg

SEQ ID NO: 375 - DNA, 959 bp, Oryza sativa
ataagatggtggaaaccacagttgatgttatgataagaaaaggaacaaacatgagactcgaaagctacgagtttttgagtgatttcaagcatggcaacgctgtggtactcctggactacacagagtccggaaacaaggggagtttcatcgtcacacaagttgatgggtcattcactgcctggtttgaaacaggtggaaaagagctctgctttgactcatctggtcatattactcagttatttaaagacatgattgtcgatttttacgatctgacctggagtttgcacaagaggcacttagtcatgcagaattttgtaaaggaaaatatatacgtcaaaatctttgatggcgtacccaaacttatgattctactaactgaagttaaattggttgatcagctagggccattcaaacaggactggagtcatgtccaaggcctcatgacttggtgtaaagaacaatctggtttaaaaatggactttcttaccaagagtttctatgatttcatcggatctaccgactgcacagtaatcaagctgagaaactaccctgatgattgggatgaaaaaaagaaaggtgattatttgctcacactcgcagaagtaaaccacggagttcttaaagataagttgaagagtagggatgattttcattggccgtttgtgaagctgcctaagctggagcagaacttaccaccaatgttacagcaaattcttagtggggagagacagatgaaaagaaagttcgacgtgacattcttttgtgattatatcaacctcttgagaaactcctacaagaaattcaatgaattaccagaaaatgttaaggctttatgcataaaccaggatggcttcattaaactgatagatgggtggtctcctgagttttggaccaagatctacgagaaaattgggtggccagattataatatctggaagtggccttgtaaaaaatagtag

SEQ ID NO: 376 - DNA, 1271 bp, Oryza sativa
cgccgatggggtacgtgctgtcggcggtggcgagggtcctggagcagccgacggcgtggggcgcggcctgcgagatggccgtgctggccggcccgctctgggccgccgcgctcctcggcctcctgctcggctgggcgtggcgcccgcgctgggccgccggcctcgtcgccaccgccgacagccaccccgcgccgctgacgttcgccacgctggagttctggaggacccagctccccgcccgcatccgcgccccgctcgcgcagtacgtcggcgccgccggcccggcgccgccgccgcagcaggaggacgactcctccctgcttgggtcgtcggagatggcgaacgagcagctggcggtggggaaggatgacctgatgaacctctggaggctagtggagggcagggatggcggcccggcatggatcaagatgatggagaaggcgctgcccgccatgacctaccaggcatggaggagggatccacagactggacctccacaataccagagtagtactatatttgagaatgcaaatccggaggaggtgagggacttcttcggcgacgatcaattccggatgtccaacaagtgggatgatatgcttatctatcataagactttggaagagtgtcagacaacaggcacgatgaaagtgcattgggtccgcaagttccccttcttttgtagtgacagggagtacatcattgctcgtcggatatggaaactgggaggtgcatactattgtgttacaaagggtgtgccatgctcatccatcccacgtcgtaacaaacctcgtagagtagatgtatactattcaagctggtgcatccgtccagtggaatcaagaagagggaacagtggattgacggcttgtgaggttctcctgttccaccatgaggacatgggtattccctatgagattgcaaagattggcattcggcagggaatgtgggggtgtgtaaagagaatcgaacctggacttcgggcctatcagaaagcgagagctgctggggagccattgtctcagagtgccttgatggcgcatatcaataccaaggtcggtgacaattttgttcgtggattggaatccaacgacgatcagtcagatattgtggaagcagaagagaaacccgcgaaaaaccgagtagcaaggttccttgtgctcggtggagctgttgctctggcttgcactcttgatcaagggctgttgaccaaggctctcatcttcggtgttgcacggaaatttgtagggcagaggaacacattgtagtag

SEQ ID NO: 377 - DNA, 941 bp, Oryza sativa
catcttccatagctgtacacatcctatattttcattcatggcgatgacaccgcagctagcattttctcgcatgcctccagggtttcggttccagccgacggacgagcagcttgtcgtcgactacttgcagaggcgtaccgctgcgcagccatgcgttactcccgacatcaccgatatcgacgtttacaacgtcgacccgtggcagcttccagccatggcgatgtatggatcggatcatgaccggtacttcttcacgatggcggcccgagaggcgcaggccagacgaacgacaccgtcgggtttctggaagcccaccggcacaaagaagacgatcttcgtcgtcgccggtgggcatgaggtgcccaccgccgtcaagaggaggttcgtcttctacctcggccaccaccaaccatcgggcagcaacaacaacaacaaaacatcatggatcatgcatgagtaccgtctcatgaactctccaagagcggcagtgccgtcgtcttcttcggtgaatcgtcttcccactgatgatctcacggaagagatggtgctgtgtaggatctccaacaaggacctgcctaaaccacccttcatccacaacagcttgttgcagttctcttcagtggggttgaatggtgatgggtataattacttgatccttgatcaccttgagcctccagcaatggagtatcctaatgttggcattggtaatgttgatgatgctgctgctggtactgatgatccgggtgaccttgatgaggagattgatgatagcatgcaaagaaaccatggtggctagaattaaccagtagcatcatgagtgaatggttttgcgggagatttgagttaaatatcagataataaaataataatacaaagaataaaaagaaaaacaaacctgtatagttagcaggttttgattcatttcgttgaactttgtgtgc

SEQ ID NO: 378 - DNA, 1268 bp, Oryza sativa
aaattatgccttcgccttcgcacctcgccggcgcgctggacgcggcgcgccccttcctgcgcggcgaggaggagcaggtggacccggcgctccccaagctggccgccgtgctgcgcgccgccggcgccggcgagtgctggcacaagcacggcaccttcctcgcccacctcctcgacgtccaccgcatcctccgcctctggggcgcccccgacgccgtcgcgcgctgcggcctctaccactccgcctactccaactcctacgtcaacctcgccatcttcgaacccgacgtcggccgcgaccacgtgcgccccatcgtcggcgccgccgccgagcgcctcgtccacctcttctgcgtcgtcccgcgccaccagctcatccacgacgacctgctcttccactacgccgaccaggacctcgtcgccgacctcgccgcctccgaggcgtcactgcaggacgcgcggcgcgggctgttccaccacgacggcgaggcctggcggctcaagatccagcgcctcctcccgccccacggaatcactgtcaaacacatcaggactggcgaggatgtggcactgtcgaggcgcatcgcggcaaccttccttctcatgacaatggcggacttcagcgaccagctcttcgactggcaggatcgcctcttcgacaacaccaatggccgcctcgagttcagtggcaatacctggacttcgctctggccaggcaccggcaagcccggcctctggactgcctccatatcccgcatgggcgcgctctacagcctcatcgttcgcgaggaagagatacacatagctcaacgaaagcatagcaacaatggccaagaagacgatcgtgacgaggacattgagctggtgatcccaccggtgttcaatggctgcacccaggtgctcaccgccgacgaccagaaggcggcacgggacctctactgggatgcagtttgcagcggcggcgaggacgagacggattggcgcaaggtggaggagatcctgcgacggtgcattggcaggaacccgtttgtaggagagcctcacctggttcttgctcaggtgcttctgaacatggagatgtatgaggaggcagaggagcagatagaggcaggggtgaagctgttgctggagtgggggagcagctgggacaagaggatgccatgggaggcttgggtgtcatggggcagggcgatgctgatcaaggccaaggacaaggattggccgcacacctccttcggcatcctcagcatagggcttgtcaagtgatga

SEQ ID NO: 379 - DNA, 992 bp, Oryza sativa
ggccacactgacgagtagtagacggtgaacagcctacagggaggaggcatgggggtagccgtgacaatggcgagctacgccgccgtcctgcgcccgcacgcctcgtcgacgaggactccgcgcgggcctcgtcgtcccgcgggcgcggtgccacctacgccgcgccgggcagcgctgcgagctactacgcggtctcctccggctgtcgctgccactccacctccgcgggagcgggtgcagcagcagcagcagccgggtgacggccagacgacgacgcggctctactcgctggcgccgtgcccgctcctgctggcggcgctgctgccgggggccgagccggtgcgcgccgtgttcgagccgttcgtcgagctggtcaagacgtggggcctccccggctggctcgtgcactggggccaccccggcaacatggccgtggtgctctttgcaatgggtggctacggaacatacctgggcttcaggatcaagctatcggatgaccctgaagagaaggccaaggccaaggacctccacccgaagctcctcgccggcatgttcttcttcttcgcagctggcgccactggtggagtcaccgctcttctcacgtcagacaaaccaatctttgagagtccgcatgctgtgaccggcatcatcggccttgcactccttaccattcagtctatcctgccgacattgttcgagggtaatccttcgctgagaaatgcacatggactcctcggcagcggcatcatgaccctgtttctaatccacgcagccttcgggctacagctcgggctcagcttctaatcctcagccacaacatctggggtttgcttctctgtgattagctctcagaggcatccctgttacacacatcgaagagaaatgaaacacagagagagttttctctctcttgttttccctttgtttcttttcaccctgcgaatgttgacaataatgtagacctggtgttggattgtgtattgacgacaacg

SEQ ID NO: 380 - DNA, 2471 bp, Oryza sativa
cggccatggcgcgcggcgggggcggcgggtgctgcccgccgatggatctgatgcggtcggaggcgatgcagctggtgcaggtcatcatccccacggagtcggcgcacctcaccgtctcctacctcggcgaactcggcctcctccagttgaaagaccttaacgcagacaagagtccttttcaacgaacatatgctgcccagataaaaaggtgtggtgaaatggctcgcaaattaagatttttcaaagaacaaatgtccaaagctggcatatcaacttctgcacaattaactgaaatttcgttggactttgatgatttggagataaagcttggagaactggaagctgaactagctgaagttaatgcaaacaatgaaaagttaaagcggacctacaatgagctgttggagtacagtactgttcttcaaaaggctggtgaatttttctattcggctcaaagaagtgctgcggcgcaacagagagaaatggaggcaaatcaatctggtgagagttcactggagagccctctgctggagcaggatacgttaacagatgcatcaaaacaagtgaagcttggatcattgagtggtcttgtaccaaaggaaaaggcaatggcttttgaacgcatcttattccgtgccacgaggggaaacattttcctcagacaagagtctgttgatgaacctgtcactgacccagtctctggagaaaaggttgccaaaaatgcatttgttattttctactctggggatagagcaaaagccaaaattctgaagatatgtgatgcgttcaacgcaaatcgctacccatttccagaagatgttgctagacaattacatgctgttcaggaggtatctgcaaagatatcagagttaaaggcaacaattgacatgggattagcacatcgtgacaatatattgaaaaatatcgcgtctgagtttgagaattggaaccgtctggcaaataaggaaaaaataatttaccacactttgaacatgttgagtgttgatgtgacaaagaaatgcttagttggtgagggctggagtccagtttttgcaacaactcagatccaagatgcgctccagcgagctactcttgatagcaaatcccaagttggttcaatttttcaagttctcaacacaacagaatctcccccgacatatttccagacaaataagttcacttcggctttccaggaaattgttgatgcatacgggatagccaaatatcaagaagcaaaccctggtgtattcactattgtcacttttcctttcttatttgctgtcatgtttggagattggggacatggaatttgcatattggtttcgacactctatctgataatccgagagaagaaatttgcttcacagaaacttggagacataatggagatgatgtttggtgggcgctatgtaattataatgatggcactcttttcaatctatacaggattaatatacaatgaatttttctctgttccatttgagctttttggtaaatctgcttatgcatgccgtgatccttcttgtggagatgctgcaacagaaggattactcaaggtaagacggacatacccttttggtgtggaccctgtatggcatggcagccgcagcgagttgccgtttctcaactcactgaagatgaagatgtcaattcttcttggagttgcacaaatgaaccttggaattgtgattagttactttaatgcgaaattcttcaggaacagtgttaatgtgtggtaccagttcatcccccagctgatcttcttgaacagcttatttggttacttatccatgctcatcattatcaagtggagcacgggggcaaaagcagatctgtaccatactatgatatatatgttcctcagtccaacagatgaacttggggagaaccaattatttcctggacagaaaacagtgcagcttgttttacttctgcttgctctggtgtctgttccctggatgctgatcccaaagccatttttcttgaagatggagcatgagcgaaggcatcaaggacaacaatatgcaatgcttcagagcacagatgactcagtggtagcggagatgggacatcataatggctcgaaccaccatgaggagttcgagttcagtgaagtttttgttcaccagttgatccacacaattgagtttgttcttggggcagtctcaaatacagcctcatatcttcgtctctgggctctcagtcttgcacactcggagttgtcaagtgtattctatgacaaggttctcctcctagctttcgggtacaacaacattcttatccgcatcgctggcattaccatcttcatctgtgcgacagttggtgtcttgcttgttatggagaccctaagtgcattccttcacgccttaaggctacattgggtggagttccagaacaaattctatgagggcgatggatacaagtttgcgcccttctctttcgcactgatcagtgaagaggaagactgatga

SEQ ID NO: 381 - DNA, 551 bp, Oryza sativa
cctcgatggcgtcgcagagcaccaagcccgcgcaggccgccgccgagccgtccccgccggcggccaccgcagcagcgggggaggcgccgccggctccgaaccccgcgtcggccgccacgccagcccaaaaccctaccgctgccgcgggggcggccgctggcggggccacggatctggagaagaagatgcgccgcgctgagcggttcgggacggccgtggtgatgtccgaggaggagaagcgcagcagccgcgccgagaggtttgggactggatcttcaaatgaaaaggcggaggaacaaaagaggaagtccagggctgagagatttggccttgcctcatcttctgctgacgaagacgctaagaaaaaagctcgtttagaacgatttggtcagagtacaaatgttgacaagggggaagaagagaaaagaaaggcacgagctcttaggtttgcagaaacatctagtggaccatctcaagaaaatggcaaagacagctccaagccggacgcggccactgtggcaggcacggcataatggaagcactccctgtaa

SEQ ID NO: 382 - DNA, 4505 bp, Oryza sativa
acgacatgacgaagctggcttacctccatgaacctggagtcttgcataacctcgcttgtcggtacggtattaacgagatatatacatacaccggcaatatcttgattgcagtcaaccctttccggaggctgcctcatctgtatgacgtgcacatgatggagcagtacaaaggtgctgcatttggggagctcagccctcatctgtttgcgatcgcagatgcttgttacagggcaatgatcaatgaacaagggagccaatcgatattggtgagcggtgagagtggtgctggtaagacagagacgaccaagatgctcatgaggtatcttgcattcatgggaggaaggtctggaacagagggtcggactgttgaacagcaggttttagagtctaatccagtactggaagcatttggaaatgcgaagacggtgaagaacaacaactcgagtcgattcggtaagtttgttgaaatccaattcgacaaatatgggaagatatccggggctgctgttcgaacgtacctccttgaaagatcgcgagtatgtcaggtctctgatcctgaaaggaactaccattgcttttacatgctatgttctgcaccaccagaggatgtgaaaaagtttaaggtgggagacccaagatcattccattatttgaaccaaacaaactgctatgaagtagctaatgtggatgacgcaagagaatacctagaaacaagaaatgctatggatgttgttggcattggtcaagaagagcaggatgcaatctttagagtagtagctgcaatccttcatctgggaaacatcaatttctcgaaggggcaagaaattgattcatcgaagctgagggatgagaaatcagtctatcacctgaaaatagtagcagaacttctaatgtgtgatgaaaaggctcttcaagattcgctttgtgagcgtgttattgtaacacctgatggaaatatcacaaagccacttgatccagattctgcagcactgagtcgtgacgccttagcaaagactgtgtattcacgactgtttgactggattgtggacaagattaacaactcaatcggtcaagatccagatgcaactaatattataggagtacttgatatatatggatttgagagtttcaagattaacagcttcgaacaactatgtatcaacttgacaaacgagaagttgcagcagcactttaaccagcatgtattcaagatggagcaagaagactatacaagggaggaaatagattggagctatgtggaatttgtggacaatcaagatgtgctggacttaattgagaaaaaacctggaggaataattgcactactggatgaagcatgcatgtttccaaagtccacacatgaaacatttgcccaaaagatgtatcaaacatacaaggcacataagcgcttcagcaaacccaaacttgctcggacagcctttacaatcaaccactatgcaggagatgtcacatatcaagctgatcagtttcttgacaagaacaaagactatgtggtggcagaacatcaggctctacttaattcctcaaggtgcccttttgttgcaaatctctttcctccattacctgaggaaacctctaaacagtccaaattctcttccatcggtactcgctttaagcaacaactacaagctctcatggaaacactgagtacgacagaaccacactacattagatgtgtgaaacccaatgctgtacttaaaccaggaatctttgagaatttcaatgtccttaaccaattgagatgcgggggtgttctggaagcaatccggatcagttgtgctggctatccaacaaaaaggacatttgatgagttcattgatcggtttggaatgcttgcagcagagcttgtcgacagctctgatgagaaggctgcctgtgcagcaatatgtgataaaatgggtttgaagggatatcagataggaaaaacaaaggtattcctaagagctggtcagatggcagagctggatgctcgaagagcagaagtattggccaatgctgcacggcttatccagagacgtataaagacacatcttacaagaaaggaattcatcaacttaagaaaagcctcaattcagtctcagaagttttggagggcacgcctagctagaatatttttcgagcatatgagaagaaatgctgcttcaatcaggatacagaagcatgcacgtactcattcagccaggaaatcttaccttcaaatgtatgagtcagccatagtaatacagacaggattacgtgcaatggcggcttgcaatgaacacagattcagacgagagaccaaagcttccataataatccagactcgatggcgccaacacaaagcttatgttgattacaaaaagcaaaaaagagctactttgattcttcagtgcctgtggagagcacgtattgcaagaaaggaacttcgaaagctcaaaatggaagcaagagagactggcgcactgaaagaagcaaaagacaaacttgaaaaaagagttgaggaactcacatggcgattagatgttgagaaacacttgaggattgaccttgaagaagccaaggggcaagagatttcaaacttgaaatctgtgttgcaagaaatgcaagaaaagctttcggaagcacatgcagcaatagaaaaggagaaagaagatgcaaaactagcaattgaacaggcaccaccaaagatagtagaggtgccggtggtggacaatgcaaaagttgagctgctgactagacaaaataaggaacttgaggatgaacttgttacatttagaacaaaggctgaagatctagaaaagagacttctagaggttcaaaaggagtccgatgaattgtcgagggaaattctagaaaaggactccaaacttaatcaacttcaggagatgatagaaaggcttgaaacaaatttatccagcttggaatctgaaaaccaggtcctacgtcaacagtcactacttgcatctgcagatgacgataaatcaaagcaaatagagagtctggaaagcaagattgccatcttggagtcagaaaaccagttgctccgcagtaaatcttctgtagctgttcaagcagtaattactcctgaagtgattcagccatcagcaatggagggccttgtgaatcgatatcagcttgaagaacataaaatcctcattgaggaggtggttgttcctcctataaagaatttaagcaaacaaaagtcgctcacggatcgacaacaagaaaatcatgatgtcctgatcaaaagtctggctgaagacaggagatttgacaacggcagaccagctgcagcatgcatcgtgtacaaatcactcctgcactggcactcatttgaagcagagaagactaacatatttgaccgaatcatccatacaattaggtcatcaattgagcacgctgaaagttctacagaactggcttattggctgtcgactacatcaactcttctctacctattacaaaatactcttaagtctagcagttcagcaggtaaaggatcaaatcgcagccgaaccacaacaggcaacctgttcagtaggatggtgcagaatgctcgatcgtcgtcattaggatcaggcatatcaagtggatatagtggaatggttggaaggcctgacactgcatcaaaggtagaggcaaaatactcagcactacgtttcaaacagcaattaacagcatatgtcgagaagatatatggaatgatcagagataacctgaagaaggaaataaacccgttcttgattatgtgcatacaggctccaagggctgttcgtgtgagatcatccaggggatcgttgaaaagtgtacattctaattcactatcaaggcaaacatcaagtgtgcattggcaaagcatcattaagtgcctgaaccatacactcgaaacaatgaacaataatcacgtacctccaatgataatcaggaaaacattcaatcaagcatttgcctttatgaacgttcaactcttcaatagtttgctactccgtcgagaatgctgctcctttagcaatggggaattcttaaaggctggtttacaagaattagagcagtggtgctctgtaacaactgaagagtatgcaggaacgtcttgggatgaatttcagcacatcagacaggcagttggatttctggttttgcatcagaagacacataaaaccttggaggaaatcactgatgagctttgcccagttttgagcatcactcaaatatatcgcattggaacaatgttctgggatgataaatacggtgcacaaggtctatctcaggaggtcattggaaagatgagaacaatggccactgatgactcaataactactccaaatagttcgttcttgttagatgacgactcaagcatacctatatcgttggatgatatagcacgactgatgcttgacatagacctatctgacgtggaaccaacaccactgctcaggcagaactctcagttccactttctactgcagcaccacgccacacagactgatggcattgtttgttaataa

SEQ ID NO: 383 - DNA, 1721 bp, Oryza sativa
ccgccatggagagcatcaacgtagcaccaggaacaaccgctacgcctcgcatggcgccgccgccgccgccgccgtgcatcaccaacctccagagtacccttcgctacaacaacctgctcttgcaccgcaagacgaaggggtggaagccgcggaacgtgtcctgcagggtcgaccgccgcgacgtgctcctcggcatcagcggcgcggccgccatggtggccacgcagggcggcggcggcgcgctcgcggcgcccatccaggccccggacctcggcgactgccaccagcccgtggacgtccccgccacggcgccggcgatcaactgctgcccgacgtacagcgccggcaccgtcgccgtcgacttcgcgccgccgccggcgtcctcgccgctccgcgtgcggccggcggctcacctggcggacagggcgtacctggccaagtacgagagggccgtgtcgctcatgaagaagctccccgccgacgacccccgcagcttcgagcagcagtggcgcgtccactgcgcctactgcgacggcgcgtacgaccaggtcggcttccccggcttggagatccagatacacagctgctggctcttcttcccatggcacaggatgtacctgtacttccatgagaggatactgggcaagctgatcggcgacgagacgttcgcgctgccgttctggaactgggacgcgccggacggcatgtcgttccccgcgatgtacgccaacaggtggtcgccgctgtacgacccgcggcgcaaccaggctcacctgccaccgttcccgctcgacctcgactacagtggaaccgacacgaacatcccgaaagaccagctgatcgatcagaacctcaacatcatgtaccgccagatgatttcgggagctaggaaggcggagctgttcatggggcagccgtaccgcgccggcgaccagccggagccgggggcgggcaccgtcgagagcgtgccgcacaaccccgtccacagatggaccggcgacccgaggcagccgaacggcgaggacatgggcatcttctactcggcggcgcgcgacccggtgttcttcgcgcaccacggcaacgtcgaccgcatgtggcacatccgccgcggcctcctcttccccggcgacaccgacttcaccgaccccgactggctcgacgccagcttcttcttctacgacgaggaggcccgcctcgtccgcgtccgcgtccgcgacaccctcgacccgtcggcgctgcgcttcacgtaccaggacgtgggtctcccgtggctgaacgccaagccgtccacgggagcagccagcacgccggcgcccgcggccggcgcgttcccggcgaccctggacaagaccgtgcgggtggccgtgacgaggcccagggcgtcgaggagccgcgaggagaaggaggaggaggaggaggtcgagatccccgaccactccacgtacgtcaagttcgacgtgttcgtgaacgcgcccgagagcggggacggcgcggcgacgtgcgcggcgacgtgcgccggcagcgtcgcgctggcgccgcacgggatccaccgcgaggggcagctgtcgccgaggaagacggaggcgaggttcggcatatgcgacttgctggacgacatcggcgccgacggcgacaagacgatcgtcgtgtcgatcgtgccgaggtgtggctgcgattcggtcaccgtcgccggcgtcagcatcggctacgctaagtgatga

SEQ ID NO: 384 - DNA, 603 bp, Oryza sativa
aaaggatccccagtgaatcaagtcatcaaccttcaatggcgggtgcagcgaaggcgtcgtggatggtggcgatgagcgtgggcgccgtggaggcgctcaaggaccagggcggactctgccgctggaactacgcgctgcggtccatccacaaggcggccaaggccaacgccgccggcgtctcgcagggcaagaagctgccagcttctgcggcggcggtggcggagaggaggagagcggagaaggccgaggaggggttgaggacagtcatgtacctcagctgctggggtcccaattagctaggccattagtgttagctcggatggatctcgatctgctctgctgggtgtccgtttgacggtagcagccatggccggagacgtaattggccggttgctcccagctgatcgtaatatatcacgatgatgatgaaaaattctgctacttgagtacaattgcttcatgggtcattttgcctttgtgattgtgtcgtctagaacaatttatgaactgaccacttttacggtcatgcacgcaaaaatcaggccgtgtcatcaatttaagatccaaactttctgggagaaaggtgttctgttcctcgagttt

SEQ ID NO: 385 - DNA, 854 bp, Oryza sativa
gagccatgggagagctggcttcctcgccgccgcccgcggcggtgctgcccgtcgtcttcgtcgacggcgaccagaccgtcgacctcggcaccgtcaccgtccagccctccctcggcgtccgcaagctgcaggccgtcgtcgccgacagggtggggctcgcgccgcagcagatcctggcctcgctcgcgcgcccccgccgcgcgcgccgcgtgcccctcgaggaggggaccgacctcgccgccgccgtcgcgcgcgagggctccggctgctacgtcctcgccgccctccgccgctcccgccgcgagcgccgcggcggccgctcccgccgcgagaagaaggcggcggccgcggccgcggcggcgggggccgcgcccgctgcgccgacgcaggagaggactatcctcaagcgcctccccgcgatggatctggcctccctggcctcgaccccctcgccggcggcggcggccatgttcggcgtctgggactacgaggcgcagctccaggagctgcagcggcagcgcgagtggtacctcatgcacacggcggcggcggatccgtacttcccgctggcgccggagcgcgaggacccgcccttctggtcagcgcagccgctgctgcggcaggggacgccctcgtcgtgccccgagtgcgaggcggcggcggcgatgatgcgggagccggggttccactggtgcgtgcgcgacgcggtcaccgtcggattccgctcactggtggggccaatcgagcgcccggcgaagaaatccccctcgccgtcgccctcgccgcctcccctgccgccgacccccggccgactcccgccgtcgttcgtcgggatgatgcccgtttactagtag

SEQ ID NO: 386 - DNA, 784 bp, Oryza sativa
agggagtgagcgagcactatactagtagtggtaagagaagagagaaatctaagagagagagagagagagatggatcatcaccagcaccacgagcagcagcagcagcggatggtggagatgcggatggggatggcgatgggcgaggcgtacgtcgggggaggagaggtggtggcgcgggaggcggcggcgcaggcgctgggggcggtggtgcagctgcacttcgacaagacgctggagaagaagcgggcggcggacgcgcagaagcaggagctgtggcgcctcttcctcgccttcttcctcttcctcgccatcctcctctccgccgtcgcccagtccccgccgtcccgcctccagtgccgccacctctgggcccccgccggcctcctctccctcgcccacctcgccttctacgccgccgtcgcacaccacctccgatgcctcaacggattcaggtaccagcggcgttgccacaagctgaccctggcgctggcggcggacaggctgcggatgctcaagtccggcggcgacgtggtggcggccgccgacgtggaggtgccgtaccaggagccgcccgagagctacctggccaagttcaagcgcagctgggccatccacttcgccttcctcatcaccaccttcgccttctccgtcgccgccgccgtcgccatcctctgcttctagctctcagatctcctctcaactggactactcctccaatccaatcttactagtaggagattttgattgatcatcagatcagatgatggaagagtcgttcgttgtt

SEQ ID NO: 387 - DNA, 1262 bp, Oryza sativa
aaaggatcctcaactgcaagcttacatcacactagctaattagctacttactcttcttcttgctagcttgctagcttctgcatttagacattgcaaaatctgaaaaaacttgagaaattaactaaacaaaatggttgttccggtgatcgacttctccaagctcgacggcaccgccgcagagagggctgagacgatggcgcagatcgacaatggctgcgaggagtggggattcttccagctggtgaaccatggcgtcccgaaggagcttcttgatcgggtgaagaaggtgtgcttggagagctaccgactccgggaggcggcgttcatggagtcggagccggtgaggacgctggaggggctcatggcggcggagcggcgcggcgaggcggcggcgccggtggacgacatggactgggaggacatcttctacctccacgacgacaaccagtggccgtcgaacccgccggagttcaaggagacgatgcgcgagtaccgcgcggcgctgcgggggctcgccgagagggtgatggaggccatggacgagaacctcggcctcgacaaggggcgcatgaggcgcgccttcaccggcgacggccgccacgcgccgttcttcggcaccaaggtcagccactacccgccgtgcccgcgccccgacctcatcaccggcctccgcgcccacaccgacgccggcggcgtcatcctgctgttccaggacgaccgcgtcggcggcctccaggtgctcaggggcggcgagtgggtcgacgtgcagccgctcgccgacgccatcgtcgtcaacaccggcgaccaggtggaggtgctcagcaacggccgctaccgcagcgcgtggcaccgcgtcctccccatgcgcgacggaaaccggcgctccgtcgcgtcgttctacaacccggcgttcgaggccaccatctcgccggcggtgggcgccggcggcgagtacccggagtacgtgttcggcgagtacatggatgtgtacgccaagcagaagttcgatgcgaaggagccacgcttcgaggccgtcaaggcgccaaaatctgcttaaagttaaaaatagacttttatttgtgaattaattaattgattagttgcataaactatacataaccgcttttgctattcaagataaaaaataggtgaccttacaaaatttaagtggttattattgtcatgagaatacaactattgttatgttacagtatatagtttggtattttagtgtgtcacggtttgtcagtaggctcgagttt

SEQ ID NO: 388 - DNA, 1259 bp, Oryza sativa
gttgacaagagttcacatttaattcgtacatgatgaatggttcaaatggttcccaagggtatcatgtgaatggaaagcaagtgcaaagcgttgttccttccattcagaacaatggaccaagacaccggccattgactctaatgagacggtgccgtggcatgttatgtttggttattatgccgttgacagcatttatgatgatggtttacctatcccctgtaactactttcctcatacggttgttcagtgtgcattacagcagaaagtcgacatgctttctgtttgggatgtggttagcaatgtggccatttttgtttgagaagattaacaagaccaagtttgttttctctggcgaaactgtgcccccaaaagagcgtgtcttgttatttgctaatcacagaaccgaggttgattggatgtacttgtgggatcttgcgttgaggaaaggccgtttgcagtgcatcaagtatatccttaagaaaagcttgatgaagttgcctatttttaactgggcatttcacattattgaatttattccagtagagcggaagtgggaggttgatgaaccattaatccgaagtagactttcggaattaaagaaccctaaggatcccctttggttggcagttttccctgaaggcacggattacacggagaaaaagtgtatcaagagtcaagagtatgcaaaagagcacggattgcctattctgaataatgtcctccttcccaagacaaagggttttcattgctgtctacaagagttgagggactccatggattctgtttgtgacatcacaatcgcatataagcatcggccaccgacttttatggacaatgtttatggtattgatccttctgaagttcacatacatgttaaaatcattcaagtctctgacatacccacctcagaagatgaagtcgccgattggctgatcgagagatttaaactgaagaacaagcttctgtctgatttctcggcacttggccatttccccaacgaaggaactgaagatgatctgtccacactcaagtgcatcgcgaattttgtagcggtaatcagcacaacgaccgtcctcacgtacctgaccctgttctcgtctgtatggttcaagattttcgtagcatttagctctgctttccttacttttgcaaccttatactccatacatctgccccagctgatatgctccccggaagctggtacccatgccaagaaatcctgaaagtatttgtgcaagtgtaaccctcagctgtgttag

SEQ ID NO: 389 - DNA, 3714 bp, Oryza sativa
aaaggatcccatcacccgaaaccctagccccattcgccgccggggtcgcggcctcaggagcggaggccatggaggacgtctgcgaggggaaggacttctccttccccgcggaggaggagcgcgtgctcaagctgtggtcggagctcgacgccttccacgagcagctccgccgcacgaagggcggcgaggagttcatcttctacgacgggcccccgttcgccaccggcctcccgcactatggccacatcctcgcgggcacaatcaaggacgtggtcacccgccaccagtcgatgcgcggccgccacgtctcccgccgcttcgggtgggactgccatggcctccccgtcgagttcgagatcgacaagcagctcggcatcaccaaccggcagcaggtgttcgacctcggtatcggcaagtacaacgagacctgccgcggcatcgtcaccaagtatgtcgccgaatgggaggccgtcgtcacgcgcacggggaggtggatcgacttcaaagacgactacaaaaccatggacataaatttcatggagtccgtttggtgggttttctcgcagctctgggagaaagacctcgtctacaagggtttcaaggtgatgccttacagtacaggatgcaagactgcactatcaaactttgaggccgcacttgactataggactgtcccagatccagcaatcatggtgtctttccctattatcggtgatgcggacaatgcagcacttgttgcatggactacaactccctggacacttccaagcaacttagccttgtgtgtcaatgccaatcttgtgtatgtcaaggttaaggacaagtcaactggagcagtgtatgttgttgctgaatctaggcttgggcaattgccagccaaggctaaatcatctggaaagaagcaagcaccttctaagggaggcactgctgaagttgttcagggtggattggatactgaagcatatgaattattggcaaagtttccaggatcatccttagtaggcctaaaatacaaacctctgttcgattttttcttggagctccaagagactgcctttagggtgatagcggataactacgtaactgatgatagtggaactggtgttgtccattgtgctcctgcttttggtgaagatgaccaccgtgtttgtcttgctgctggtatcattgaggccagtgggcttgttgtcgccgttgatgatgatggctgcttcattgaaaagatatctgagttcagtgggcgatatgtcaaagaggctgacagggatatcatcaactctgttaaggataaaggaagacttgtcagtaaagggagcattgaacactcttatccattttgctggcgctcgggcactcctcttatttaccgggctgtcccaagctggtttgtgaaggttgaaaagattagggaccagttgctggaatgtaacaagcagacctattgggttccagattatgttaaggaaaagcggttccataattggctagaaggtgctagggattgggctgttagcagaagtagattctgggggactccactaccgctgtggatcagccaagatggtgaagaaattgttgttatggattccattgagaaacttgaacggttatctggtgtcaaggttaatgatcttcaccgacactatgttgatggtatcacgattccctctagcagaggtccggagtatggggtgctcaaacgagttgaggatgtttttgactgctggtttgagagtggttccatgccatatgcctacattcattatccatttgagaaccgtgaattgtttgagaagaactttcctggcaactttgtggcagagggattggatcaaacacgcggatggttctatactttgatggtgttatcaacagctttatttgggaaacctgcatttaaaaatctgatatgcaatggtcttgtattagctgaggatggtaagaaaatgagcaagagtaaaaagaattacccttcacctgtagaagtcatcgatgaatacggagcggatgctttgagactgtatttgataaattctccagttgtacgagcggagtctctacggttcaaaaggagtggtgtttttggtgttgtgaaagatgtcttcctgccgtggtataatgcgtatagatttcttgtacaaaatgccaagagacttgaaattgagggattctcagcattttctccaatagatcaagcctcacttctgaagtcatcaaatgttctagatcactggataaactctgcaactgaaagtctagtcagttttgttcaccaggagatggacgcatatcggctttacacggttgtgccatatttggttaaatacatcgacaatcttactaatatatatgtgcgtttcaaccgtaaacggttaaaaggacgtactggggaagaagactgcagagtatctctttcgacgctctaccatgcacttgtaacaacttgtgtggcgatggctccatttacacccttctttactgaaactctctatcaaaacctacgaaaggtgtcaactaaaccagaggatagtattcatttctgcagtttcccttccacaactggggagagagatgagcgtgttgagcaaagtgtaaacagaatgatgaccatcattgatcttgcccgcaatattcgtgaacggcataacaaagccttgaaaacaccactgaaggagatggtgattgttcatcctgacaatgaatttcttgaagacataacgggaaagctaaaagagtatgtcatggaagaaatgaatgttaagactgtcactccatgtaatgatcccatgttgtatgcttctctccgggcagaacccaattttagtgtgctaggaaaaagactgggaaaggacatgggcaaagtgtcaaatgaagtgaagaaaatgacacaggaacagatcttagcctttgaacaaagtggagaaatttcattctttggtcattgcttgaagttagacgatattaaggtgatccggcaatttaaacgtcctgcaaatgtggcagagaatgaaattgatgctgcgggagatggtgatgtgttagtcgttttggatcttcgagctgatcaatcattgtttgaagctggagttgctcgagaggttgtgaacagaatccagaagttacgaaagacagcgcaacttgagccgacagacttagttgatgtatattacaaacctatggacgatggcaagaatactctagtagagattgtgcagtcacaggatcagtatataagggatgctcttggcaatccactaattccaaagatggcggcgccaccagatgcagtaatgatctgtgaggagtctcacaatgtacaagacatgtcgtttgtcatttacattgcaagggtttctccagtggtcacagatgatctccttgtccatgccgctggcaaccgtgagcattttgatgcattaaaagtatatttactgtcaaggtctatttccagattgaagaatgaattccaggctgggaatggcaagattacggtggatttcattgaaggcttcccaccaattgatctccagctgggaaaacatgtttttcttagtacaggagatttctacctggctactcgttcttgatttttctttcaagcatcccaattttgagtgatttatcttttttttactgcaatcattttaccccgggccctattctatttgtgcccacaaagcaatgtatgtggtttcatctgccatgggtaccttt

SEQ ID NO: 390 - DNA, 717 bp, Oryza sativa
aaaggatccttcactcactcactcacactgaactcctatggcctccgccgtcgtagccaagccaccggccgccgctccggcgagccgccgccgatgcttcgtcttcgtagagcgcgccgccgccgccgccgtcggcgtcaacgcggcgatcgctgccgtcgatgaccaccgcccagttccggccgcggccgccgccgccatggacgacgtcgtcggccgcgtcgcgcggcctgcgcgccccagcgcgcgcgccatcatggaggggacgcacaagcagatcagctccggcggcgcctcgggcggctactgcaccgtgccgtggtgcagcatctgcaccgggaataacccgttcgccattgccgagttcttgctgtgctgcaacctctgcggcgtccctctcgccggccgccccagcttcatctacattggagagaaggcgttctgcaaggaggagtgcaggtcgaggtacgtggtggaggaggcgctgcgcgaggcgagggaggagaagcgccgcgccgccgccgccgccgccgcgtcgccggagaagaagaaggaggcggcggcggcgaggaagggcggggaggagtgcagggaggggagcatcttcttcatctgcgccgacgacctgtgaagaatgtgatggatatgatgcatcatgcgtgcattgcatggcggatgataatcggagcttggctgtaataataatcgctcgagttt

SEQ ID NO: 391 - DNA, 1202 bp, Oryza sativa
ccacgacggacatgcagcacctgcacggcgacgtgctcgagtcggcggtggagcgcgtgccggcgcccgatctcgccgccgcggcgctggtgtcacgggagtggctccgcgcggtgcgcgccgcgctgcgacggcgcatgctgcggctgccgtggctcgtcgtccacgtgatccatctccggggccagcggcgcctcgccgcggcttacgacccgcgctccggggcgtggctcgccgtgcccacggcgccaccggctcgccacggcgcgacgtcgccgccgcagccgcactcgcacgtccgcctgatgcggggcgcgagcggggaccgcgtctgcgcgctctcgctctccgggctcgccgtggcgcgggacgctatcgggatggacgacgacgcgctcgtcgtcgcgctcaaggcccccggcgtgtggcgcgtcgatccggtgctcgccgcggtgggtgaccgcgtggtcgccatgggcggcgcgtgccggctggcgctgggtgacggggaggacacctcggccgtcgaggtccacgagcgcggcggctggacgcactgcggcgcggtgccggccgcgctccgggagtccgcggcggcggcagcgacgtggctctcgacggcggcgacggatcagagagtgtacgtcgcggacagagccacggggacggcgagctggttcgacccggcgaagcagcagtggggacccacctcccgcctccgccctgacgccaccgtctccacatggggcctcgccgccggccgcgccggcgccgagaagatcatcctgttcggagtgaagcatgcagacagccgagtcgtcatccgatcatgggaggtggacggcgacagcctctccctgtcccatggcgcggcggcggcgcacgacacgatgccgagcgagatgtccgagaggctgttcccgcacggcgacgacggcgaggaggagacgtcgtcgccgtcgatcggggtgtgcggcaacaccgccggtgggtacgtgtacaatgcggccgtgccggcgacgggcgccgtcctctacgagctccggcggggcggggtggagggcggcggcgtggagcggtgggcgtgggttgcgtgcgcgccggtggtggccgaagcggaggcgttgggacgcgtcatcctcgcgtgttcgccggtggggctgcacgagcttgcggacgaacggcttgcacactgaacttga

SEQ ID NO: 392 - DNA, 1065 bp, Oryza sativa
gacggcaaaggtggtaactggtagtactatatatgacgacgtcgatggagaagccccggcaggtggtgcggaagttcctggcgcggccgcagcacgagggcgtcggcgccgtcgttcgccggagcatcgggaggtttgagctgaggtacttcgatccgttcctcgtcctggacgagttctcagtgtctgctccggctgggttccctgaccatccacacagaggtttcgagaccgtcacttacatgctcgagggagccgtgacgcacgaggacttcgagggccaccgtggcacgatcaaggccggcgacgtgcagtggatgacggccggacgcggcatcgtgcactcggagatgccggcggggcccggcacctccaggggcctccagctctgggtcaacctctcctcccacaacaagatgatcgagccggggtaccaggagatacagagcaaggacatcgcgagcacgacgtcggacggcgtgacggtgcgggtgatcgccgggcagtcgatgggcgcccggtcgccggtgcgcacgcggacgccgaccatgtacctggacttcacggtccgcccccacgcggcggcgcggcagccggtgtgcgcgacgtggaacgcgttcgcgtacgtgctggagggggagggcgtgttcggcggcggcggcggcgacaaggccggggcgcaccacctgctgctgctcggccagggcgacggcgtcgaggtgtggaacaggtcggacaagccgctccggttcctgctcatcgccggcgagcccatcggcgagcccgtggcgcagctggggcccttcgtcatgaacaccgaggaggagatcgacatgaccatcaacgacttcgagttcagcatcaatggcttcgagaaggccaagcactggaagtctcaggcgctggtggcgctgggcttagagtagtagggtgcaaccatgggacgacacgacatgtcgacatatgctctgaacgaagggaaaaaaaatggaatagttctttctctcatgatacgaggttgttttatttatttgttttttttctcttccaaacaaatagcgatca

SEQ ID NO: 393 - DNA, 1161 bp, Oryza sativa
gacgctcgcctccctctccggccgccgccgccgccgccgcagcccatggcgtcgctgctccgcctccaggccctcgccctgaacctaacggcaccccgccgcctccccttcctccctctccgcgtcacgactgcgacggctccgctcgccggccgcctctccaccgccgccgcctctggcagctcgccggagtcacctgcctcggaaccggatttggattccgggctgtatcttgtggcaacgccaatcgggaacctcgaggatatcaccttaagggcattgcgtatcctcaaatgtgctgatgtcatactatcagaagacacaaggcattctggaaagctacttcaacattataacatcaagacacctcttctcagctttcataagtttaatgagcgtgaaagagagcctaatatcttaaagagacttcatgaaggggaagcagttgcattgattagtgatgctggtactcctggaattagtgatcctggcatggaactggctagactatgtgctactgagggaatccctgttatccccattcctgggccgtctgctgcaatagctgctctttctgcatctggtttgccaactgatgaatttacatttgtggggtttttaccaaagcatgctcgatcaagaaaagaaaggcttgaaatatctgcctgtcaagctgccacacaaattttctatgttcctccccatggaattcaccaatttctttctgatgctgcttcatcatttggtgattctaggtcatgtgttattgcaagggagataacgaaattacacgaagagttttggcggggaactattggtgaagcaaatgaagcctttgcaactcggcagccaaagggagaaattacagtgctcatagagggaaagttaatttcagctgatgaaactccatctgaggatttccttgagcatgaactcagagaattgatgacgcagggacatcctctgtcagcggcagtgaaaatggtgagtgaagctacatcagcaaagaagaaggatgtttatgccctcgcattaaggttatttggaaaatgagtaaaatgcgatgttttgctctcatatggtaactaaactttcagaaaccatgaaggatgtttggaatgtgtcatatttttcagtccatttgaacatcgcggatatctt

SEQ ID NO: 394 - DNA, 548 bp, Oryza sativa
agcagatgctcgccgacgcgtcgtccttcatctgggacaccttcgagcagcccggcgacggcggcgaccggaagccggtggacgcggtgaccctgaccgtggaggacatcgacggcgtggcgttcaccagcggcgacggcatccacctgagcgctcggtacgtcggcggctacagcgccgccggcgacgtgagggcggaggtgaccggcgtgctgtaccacgaggcgacgcacgtgtggcagtgggacggccgcggcggcgccgacggcgggctgatcgaggggatcgccgacttcgtccgactgcgcgccggctacgcgccgccgcactgggtgcagcccgggcagggcgaccggtgggaccaggggtacgacgtgacggcgaggttcctcgactactgcgactcgccggcggtggtgcaggggttcgtggcgcagctcaacggcaagatgaaggacggatacagcgacgacttcttcgtccagatctccggcaagaccatcgaccagctctggcaagattacaaggccaagtacggcggctagtag

SEQ ID NO: 395 - DNA, 493 bp, Oryza sativa
aaaggatcccctggtccaaagtccaaaccccctcaaaccccatcccctcccccaatccttcccccgaacccccaatcccggcggcggcggcgaagatgatcataccagtgcgctgcttcacctgcggcaaggtgatcggcaacaagtgggatctctacctcgacctcctccaggcagactacaccgagggggatgctctggatgctttgggcttagtccgttactgctgtaggcgaatgctgatgacccatgttgacctcattgagaagctgctcaactacaacactctggagaagactgagaccactgctggcaattagatgaacctcgcatactccaccgcttcattgcacctagtatcctttagtctagtgtttatgctgtgtttgacacatctaaacaaacagtgctgctatgcttatgcaaaaagctgttctttgcacattagtgaatatggatggacttgaccatttccaatgtacccctcgagttt

SEQ ID NO: 396 - DNA, 864 bp, Sorghum bicolor
cagtcctctgttccctccacccagcgccgccgccctccgccttgtcctccatgaccggcgccgcgacaacgccttcacgtcaagcctggacgccaccgaggccccggcgtcctccgcgaccgcggcgtcgtgcggactcgcgaccgcggacggccacgcggatgccacggccgcaccgggacgcaggcgcttgagttgtccgcgacgagcacccactgcgccaccgagagcccgagacgacggcgcccttgcttcgacggctgacatgacgcccagaagccaccttcgccgagccgtggccagccgcgacgctgccctcgccgcgtcgagcttcgaccacggctggccacgcgggcgccacagcactgccgagccgcctcggtgccccgcgacgccagctccggccacggccgacctgaagcccgtggcgtccacgtccgcgctcaggagccgcgaccaccgagcgcgacgtcgggccccgacgcgtccccgtcctcgccacggtcaccgcgtcaagctcttgtccctgtcttcgccaagccaaaccccggtgagctcgccaagaccaaagttttccccttcctgcgttcaccatgctgagatcggccttcgtgccgtgttctacaccttgcagggaggatgtgcccttggggcaccattgccgcatggctggaccacactgctgccctcggctaacccctggactcgctgcagcaagccgcaaccgcttccaaccagccgcagcaagccacagctggtcagcggcagatcatagccggatcagagtggcagcagcaggtctccgccaccttcctcatgttcgtcaaggtcgaaaaccccccctaaaccctagtcgacgttgga

SEQ ID NO: 397 - DNA, 3014 bp, Sorghum bicolor
catccatggcgatggcgccctccacggccgccgccaccacccttctcctccccgtcttcctcctcatcgccaccgcaactcactgcaccgcagccgactcatcctcctccccggacgcggccgccctcctcaacctctctgcggcgttagcggacccctcgggctacctctccacgcactggactccggacaccgcgctctgctcgtggccgcgcgtgtcctgcgacgccaccgacacgcgagtcatctccctcgacctctccggcctcaacctatccggccccatcccggccgccgcgctctcttccctcccgcacctccagtcgctcaacctctccaacaacatcctcaactccaccgccttccccgacgagatcatcgcgtcgctcaagagccttcgcgttctcgacctctacaataacaacctcaccggtccgctgccggcagcgctccccaacctcaccgacctcgtccacgtccacctcggcggcaatttcttctccggcagcatcccaaggtcctacggccagtggagccgtatccggtacctagccctctccgggaatgagctcaccggcgagataccggaggagctcggcaacctgacaacattgagggagctgtacctcggctactacaacaacttcaccggcgggataccacccgagctcgggaggctgcgggcgctcgtccgcctcgacatggcgaactgcggcatctccagggagatcccgccggaggtggccaacttgacgtcgctcgacactctgtttcttcagatcaacgctctgtctgggaggctcccaacggagataggcgcaatgggggcgctcaaatcgctcgacctgtcgaacaacttgttcgtcggggagatcccagcgagcttcgcgtcgctcaagaacttgacccttctgaacctcttccggaatcgcctcgccggtgagattcccgagttcatcggtgacttgccgaacctcgaggttctgcagctgtgggagaacaacttcacaggcgggatacccacgaacctcggcgtggcggcgaccagtctgaagatcgtcgacgtgagcacgaacaagctcacaggcgttctgccatccaagctgtgcgccggcgagcgcctggagacgttcatcgctttgggcaattcgctattcggcgacattccagacgggctcgccgggtgcccgtcgctgacgaggattcggctgggagagaattttctcaacgggacaatacctgaaaagcttgtcacgttgccgaacctgacgcatgtagagctgcacgacaatttgctctccggtgagctccggctggacggagagaatgtgtctccgtcgataggagagctgagtctgtttaacaaccgactgaccggtcaggtgcctaccgggatcggtggactcttgggattacagaagctgctgctcgccgggaacaggttgtccggcgagctcccgacggaggtccggaagctacagcagctctcgaaagcggacctttctggtaacctgatctccggagcggtgcccgcggcgatcggcagatgccgtctgctcaccttcctcgatatctcgagcaacaagctgtccggtagcatcccgccggagctcgccagcctccgcatcctcaactacctcaacgtttcccacaacgcgctggaaggggagattccgcctgccatcgccggaatgcagagcctgacagccgtggacttctcatacaacaacctctccggcgaggtcccgtccaccggtcagtttgcctacttcaacggcacatccttcgccggcaacgctgggctctgcggggcgttcctctccccgtgccgctcccacggcgtcgcgacttcgggctttggctccctctcttcgacgtccaagctcctgctcgtgctcggcctcctcgcgctgtccatcatcttcgcggccgcggccgtgctgaaggcgcggtcgctgaagcggtccgccgaggcgcgcgcgtggcggctgacggcgttccagcgtctggacttcgccgtagacgacgtgctggactgcctcaaggaggagaacgtgatcggcaagggcgggtccgggatcgtgtacaagggcgcgatgcctggcggcgccgtggtggccgtgaagcggctgccggccatcgggcgctcgggcgcggcgcacgacgactacggcttctcggcggagatacagacgctggggcgcatcaggcaccgccacatcgtgcggctgctgggtttcgcggccaaccgggagacgaacctgctggtgtacgagtacatgccgaacggcagcctcggcgaggtgctccacggcaagaagggcggccacctgcagtgggcgacgcggttcaagatcgccgtggaggcggccaagggcctctgctacctgcaccacgactgctcgccgccgatcctgcaccgcgacgtcaagtccaacaacatcctcctcgacgccgacttcgaggcccacgtcgcggacttcggcctcgccaagttcctccgcggcaacgccggtggttcggagtgcatgtccgctatcgccggctcgtacggctacattgctccagagtatgcctacacgctcaaggtggatgagaagagcgacgtctatagcttcggcgtcgtgctgctagagctcattgccggtcgcaagccagtcggagagtttggggacggcgtggacatcgtgcagtgggtgcggatggtgaccgggtcgagcaaggaaggcgtgatgaagattgccgacccccgactctcgacggtgcctctgtatgaactaacccatgtcttctatgtcgccatgctatgcgtcgcggagcagagcgtcgagcgccccacgatgcgagaggtcgtgcagatactagccgacgtgcccggctcgacatccacgtccattgacgtgccccttgtcatcgagccgaaggagaatgggagcccgggggagaagaagcaggagcagcaggaagggtcacacgactcgccgccacagcaggatcttcttagtatctagtag

SEQ ID NO: 398 - DNA, 1494 bp, Sorghum bicolor
aaccttatcggccttcttgttgcctccgtccgcatttgactgtccccgcatccatcccgtcccctctcagccggcgctcgcctctggtcgttctcgtcgacctcgccggtccgccattgttttgcccgtctcttcctccctctgcgtgtccggtggacctccgtcgtagctggtgctcgtgcggggggctgccgctgcacccccccctcctccgtcgtatttgcgtcgatgtttgctccgacctaggttttggggtttccacaccttcggcgccgccggtgtccgctgccctttcagtcttctccggtccattgagattcttggtatgcctctgccccatgtgttttcccctatcttcgcctatgatttgtttcgtttgctttggtgtttgctccgacctaggtgttggggtttccacaccgtcggcgccgccggtgtccgctgccctttcagtcatctccggtccattaagcttcttgttcaggtttcagctctgaaggtccgcggtgccctgcatttgtgcctggttgggtcgatctccatctaggtgcttccactcctgcatgctcctcagtatacaaatggatccgcagcttggtggtggatacaaatgcctataaggtcatggcacaaatgcattacctaggtacctattaaacttcactgcaggggatgaaataggagaggcaaagtttctttgcatatcatgagctccagcaagcacctccatgcagacaccaacttcacttcaaattgcgtggtccacaggttcagcaacaagttcagatttcccacacgacttaatcaacacccgtctcagccgcggatccagatgacacacctacaaaggatcctggcaccgaggtcacctgcagaggcacccaatgctcgcagacacttatttaaagatgtcggtgcagtggacgagcgagtagcagacgatgagagtttcactgcacctggactgatacaggatgatatgagtatcccaacagggtctccaccacaaccacagacaaaaagggctagatctgaaatctgcaggggttaatcagctgcggctcaaacagggtagcctaaggccgcagtgatctagaaggggccatcattggtcttttgcgcatgaaaatgcttatgatcctgtagatggttctgccatacaattaaacataagaactgtttgaaggcctgtttgttgtataatatccaggccattctgcatctatctatctctataatacaatgaaacgcaactctcctgtatttttagaaaaaatttttgcatctatctagcgttacttaaactcagttgctccctctgcagcttatttattgtataatatccgtgctgctactgcctcagggagaatccgtatggtacaatcgtctgtttctgaatggaacttatgtagcagcctatttaaatacttatagaacaagcatatgtggtacaagtactaatataatataaaccagtgtacatgtgctgctacc

SEQ ID NO: 399 - DNA, 1208 bp, Sorghum bicolor
aaaggatccgattcacaccagcttcaatacgtccagatggcgcagcaccggttccagaacctcagaatcatcgataatacagagctcagagacatcgatgccactatgtccggcaacacagtcttcgcaacagtcccggatactatctcggacacattcaaccactatgacctcgcggaggcaatccaacaacagttccagataaacatcgaggtagaagacatatccaggtataacgaaggttacttcttacgcgtgcacacacagcaggccagaacaaacatgctacaccgaggctttatcattgttcgaaactacctcattggtctgagaccatggaatccagaacatggatcaatagcagtctccttacaaaccgtgctaacctcttgtccactcaacatacacctagctacagacatacccttatcagatccatatgaacacctaaccattcacattaccggcgtaccaccgcatctatgctgcaactccctcatacacaaactgttccacaaaatctgcatcatccattcagtcaactttatatctgctacaactgaatatgagattagcgcccgcggaagggtaacaatgatcccacagactgctcatttaggaattagaaacctgagcggacagagtgaggtaatcaacatttggcagttatcttaccagacattcacagacgaaatgctaggcagacaaacaccaccaggagaccggcgatctgacctctgcggatactcagacatcgacacagagcaacgactggaactggttgacagcaacggaaataacgaagcaacctcccgactccaagtcgcctccgatacttcgacaatggacacatcagacaacagtattgaagaatgaaagtgaagccacaacaacaggtcaaaacccagctacgaacaaaagaaccaaaatggtccaccagaccatatagacacttactaatctatttcgtatctaccacgatgctatgtttgtaatcagcaacctatcaaactttcctatgtgtactctatatgtccctttactagattaagcctttccatgtacacataaaggcctactaaagaccatgtatccctagctttatgcagaagtatgtttacttaacccatgtgtaatatctatgctattcgcttcaaacagactgctacagaacgttgaatgctcaattagtaacttcaggtaccaaa

SEQ ID NO: 400 - DNA, 740 bp, Sorghum bicolor
ccacgatgtcgcccgcaactgcgtcgcccgagcgtctcgtcctcggcaccacctcggcactcgcaccgcgccctcgccgagcagcagcagagccgcggccatggcctcgccctgccgacgccgccaagcaccactgcgcccgcctcggccgtgcccctacctctgtgtcaagcttcatcaccacgcgggggtcagccgcggtgccgtcctcgctgcgcagcggcctcgcccggcgacgtcgagcccgctgccctcgccgcgtcgagcttcgaccacggccggccgcgtggacgccacagcccggccgagcctctgcctcgccaccgtgggagtcgccgcggccacgacgccttcagccccggcgcccctccgcgtctacgacggtgtcgaccgcgagcccccgtgctgtcatggagcttacctcgtcgagccgacacgccgtcgacagagccaccgatgccgcgcgccgggcaccagagcaagccccttcgccgagcacccgatgcgccccgttgccgcggccacgccaggacatcgccatggtcaccgcgtcagcgccggccgtggtgatcgcgaccccgaccacgacgccgtgctcatcttgccacggtgaccgcgaacttcccttttgctggctgccgatcaccactgaacgtgcagcagcggcagcaccaccccgcgcgaagctcttctctgccgccggtgagccaccagtgcccaagtgccctccttgctagtag

SEQ ID NO: 401 - DNA, 613 bp, Sorghum bicolor
gttgcccagcactcttgcacttgcgatgcactcgctagccctcgccttcggcctcgtgccgccgccagccatcacccttgccgtcgtggtgagggtggcgcacgcgtggagaagcgtgaggtcgggttcgagggatctgacgatgacagtgcaaggacaagggctggcaacgccggcgcaagggtcggggccttctactcagcacttgtgcgattgccataccgtacaacctcctcatcgatgtccaacctcgccacatgtgtcgatctcgatctggatcttcgatggtccaacctgaacatcacgttgtactggaatctggaaacggaggcggccagttggtggagcacttaccttccaagcatatacatacaattgaccaacactgcacggaagtacacttcatcctaccatggtgaaaacatgtagctttgccactgctggcctctcaccatcgatatgcttggtcgccggcatggtagtgagggtgccactcatggataatatctgtgttttaagcttgagaatgtatctgaaactaatgctacacatggctacttctctcagtaatctttatttgactttgtatcatctttaggcttgtggcacctga

SEQ ID NO: 402 - DNA, 2206 bp, Sorghum bicolor
cttatcctttcccggcctcccacagtcctgctgtgcggctaccgcgggaaatggtcgcgctccacgcgaagcagcccacgcttcgtctactccccgcgccaacgagccatgtcattgcccgcccgcccacggcggcggccaatgtacgcctcggtgcgccgccgccgcctgacgtcgtcctcgactgcaaacggttggacgcgctgatgaagtccgggaggctaagtgacgcgctggacctgttcgaccgtatgcctcgcaagaacgtcgtcgcgtggaccacggccatctccgggtgcacgcggaacgggcagcccgaggcggccgcggccatgttcgcggacatgctggagtccggcgtcgcggccaacgacttcgcgtgcaacgcggcgctggcggcgtgcgcggccgcgggcgccggcgcgctcagcctcggcgagcaggtgcactcgctcgccgtgcgggcgggcttcgccgccgacgcctggatcgggagttgcctcatcgagctctactcgaggtgcggctccatgtgggcggctgaggaggtgtttcgcaggatggaggcgccggatgtcgtggggtacacttcgcttgtctcggcgctctgcaggaacggcgacctcgcacgggctgtggaggtgctctgtcagatgatgaggcaggggttgcagccgaacgagcacacgatgacgagcatgctggcggagtgccctcgaatgattggcgagcagatacatggatatatgctcaaggtaatgggttcacagagcgtctatgcatcgactgcactgattgacttctattcgaggtacggtgactttgacatggcggagaccgtgtttgaaaatcttgactccaagaacgtggtgtcgtggtgctccatgatgcagctgtgcattagggatggaaggttggaagatgcactgcgagtgttcagcgagatgatttcggaggccgttgagccaaatgagtttgcattttcaattgctctcggggcttgtgggtctgtttgtctggggcgtcaaattcactgctcagccatcaagtgcaacttaatgactgacatccgagtatcaaatgctttgctctctatgtatggtaggagtggttttgtttcagaagtcgaggctgtgcttggcaagattgaaaatcctgatcttgttagctggacagctgccatttctgcgaacttccagaatggtttcagtgagaaggccgtagcattgcttcttcagatgcattcggaaggttttacaccgaatgactatgccttctctagtggtctgagttcttgtgcagacctggcattgctggatcaaggaaggcagcttcattgcctggcactgaaactggggtgtgacttcaaagtttgtactgggaatgcactaatcaacatgtactccaagtgtggtcaaattggatctgcaaggcttgcatttgatgtcatgaatcttcatgatgtcatgtcttggaactcactgatccatggtctcgcacagcatggagctgcaaacttggtactggaggcattcagtgagatgtgttcaagtggttggcagccagacgattcgacatttatagcagtcttggtagggtgcaatcatgcaggtctggtgaaggaaggggagacattcttcagactaatgactgatcggtatggtctcacaccgaccccttctcactatgcttgcatgatcgacatgctgggtcggaatggtagattcgatgaggcgctacacatgatcaagaatatgccattcgagcctgatgttttgatttggaagacactattagcatcttgcaagctgcacaagaatcttgacattggaaaactcgcaacagacaagctgatggagctttcagaaagagactccgcgagctacgtgctgatgtcaaacctctatgcgatgcatgaagaatggcaggatgcggagagggtgcgtcggaggatggatgaaattggggtgaagaaggatgccggttggagctggatcgaggtcaagaacgaggtcagcacctttgttgcaagagacacgtctcattcagactccgcatccatctatcagatgcttgcagagctcgttgttgtgatgcaagatacagagttagatgttcatatgcagatttagatgccaaagatgaacatatcacttgcagactttacatgtactaggtagcgtgcccgtgcgttgctacgggatag

SEQ ID NO: 403 - DNA, 2129 bp, Sorghum bicolor
tttctcgaggctccagtccagtccacgccatggcttcccgcgccactctcctgccgctcttcctcttgctcctcgcggcgcccgcgctcgccacctccggcaccatcgtcttcaccacgctcggccggagccgctacgccttcgacatcttcgcgctcccactctctccgctctcctccgccgccgcctccgcggagctccgcctcaccgacggcgtctccgttaactacaacggcaacttcgcgccctcctcctcctcctcggagccgccctccctcctcttcgtctccgagcggaacggctcactaaacctctaccgcacccccgtccctctttccgcctccgccgcccgccgccgcgaggcgctggaggaggaggacgactcgccgacgctcacgccgctgctcccgtgggaccccatcgcgctcaaggaccggccctcgctgacccccgacggcgcccacctggtgtacgtctccacggcggagcccgcggggtccccgcgccggagctgggcggcggtgtactccacgagcctagcgtccggggccacgcgccgcctcaccccacgcggcgtcgccgacttcagccccgccgtgtcgccgtccggggactggaccgccgccgcgtcgcccggccctcgcgggtgggacggcgaggtggaggacctccgcaccgacatctacgtcttccggacctccgatggttcgcggcggacgctggccgtcccggacgccgggtggccgacctgggccgacgacagcaccgtcttcttccaccgccgggacggcgacggctggtacggcgtgtaccgcgccaagctctccttcacggacgacgacgacggcggggtggccgtcgcttccgtcgtcgaccggattaccccgccggggatccacgcgttcacccccgccgcgtcgcccggcgcgccggggctcgtggccgtggccaccaggcgcccgggctccgactaccgccacatcgaggtcatcgacgtgtccggcggcggcggcgccaacgccgcctacttcgacgtgactagggccgtggcgccgcgcgcgcaccacttcaacccgttcatctcgcccgacggcgagcgcgtcgggtaccaccggtgccggggcagcgggaacggggactcaccgctgctgctggagagcatcaagagcccggcgccggacacgttctcgctcttcaggatcgacgggtcgttcccctcgttctcgcacgacggcaagaggatcgccttcgtcgggctgccggggctgttcgtggtcaactccgacggctccggcggccgccggcgggtcttctcgggcaacgcgttccccacgacatgggattggaagaggaaaggtgtcatctacaccagcgtcgggccagacttcgcgagcgagagcaccgaggtggacgttgtcgccgtgtcccttggcgacgacgacgaccccaaagtctcgatcaagaagctcaccgtgggcggcgagaacaacgcgttcccgtccccctcgccggacggcaagtgggtggtgttccggtccgggaggtccgggcacaagaacctctacatcatggacgcggaggacggcgaggccagtggcatccgccgcctcaccgagggtccctggtccgacaccatgtgcaactggtcccccgatggcgagtggatcgcgttcgcctccgaccggcacaacccgggcggcggcagcttcggcatctacatggtgcacccgaacggcaccggcctgcggagggtggtgcacagcaccgacggcggccgcaccaaccacccctggttcagcccggactccaagacgctggtgttcacgtcggactacgccgccgtgtccgcggagcccatctcaaacccgcaccactaccagccctacggcgagatcttcaccgtcaacatcgacgggtcgggcatccgccggctcacgcacaactccttcgaggacgggacgccgtcgtggacgccacactacctgaagccggaggacgtcggcgagacgctgcaggcctccgggacgtgcgcgtttgaggattgccactggctcaacattgctgcccagccagatggcctcatgtgtggcaagcacggctgatgtagaatctgagaaaagggcgaattc

SEQ ID NO: 404 - DNA, 1445 bp, Sorghum bicolor
aaaggatccggtcttctgtcttcgcagcggcggagtgcgcgcccatcagtcccgagttcccgccacacccctccattcccctcccaatcctttccccaaatctcttctctctagggcgaggcgaggcggggaagacgagcgcggcggcgaggatgttgtgggtagacaagtaccggccaaaaaccctagacaaggtcaccgtccacgaccaggtggcgcagaacctcaggaagctcgtgtcggagcaggattgcccgcacctgctgttctatgggccgtcggggtccgggaagaaaaccctaatcctcgcgctcatcaagcagatgtttggcgctggtgcggagaaggttaagctggaaaacaagacatggaaaatcgatactggaacaaggacacttgagatagaattggcaatgttgtcaagtgctcaccatgtggagatgaaccccagtgatgctggctttcaggacaggtatgttgtccaggaggtcatcaaagagatggcgaagaacaggccaattgatgccaaaggcaagagagcgtttaaagtccttgtgttaaatgaagttgacaagctctcacgagaagcccagcattccctccgcagaactatggaaaagtatagctcatcgtgcaggctgatcctatgctgtaacagctcctcaaaagtgacagaggctgtaagatcccgttgcttaaatgtgcgagtaaatgcacccagcgaagatcagattgtccaagttctagagttcattgggaagaaagaaaacctgcgtcttccagctggatttgcagctcgtatcgcagcacaatcaaaccgtaatcttagacgggcaatactgttttttgagacttgcaaagtgcaacaatatccatttacatcaaatcaagcggcgcctcctcttgactgggagcaatatgtgtctgaaatagcaactgatatactgacagaacaaagccctaaaaggctatttgctgtacgtcagaaattctatgaattacttgtcaattgtatcccgcctgaaagtattttgaagaaattgttggcagaattactgaggaagttagatgctgatctgaaacatgaaatctgtcactgggctgcacactatgagcacaagatgcgccttggatcaaaggccatttttcatctagaagctttcgtggccaagttcatgagcatttacaaggagtttctggtggctacatttggttgagcagaaccccttaacttctgcagctttcgtggccaagttcatgagcatttacaagtagttcctggtggctacatttggttgggcagaacctcaagcatagggttggctatcacattgtatcagggagtatctttggcggtgtagtcttgtactaaactcgtgaacgactagactagcttcattctgtctgtttaaaccatcgtcaactctggttaccctctcgagttt

SEQ ID NO: 405 - DNA, 1689 bp, Sorghum bicolor
caattgcaaacgaaagggaccagaggacaggcccctctccctctctctccccaatctccacaggacttgttgagcttttaagcagctagtagcctagagcactagcagtccttttggattttggtttggaaacaaggcgtcccagtcccaaatctcaagcaagcaagcaagcaatctgcagatggcaacacagtggttctccaacatggtgatggacgagccgagcttcttccaccagtggcagtcggacgcgctgctagagcagtacacggagcagcagatcgcggtggcgttcgggcagggggaggtggaccacgccgtggcggcggcgctgtcgacgatgccgcagcagcagcagcagcagcaacccgcggtggcggccgagcaccgcccgcgcaaggcggccaaggtcaacaccagctgggactcgtgcatcacggagcagggctcccccgcggactcctcctcgccgaccatcctctccttcggcggccacgccgcggccgcgttcgccaagccggagccgcacccgcaccaggcgcccagcgccgccgcgtactacggcgccgcggcggcggccgccaaggcgccgaagcaggaggtgctggacgccgccgcgctgccgttcccggctaagcgttcctacgacgacatggccgaggccgccaataaggcgccggccgccaccacacgcccggcgtcgcagaaccaggaccacatcttggccgagcggaagcgccgcgagaagctcagccagcgcttcatcgccctctccaagatcgtccctggcctcaagaagatggacaaggcatcagtgctcggcgacgcgatcaagtacgtgaagcagctgcaggaccaggtgaaggggctggaggacgaggcccggcggaggccggtcgaggcggcggtgctggtcaagaagtcccagctgtccgccgacgacgacgagggctcctcctgcgacgagaacttcgtgggcaccgacgcttccggcacgctgccggagatcgaggcccgggtgtcggaccgcacggtgctggtcaggatccactgcgagaatcgcaagggggtgctcatcgccgcgctttccgagatcgagcgcctcggactctccatcatgaacaccaatgtgctccccttcaccacctcctccctcgacatcaccatcatggccatggctggtgatgacttctgcttgtctgtcaaggatattgtcaagaagctaaatcaagcgttcaaatcatccttctgatgggtttagcttctgaccaagcttaatctaggccaactttttcccatcagccttaaggatttgaggctaatggttaggttatcaggttattccttgccttgcttccgaagagagttgcttgcagtccccaacagagcccccccaaagatagccatttccactggtttttgctgcatgggtgcagagattattacctagttgcctaccaacctattttctctccctccaattttttacatggtttgatcttgtcactccatgtttttgggagggagcagattgtaaaaaaaaaacaaaaaaagaagagaccaacctttttctagggctttgctatgtaggtcggggagtttgacttttacaaacctaattttctttctcccctttgccagtatgttgccctttcaccttgtttttccacgagaggattgtgtttctca

SEQ ID NO: 406 - DNA, 419 bp, Sorghum bicolor
agagcatggaccacggcgacaggaggagcggcgcgacgggcaggccctggcgcggcgccggcgccggcgtcgcggcggggggcggcggcccgccaccgcccaaggtgtaccgcgtggagcccagggacttccgggagctcgtgcagaggctcacgggcgccggcacgccctccgccgccgccggcgcgccgggcccgtcgccgcaccagagggcgacgacgctgacgccggccatggtcactgcggacagcaggcgcgcccaggccgcggcggccgtgcccgtgcccgggccaaccgagcagttcgactacgcgtcctggttctccgcgccgctgctcagcccggcggcgtacggcgcgccgggcttcggtggcggacaccagcagcaccaggggagcagtgggcctctgctttagtag

SEQ ID NO: 407 - DNA, 1075 bp, Sorghum bicolor
aaaggatccgtttcttggagaaggagagatggccgaaatggcggtgactgtcgcggccgccaacggcaccctccggacgtgctccggcgtgtcgccaacggcgcccggcggccgccgtgctgcggttcttggtcggtggcgggctcttgcgccagccaacttgagattgtcctctccagctgtgagggttccaagggctacttccgctgcggcggttgaggattggagcaacactgatatagtccctatcccgaaagttataatagatcaagactcagatccggatgcaacaattgtagaaataaccttgggtgatcgtcttggcgagctccttgatacaatgaatgccctaaagaacttggggctaaatgtcgttaaagctagtgtctgtctcgattctactggcaagcataacaagttttctataactaaagcgtccactggccgtaaaattgatgatccagagttgttagaagcaattcgactgacgatcattaacaacatgttagtgtatcatccggagtccagcagtcaattggctatgggagcaacttttgggccagaagcccctacagaagaggttgatgtggacatagcaacccacatagatatctatgatggccctgaaagaagcttacttgtggtggaaacagcggatcgtccggggttgctggttgaccttgttaagatcatctcagacatcaacattaatgtccaatctggagagtttgatactgaggggctactggctaaagcaaaattccatgtcagctacaggggcaaaccactgatggaggctttaaaacaggttctttctaatagcttgcgctatttcttgaggcggcccacaacagaggacgctagcttctagccagatgatcatgatgaagcctcccaactttcttatgagatgggattcacatgaattggataccatcatcaaagcatttgaaacacgtacaataatttattaagattggggaaagtatacttatgctatggcaccaccacttgaaggttccaaggcaggggaatctgttgtatccaagtgcaggagattgctattctcgagttt

SEQ ID NO: 408 - DNA, 2909 bp, Sorghum bicolor
aactgcttgcttctgtttggaggaacacaggcatcaggccagccagggacgacgagagtaagagaggagggggttctgcatttctttcttcccctctcggttgatctgccggccggtcgaggaaggaaggaaggaaggatgtttggggattgccaggtcctgtcctcgatggccgccatggccggggcctcctcgtcggcggacgcgctcttcatccccaacccaggcgcgctcgccggattcatgtcctcctccgccgccgccatgccattccaccatttctccaccactgccgcctccctgatacctaaggaggagggcggcatcatgggtgcgctccaggtggccaaggacgaggacatggatcagttggagatggacatggagctcagcggcggctctgggagcgcccacctggacagcctgctcagcttcgcggacgtggacgacgaccggccggagcagaagccgcagcacagcggcctcgaactccagacgacggtggacgccgccgggcagcagcagcagcagcagctggccaccgccaacggcaagaagaagcggtaccaccgccacacggcacaccagatccagcagatggaagcgctgttcaaggagtgcccgcacccggacgacaagcagcgcctcaagctgagccaggagctggggctcaaaccccgccaggtcaagttctggttccagaaccggcgcacccagatgaaggcgcagcaggaccgcgccgacaacgtcctcctccgcgccgagaacgagagcctcaagagcgacaactaccgcctgcaggccgccatccgcaacgtcgtctgccccaactgcggccacgccgccgtcctcggagagatgtcctacgaggagcagcagctccgcatcgagaacgccaggctcaaggacgagctcgaccgcttggcgtgcattgcgacccgctacggcggcggacgacagccgagcatgtcgtccgcgctgggctgcttatcggcgccgcctccggtactcatgccgccgctcgacctcgacatgaatgtatacgctcgccatttcaccgaccagtcttcagtcatgggctgcggcgacctcatccagtccgtcctcgcgccacagcagcagatccccgtcggcggcgccgagcaccacgcgacgtcgtcgttcatgggcgccgccatcgggcctgtccaggagcaggacaggcagctggtgctcgacctcgccgccacggcggcagacaccctcgccaagatgtgccgcgcgggcgagccgctctggctgcggcgccgcggcgcgagctccgaggtcatggtggctgatgagcacgcccggatgttcagctggcccgtcgacggcgggcagcagggcagtgcctctacgggtgccgcggccaggaccgagggatcaagggacagcgccgtggttatcatgaacagcatcacgctggtggatgcattcctggatgctaacaagtggatggagctgttcccttcgatcgtgtccaaggcaagaaccattcaggtcataaaccatggagctcgttctggtcatatgggcagtggatctctcctcttgatgcaagcggaggtgcagttcccgtctcctctggtgccggcgcgggaggtggtcttcttcaggtactgcatgcacaacggcgatgaggggacctggtccgtcgtcgacttcccggccgaggggttccagctagaaggtctgcagacctcatctgttgtcaagtgctgtaggcgtccctccggttgcatcattcaggacatgcccaacggctactcaagtgtggtgtgggtggagcacatggagatggttggagaggagaagccactgcaccaggtgttcaaggattatgttaccagcggctatgcctttggggccacacgctgggtatccctgctccagcgccaatgtgagcgccttgccagtgagctcgcccgcaacatcgccgaccttggagtgatccgcaccccagaggcgagaacaaatatgatgaagctgtcacaacggatgataactactttctctgccaacatcagtgcttctggaagccaatcttggacggcactctcagaaactacagaggacacaattagggtcactactcgtaagaacacggatccaggccagcccagtggtgtcattctaactgctgtctctacaagttggcttcctttcagccatcagcaggtctttgagcttcttgcagatgaacaacagcgttgccagcttgagattttgtcaaatgggggctcacttcacgaagtggcacacattgcaaatggatcacacccaaggaattgcatttctcttcttcgaattaatgctgcaagcaactcctcccagaatgtggaactcatgctgcaggagaccagcacccaccctgatggcgggagccttgtggtgtttgcgactgtggatgtggatgccatccaagtgacaatgagtggcgaggacccttcctacatcccacttctccccctgggctttgccatcttcccggccaccaacccttcgccagcagcaaccagcacaagctccggcaatggcgaaagcagcccaggtaacacagatgagcccaccagtggctgcctcctcaccgtcggcatgcaggtgctagcaagcgcggtgccctcagctaagctgaatctctccagcatcactgcaatcaacagccatgtctacaacgccatccaccagattacaaccgcactcaaaggccaaggagctggggtgagcggggttgaaccggtggctgctgctggctccgactaggaagagtgggaacagaggagagcagatccatgccgaccaaaatgccttccaagtccggttatttttgctaacaaacatatcgcaggtgcaagcgaggatttgacaagagcccgaaactaacacat

SEQ ID NO: 409 - DNA, 560 bp, Sorghum bicolor
aaaggatccctgcacaaacttgagcacctaccctctgtactgtgcctgtttttcagttggtacaggatgctacacccattgctcgcggcagtaacagctgccgtctcttcgtccttcgtctcaccgccgcggcgagtcccggcttctccgggtccgggacgacgacgacgacgtcctggtggcttcgcggtccggtgcgcgccgaacggaggtggcgtgacggcaggcgccgacacgaaatcgaagctcaaggtgggctccccgatcgtcatcgtcgaggcgcccgtgatgctcaagaccgccgcgtcggtgccgtcgctccggcacaacagcggtcaggtcaaggccggcgacgtcggaaggatcatggcgcggaagcccaaggacgtctgggtcgtgcggctcgccgtcggctcatacctgctggacggcaagtttttcagtcccttggattctgacgacggagacggtgatgagccccaggcccaggatgaatgagtgatcaatgccttgacgattgaatcgcaagtttactcacaataatgccgtgcctcgagttt

SEQ ID NO: 410 - DNA, 877 bp, Sorghum bicolor
atcggatcggagagcctacgacgcggcaggagctggctatccctcgaggtcagggagcggcggcgtcgccgcgcccgcacgagacggcggagctggacgcggcggcggcgttcgccgggggggagtcggcggagcagcgcaaccgcttcctggtgctgcgtctgtacgaggcgctcaacgcccgcgacgcgcgccgggcgcaggagctgctggcgcccgacctcgagtggtggttccatgggccccccacgcgccagcacatgatgcgcctcctcaccggcgcggaccagcgcgacaaacagaaccgcggcggcggcggcgggttcgtcttctccccgcgctccgtcgacgccttcgggtccaccgtcatcgccgagggcgccgacgacgcgcgccagctctactgggtgcacgcctggaccgtggggcccgacggcgtgatcacccagctcagggagtacttcaacaccgacctcaccgtcaccctcctctccggctccggcgccgtctcctccaccaagaaagctgacattgcaggcgctctgcctaagctacaggacgctgcgtcttcttcttcttcctcctccccctcggcagctgcagggcccaagtgcctgtggcagagccgccgcgccgacagcgcacacaagtcgctgccgggcctcgtcctcgccatctgaagagacttgagaccgcaagatccatctgctaccctccagtataaccgtataataaaaatcctaaagttccaaactattatcgcagaaataatctggaacggcactagtcgtagtatgtactgtactgtactgtactcagagccagtcagtgaaaacgtaatgacgtttccgtatgcgtatggactgaactgaactgg

SEQ ID NO: 411 - DNA, 1680 bp, Sorghum bicolor
cctaggaggaaagaaacgcacgcacccacgtccccgcgccaaagggaaaccgtcgccgcgtcgagagaaactgaagcggagcagaggaggagaggccgaaggccaggagaaggattcccggcggcgatggagcggtaccatccctccgaggtgtacgagctcttcgtgcgccacatgaacaccccgagggtggtggtggacaacggcgtgtgcgcgacggcgacgctggtgcaggtgcacagcgcgaggaagcacggcgtgctgctcgaggcggtggcggctctgtccgaccacggcgtctgcgtccgcaaaggctacatctcctccgacgacggccgctggttcatggacgtcttccacgtcaccgacgcctcgggacgcaaggtggccgacgccgacgccctgctggcgcgcctcgagtcctcgctcaccgcggacgcattgccgccccgcacaccgcccgccgccgccgtggggaatggggctgggcccgcgatgcccaccctgctcgagctcgtcggtgccgaccgcccgggcctcctctccgaggtcttcgccgtgctgcacgacctccgctgcgacatcgccgacgccagggcgtggacgcacggcggccgcgtcgcggccctcgtgttcgtgcgcgacgtggagacgggcgcgcccatcgacgacgcggcgcgggtcaggcgcgtcgagtccaggctaaggcacgtcctccgcggcggcgcgctcggcgccaggatggtccgggaagacgccgcggccgtcaacatggaccggaggctccaccagcttctcaacgaggacggggaggcggagtgccgcgccgaccaggcggacgcgacggcggtcgccgtgcaggattggggggagagagggtactcggtggtcaccgtcagctgccgtgaccggcccaagctgctcttcgacgtcgtctgcaccttgacggacttggattacgtggtgtaccacggcacgttcgatacggacggcgatcacgcccagcaggagttctacatcaggcggttggacgggcggccaattagctcggcggccgagaggcggcgcgtgatccaatgcttgcaagcggccatcgagaggcgcgcatccgagggcgtgaggctggagctgcgcatcaccgaccgccgcgggctgctcgcctacgtcacgcgcgtgttccgggagaacagcctctcggtcacgcacgccgagatcaccaccaggggcgacaaggccatgaacgtgttccacgtcaccgacgtggccggccggcccgcggaccccaagaccatcgacgaggtgatccagaggatcggcacggagagcctccgggtggacgaggagcggtggccgcgcctgtgctcgacggagggcgacgagggccgcggcggcggcggtgcggggatcttctcgctcgggagcctcgtgaagaagaacctggccagcctcggcctcataagatcctgctcgtgaggacgccatcaagggggggcacgtgcttgctcgatgggatggatccttgtgtaaatatgggatggtgcgtgggttaggatgtaaatggagtaggatttttaatttgccgtttctaggttttagttgccacgtgtacatagtagcaagtggagatggaaggttttaaaagttgctggtcggcaacagcttggagcttaatggacctct

SEQ ID NO: 412 - DNA, 730 bp, Sorghum bicolor
acaagccaaggcaaagagaaggaggagaagcaagcgcgaagcagtcgtctcgattcacatggccatggcggcagcggagggcaagagccggaggttcgcgctggcatgcggggtgctgagccagtacgtcaaggcggagcagcagatggcggccgccgcggcccctgcagctcgcgccccggccacgacgctgagcctcatgcccggcgcggacgtcggcgccgagcaggagccggccccggccgccgccgcgaggggcgaggagatggccgggcccgcctccacggcggcgccgctcaccatcttctacggcggcagggtggtggtgttcgaggacttccccgcggagaaggcggccgaggtcatgcgcctcgcagccggcggcgccgagcgcgcggcggtcccggccccggccccggctccggctccggctccgcgcgacgacctgcccatcgccaggaaggcgtcgctgcagcggttcctggccaagcgcaaggaccgcctcgtggagcgcgcgccctacacccgcccgtccccgtcccccgcggaggaggcggagaagacgaagcagccggcggcctcctcctggctcgggctcggcggcagcacgacggacgccgagcgcctcaccatcgcgctgtgatttggggagttctcgtcgcgtcatgtggatcgattaattcggtgggttcctgccttcctcaggctggattggtttgtatggaaatag

SEQ ID NO: 413 - DNA, 627 bp, Sorghum bicolor
catctacgattacaggacgtggtagtaatggtgggtcggaagccgatgcgccgccgccgaagtgaccggcaaccgccgccgcaatccttcggcgccacggctcgcccgagttccccacgctcgctcgcctccactcctgcctccgctgccgcggtcgccgccgacctggacgagctgctgctgacggcgcccccgccgtccgcgtcggagccccggagcttctcgtacgcggtgaagcagcagtgctgggagaaagcggagcgggttcccggacgcgacccggagaggtggcgccgcgatgcgctcggcaacatcgtcttccgcaagctcgtggggtgccccggctgcctctgccacgactacgaccacatcgtcccctactccaagggcgggaagagcacattggagaattgccaggttttgcaggctacggtgaatcgatctaaaggcaacaagactgagatatccaaatctgagctcatacagaagagtgcatattgtagggtttcaggacgggacatggatcttgttgaactctctgcctatggaaatgtccggcgagggccagattcagggggctgcaaaatccaatgaagtagatatatctgaggaatcacgtcaatcagt

SEQ ID NO: 414 - DNA, 1750 bp, Sorghum bicolor
gggaggaacaactcatcagggcggtgccgtcattcgggatgacgacaagcccacaagcagtgagagcggagcgatctttgcagacactgaaaccatttgcgccgcgcttgtgacagcaatgctgcgcaagtcgggcactgagcgccggcagccggcgttatggcggcgatgccgcagcctccggcagatcaagcaggtccacgcgctcatggtcctccggggcttcctctcggacccctcggcgctccgcgagctcatctttgcctcctctgtcggcgtccggggcggcaccgcgcacgcccgcctcgtgttcgaccgaatcccgcaccccgaccggttcatgtacaacaccctcatccgcggcgccgcgcacagttacgcgccccgggacgccgtctccatctacgcgcgcatggcccggcacagcgccggctgcggcggtggcgtgaggccggacaagcgcaccttcccgttcgtgctccgcgcctgcgccgccatgggcgcgagcgaaaccggggcgcaggtccacgcgcacgtcgtcaaggctgggtgcgagtcggacgctttcgtcaggaacgcgctcatcggcatgcacgctacctgcggggacctaggtgccgcggctgcgctgttcgacggcgaagcgcgcgaggacgccgtggcgtggtcggcgatgatctccggcttcgcgaggagaggggacattggtgccgcccgggagctgttcgacgagagccctgtgaaggacctcgtgtcttggaatgtgatgatcacggcatatgcgaagctgggagatatggccccggcgagggagctcttcgacggggctcctgatcgtgatgttgtgtcgtggaacgccatgatctctgggtacgtgaggtgcggctcgcacaagcaagcaatggagctctttgagcagatgcaggccatgggagaaaagccggatactgtcacaatgctcagcttattgtcagcctgtgcggactccggtgatatggacgctggccgcagactgcacaggtttctgtcagggaggttttctagaattggtcctagcactgttcttggaaacgcgctgatcgacatgtatgcaaagtgtgggagcatgacgagtgcactagaggtgttctggttgatgcaagataagaatgtctcgacttggaactcgatcataggaggattagcattgcatggacatgtcacagaggccatagatgtgttccagaagatgctgcaggggaatgtcaagccagatgagatcacctttgttgctgtccttgttgcgtgcagccatggcggaatggttgacaaggggcatgagtacttcaacttgatgcaacaaagatacatgattgagcccaatgtcaaacactacggttgcatggttgacatgctgagtcgtgctgggctgctcaaagaagcgtttgaattcataggcacaatgaagatcgagcctaatcctgtcatatggaggacccttcttggggcttgtaggatccatggtgagctcgaactggctgagcatgcgaatcaggaacttctgaaggcaaggagtgatgcaagtggggattttgtgcttctgtcgaatatttatgcttcagttggagaatggctggggtcagagaatatgagaaagttgatggacgacagtggtgtcaacaaggaggcaggctgtgcagttgtagacggcagttcaaaggatgtaattgactaatacaatcttgtagactgttctaattgcattctgtag

SEQ ID NO: 415 - DNA, 894 bp, Sorghum bicolor
tctccagtaggtagagtggcaagaaggatggtggcgacgatggcgagctcgctgctgctccggccgcgcgcggtcctgccacaccatccttctagttctagctccagccgccggccattgccagccccgcgtgtacagctgcaaccgatcatccagcagaaaccgggcctcgcggcgagaagcgacggcgagcggaggcggccggccgggacgcggctctactcgctggcgccctaccctctgctgctcgccgcgctgctgccgggagctgagccggtgacggccgtgttcgcgccgttcgtggagctggtgaagacgtgggacctccccggctggctcgtgcactggggccaccccggcaacatggctgtggtgctcttcgcaatgggtggctacgggacatacctgggcttcaggatcaaactgtcagacgatattgaagagaaggccaaggccaaagatctccacccaaaactcctcgcagggatgttctttttcttcgccctcggcgcgaccggtgggatcacagctcttcttacctcagataaacccatctttgaaagtcctcatgccgtgactggagtcatcggccttgcacttctgaccgttcagtctatcctgccaaaattgttcgagggaaatccagggcttaggactacacatggtctgctcggcagtggcatcatgactctgtttctaatccatgcggcactaggcctgcagcttgggatcagtttctaacttgtggctaccatatctcggggtttgcttctttctgattcttttcagagattttaagtcactcttagtattatcacacgaagcatccccttataaatcaaaataatgtaagagaaaggaaatttttgttttccttgtctttgttggcacctg

SEQ ID NO: 416 - DNA, 1813 bp, Sorghum bicolor
aaagatccagccatcacagaaagcaagcagccatgccactgcacgccacgagccccgccggcgtgctcgcgtacgccgccctcgcgctcgcggcgctgcggctgctgctgtcctacaagtcggcgctctacgcgctgcgccgcctgtggcggtgcgccgacgagtgggcgcaggcgtaccagtaccacgaggtgccgcgcttcgccggggctgggtgcgacggcgccgagaacccgctgttccgcaaggccgccgcttacgtggcggcgctgccgtcgctggaggacgcggacgccgcgtgcgtggtgtcctcggcgtcccggaccaacggcgggctctccctgcagctcggcccgggccacaccgcgcgggacgcgttcctcggtgcgcgcctgtcgtggaccagcgcgggcggcggacccgagcgcctggtgctgcgggtgcgccgccacgaccgctcccgcgtgctaagaccttacctgcagcacgtggagtccgtggccgacgagatggagcagcgccgccgcgagctgcggctcttcgccaacgccggcaccgacgcggacacaggcgcgccgcgctgggcgtcggcgcccttcacccacccggccacgctcgacgacgtagccatggacccggacctcaaggcccgcgtccgcgccgacctcgagagcttcctcaagggccgcgcctactaccaccgcctcggccgcgtctggcgccggagctacctcctctacggcccgccgggcaccggcaagtccacgttcgcggcggccatggccaggttcctgggctacgacgtctacgacgtcgacctgtcccgcgccgtcgcctccggcgacgacctccgcgcgctgctcctgcacaccaccccgcgctcgctcgtcctcgtcgaggacctggaccggtacctgcagggcgggggcggggacggggaggcacgcgcggccagggtgctgagcttcatggacggcgtcgcgtcgtgctgcggcgaggagcgcgtcatggtgttcaccatgcgcgggggcaaggacgccgtcgacgccgcggtgctgcgccccggccggctggacgtgcacatccagttcacgctctgcgacttcgaggcgttcaaggcgctggccagcaactaccttgggctcaaggaccacaagctgtacccgcaggtggaagaggggttccacgccgccggcgcccgcctcagccccgccgagctcggcgagatcatgctggccaaccgcgcgtccccgagccgcgcgctccgcagcgtgatcaccaagctccagcacgtcgcgtccgggggcggcgcggcgccgcggtacccgtcgcacaggcggaacacgagctggtccggcggcgggcaccagtgggaggaccaggcccagtcggcgcgcgccagcgcggactccgcgctggccgacgacgagacggccgccggggccccgccgacgtgcggggtgttcggcaaggaggcgccgatgagggagttcaagaagctgtacgggctgatcaagatcaggagccggagggaggggtcgggcgtcgtgccacaggaaggcgacgcgcacgggccgccgacgccgggcaaccacgacagggaccggtgaacgttgtggatggtagaattgtagtggccagcaaaaagaaagcttttttatttcctttttttcttgttattattacagttttttgttacactactctaggtgttagtgactggaaggaacaactagaattggaggaagataacaacaatggaggattgtgagtgatgtacatgagaggcattcttgtgtggtctgaattcttt

SEQ ID NO: 417 - DNA, 1421 bp, Sorghum bicolor
gagcgatggacccgtgcccgttcgtgcgggtgctggtcggcaacctggcgctaaagatgccggcgtcaacaaccgcgccacgcagcaccgccgcgtccggctccggggtgcacccgaccacggcgccatgctactgccgtatccggctcaacaagctcccctaccagacggcctcggcgccgctgctgccacccaccgaggaaggcccggcgtcgtgcacgggcgccttcgccgccgcgttccacgtctccaaggccgacctggaccgcgccgccgccaagcccgcgctcctcctcggcgcccgcctccgccgccgcaccgcgcgcctcaaggtcgccgtctacgccggccgcggcggcggcgcgtcctgcggcggaggcggaggcggggtcaactccggcaggctgatcgggaagctcgtcgtcccgcttgacctcggtgctgctatggcgaagcccgtcgtcttccacagcggatgggtcgccatcggcaagcgccgctccggcgggcgtggcaagaccgcggcgagggcgcagcttaacctcaccgtccgtgctgagccggacccgaggttcgtcttcgagttcgacggcgagcctgagtgtagcccgcaggtgcttcaggtgaaggggagcatgaagcagcccatgttcacgtgcaagttctcctgccgcagcaacagcgacctccgctcgcggtccgtgcagtctgatccgggcaccgcggggccgcgcaactggctggccaagttcggttccgaccgggagcgggcggggaaggagcggaaggggtggtcagtgacggtgcacgacctctcaggctcaccggtggcactcgcatcaatggtgacgccgttcgtagcgtcccgagggacagaccgcgtgagccgctccaacccaggcgggtggctgatcctccgcccggtcgacgggacctggacaccatggggccgtctggagtgctggcgcgagcgctccggcagcggcggagggggggacaccctggggtaccgcttcgagctagtcccgggccacacgaacgcgggcgtgtgcgtggcggagtcaggcctcccggcgtcccgcggcgggcggttcgccatcgacctgacggcggcgcagccgttcgggtcgcccgggtgcagcccgcgtgggagcggcgacttgggccactaccacggcggcggggtgtggccgttcggcacgttcaggggcttcgtgatgtcggcggctgtgcagggggaaggacggtgcagcaggccgacggtggaggtcggcgtgggccacgtcgggtgcgctgaggatgccgccgcgttcgtggctctggcggccgctgttgacctcagcatggacgcgtgccggctcttctcgtgtaagcttcgccgggagctgtcggcgtctcgcgctgagctggtccggtgatga

SEQ ID NO: 418 - DNA, 777 bp, Sorghum bicolor
aatctagagggctgtttcgagggggagaaatcaggactcgatcgcgggcgatgggggccggtgaccagggcacgtcgtcggagggggttgacatcctgaagaaccccacggcggaggagccccaggcgccagccgggaccaggaagaaggggaaggaggcgagcgcgccggagggcggtgaccttggactcaagctgaaggaagcgagcacgttgggcttgggcggtaagatcctgaagaagaggaaggaggcgatggcggcgttggatatcatgctgccgacgaagcccgcggcgaggaaggcgcagccggccggggtcgagaagaagaggaagaaggtggtcaggaagaagctgccgcaggatgtcatcgactcaattgtagcaaagccgtgtaagattgtgtatgagctctccgatgaagaccttgccgacaaatcccagcaattccgcgaagcctataggagagcaatgttagtccatgagaaggtccgcagctacgagcaggccctcatggagcagtacagagccacgggctccgtggaggatgaaattgaggtcaccgatgatgaggacgaggggacgggagaaaatgtcactggtgatgaggagacgtcagcgaacaaggtcacgggctctgtggaggatgaaattgaggtcaccgatgacgaggacgagaggacgggagaaaatgttactggtgatgaggagacatcacacatcagtgaacaaggtcaccggtgactaggaggagacggtggagaataagcccagaagt

SEQ ID NO: 419 - DNA, 1571 bp, Sorghum bicolor
ccatcatggaggcgtcgtcgtcgtcgtctctgtggggcggcctcaactccggcatcgtgctgagcctgctggccgtggcatggaccatgctatggcaggcgctgcagggcctccagctgcaccacttcttcgatcgccactcccgccgcctgtcgcgccgcctcgccgccatcctggacccggacctcacggtgaccatcgccgagtacaacggcgggcgcatgcgccgcagcgacgcgtacaaggaggccaaggcgtacctggagcgcgccacgcgggaggcccgcggcggcggcgccggcggcggggtgcgccacctcagggcggagcccgacaaggaccccgaccgcgtcctgctcagcatggacgacgacgaggagatcaccgacgagttccgcggcgccgtcgtcacgtggcgcgcctgcaccgcgccgcagcgcgaggacaccgggccggcgtacttctggcggggcggcgccggccagcgcgccgagcgcaggtcgtacaagctcctgttctccgagcgccaccgcgacctcgtcctgggtgagtacctcacccatgtccgacgcgaggggcgcgccgtcatggtcaagaaccgccagcgcaagctcttcaccaacatctccggcgacggctcctgggactccgacggtgtgtggagccacgtggtgttcgagcaccccaagacgttcgcgacgctggcgatggacccggcgaagaagaaggaggtgatggacgacctggacgcgttccggaacggcaaggactactacgcgcgcgtcggcaaggcgtggaagagagggtacctcctgtatggcccgccgggcaccggcaagtccaccatgatcgccgccatggccaaccacctcgactacgacgtgtacgacatcgagctcacgtccgtgcgcaccaacaccgacctccgtaagctcttcatcgagaccaccagcaagtccatcatcgtcatcgaggacatcgactgctcgctcgacctcaccggcaagcgcaagcggaagaagaagaagaaggaggaggaggaggaggagggcaagaaggacggtgacaaggagaaggaggacgacagcaacaaggcgggcagcagcaaggtgacgctctccggcgtgctcaacttcatcgacgggctgtggtcggcgtgcggcggcgagcgcatcatcgtgttcaccaccaaccacgtcgagaagctggacccggcgctgatccggcgcggccgcatggacaagcacatcgagatgtcctactgctgcgtggagtccttcaagttcctggccaaggtctacctcgacgtggacgaccacccgcgcttcgacgccgtggcggcgctgctgcgggaggtggacatgacgcccgccgacgtcgccgagaacatgacccccaaggcgcccggcgagaacgccgactcgtgcctcgccgcgctggtggaggcgctggagaaggccaaggtggacgccgcgctggcgaagaagaagaaggccaaggggaacaaggaggacgccggcgccgccgacgatgaggacgaggaggaggaggaggaggaggaggagtagtag

SEQ ID NO: 420 - DNA, 1549 bp, Sorghum bicolor
gagccagcagtaacagtaagcagcagaaaccatggcgagatcagggcgggaaggggaggaacggaagctggtgctgggcaagtacgagctgggccgcctgctggggcagggcaccttcgccaaggtctactacgcgcgggacctgagctcctccggcgccgccggtggtacgggcagcggcggcagcagcagcagcagcagcgtggccatcaaggtgatcgacaaggcgcggctgcggcgcacggaggggatggtggagcagctgcggcgtgagatctccatcatgcggatggtgcggcaccccaacgtggtgggcatccgggaggtgctcgccagccgctcccgcgtcttcgtcgtcatggagtacgcccgcggcggggagctcttcgccaaggtcgcccggggccgcctcaccgaggaccacgcccgccgctacttccagcagctcgtcgccgccgtcggcttctgccaccgccgcggcgtcgcgcaccgggacctcaagcccgagaacctgctgctggacgaggaaggccggctcaaggtcaccgacttcgggctcgccgcgctccccgagcagctgcgccacgacggcctcctccacacgcagtgcggcaccccggcgtacgtcgcccctgaggtgctccggaagcgcggctacgacggcgcccgcgccgacctctggtcctgcggcgtcgtcctctacgtcctgctctgcgggttcctcccgttccggcacgacaactacgtcaagatgtaccagaagatcttcaaggcagagtaccaggtgccgccctgggtctccggcgacgcgcgacgcctcatcgcgcgcctgctcgtcgtcgaccccgcgaagcgcgcctccatcgcggagatcatgtgcacgccgtggttcaggaagggcttcgtgccgccagtcctttcaccgccggtaacgcccccgaagaaacggctggacgaggaccacgacgccgccggcgacctcttcgacaccgacgacgacgacaacagcagcagctgcagcaactctggcgccaccgccacctcgcctcggtcctgcaacgcgttccagctcatctcctccatgtcctccgggttcgacctgtcggggctgttcgagaacgagcagaaggccgcgaccgtgttcacggcccgcgcggcggcggccaccgtggtggagaagctggagtccgtagcgcgcaccctggggttcgagatcaccagggggaaggagagcgggaaggtgaggatggaggccaaggccgagggcacaaacgggcggctcgcggtcaccgccgaggtgctcgaggtggccgtggacgtggccgtcgtcgagttcgcgcacgacgccggggacgcgctggacttcaacaagttctgcgcggtggacgtccgcccggggctcgcggagatcgtctgggcgtggcagggcgacagcccgcccgcgccggccgccgccgtcgggaccgcgtgaacaagaacaaacggccccttcgtcctgtccgtgatgtaaaaattgtagcgactttgcgtaggagttacaccagcttca

SEQ ID NO: 421 - DNA, 3202 bp, Sorghum bicolor
cgcttcgttgccaacttccgctccaagcgtcgcggtcgccaagtctcatcggcgagcccggtggctgtgctgccgccgcgatggattcgaggccccgcgagactgacgcccccggcgacccggccaacggcgccgcccctccgcaggccgcggcggtgacgtccgcgaccgcgaccggggacgtcgagatcatcaggccccgcaacgacaagcgtgggtaccgccgcgtcgtgctccccaactcgctcgagtgcctgctcatcagcgaccccgacaccgataaggcggcggcgtcaatgaatgtttcggtggggtacttctgcgaccccgatgggctggaggggctcgcacacttcctcgagcatatgcttttctatgccagtgaaaaatatccagaagaagacagttactcaaagtacattgcagagcatggtggttcaaccaatgctttcacatcatctgaacacacaaacttctatttcgatgtgaacagtgatagcctgcatgatgctttagataggtttgcacaattttttatcaagccattgatgtctccagatgctacacttagggaaataaaagctgttgactctgaaaatcagaaaaacctcttgtcagatccttggcgaatgagtcagcttcagaagcatctttgtgcagagaatcatccttatcataagttcagcactggaaattggaatactcttgaagttaaagcaaaggagaaaggattggacacaaggcttgagcttattaaattttatgattcacactactcagccaacttgatgcaactcgttgtgtatggaaaagatagtcttgataacctgcagaaccttgttgaaaataagttctgcgatattagagatgttgggaggaagccattttcatttcctggtcatccatgtacacgtgaacatctccagatccttgtcaaagcagttcccattaaacaagggcacactttgagaatcctatttccaatcactcccaatattcggcgttacaaagaaggcccttgcaagtacattagccatctgattggtcatgaaggagaaggatctcttttttacatacttaagaagttgggatgggctataagtttggaagctggcgaaggggattggagtcatgatttttctttcttctccgttgttattcagcttacagatgtaggccaggaacacatggaggatactgttggactattgttcagatatataaagttgctgcagacctctggaactcctaagtggatatttgatgagcttcaagctatctgtgagacaggatttcactatcgagacaagagcccccctatcaattatgttgtaaatatttcttcaaacatgcagattttcccaccagaagattggttgattgcatcatctgtgccatcaaagttttcaccagatgctattcagaatattttaaatgaattgactcctgagactgtaagaatattctgggaatcaaaaaagtttgaagggaaaacaaacttagcagagccatggtatggtacatcatattctgttgaagctgtccctccatcaatcatacagaattgggtagataaagcccctaaggaagatctagacctgccaaaacgtaacatctttattccaaatgatctttcattgaaatgtgtagaggaaaaggcaagttttcctgccatgctgaggaagacatcattttcgagactctggtacaagcccgatacaatgtttttcacacccaaggcttatatcaagatggattttcactgtccactgtcccaaagctcacctgagtcagcagttcttactgatgtattcacgaggttgcttatggattatttgaatgattatgcttatgacgcgcaagttgctggcctctattatgctgttaagccaaatgacactggttttcaggtaactatggttggcttcaatgacaaaatgagaacccttttggagactgttattggcaaaattgcagaatttgaagttaaggctgaccgtttttctgtgataaaggaagctatgacaaaggagtatgaaaatttcaagtttcggcagccataccagcaagtcttatattattgttctctgatactggaggaccaagcatggccatgggatgaggaattttctgcactttcccatctcgaagctagtgatctgggaatttttttgccccgtttgctatcaaaaaccttcatcgagtgttattttgcaggtaatattgaagccaatgaagcaaaaaatatcgttcaccatcttgaagatgtcttattcaatgcacctattagtgcttgcaagccactatccccatcacagcatcttgccaagaggattgtaaagcttgaaaagggtttgagatactattatccagcaatgtgctcaaatcaccaagatgaaaattctgctcttctgcactatattcagactcatcaggataatgtcaagcaaaatgttctacttcaactacttgctcttgttggcaagcagccagcttttcatcaattgcgatcagttgagcaacttggctacatagcgcttcttaggcaaagaaatgattcaggtgttcgtgggttgcaatttataatccagtcaactgttaaggatcctgccaatctggatgccagagttgtaaattttctcaacatgtttgaaggcactctctacaatatgtctgatacagagttcaagagtaatgtaagtgctcttattgatatgaaactggagaaatacaaaaatatacgcgaggaatcagctttcttctggggagagatttctgaaggaaccctcaaattcgatagaaaacaagaagaggttgctgcactgagggagctcaagaaggaagagttgatagacttcttcaatgatcatgtgaaggttaatgcaccacaaaagaagattcttagtatacaagtgtacggtggtctccattctgcggagtacgaaacaatagtgcaaaatgctccgccgccgcagtcgtgtgagataactgatatttacagcttcaggagatcgaggcctttatatggatcattcaggggaggtgttggtcagatgaagttatagttcaacattttctcatctttctgtaaaattctgaaaaaaagaataatatttttgttcaactgcttttgttggactaggctggcctgcatctacgttcatagttcatttaatcgaggacaccatattagggcatttta

SEQ ID NO: 422 - DNA, 1027 bp, Sorghum bicolor
aaaggatcccatcagtcatcacacagagtgcgccatggcgtacaggacgctggaggtgactctcctgtcggccaaggacctgaagagggtgaacctgatctcgcgcatggaggtgtacgccgtggtgaccatctccggcgaccctctgacgcggcagtgcacccagccggacccctacggcgggcgccacccgtgctggaacacctcgttccggttcaacgtcccgcccagcgccgcgacggccaccggctgcctccacgtgctcctccgcaccgagcgcgccctgggcgaccgcgacgtcggcgaggtcatcgtgcccctggccgacatcctcgccggtggcggcgccgcgtccgaccccgggtcccggccgccgcagctcgcgtcgtaccaggtccgcaaggtgcaccgctgcgagccgcgcggcgtgctcaacgtgtcctaccgcctcggccccatcgtcgccccgcaggccagagccgtcgacgaggccgccggcggcgccggtgccttcgtcgggtatccggtgccgcggcagttctacgcgccgtcgtatgcctatctgccctcgccgctgtccctggcgccgccgccgcctccggcgcaagctgccggtcgcgacgcccagctgcacccacctccgcagtacagcttgcctgctgctacttattcgcaggcttatccacagcagccggctgctaattatccacagcagccggctgccgggcgcgctgctctgccggcgccggcgagcggggagagcaacggcaagctggacttcggggtgggcctcggcgcggggctggtcagcggcgcgatcggcgggatgctggtcgccggcgacgtgatgatgtctgacgcggcggcctacaattccgggtaccgcgctggactggccgacggcggcgcggcggcggtgtacaagaattcttatcgcgttcacgacaaagtcgaagcaaaacgggcggcggtgtgactcacttgaatcgatgcatactgtgtgattgtcattagtctcgtcaggcct

SEQ ID NO: 423 - DNA, 890 bp, Sorghum bicolor
gcaggcccagtttctttgtcaccgtcctcggaggggaaggagcaatggcagcagcagcagcctccgtgtggctgcagctgcaggtccctccccatcgtctccacagtcccccggtgctctccctaccaagcaaccattcttcctcacatgcatgccctccagtatacaaatacaagaaacatgcggcgccagggagaggaaaccttcttctctgcagggcctctggcgcctcctcctcctctgtggtgaccaaggagcaggagggagcggccagcgatccttcgtcagaggagggatattctgagcctcaaatctatagttacaaggatgaccccaacttcaggggctgcaagggctgcggcagagacgagcttgagaggggttgcaatggcgaagggcggatccagggcggcatagctgccgtcccgggcttcggctggtggcccatcaaggcgtaccggccgtgccctggcttcgtcgcgtccggcggccgctatcggcgccagggccaaagcatggacgacgttgcatccggcaggggaaagaagaaaccctctcccgccaaaaagaagagcgacaacaagtaatcccagcccaaggaactgcagtgttgacaatgctaggaagtgtgttgtgttattcaggccagggtgaccaatgagattcggctgtcactgtctgcatcagcagtagataatgtttcttaccagaaattcagaatctatccaagatgaaatctgggaatgtttgccattaccatggtggaattggggaagctcaagttattcagaaacaacagttttggtccacaatggcaatatatatgcactagttgggactggttgtagaaacatcaagaatgtagggtgcagtgttgttctcctaggctc

SEQ ID NO: 424 - DNA, 830 bp, Sorghum bicolor
cgccaatggccgcaccgccgcagacgatagcgctcgcggggctcatgctcctcaacttcgtcctcgccgtggcagcgctctgccttcacgtccttggccgacgcaggcctcggcagcaagtcccgtcgccgccgccgccgccgctcgagccggccgtcgcgggggaggaaggcggcggcgaggagaggccgcataaccagcggcggaggaggaacggcacgcaggaggaggaggaggaggggtcggcggcggcggcggcggcggatggtggtggccacggcgcggacggggaccgggacgccgccgcgaaggcggcggggaaggaggcgctgctcccccgccggccgcagttcccgctcgcctccgtggcaggcgcgctgcagcggcggatcaacgcgcggtacgacgacctcgcgcgggccagcgaggcgcagtgcctcaccatcgaacaggttaatgagtttgttaacagtctcatagatgctagaaacgagctgctgcagaggtatgagaatgtagaaagaagcttcaaaataaagaaggcaatgctatccaaccatcgaaactataggtcttcatatgaacggctctttgaacaggtacgcagattggaaaccgagcgtgataacctaaagaaagatgccgccatctacaactacattcaagagcgtcttcagaagtcagcagcatacaaaatgatcatggagctcggtactatggagatggaggcccaagagatatcattcgaggagctgctggctaaggagaaggaggacaccgccttctggcagcgcaacgggaagatgagatcattctcatccaagtagtag

SEQ ID NO: 425 - DNA, 752 bp, Sorghum bicolor
aaaggatccgagcacgtacgggttccatagcgcacgcatccgatcgatccatatccatcactcgcatcgcatctgatcatcatcatcacgagagcaccatgggcggagggcacgacatgcacggccacaacggcggcgtgaagggctacgtgtccaacctcgtccacggcggcggtggcggcggccatggccacggctatggcggcggccatggcggctacggcggccatgggcatggatacggcggccatgggcagggctacggccacgcgtaccctcctccggccgccgccggcgcgtaccctcctccgcacggcggctacccgcccgccgccgcctaccccgcgcactcggcgcactacgggaacatgggatcgtaccacagcagccacagccatggcggcggccaccacggcggctacggcggcaagcacaagggcggcatgttcggcggcggcaagttcaggaagtggaagtgaagctgaaagccatcgatcgaaacaacacgacacctacctctacggctctacgtacgtatctgccagccggcagccgcgtacgtacgtacgtacgtatcctgccagccgtagctaagcatgcactgcacacagttcctataaataaattaaataaagtagtgcaagcaggcaggacgcgtcctacgtgtacgtacgttcaatacgagtgccagtagtcgttatttgtatacggaataaagtgagacgtgtgtttctggtcatgttctcgagttt

SEQ ID NO: 426 - DNA, 1433 bp, Sorghum bicolor
ctcttccagttccagcaacacgcaacgctgcacctgcacttggcgtagccatgaaggagttctcgtacgaggaggtggaggcggcgacgggcggattcgcggcgaagaacctcgtgggcaagggcagccatggcagcgtgtatagggccaggctgaggggaggcggcggcaggatgacgaccgtcgtcgccgtcaagcggccgtcgcacgcgcagggggtggccaagctcgccaacgagatcgccgtgctctcggccgcgccgcgccacccgggggtcatcggcatcgtcggggtgtcgtcgtcgtcatcatcgccccagccgccgccgccgccggccgcgtcggggcctcggctccccccgctgctcgtcatggagttcatgcccaacgggtcgctgcacgacctgctgcaccggtcgccgaggccgcccccgtggccgcgccgcgtggagatcgcgctggacgtggcgcgcgccgtgcatgcgctgcacgccgccgcgccgcgcgtcatcatccaccgcgacgtcaagtccgccaacgtcctcctcggccgcgacggccgcgcccgcctcgcggacttcagcctcgccgtcagcgtcaaggcggtccacgcgccacctggagctgctggagcctgcggcggcggcgaggaggaggaggaggacgacgacgacgaggaggaggacgaagaaggcggctcgtcgtccgcggggccagctccggcgggcacgatcgggtacctggacccctgctacacggagcctggtcggctaggccccgcgagcgacgtgttcagcttcggcgtggtgctcctggagctcgtgagcgggcgcaaggtgatggacgtcaactcgtgcccgtcgtccatcgtgtcctgggcggctccgctgatcgccgcggggcgggcgcgggaggtgctcgacggcagggtggccgcgccgcccacggcgcgcgcgcaccgcgcgttggcccgcgtcctcgccgtggcggcgcggtgcgtgtcggagaccgtggagcggcggccggccatggacgaggtggtctccgagctgcgcggcgccctcgagagcgccgggtggcggtggcgccaccaccgccgcggcgacagcggcggaggcggcgtggtggagcgggtgtgcaggcgcgtcgcgtcgtgggggcagcgcgtgcggaggaggagcaagagggtggtgagggcgactaaggtcgagtgcaccgagcactccgacagcggcggcgccgcgaccggctcgtcgtcgtgcgcggctgctctgccatcgcatcggagcaacaacggcatgatgagcggcgccggcgcggcgcactcgaatgaatcatccaaagcaaaagagaacgctttgaatcgattcgagagcgaattggatctcgttttcagtagttgattgatgataaaccttggatggatttggtag

SEQ ID NO: 427 - DNA, 1680 bp, Sorghum bicolor
aaaggatccgctcgactgaatcaactgtttgagcctgacagcaccatgggttccggcgatttgagctcggagatggagaggaaggttcttggcctgacgctgtgggtctggattgccatcggcgtggtcgcacttctcgtggcgatcctgctgatgatctgcatttgggtggcgtcccgccggaggaccaagagaaccatggacaccctgaggcagacgcagatccccatctactccaaggagatccccgtcgaccgggtcggcgggcgcagccttgcacagacaatgcacgagcgcgagaagccgagcttgccgccgccggacaagtacaacgcgagcagggagccggcaggggccacgctgggccacctggcactcagcaagtcctcggaccatgataacatgagccaggggagctcggtttgcaatgtcgaccgtgctggcagcgtgcactccggtgaggatgggagctctggacctcggaggaaaccaaattcgcctgcggctttcgtgtcagcgtcgcccttggttggccttccagagttctctcatcttggttggggtcactggtttactcagcgggaccttgagcttgctaccgaccgtttctctaaggagaatgtgcttggagagggtggttatggagttgtgtaccgtggacgtctagtgaatggaactgaagtcgcaatcaaaaagatctttaacaacatggggcaggcagaaaaagaattcagagtggaagttgaggctattggccatgtccgacataagaatttggttcgactgttgggatattgtgttgagggggtaaacaggatgctagtatatgagttcgtgaacaatggtaatttagagcagtggcttcatggagctatgcatcagcgtggtgttttcagctgggaaaatcgcatgaaggttgtaacaggcactgcaaaagcgcttgcttacctccatgaagctatagagccaaaagttgtacatcgtgatataaaatcaagcaacatattgattgatgatgaatttaatggcaaggtatctgactttggattggctaaactcttgggatctgacaaaagccacattactactagagtgatgggaacatttggatatgttgcacctgaatatgctaatactggaatgttaaatgaaaagagcgacgtttatagttttggtgttctcttgttggaaactgtgacaggaaggaatcctgttgactacagccgatcttccaatgaggtcaatcttgttgaatggctcaaaacaatggtggctaaccggagggcagaggaagtggctgatccaagcttagaggttagacccagtattagggctctcaagcgggctcttttggtggcactgaggtgtgttgatcctgactctgaaaagagacctaagatgggccaggttgttaggatgcttgagtcagaagaagttccataccgggaggatcggagaaatcgtagaagtcgcactggaagcatggatattgagtccattgcagagggttcaaactccgcggagtttggaaagaaggtagaaaggactggaagctcaacatctgaccgatctcaaccatgaggcctggaaatctaagctataccaggaactgtctcagaaacgatgttaatcaccaaggtgattgctgtcctgatattggatgctggtaggctcgagttt

SEQ ID NO: 428 - DNA, 3634 bp, Sorghum bicolor
cgatcctctcttggatctcgccgcgcgctcgaaggcaagcggggccgcgatgcctgcggcggccgttcccggaggcggcggcgccgccgacgccgaggagctgttccgcaccaagcgcatcccggagattcgcgcggctgagggcgccacccgacgcgagatctccgccaaggaggaggagctccggcagctcgtcgggcgcagctaccgcgacctgctcgactccgcggactccatcctcctcatcaagcagtcttccgatgccatatcggacaacctcgcccgcatctccggctccttgtcgtcgctctcgccgccccctgaaccctctcccgccgtaagcgccgcctcgccgtccccgtctgctggagggcgcgcgaggctgtacgcgctcgccgcgcgcgccaagtacctggttgacacgccggagcacatctggggccggctcgacgagggcctgctcctggaggcggcggggcggtacctgcgagctcaggtcgtgcacgggcggctctcccgcgacgccgcggccgccgcgcggttcccgctcctcgcgcaccaggcgcagctcgtggaggcgttccggccgcagatcgcccagcgcgcgcgcgagcgcctcgccgaccgccgcctccctgtagcggcccacgccgacgcccttgcggccgtggccgcgatcgacgccccgtcgcttgccccggcccaggcgctcctcctgtttctcacctcgcgccgcgcttggatctctcaagccctagctgggctcgcctcggatctgtcatcctacacctctgtgctgtgcgatatctcgaggatcgtgcggatcacgcttggccacgttggacagttgttcgtgcctgcactcagtgatatgccgttgttcttcaagacggtgcttgagaagaccccgcctgagcagttgttcggtggcattccagaccctgatgatgaagcacggttgtggaaggagcacatgaatcagatcgaggctacaatggtgctgcttgagccagatgctgttgcacgggcctgtacggattggctcaaggaatgttgcactgaaatttttggtgtgattgctggtgagcaaaagttggttgatgccattgggagtggggagctgcttgggtcagtgcaaaggcttgtacgtgatgcactagatgggagggacggattggagggaagtttggagcagtggctgaagagcgtgtttgggtcagatattgagtcgccatgggatcagatccgtgggttaatcttgaaggacggcaaggatatttttgaggattggatggaggaagcatttgtgcggcggatgaaggacattgtgcattcagagcttgatggattgggtgcttgtgttaacgtgaaggaatcagttcatgctattggtgccaatgctgatccaaaggatgctggagatttccttgcatacctgcggaaatcttcaaagggcggtggtttctggttctcagagtctaagatcaagaaaggtggagttttggcacacttgaagccaattgctgatgaaaatgatttccatagctgcctaacatcgtattttgggccagaagttagtcggatcaggagtgcaattgacagcaaatgcaagaatatccttgatgatctgttaagctttgtggagtcacataattcagcaccaaggctgaaggaattggtgccatacctccaggagaaatgctacaggaccatctcgagagtattgaaagaattagaagctgagctcagaaagctctctgctttgttgggaaccaaaaaggagggtaacgacatacctgcagcttctattatagcggagaggtctctcttcattggtcgtctcttgtttgcgctgagataccattcaagtcatgtacccctaatactaggttccccaagggagtgggtaaaggaggctggtggtgcagcatttgccaggttatcatcacctacaccaagacattcgagggcatctttcgattctttggtatcttttacacccagaaggcgcacatttgacggtcccaggagtcctggaaggcaattctcggatagccccagaaaacaaactattgctgctgcagtgtctttgtttggagctgatgatagatccaatcctagacttgatgaactcaataagaccctgcagtcactttgcgtcatggctcataatgtatggatagcatgggtgtccactgaactatctcgcattctttcatatgatctcaacaaagatgattcactatcctcttcgactcctttgaggggctgggaagtcacagtaattaaacaagaggaatcaactgagggtcccttggagatgcaaatagctcttccgtcgatgccttcattgtacatcatatcctttctttatcaagcatgcttggagattcataaggttggagggcacatcctggacaggatcattttacataattttgcatgggagctactgcagaaggtcatcaatatttatgaaaaatttctttcatctgttgaatctgggaattctccggtttcagagaaaggaattctgcaaatactgctagacttgcgtttcattggtgatgtgctatcaggaggtaaaagttcttccgccaacactactgaaatgcagacaaaacaggattctttgccaagcaccgtcaccaagacttccttcaggagaaaacagtcacaattacaggcagactcagctgtcatagagcctataaacaagttaatcaacaggctctcacagagattggatcctatagactgggccacgtatgaaccttacctgtgggagaatgagaagcaatcttacaagcgttatgttgttctttttggttttttggtccaactgaatcacatgtacactggtactgtacaaaaattaccaacgaaatcaaatacagattcaaatatcatgagatgctctcaggttccaagattcaagtacctaccaatcagtgccccagctatatcatcaagatcacacaaatcatcactacagtcgccgtctagcgactccacatctaaaagtccttggaaatcctattcaaatggagatagatctactacaccagagtttgatgataatgcaagtcttgtcggtgctgctccattgcttaagtcatttgttactcaggtggggagcaaatttggggagaacacatcgagatgggggtccatgctctctgacgggcaggttggtaagctaagtgacatccttccgggaccagcagctgggtttttctcttctttcacatctggaactcgatatgattcatagtaatggcaccatgacccttgatctttagcccttactacacgtcatacggaaacccacatgtgtcatcaagagagcaaaagaactgttggcaagtgtaatatgcctttggaaatctgctgctcacagaatgatgccacattgctggtccagtgttgcttggcatatcctgccgcgcctctgcacatcttattgtgactagacagtgtcatggagaagctcaggaaattatgatggagaagacgagatttattctatatcggctgcccacatgttgaatgagcagttaaggaaatcaagtttggtttcagtgtgtttcctgcttgcaatttgacttggtacataggacagagcaagtgcaac

SEQ ID NO: 429 - DNA, 1508 bp, Sorghum bicolor
acggttgagagccacacacaccgagacgtcacgcgcggatggccgccgccgcgacgggggagacccgcggctgcggctgccacattgtggcagtgccgttcccgggccgcggccacgtcaacgccatgatgaacctgagccgcctcctcgccgcccggggcgcggcggtcaccttcgtcgtcaccgaggagtggctgggcctcatccgctcctcctccacccacgccgaggcggccggcatccgcatccgcaccatccccaacgtcatcccttccgagcacggccgcgccgccaaccactcgggcttcctcgacgccgtcgccacagagatggaggcgcccttcgagcgcctcctcgacgggctcgagggcccgccgcccgcggcgctcgtggcggacgcctacgttccctgggtcgtcggcgtcggtaaccggaggggtgtccccgtctggtcgctcttccccatgtccgccgcctttttctccgcctactaccacttcgaccgcctcccggcctggcttaccgactatgagcacgcgccggactccggtgagacgataggtaactctgatcagagacttggacactatatcgctcgacacgcttcaagttcaataaggttgtcagatcttgagcccttaattcacgacaagagaaaagtgaagcatatcctagcaaccatctctagcgttagaaatgctcagtctctccttttcaccaccatgtatgagcttgaggccagtgtcattgattcgctaaggtcagtactctcttgtccagtgtacccaatcggcccctgcgttccctacatgacgcttgaagaccagcataccatgtccaatggcgaagttgccggccaaagagactatttcacctggttggattctcaacctgtgaactcagttttatatgtctcccttggcagctttgtctcagtctcagcctctcagcttgaagagatcgcattgggcctagtagccagtcaggtcaagttcttctggattcttcgtgaacaatcccctcgggtgcaagaactcttggctggcatcaataatgggatgatactgccatggtgtgagcagcttaaggttttgtgccatcattcagttgggggcttcttgacccattgcggtatgaactcgacacttgaagccgtctttgctggtgtgcctatgcttgccttaccactgttttttgatcaaccgattgatggacgattaattgtggaagagtggaaggttggcctgaactttagggattgggctagcaaggatgatctgatcgggcgagaggatattgcacgggctgtgaagaagctgatgtcttctgatgaaactgagacgaaggctctgagggaacgtgctcttgagttgaaggaggcttctcgcagagcagtagacaagggtggatcttcatactgcaatctgagttcattgatggagacggtatgcactccaaaataattggaattgtatttggtatacgctgaaaccgatcttgtcacttag

SEQ ID NO: 430 - DNA, 2576 bp, Sorghum bicolor
gttaatttctcgcttggattggaggctgcatgccctgcccctggctagctgcagcaatggcgactcgcggtggagggccggctgcggcagccgtccttctgcaactcctcggcttcctgtttctgctgcggggagttccgtcgcgagccgaggacgacaccgtcgccgccggacggccgctgtccggcgggcagagcctcgtgtccaagcgtggcaagttcaggctcggattcttccagccagacaactcgacccagcgctggtacctgggcatctggtacaaccagatctcggtgcacaccacggtgtgggtggcaaaccgggtgacgcccatctccgacccggagtcctcgcagctttccatctccggcgacggcaacatggtcatcgtcgaccacagcagcaggtctaccgtcgtctggtcaaccaacgtgaccgccaccaactcatccacggtcggcgtcatcctcgacaacggcaacctcgtcctggcggacgcgtccaacacctccgccgtgctgtggcagagcttcgaccacttgggcgacacgtggctccccggcgggaagctgggccggaacaagctcacgggcgaggtgacgcacctcgtggcgtggaaggggtacaaggacccgacgccgagcctgttcgcgctggagctggacccgcgcggctccagccagtacctgctcaactggaacggcagcgagcagtactggagcagcggcaactggacggggacggcgttcgccgccgtgccggagatgacgcccaccggcgcgtcgccggtgtccgagtacaccttcggctacgtcgacggcgcgaacgagagctacttcatctacgacgtcaaggacgagtcggtggtgacgcggttccaggtggacgtgacggggcagatccagttcctgacgtgggtggcggccgcaaacgagtgggtgctcttctggtcggagcccaagcggcagtgcgacgtgtactcggtgtgcgggccgttcggcgtgtgcaccgagaacgcgctgccgtcctgcacctgcccccgggggttccggcagcgcgacctggcccagtggctgcaggacgaccacaccgccggctgcgccaggaacaccgccctgcagccttgcagcgccgccgccgctcgagacgggcagaagaagcacagccgcaggaacgatgataggttctacacgatgcccaacgtgaggctgccgagcaacgcgcagagcacggcggcggcgagtgctcacgactgcgagctcgcgtgcctccgtaactgttcttgcaccgcgtactcctacagcggcggcggcggctgctcgctgtggtatggggacctcatcaaccttcaggacacgacaagcagtggcactaccggaggcagcagcagcagcatctcgatccgcctcgctgcgtccgagttctctagcaacgggaacaccaagaaactgatcatcgggctcgtcgtcgggggtttcgtcaccgcggtcaccgccatcgttctggctacaacgttcattctaagaaaacgaaggatcaagtcgttgaggagggtcgaaggatccctggtggcattcacgtaccgcgacctgcagttggtgaccaagaacttctcagagaagctcggcggcggggccttcgggtccgtgttcaaaggggcgctgcccgacggaaccctcgtggcggtgaagaagctggaaggcgttcggcaaggggagaagcagttccgtgccgaggtgagcacgatcggcacgatccagcacgtgaacctgatcaggctgctcgggttctgctccgaggggtcgaaacggcgcctcctcgtctacgagcacatgccaaacggctctctagacaggcacctgttcggggccagcagccaaggccaaggtgtcctaagctgggacaccaggtaccagatcgccctgggagtcgcgagggggttggactacctgcacgagaaatgcagggactgcattatccactgcgacatcaagcccgagaacatcctcttggacgacgcgttcgtgcccagagtcgccgacttcgggctagccaagctcatgggccgcgacttcagccgcgtgctcaccacgatgcggggcacggtggggtacctggcgccggagtggatcgccggcacggccgtcactgccaaggcggacgtgttcagctacggcatgatgctgttcgagattgtctcgggccggaggaacgtcgggcagcgcgcagacggcacggtggacttcttcccgtccacggccgtcagcctgctcctcgacggcgacgtgaggagcgccgtggacagccagctcggcggcagcgcggacgtggcccaggtagagcgggcctgcaaggtggcgtgctggtgcgtgcaggaggacgagagcctgcggccaagcatggggatggtggtgcagattctggaggggctcgtcgacgtcaacgtcccgcccatcccgaggtcgctcaaggtgctcgccgatccgtccaagtacgccgtcgagttcttctcaggcttgccgtcgacctgagattgggccactgtctgttagcggcatcaaacttacagtagggcg

SEQ ID NO: 431 - DNA, 1646 bp, Sorghum bicolor
aaaggatcccgcttctacaactccaccactcagcccgcccgccggagcaatggggagcacggggcgcgagccggaggtgacccgcgccgacttccccgacggcttcgtcttcggcgtcgccacctccgcgtaccagattgagggagcgagaagggagggaggcaaaggagacagcatatgggatgtatttacagatgacaaagaacgtgtcttagacaaaagcaatgcagaaattgcagttgaccactaccatcgatacaaggaagacattgagctcatggcaagtctaggttttagcgcgtacagattttctatatcttgggcacgtatatttcctgatggcttgggggaaaaggtcaatgagcaaggagtcgccttctacaatgacctcatcaactttatgatttcgaaaggtattgagccttacgcaactctgtatcattgggatcttccaaacaatcttcaaaaaactctggggggctggatttctgacaagattgtggagtactttgcattgtatgcagaagcttgctttgcaaattttggagacagagtaaagcgttggataacaatcaatgagcctctccaaactgcaatcaatggttatggtattggaatatttgcacctggtggatgccaaggtgaaactgcaagatgttacttggctgcccatcaccaaatcttggctcatgctgctgctgttgatgtttatagaagaaaattcaaggctgcacaaggtggtgaagtaggcttcgttgtggactgtgaatgggcagagcctttttctgaaaaagcggaagaccaaattgctgcacaacggaggattgactttcaacttggatggtacctagatccgatatattttggtgattacccagaaagcatgcgtcaacgactgggcagtgatcttccaaccttctcagagaaagataaagaattcatcaggaacaaaattgattttattggactgaatcattatacttcgagactcattgctcatcaccaaaatccagatgatgtttatttctaccaagtgcaacaaatggagagaatagaaaaatggaatagtggtgaaaaaattggtgaaagggctgcatctgaatggcttttcatagttccttggggccttcgtaaagtacttaattatatagtgaagaaatacaataatccagtaatttatattactgagaatggcatggatgatgaagatgatcaatccgcaacacttgaccaggtcctaaatgacacgacaagagtcggttacttcaaaggatacctcaattcagttgcacaagccatcaaggacggagctgatatccgtgggtactttgcgtggtcattcctggacaactttgagtgggctatgggctacaccaagaggtttggtatagtttacgtcgattacaagaatgggctgtccaggcatcctaaagcatcggccctgtggttctcgcgcttcctgaagggcgaggctgccgaaaacaaacctgatacaaactgagcgaacagcccgcagcaagtacagaacattacatatacacacactacacgtctcttctgttgttgtatcttacagtgagcaccggtgtatgtatgtatgtacgtaatagtctcagatgtgcttcctgcctatacctctcgagttt

SEQ ID NO: 432 - DNA, 3322 bp, Sorghum bicolor
aaagtcgacagaagaaccatcatcatcatcagccgcagcgccagcgcccgggaggagatgtagctctagctccgcggcccgcgaggaaaaggaacggggaatgaccgttacggcacgcgggaggagcggcggcggggtcgggatggaggagaagtgcgacgcgcccgggttcggcttcctgggcctcgaccggatgcgcgtcctcctgccgccgctccgcctgccggagaagctgtcggccagcaggacgctgcggacgcacctcttcaccaactaccggatgcgcaaggtgcgggacagctccaggtggctcatcccgctctgggtcaccatctgggtcttcatcgcctccctcctctacctccggatgagctaccaggccgtcgacaagcgccgggagtcgctcgccatcatgtgcgacgaccgcgcgcgcatgctccaggaccagttgaacgtcagcatgaaccacctccaggcgctcgccatcctcgtctccaccttccaccactccaagacaccctccgccatcgaccagaaaacgttcgcgtggtacgcggagaggacggcgttcgagcggccgctcacgagcggggtcgcgtatggggtcaaggtcacgcacgccgagcgggagcagttcgagcgccagcagggatggagcatcaagaagatgtactcctccaaaaccaagaagcagtcgcagggacaagggaacggcgaggacgccgaggtgcgggagccggcggaggagtatgctcccgtaatcttcgcgcaggacgcctacaagcacgtcatctccttcgacttgctatccggcgccgatgaccgcgacaacgtgctccgagctagagaatctgggaagggtgttcttactgctcctttcaagttgctcaataatcgcctcggagtgatctccacctacgctgtgtacaagtatgagcttcccccaaatgccacgccacaggatcgcattcaggctgctataggctatttaggtggcatatttgacattgaagcgcttgttgataagtcgcttcaccagctcgcgggcaagcaatccatcatggtgaacgtgtatgatactactaatgagaaaccgatcagtatgtatggttcaaatgatacaggaagtggcatgtgccaggtcagcacactgaactttggtgatccgacgaggaagcatgagatgcactgcaggttcattcagagcccaccttggccttggctggcaataacgacatcaattggaatttttgtgattggtttactggttggatacatagtttatgctactgcaaaacggattgccagagttgaagatgactttcaggagatgagtttgctcaagaagcgcgcagaggatgcagatattgccaagtcacagttcttggctaccgtttctcatgagatcagaactccaatgaatggtgttctagggatgctccaaatgctcatggatactgatttggacacaacacaacaagactatgttagaaccgcacaagccagtggcaaagctttggtatctctcatcaatgaggttcttgatcaggcaaagatcgagtctggtaaacttgagcttgaggcggtaccattcgatcttagaacagtttgtgatgacattttgtctctcttctgtgggaaagctcaggagaaaggactggagttggcagtgtttgtttctgaccaagttccacaaacactaattggcgatccaggcagaataaggcaaatcattacaaatcttgttggaaactctataaaattcacagagaagggtcatatctacttgactgttcatgtcgttgaggagattatgcattgtttggaggttgagaccacaaataccttaagtaggtacccagtggcaaacaggaagcgcagttgggaaaactttcaactttttagtagggaactgaactcctccgagatgccttttgcacccggtgcatcagactcaataagcttgataatatcagttgaagatacgggtgttggaatcccgcccgatgctcagtcccgtgtcttcacccctttcatgcaagtaggtccatccattgctcgcatccatgggggcactggtattggattaagcatcagcaaatgcttggtcggcctcatgaagggagagattggatttgcaagtaaaccccaagtcggttctactttcaccttcactgcagtgcttacgagggcccactccagtggaaatgagaataaatcatcagagtttaaagagatcaatgcattggtggtagatcatagaccggtccgtgccaaggttactaagtaccatttgcagagactgggggttcacaccgaattgacaactgacctagatcagtatatttctaaaattaattgtggatcacagattgcaaagcttgtgctcattgacaaagaaacctggctggaggaatcccactctatgcctcatttggttactaaattgaggaacaaagatcagccagactctacaaagttatttcttttggagaaccctaaaagttctgtcaaaagcagtttgcatatattcagggaatataacttgaatgtaattatgaagccacttcgtgcaagcatgcttcaggtttccctacaaagagcattgggtgggatagataaactgcattgcaggaatggggtagttggcaattcaacacttggcagccttcttcacaagaaacgaatcatagtggttgatgacaacattgtaaatctcaaggttgctgcaggcgctctgaagaaatatggcgcagaagtaacttgtgctgatagtgggaagaaagcaatcacactgctgaaacctcctcacagatttgatgcttgtttcatggacatacagatgcccgaaatggatggatttgaagccacgagaaggattagagtgatggaaagagatctaaatgagcaaatagaacgtggagaagccccactggagtgcgcaggggtccggcagtggcgaactccaatattagccatgacagcagatgttattcaggcgacacatgaacaatgcttaaaatctgaaatggacggttatgtttccaagccattcgagggcgagcaattgtacagagaagtagctcgctttttcctaaatcaagaccaagttcagtaggtaggcttatatggagtgtaaaatagtggaggatatcggcaacggttcacctgtcgaggctgaaagaattttgtcagagatcttagttcttgagagtgggcatcaattcgcagagttaggggccctattaaaacactagaaatgctgggatgtggcctccagttaggtggaaacactttaggctggagatggaacggatccttt

SEQ ID NO: 433 - DNA, 1727 bp, Sorghum bicolor
tcatcatgccattgccattggcggcccagagcgctctcgtcgcggcagccgtcgccatagccacggccaccgtcctcctcctcgtcccatggacgccaacgccgcgggaccgcttcgccgacatggtgctggccaacgccaccatctacaccgccgaccccgcccgccccttcgccgacgccatggccgtccgcgacggccgcgtgctccgcgtcgggacctacgagtccgtcaaggagctcaacggccgccacacgcatgagctgagtctcagtgggaacgtggtactgccagggttcatcgactcccatgtccacttcatcgatggtggattccagctagcgagggtgccacttcgagggatcagaaacaaagatgacttcattggcagagtcgaggaagctgtcagagataaacatcctgggcagtggattttaggaggaggttggaacaatgatttttggggaggtgacctccctgctgctgcttggctggatgatatgtcacctgataatccagtctggctctctcgtatggatggtcatatgggagtagccaactcattagctatgaagattgctgggattgacaaaaacacagacgatccaattggtggaacaatcatgcgaacaaccggaggagagcctactggtcttctagttgatactgctatgaagcttatatttgatgtcattgaaaaagtttctaaccatgaaagaagagaggctcttcttagagcaagtaaacatgccctaatgaggggagtgactactgttgttgatgttggaagttacttccctgggacctcaacagagaaaacatggcaagattttgcagacatctatgaatgggctcactcaatggaaaaaatgattatgagagtatgcttattctttccaatgcccacatggtctcgtgtttctgatcttattgatgaacatggtcgatcactaagtcagtggatccatctaggtggtgttaaagcttttcttgatggttctctgggttcttcaagcgcattgttccatgagccttacgagggtgatcctggtaattatggtctgcaagtgacagatttggacagcctacttaatagaacactagaatctgataaatctggactccaggttgccatacatgcaattggggataaagctaatgacttgctactggatatgattgacaaggttgttgatttaaatggagtgaaggaccgtagattccggattgagcatgcccaacatctggctccaggtgcagcaaatcgctttggcaagcatggtatcattgcatccgtgcagccagatcatctattagatgacgccaactcagctggaaacaagattggggtggaacgggctgaacgaagctcctacacatttcgatcactgttagatggcggtgcacagctagcttttggctctgattggcctgtttcagacatcaaccctctacaagctatccgaaccgcaatgttccgtaagcctcctgggtgggaggtcccctggatccctgcagagcgcttgaccctagatgaatcactgaaagcgcatacgatgtctgctgcctacgcctgcttcttggaccacgccgtgggcagcctttctgaagggaaatacgcggattttgtggtgctgccctctacatcgtgggacgaattctccaacgatgtgccggggcaggtcctggcgacgtacgtgagcggcaggcaagcctatccatgatga

SEQ ID NO: 434 - DNA, 4211 bp, Sorghum bicolor
aaagtcgacttcacaggtctaggcatttatcctaccagtacatatagaattatagatagactaatagtacctaatatgtatccagcaaaccactacatggatccataccactcgcactacagaaatcatgctccttacccatactatcctcctcctagatgggaaatcccatccggtcacccacgggcaatggactcatcttattattatcggccaccaagctgtggaacttggccatacaatcatgatatgcatcactcacatccttctgagctccattgttgctgcaaccaaacatatcctcctggttactacagtttcagacccccattccctcaagaacttccaccccctcatttatattatcatgggccatttccacagcatccaaatgcatggccttcttactttgtcccatcacatccctaccctgttgatcatacaccatatggttatgacaagttcaagggccattgttgtggatgtccaaatcatgtgtgccctggggctgagaagagcaatgtgaaaattgaggaagaaaggcctgatgtcaagcttgagagtgaacacaagaatgctgatagcggcagtataattcaacacccaaacagcaagtatcctttcatatggctaccaccaggcaatatgaaaggcaaggagaatggagagcattatgaattgtcacctcagattttcaatgaatgggctccattgagtagcaagaggttaggggatgtgaagcaacaagagcaagataatcagaaggggaaacaattccagtggccaatggtttggatgccagcaggatatgatgcgccgaagcaaaaagctaaagagatgaatgacacggaagggaccccaaaatccccaaagatttctgaagagtctcctcaatcacccaagatcaagatcattcccctgtcttggtttgagaatggtcatcatcatgatcagaaactggctgccaaaaatgactctggagaccacaacaaaagatcagcagtaaagaaccaacctgtgcttactaataatgaagatgaagatagcatgacactggaaggaaaccctaaaactactccagctgtgcccaagagcataaatgatgagaagaaacctctaagggaaagctgcaagaccattccagttgtgccagagaaagagattaatgaaaagaaggccagtacttgcagaaccattccagtcatgaaaggaagtgatgagaagaagattggcatgaaggaaaagaaagaggcaaaggagacgaacagtgttgaaaaggtagaagagaacaggaaaacaaaacacagtgactcatcaatagctaagcattcaaaattgcccccagtatgcttacgtgtggatcccttgccaagaaagaaacctggaaatggttcttctaggtctcctagcccaccaacaaggaaggatgctgacagcgcaaaggacatgaagaacccgcagaaccagaacctggagcctaaacagtctggtacaagtaatcatatcgctgtgtcagaggtgaaagaaaagtcgccttatgaaatgaagaaggaaattgggtttagaaatgaaacagtacaagcttctgctgttgaacattcacaggatgaagaagctcccacaagtgaagatcaccagaatgtccaagctggtagcactatggtgggtactcaagaaaatacaggcacgaagagcatacagggaggtgctgtgcaagaaaatgttggtgcagggagcttgaatggatgtgacaaaagcaaaaatgaagatgggacagtgattgaaagtgaagctgcaaaagatgacaaaagcaaaaatgaagatgggacggtgattgaaagtgcaaaagatgacgccaggacatatagagttaatttgtcagaaccagatgctgcagttcgtattcagtctgcatacagagggtatgatgttcgaagatggcaacctttggataagctccggaagatcaggcatgtgcatgaacagatgcaaggtgtgaagaagcagcttcaatgccttgaagattcttgcaataagccaacacaaaaagagcaagtggccattggtgaaactatcatgaatttactcctgaagcttgacacaatccagggcttgcatccaaatgtaagggaagctaggaaatctgttgctcgagaactgatatgcttgcaggagaagcttgatactctatgcaaagcgccatttggggacttggatcacacaaatagtaatgatgatggtgagtctgagaggaccaagagcattatccaaactgcagctcctactgtaacaactgaagcttctgatagacaggagagagctgttgaaatgggtaaggtagaagaaccatcttcagtgagcatggagccatgcaacacagttccatctgaagtttcctgggaggtgaggccagatgcagacttcagtgagaggagtgaaaaacaagagtcatgtagccccacagtggacgaagcacatgaagaggtagcatcatcaatggatatgacaagtgatgaagtttttatagaacatcccactgacaaccaggagcacggaattcgagaatcaaatgttaattcagtggaacaagtgactgaagaagagaaaccagcagcagaggatgaagtaaaagagtcactaactgacaaccaggagcacggaattggagaatcaaatgttaattcagtggaacaagtgactgaagaatgtcaacaggaaaaaccagcagcagcggatgaagtgaaagagtcgccattagtgaactccatggcaccattgtattatgcagcttcattagaggattcgagtgggctgaaacaatacacagcttcgacccatcagaatctctatgctgaatctcctgcatccactgaggacattaacataagtgctctgactgcatctgtggaaagtgaagtggcaactgagaaagatggcccagttgacagtcaggtgcatgaaactgcagctttagaaaatgtggaactgaaagatgatgtttcttgtgctgaaaatgagcataacaaatcgggcagccctgttcatttggaggatccactagtacctttgaaggatgtagaaaagcatgatctaactcccgcaaaggactttgtcgtatctaacacagaagatcaacaagaagccagggatatccgcttgcaggtacaagatgtggattccatggaagattcaggcaaagtaccagatggaaccatagaggcttcaaccgatgatgatttagaactgggtactgcagatgtagaaaagcatgatcaacctaacttgctggaaccaagattggagtctgtttctgccccagaattgtctgtcttggatgagtctgatgataaaatgcaatgtggtgtttctggcaaggatgaggtaccacatgtggatgagaaaaccgaaactactgttgacaaggtaaccggaggttctgcaaactgcgaggatcttctttgtgagtcatcaaggacggaacctgacattcaagagagtcacactagccttggagaagaggtagacgtcacaatcacaacaggtggaacagtcttccctgattcagttagttgtgatttatcatgtccacacgatggtggcatgacagtatacgagggatctgagacggtgtcatcagagaaccaaactgatgctcagaaagaaaacatccattcagatgtctctcagacagatgaatgcactaagactcagaaagtccctccagtaggcacacagggagaaaattctgctgaagattctgatgtgcaggtgtctgagatggacaaatgcaatgagatgccgaaggaagctccagcacatgcaacaggagcaaatcctgctgaagacgaagcttccctgaaagaagacatcactgtgcagacagacaacaagccttctgcctccccagctcctgaagatccaaaggtcagtgacaaggagaagctggcagaagaaaaccagaagctgaaagagcttcttcaaaagcttctcgcatccggcaatgatcagatgggggtcatcacagacctaagtgagaaggttaaggcgcggaagctggcacgcaagaagaggccaaaggtgagggtgcacaggccgtccgggcatgtgactgccaaagtccactgaaaggaaggataatcttaaggtttgaggttatgttgtatggatcccatgttacttcttgtgtccatgttgtatttgcacccgggttt

SEQ ID NO: 435 - DNA, 2448 bp, Sorghum bicolor
cggaccatgaaaatgagccccccggctctcgccgccggcaccacctcaccgctgtcgcctcccaccgctgccgtctctgcccaccccttccctcccacgaaccacaagcctcacagcgcccgcatccgcctctcctccgccgccgcggctacctccagctccaggtgggtcaacccgcgggcacccccgccccggcgcggcgcgggcaggagcggggctaaccagcggctgcaccacctcgtccacctcggcgacctggacgccgcgctcctccttgtggagtccatgcgggatcccgagcgacccgccgcggttccctgtacactcctcatcaagaagctttgcgcagcgggccgcctcgacgacgctgagcgtgtgctcggggcctccgagcgcgcgggcaccgccgatgccgtcacgcggaacaccctcgtcgcggggtactgccgcgcggggggtcgtctcgccgacgccgagcgtatgctggcctcccttgccttgtccggctccgccgatgtcgtcacctataacaccctcgtcgcgggttactgccgcgagggccgcctcaacgatgcccggcgcctcgttgccgacatgccgttcgcccccaactcgtacaccaatagcaccctgctcaagggcctgtgcagcaacaaggagtgggacgatgccgaggagctcctctccgagatgatccggagtggttgccccccaaatgatctcacgttcggtatgataatccattcgttatgccaaaatggattggctgaccgtgcaatgggagttcttgatcagatgtccaagtgcaggtgcacacggggcgtgattgtttacaatgaaatcatcagttgccttgcagagctggggcgtgttgaggaggctcttcatttattcgaccaaatgccctgcaaacctgacatctttagttacaacactgtgatgaagggtttgtgtagagatgggcgctgggaggatgcaggaacgcttattgctgggatggttagaaaggattgccccccagatgaagttacattcaacacagtaatcagttacttgtgccacagagggttggttgactgtgcaatggaagttgttgagcaaatgcccaagtatggatgtaaacctgataatttcacctacagtgccctagttaatgccttatctgaacgtggctgtgtggatgatgctcttgagttactaagaactataccatggaaacctaacactgtttgctatcgatccgtactgaagggactgtgcagagctgatcgatgggatgatgttgggaagcttgtagctgagatgatcagaaaccagctgaaccttgatgaagtcacattcgggttgatcatcgactgtttgtgccaaaaagggctagttgactatggtgctgaagttttgagggaaatgacaaagtttggatgctcacctgatattatcatatacaattctcttatcaatgggttttctgaaaatgggagtgtggatgatgccctcgagctattcaaaaacatgtcctgcaaacgaaatgttgttacctataattatatgttgaagggtttgtgtagagctgagcaatgggaagatgctgggaagctcgtagctgagatggttaaggatgaatgtctccctaatgaagtgacatttagtaccctaatcagctatttgtgccaaaaaggttttgttgagtgtgcaattgaagtttttgagaaaatgccgaagtacaattgtatgcctaatgttataatctatagcacccttatcaatggcctttctgatcaagagtgtgtagatgatgccttgaagttactaaatgacatgccctgcaagccagataccatttgctatagtgctgcattgaaaggcttgtgtagggccgagcgatgggaggatgctggtgaactgatactggagatgattagaaagaactgtcttccagatgaagtcacattcagtatactaatcaataacttgtgtcacaaagggtttcttgagtctgcaactgaagtttctgagctaatgcttaagtatgaatgcatgcctaatgttttcatttacagttccctcattaatggctttgctgaacaataccgtgctgaagatgctctccagttactaagaaacatgccatgtgagcctgacaccatttgctacagcgctgcactgaagggtttgtgtagagcaaagcgatgggaggatgccagggagcttatagctgagatgtttagaaagcagtgccccctagatgaagcaacattcagtatgctcattggttcattgtgccagaatgggctggttgacatggcaactgaagtttttgagcaaatgtcagtgtatggatgtagccctaataggaagattcatagttcccttgtcaatggctattctgagcaaaggcgtgtggatgaaggcctcaagttattgagcagtatgccatgaaagccttga

SEQ ID NO: 436 - DNA, 1498 bp, Sorghum bicolor
caccagctacctccctgcggctgctttgcatcgcctcgcctcgcctcgctggccgttagggcaaggcgagcggcaggcggcaggcggcgaggccgccctagtaaaggatgatatacacggcgatcgacacgttctacctgacggacgagcagctgcgcgactcgccgtcgcggaaggatgggatcgacgaggccaccgagaccgcgctccgcgtctacggctgcgacctcatccaggagagcggcatcctcctcaagctaccacaagcggtgatggccacggcacaagtactgttccatcgcttttactgcaagaaatcatttgttcgattcagtgcaaagagagttgctgctagctgtgtttggctggcagggaagttggaggagagtcccaggagatcaaagcatattatatttgtcttccacagaatggaatgtaggagagaaaacttgcctatcgaattcttagatgttttttcaaagaaatattcagaactgaggcatgacctgatacggacagaacgacatctgttgaaggagatggggtttatttgccatgtcgagcacccccataagttcatatcaaactaccttgcaacacttgaagcccctcctgagcttactcaagaggcatggaaccttgccaatgatagcttaaggacaactctgtgtgtgcgatttaagagtgaagtagtagcatgtggagttgtgtatgctgcagctaggagacaccgtgtaccccttcctgaagatcctccgtggtggactgtctttgatgctgatgaagcaggaattcaggaagtttgcaaggttcttgctcacctctacagcctgcccaaggctcaatacattccagtgtataaagacaatgattcctttactgttaggagaatctctgatccacaggcttcaaaggaaagtccagcaagtgctgttgctagcgataagggtacccccataccctcaagttctagccaggagaaggattcagtgactaagactatactaaacaaggtgaaggaaaaaagtgatgacgaaggtaaaccattacccgctgaacttgatggaaaagaaaacttggtggtgaactcgaaaaatgagaagtctgattctggtgttgaccggagtcgggaaagagaaagagagagatcaagagggcgggaacgtgatgccaggggtagggattcggatcgtgatagcaggggtcgtgactctgatcgcgagagggaccggagacgtcgctctagggaaagaagttcaggacactcagacaaggagaaatcaaggcgacattcatcacgagaccgggttgactactacagttcgcattcatctcgtgaaaaagatcggcacaggcaccattgatcaaggtgaggaggatcccgatctgcagggcatcgctgcatggagaccaccacttggcagtgccgacccaatcatgaaaacttgtggattaccatcatcccattggtggttgcattggcttcattgtttatgca

SEQ ID NO: 437 - DNA, 878 bp, Sorghum bicolor
tcgcctactccctagtccctactccccacggtcattctcgtgcagccgggccggcggcaccggaacagggcgcagccggagcagcggcgccttgtgcttgtgccactgcccacatccagcggtctggcgcctccactgttctattccttttcgtctgctccaatccagctgcggcctctaatttgtgctccaccatgaagatatcctggggtaagaattccaaggttaagaaacagtcggtggtagtatcaactataccaggcctaccatttggagtggggagtgacaacgatgaggttgaaagggaggaaaaatcagatgcaaacacaaactgtcctggaacaaagccagttgaaactgctgagttgctccagagtcagggagacaagctagccgaggaagggaagtaccatgaagcacttgctaaatgggaggctgcgcttatcttgacacctgataatgcaatacttcatgagcagaaagctcaggttttacttgaagtgggggatgcatggcgtgcactgacagcagcaaccagagcaacagaactggatccattttggcctgaggcttgggttacccttggtagagcacagctaaattttggggagccagattcagctatactgacttttgacaaggcgttagctatcaagcctgattataacgatgcaaaagctgaccgagaaactgctgctcgtctagtcaagaaacgagggcagctgcatacatcagggttaagtgctaacaagagacgcttcacagttggggagtacccagagaagggtgcagagggcgaagaaaaagggaaagaaacagctgtatagtccagttagtctgctcccttttaatccaggtgtggctgtcctagaatggag

SEQ ID NO: 438 - DNA, 896 bp, Sorghum bicolor
gaggagaagcagagcagcggggtacggtggtgcacctgcacgtagccgctccgaccatgtcggatcaccagaggatccaccctgtggacctggagggcggcagcaaccggccgacggcgccgctggtgccgggaggctcgtcgttccggtcagacaagggcgaccctgcggcagcgcggagcgccaaccaccaccaccaacaacgcgcctacgtcccgggcggcccgctgcctccgccgccgcgccgcgtcgcgccagcggcgccgctacctccgccgccgtcgaggaagcggcgcggccgtggttgctgctgccggctcctctgctgcgtggtgatcaccgcggtcgtgctggcggtgctcgccgcggcggccgtaggcgcgctgtacctagctctcgaccccaaggcgccgcggtactcggtggaccgcctctccgtgtccgcgttccaggtcgacccgtcgacggtgacggcgcgggcgaggttcgacgtgacggtgacggcggcgaacccgaactcccggatcggcatccagtacgagcccgggtccagcctcggggtgtggtaccagtcgtaccgcctggcgcgcggcgcgctgccggccttctaccagggccaccgcaacaccacggtgctgccgctggcgctggccggggaggtgcagctggccaccgccgtcgtgtccgggttgcaggacgcgcagcggacgggcgccgtgccgctcgtgttccgcgccgacgtccccgtgcgcgtcgaggtcggcagcttcaagctctggaaggtcacctccagggtgcgctgcgacctcgtcgtcgacaggctcatggacgtcagtagccccatcaagatcaaggccagcaactgcaagttcagcctgaagctgtgatcgatttga

SEQ ID NO: 439 - DNA, 680 bp, Sorghum bicolor
aaacgaagcagaggccagggacgcgccagcgcgagcgataaggcacactgccatggccgccaccacggcgtactccaccgcgcttctcggcggggcgcgcctcccctctgcaagaggagccgccgcaccgccctcctccctcggcctcctcccgctgcggtctccgctccctctccggctccaagtccaagattctgcgccgccgaggctgtcgctgctccgggtgaaggcctcctccgatgactcctcggccgccagtggggacgagctcatcgccgacttgaaagccaagtgggacgccgtcgagaacaagagcactgtcctcacctacgccggcggcgccgtcgtcgctctctggctgacgtccgtcatcgtcggcgccatcaactccgtgcctctgctccccaagatcatggagctagtcgggctcggctacaccggatggttcgtctaccgctaccttctcttcaaggaaagcaggaaagagctcgccgacgacatcgagtcactcaagaaaaagattgctggttcagagccgaggattgccagcgtagctggacaaggtaatggttgctagcaggccgaggtgtttgctagcttagctctcctcttccgagagaattagcatttggactcggccgaggtgtttgcaagcaagcacggagaagtcgtaatccttg

SEQ ID NO: 440 - DNA, 1267 bp, Sorghum bicolor
gtcctctgttccagcgtttccgccgctctccagaagccctgcctacccgatgtccgtcgcgtccgtggccgccctccggacggccgcctccggctccggccggtgccacggcgcgggttccccacaggtcggcctgaacgggggcaggttcttgatgatgcagaggagggagctggtgaccaaggccgggatcgcgctcgccgtctcctgctccatggcaacttctccagccccggccaacggctctgctcaagggctggaggttttgccgttcaaagcggacgggtacaacttctggacgtggcggggtcgccggatacactacgtcgagcaaggcgccgggcagcccattgtgctcatccacggcttcggcgcttccgccttccactggaggtacaacatccctgagctggccaagaagtacaaggtgtacgccatagacctgctggggttcgggtggagcgagaaggcgctggtggactacgaggccaccatctggatggagcaggtctccgacttcctccgggagatcgtcaaggagcctgccgtcctcgtaggcaacagcttgggaggtttcacgacgctgttcacggcaaccgaggtgccggagctggtccggggcgtcgtgctgctcaactctgccggccagttcggcgaccccaacaagccggccgccgcaccggccgaggaggaggagggcagcccgctgtccaggttcatcgtgaagccgctcaaggaggccttccagcgggtggtgctggggttcctcttctggcagtccaagcagcccgccagggtcgagaaagtcttgaaaagcgtgtacatagactccagcaacgtcgacgactacctggtcggttccatcacggcgccggcggcggaccccaacgccggcgaggtgtactacaggctgatgtcgcggttcatgtcgaaccagagccggtacacgctggaccggctgctggggaagctgtcgtgcccgctgctgctgctgtggggggacctggacccgtgggtcggcccggccaaggccgcgcggatccaggagttctacgccgacaccgccgtcgtgcacctgcaggccggccactgcccgcacgacgaggcgccggagcaggccaaccgggcgctgctcgagtggctcgcggctctcgacgcccgcgccaagccggccgagcccagcctccagaccgtctgatcgatcaggcgtcaggggcttagcgtacatacatacactagtcaaagcatacaatttggtggccattag

SEQ ID NO: 441 - DNA, 338 bp, Sorghum bicolor
gatcgatggagaggattagctcgtccctgcagtcgtgggtggaggaacacaagctctcaaccatcggagccgtgtgggcgacggcggtgggcgcgtcggtggcgtacagccggcgtcgggcgccggcgcgtgccacgagcctgcgcctcatccacgccaggatgcacgcccaggcgctcacactcgccgtcctcggcggagccgcgctcgcgcaccactactccggcagcagcgccgggaagcagcggcaggaggagctggactacggcttctactcccagctgccgccggccaccgacgccgacggcaacgagaacgagcgctggagctggtagtag

SEQ ID NO: 442 - DNA, 1550 bp, Sorghum bicolor
ctacacgagagtgaagtgggagtggccagtgccagtcggctctgctacagcagccactaatggctcgcgtcgccggcctttgtgagctgcttctcctcctgctcctcgccacggccacggcatcggccgccacacctcttggccggaagggcggccacgaagccgacgacgacggcgagctcgagttggcagcgaagaatgagaacgacggcgtcgtcgcagctgctggcagcaggacgtcggccgggaggtacgcggtgatcttcgacgctggaagcacggggagccgggtgcacgtcttcaagttcgacaagaagctccacctcgtccagatcggcgatgacatcgagttcttcgccaaggtaaagcctgggctaagctcatatgctggtcgacctcaagaggctgcaagctccctactccctcttcttgagcaagctgataagattgtccctcgccggcttcagaaaaataccccgcttaaacttggggcaactgctggtttgagattaattggagatgagaaggcagaagagattcttgaagcggtcagagatcttgtccacaccaagagcaaatttcagtacaaccccaaatatatcagtgttcttgagggatcccaagaagggtcttacctatgggttgctttgaattatctattaggtaagttgggcggggactactcgaaaacagttggtgtaattgatatggggggtggatcagtgcaaatggcctatgccatttccacagatgctgccgcaaatgccccagctgtgcctgatgggaaggatccatacattacaaaggagtacctcaaggggaaagattataacctttatgttcacagttacttgtactatggcgctttagccgctcgtgtggagatcctaaaggcaaagaatgggccatttagccattgtattttgcgtggattcagtggtaaatacacctacaatgggaaggaatatgatgcaacagcctcacctgaaggcgcggtgtatgacaagtgcagggaagagataatcaaggcacttaagttgaatgcaccatgtgaaagcaagaattgtacctttaacggcgtgtggaatggaggtggtggagctggccaagacaacctctatgttgcatcttttttctttgacaaagctacccagtttggcttcattgatagcaaggcacccagtgcaaagtccacccctgaggcgttcaaaggtgctgcagacaaggtttgctcactgagcgcccaagaagccaaagttatgtaccctaatgtccttgatgtgccatacatatgcatggatctcatctaccaatacacattgcttgtagatggctttggtttggctcctacgaaggagattacattggtggctagggtgaagtatggagagtactacattgaggcagcatggcctttgggtactgctattgaagctattgcacccaaaaagatgagacaagatgcatgattggggtcttttagggtccttagtcctccctagctagggattttgttttccccgacattgtggcatctttgttgattcatg

SEQ ID NO: 443 - DNA, 1716 bp, Sorghum bicolor
gatccatcagctgagctctcctcgtcctcgccctgctcgtctcgaacctcgaagctctccaatccgccggtcgatcgccggaggttgctaaggtcgtgccggatcgatcgatcgacgacgaccgagatcgatcgaatggactgcggtggcgcgctgcagctcccgcccgggttccggttccaccccaccgacgacgagctggtgatgtactacctcctccgcaagtgcggcggcctgcccctcgccgcgccggtcatcgccgaggtcgacctctacaagttcgatccatggcagctcccagagaaggcgtatggtggggagaaggagtggtacttcttctcgccgcgggaccgcaagtacccgaacgggtcgaggccgaacagggcggccgggacggggtactggaaggccaccggcgccgacaagcccgtcgggtcgccgcgccccgtcgccatcaagaaggccctcgtcttctacgccggcaagccgcccaagggcgtcaagaccaactggatcatgcacgagtaccgcctcgccgacgtcgaccgttccgccgccgcacgcaagaagaccaacaacgccctcaggctggatgactgggtgctgtgccggatctacaacaagaagggcgtgatcgagcggtacgacacggtggacgacgacgccgacgacgccgtggcagaggacgtcaagcctgcgccggcgtccaggaataacccgcgcgggaccgccagtggccgcggcggggcagcagcagcagcggcgccgatgaaggtggagttcccggagtacggtgggtactacgactacgaagacctcgaggcgacgccgtcggcggggatgctgtgcttcgatcgcccgtcggccgcggtcccgacggccccagcctctgcgcccgcgcccgcgcccgggccggcgctgtcgtcgccgccgccggcggcggactcggacccagagcgcgacgacgactcgaacaactccgtggcgtggacgatgcaccacacgcacgcgcacacggacaactactccagctgcggctccgagcacgtgctgtcgccgtcgccggacctccccgaccgcgaccacgccgagagccagtccgccgggttatggtggcccgtcggcgtcggcggcgactgggccgccgccgaggacgggttcatggtcgacgtcgacgtcggcgacgggagctcgctgttcgggccgccgtccccggggctgccgttcgctcgcgtcgacgccgccgcgttcggcgacatgctcgcgtcgtacctccacaagccgttctgaagcaagcccctgatcgtctcggccagtcaccactgacatggacgttctggtcgtcgtgtacctcggttcaggtcgtcgtgcaccgttgcgtgctcgaccttttgggcacagctgcgccgcatgcatggagatcgatgagggctgagcatggtggatgacttgtgacgatcatggtgggtacttggtagaggagcttgctagccgtcggatctgctggcctcggattaatctgactgtcagtttttggtcgcgtcaagtacgtagctgacaactaagaatgaagcctactcgattcaggggctgttgaattgttgttggtggcatggtgtgtgtaatctagtctagtctagtctagttctagctgtacttagaattggtttcaggttaattagtggcaaacaggcaacgagctttaatggtaccttt

SEQ ID NO: 444 - DNA, 5582 bp, Sorghum bicolor
agtccagtggagtggatgaagtggaaccgtcaaaatgtcgtcgtcctcggcgatgccgccgccggcgtcgccgcgggagcacgtggagaggatccggcgggagcgctactacatcgggcgcggcgagcagaacccgctggcggaggacatgcaccaggccgtcaactacctctcgcaggaactctactccaaggacgtccacttcctcatggagctcgtgcagaatgctgaagataatgaatacccttctgaagtagcaccttcgttggagtttctcattacatcaaaggatattactggatgtggtgcatcctccactttactcatcttcaataatgagaggggattctcttcaacaaatatagagtcaatttgtcgtgttgggaaatcaacaaagaagggaaacagacatcagggttacattggagagaaaggtattgggttcaaaagtgtgttcttgatatcaagtcagccctacatattcagcaatggttatcagatcaagttcaatgagaaaccttgtgcagaatgcaatattgggtacattgtacctcagtgggtggaatccacgcctagcctttctgacatcgaagcaatatatgggtgctcaaaagtcctacctacaactaccatcattttaccattgaagagtgagaagattgatgcggtgaagagtcagttgtcaagcatgcatcctgaaatgctgctgttcctgacgaagatcaggaagctctctgtccgggaggataaatctgatcccaacaatacaactgttagtgagatctccatatccagtgaaaagaactaccaagccaggaagaacatgcatgctgagtcgtacacactccatttatcttctgaagagactgggaaagatgaagctgaatgtggttattatatgtggaggcagaaattcccagtaaagccagagaacagagtcaataagcgtgctgaaattgatgaatgggtgataaccctggccttcccacatggtgagcgtctgtcccgtgggaagcagctatcacctggcatatatgctttcctcccaactgagatggtaacaagcttccccttcatcattcaggctgacttcctcccaggatcatcaagggaggcaatactgttcgataatccatggaataagggaattctcgactgtgtcccaagtgctttcatgaatgcttttgtaacacttgtgaagtccaaagctgatgcgccagcaatgtcgctgccatcaatgttcagtttcctacctgtcaattcgtcactaatcccactgcttgagccggttaggtctggcatcaaatacaaggttctcaccgagaatatagttccattagaatcttatgcttcacagaagatattctgtaaacccagtgaagttgcacggctgaagccagccttttgggctatccttggcaaagcacgggaattcggtgtagatttgaagagtctgtcaactcatggaacctacattcttagttctcattttgacaaaagtagatacaacagtgtgcttgagtttcttggtatcaaaagcgtgagcactgaatggtatgcaaaatgcattgaagggtctaaccttgtcaaggaggtagatgagcagctttacctggaaattttacactttgtcgcgagtaattgggaaaactgtttttctggtacaaatatgatgtctgttcccctactgaaatatgttgataggaatggtgttctctctttttggagcatatccagagctagtcaacagaaagatcggttgtgcattgcatctgatatgaaatacagatcatggctaatcagctggaacaaggagtttctgtcttctaataagttctttctccatccgagcacacaggctgctctggatggtttctcacagaagatgacagtggaaagctggcttcggaaccatgcacgagtggaggttgtctctgtctacagttatggatcgactgttgttgattccttgagtaatgatcaaaggtctgtccttgcttttgcacactttctgtaccactcatttaagatggagcacatagagagcttctggttatcaaagctctgctgtgccatgccgatagttgacagatatggcaatgttgtcaacaaaacagaaaacattatagttccagctaaggggagcaaatgggttggtttgctgggtacatacccatggaggaatcaaggctacattgaattgtcagcagattacaagtcagtaggccactttgctgggaactacacatctgaggatcagctattggaatttctcaagatacacctgcatgcctcagatgtgccattgatacgcccaccaaatgtgaggttccatactgtctcatcacctctcaatgtggacaatacattcttgctactggaatggatacggaatatcaggtcaaatggtgtaactttaccagatcaattcctggcttgtgtagaagaagggagttggctaaagacatcagttgggtacaagccaccaaatgaatcatttctgtccagtgctaactggggaagtcttttgcaaagtggaccttcattcattgatataccaatgattgaccaacaattctatcaaaacaagctgcatatttacaaacaggaactcaaggtaattggggtgagatttgaatttgaggaggcatcatcttacattggaagccgcctcatgtctatggctgcaagcaacgtgttaaccagagactgtgtgtactccttgctgcggctaattcggttcctacgagagaaggttctatctccaagtcaattgattgacagtgtcaaagatggatgttggatgaagagtactgttggatataggcgtccttctgattgtatcatcaaagattcagaatgggcagtggcatcttgtatcagtgaccaaccattccttgatgtcgagttctatggcgaggacatcctttcatataaatcagagctggagttgcttggtgttattgttgggttcaaaaacaattaccatcttgttattgataacttcaagttcagatcctctgctattacttctgagtctactgtattaatcctcaaatgcattcgttatgttggatcatgtcaagatttcataaggaagcttagagatttgaaatgggtgaagactaatgtgggattttgtgctccaaatgtctcttttcttgtggattctgaatgggaatgccttgtgaagatcttcaaaggagttccaataattgatttaggattttatgggagtgtgatcagttcatacaaagaagagttgaagaaggccggtttgatcacacgatttgaggaggcatcgatggctatagccaatgttttcaagcgcatggtatcggagtcatcacttacgaaggctaatgtcctagctcttctactagcttaccggcagctgagaacacacagcccacttcctgttgagcttttcaactgcatgcgcacagagaagtggatacacacatcgctagggtttcaatctccatcaaatacaatcctatttgataatgcatggcaatatctatctcccatatcaatattaccgttcattgatgatggtgacacttgtaatggtttggggatggatatatacggctataaagatgagcttagggagttgggtgttactgttgaagtgaaatttggtgccagatttgcccttgctggcctcagcattcctgatgatccttccattttgtccaaagctaccattttgtcgtttctggagtgtatcaagaactactttgcctctgcaactgaacctccaaagggctttaaagaccagatttgcaagaagttgttgaagacatccttgggctaccaatatcctgatgaatgtattctcttcgatgcaaaaaattgttttctacagatggaagatggccctttcatcgatgaagcattctatggttcagatatagcttctttcaaacatccccttgcgatgattggagtgactgtggatgttaattctgcacaagatcttattgcccggtatctgaggaacaaaaaagatatagatactatttcccggatctacatgtatctgaagaaatgtaactggaagcctgacaaaaacaacaacaacaacagaaattggatttggataccaaaggaaacagagggtggagactgggtgagctcaagaagttgtgttctgtatgataagaacaatctatttggcctgcagctgcatgttctggacaaatattatgacagaaagctgcttgacttcttttcacttgctttcagtgtgaggcatggaccttgttctgaagactattgcaaactatgggccacatgggagagttcagtgcacgagctacccatatctgattgcttggctttctggaaattcatagcaaagaactggaccaagaaaacagaggaacttctttctggttgtgtcaaggttccagtatgtattgatggcaagatcattttatcaaacaaggagaacgtgttcattcctgatgatctgctgcttgcggatttgttcagaaagcatcctaaacaatcactcttcatctggtatccttcttctgccctaccttccatgtctcgagcaaggtttaacagcatatatggcagtattggtgtcaggacaatctcagaagcagtggccaagaatgattctttcacttcagcgaatagccatttcaaaacagctgttctgagtaaggtgatcaaggttggcttgctccaaatagtcctcgcattcctttccaaccctaattttgacattcctgctaaagataggcatcatctggtttcatgccttctgaatgtgactatcgaagagaccgatgaaccaatcacaatggcatatagtgtgagtttgtcctctggagagatggttgaggtgaaggctagacgaatgcttcggtgggaaagggagaattcaaagctgtacatgcagagaagtgatggtgcatccagctatgaagacaagattgaacttgcgacctactttgcacatgagatatctcatgggttgctctttcagatgccagatcagatatcttcactcactgaactcataaaaattggcagcttagtggacttccagcaggccgctgttgcgttcttgctgaagtccaaaaacctgcagctgttccctgaagatgaagatttcctgaactcttctgtgctaggtggcagcaaaaaaccagtggacaactagcagcctgcagattttactcttctgtacttgttcaaggttgctgatggcctgcaattcctagaaaaatccggtgttgcgcttgcgcttgtgcagttgtgcctagagatcccggaatatcatcaacgaacgtggtgtcttctatgatgcatatgtatcgttagactaatatctcctgaatatccagtgcctcctggtacaaaacttgtcagttgtttcggtgcagatgcttatctcagtgttaaatgacaccaagtacttgaattactgttactattattatcgtcaatgccttgtgtgtgctccgatttatggtcctgctacatgagttgtgttttagatttgtggcagtgacagtgatctgttaattgcacgggttttgcttgtactggaggccaaatag

SEQ ID NO: 445 - DNA, 809 bp, Sorghum bicolor
atcagatgtctcgccggtcgaaaagagagatggcgtcgccgcctcagatttcctctccgtccgtccccatgatgcccgcggcacgaccaagagagatggcgccgccgcctcagatttcctctccgtccgcctcagatttcctctccgggcctgggtgttttcctacgccaccagcttccataaacaccacgatggggtctgcagctcccagcccttggtggtgcggcccgccggtgccccagcaaggtatgtcgtggtggcctgcacctagctgtggtggtggtgccactgcgtcgtcttcccaatcggtccagaaagacgacatcgactctgatccaaaggaatgttgcaggggtttggataatcgcccacctggtggtttcctcagctatttcaatcacccatggagtcagtcacttccccagccgaccccaccacatttatttgatggaaatagagggaaagggagcccaacaatgttagcttctgaatctcatcggcgacgccggcccttgattaatttagacaatgatgaggataatgcaaatggtgctagtaggactgacatacggctaaaatatacgaagccagaggaagtgcgcttggtgagttgcattatatgtatttacagatggatgatgtcctacagcagcttacaaaacttcagggcacaaatgaaagtcgagaaaagatgttggaaacccagaaacatgtttcaagagagaagcttgaatcatctagacttaatcacctcgctgccaaagaaaatgctaaatcggctatgctggagacttacagagcactaataa

SEQ ID NO: 446 - DNA, 4337 bp, Sorghum bicolor
agggaatggaggcggcgctggaggcggcgcgcgccaaggacaccaaggagcgcctggccggcgtcgagcggctgcacgaggcgctcgacgccacggcgcgccgcgggctggcggcggccgaggtcaccgcgctggtcgacacctgcatggatctgacgcgcgacgccaacttccgcatcgcccagggcggcctccaggcgctctccgccgccgccgtcgtcgccggcgaccacttcaagatccacctcaacgccctcgtcccggccgccgtcgagcgcctcggcgacggcaagcagcccgtgcgcgacgccgcgcgccagctcctcatcacgctaatggaggtttcttcaccaacaatcatagttgaaagagctggtagttatgcatggactcataggagttggagggtgcgggaagagtttgtacgtacagtggcaactgcagttgggctatttgcttctacagagatttccttgcaacgagttttgctttcacctgttctgcaattgatgaatgattcgaaccaaagtgtgcgagatgctgctatctcttgtattgaggagatgtacaagcacatggggtcacaatttcatgaagagttgcagcgccataatctgccttcctacatgctaaaagaaataaattcaaggttggataaaatagaaccaaaggttcgctcatctgatacagcgatgcagtataaggctgtagaatcaagatctgttagtgctaatccgaaaagaggcagcccaagaacaaaaagcataccaagggaaagtacactgtttggaggtgacactgatgttacagaaaaacctgtggaaccagtaaaagttcattctgagaaagaattacttcgggagtttgagaagatcgcggctacccttgttccagaaaaggattggtctttacgtattgctgccatgcaaaggattgaagccctggtttatggaggtgcgatcgattatccatcattccttatgctcttgaagcaactggttcctccattgtctactcagctgtctgatcgacgttctagtattgtcaaacaggcatgccacctacttaatatactatccaaagaactcctcggcgattttgagccatgtgctgaacaattcatcccgatgctttttaagcttgttgtcataacagtgcttgttatcgctgaatctgcagatacatgcataaaaactatcctgcggaattgcaaggttgctaggattcttcctcgcatagttgacacagcaaagaatgaccgaagtgcaatcctccgtgcaaggtgctgtgagtatgcacttctggtactggagtattgggctgatgccccagaaatacaacgttcagctgatttatatgaggatatgataaaatgctgtgtagcagatgcgatgagcgaggttcgtgcaactgcaagaacttgctatagaatgtttgcaaagacatggcccgagcgctcacgccgtctttttatgtcatttgatcctgcgatacagaggataataaatgatgaagatggtggtgtgcacaaaaggtatgcttctccctcattgcgtgatagggttgtgcagccttcacgtgcttcctctcattcaagtagtacacatgtacctggatatggcacttcggctatcgttgcaatggacaagagtgcagctatttcttcagattcatcttttccatcaaacaatcttcggttatcacagtcaaagacgattggcagaagttctgagagaagcctggagagtgtgcttagctccagcaaagaaaaagtttctgccattgaaagtttgctgaaaggtgtcagcatgtcagggcaaaatttcactgcagcgcgctcaacaagcttagatcttggagttgatcctccatcatctcgtgatcctcctgtgccgcttgcagcaccagcatcaaatgttctgtcattgcagaactcagcactgttggactcatcccttcctaccatcccacctagttcacgaaatggtggttcccgcttattggatacgatgacaacacacttgcctaccaaagaacggtcaaggtcaccgtatttgagtaatatgtcatctgagtccatgtctggcttatcattgccttactcaagaagatcttcggagaggcttcaagaaggaggccgcatggatgagagctatgatatccgttcagctaggcgaatccctcaaatgcattttgagagaaactatgctgatatgtcttatagggattccagccacagagattcacataacaaccatgtcccaaatttccagagacctcttctaaggaagcaagtaatgtcaagggcttctgcaagtggcagacacagctttgatgatagccatgtaccatcaggtgatgtgtctggctatacagattctctggcttctctaaatgatgcactttctgagggtctcagccctagttctgactgggtagcaagagtttcagcttttgagtttattcggaatttattgaaacaaggccagaaaggcattcaagaaattactcaaaattttgagaaggttatgaagctgtttttccgtcatttggatgatcctcaccataaggttgcacaggcagccttctctgcacttgcagagattatcccagcctgcaagaagccatttgaaagttatgtcgagcgaattctaccatatgtattttcgcggcttattgatccaaaagagttggtgaaaaaaccatgctctgtaacattggagattgttggtcgaacatatgctattgatatgttgttacctgcgctagtacgatcattagatgaacagaggtccccaaaggcaaaattggctgttcttgagtttgcaaataaatctttcagcaagtacactgttgactctgatggttatagtaacagtggcttccttaaactatggctttcaaaattggcacctttggtaaatgaaaagaatgcaaaattgaaggaggcatctatttctggtatcatatctgtttattctcactttgattcaacagcagtgctaaattttattctcagtttgtcagttgaagatcaaaacctcttgaggagagccctgaagatcaaaacccctcgtattgaggttgatctggtgaactacttgcagagcaagaaagaacgttcacgccccaaatcttatgaccaggcggattttggaacttcttcggaggatggctatgcactgacatccaagaacagctatccatttgggcggttttcttctagttcccttgatgctgaagggggaaagaagatcaattcaatgcaagaaccagtgctgcataatgtctctataggtcgaacagcttctgatatgagcatggatcatgctattcaaagtttagagtcatctacaggagctgaagttcatttaactaggagtagagaaccaaagactaacagtaactcagttgtggaagctgctcgctcttggacaaactaccctgaaaaaactgatgcctccttagatggtgaaactgctaccggtactcctcggttagatttcagccggtttcttacttctgatgggcataatactgttggttcaacccccgaagaaagtgttcaagagggtgatatgattgtgaatcttagttctataaagaccagccttcaaacagataacggtctgagcataccacaacttctccatcagataagcaatgacactgaagtttcaagctcggaaaagcgggaagcattgcaacagttggttgatgcttcccttgataataacagctccatctgggcaaagtacttcaatcaaatcttaacggctgtgctcgaggtattagatgactctgattcatccacgagggagcttgctttatctttgattgctgagatgctcaacaaccagaaagattcaattgaagactctatggagattgttcttgaaaaactcctgcatgtaaccaaagatgcagtggccaagatttcaaatgaggcaaaccaatgcttaaatgttctattggcaaaatatgatcctttcagatgtcttgctattattgtacctttattggtcagtgatgatgagaagatacttgtcgtgtgtatcaactgtttgacaaagcttgttgggcgcctttctcaagaggaattgattgatcagttgcctacatttctgccagcattatttgatgcttttaacaaccaaagtccagatgtccgaaagactgttgtgttctgcctggtggatatctacatcatgcttgggaaagcattcgctccatacttggaagggcttagcagcacgcagctccgcctagtaaccatctacgctaaccggatttcgcaggcgaggtccggcaagccaatcgattctaaccaatgatga

SEQ ID NO: 447 - DNA, 2291 bp, Sorghum bicolor
gtggttgcgcacttgttatgctgagactgaatggaggctgtagacaagattgctgagcccaaagaccctttcgtgctcacttctcagaaggttcagagcttagagccaccgataccgataaaggcgtcatggaaagggaagtactcccaggagcaagaagagaaggatctgccagctgatggcgaagagagcttccggagcctggattcctctgatgaaggtggccggagctccttctctggagctagtcaccctccagagccaattgatatggatatcatgaagacggtctatgtcgcaatcgacgaggagaagtctgagccaccggtttgtttagtgcgaggagtctcggtgaaggggcctttcatagatgacctctcgatccgtgttgcaggcacaaaggcaaatctgttggtaggcgcaggcggtgctgaaggcatggctgaagagaggaaggtatctgcttctgcagtggcatcagtcgccacagcacgctcatctcaggctacctctttgcctcaggactcagaggagaaggagtgcgtctgggacgcttcactccctcccagtggcaatgttagccctcacagtagcattgacagcatgggtgtggtcactgccatgagcaccctccacagctgtgcgagcacatataaaagtgaagccatagctggtgaagcaatgctcaatgtggagaggaactgtgagagtgtaaagggtgttcgaggtgacttactagaaagtgcaaaaactagcatgagtcgagcaagtgatagcagtggtgttagcgatgacagcagctggagccacatcactggaggtgccagcaagcctcacaaggggaatgatcctagatggaaggcaattcatgctgtacggactcgtgatagtgttcttggaatgagccattttagactactaaagcgtcttggttgtggtgacattggcagtgtttacctctcagaattaagtggaactcggtgctactttgcaatgaaggtaatggacaaggcatccttggcaagtaggaagaagttaaatagggctcaaactgaaagggagattctacagcttctcgaccacccattcctcccaacgttgtatacacattttgaaaccgacaggttctcttgtttggtgatggaattctgtccgggtggtgatctgcatactttgcgacagagacaacctggaaagcatttctctgagtatgctgcaaggttttatgccgctgaagtacttctagctctggagtatctacacatgttgggagtcgtctacagagatctgaaaccagaaaatgttcttgtgcgcgatgatgggcacataatgctttcagattttgacctctcgctgagatgtgcagtctcacctacactcatcagaacatcagcttttgattctgatcccagaagagcaggtggttctttctgtgtacagcctgcttgcatggaacctacttcagcttgtattcagcctgcgtgcttcctgcccaaattcttcggtcagaagagcaagaagaagactagaaaggcaaggtctgagctgggacagaatgctggcaccctgcctgagcttgttgccgagccaacatcagcccgatcgatgtcattcgtcgggactcatgaatacttagcccctgaaatcatcaagggtgaaggtcatggaagcgccgtcgactggtggaccttcggcatcttcctccacgagctgctgtacggcaaaaccccattcaaggggtcagggaaccgcgccactctgttcaacgtggtcggtcagcaactgaaatttccagagtcgccgtccacgagctactcaagcagagatctcatcagggggctcctggtcaaggaaccgcagagccgcctcggcgtgaagcggggagcgacggagatcaagcagcaccccttctttgagggcgtgaactgggctctcatccggtgcagcacccctcccgaggtccccaggcccgtcgaggccgagctgcctgtgaagtacggcgtggcggaggcgatcgggagcaacagcaagaggatagccggagcagacgtgaagtccggcgggaaatacctcgacttcgagttcttttagagtatatagtgcccagtggcagcctattgtttgcatactgtccgtgtatgtggccagtttgatgttgtgtgattcgatgtggtgctttggtgtctcaccgtcgatgcaaaattctcagatctgaatcgaccaaaaattagatagatctgtcatctgtttgccacttgcctgctttggcgcatttcgagttgtagcagacc

SEQ ID NO: 448 - DNA, 2127 bp, Sorghum bicolor
agcgttccctcaccaagaggagaaaaaaagagggagcgaaggaggcaaaccaggcggcgggacagcaacgcgacgtgcttgccattctctcgaggagctcatgcaaggtgtaagtcttactgcaagaagggcagctgtgcatgttattaagacccaaatatagcctcacttgattacactgcacggggggttgaaaacttgagatacagttgatcttctggttaagagtatggcttcaaggttatcacatcagctgagcaatggcctgtatgtttctggtcgacctgagcaacctaaggagaaggccccaaccatttgttccactgcgatgccatatactgggggtgacatcaagaaatctggagagctggggaagatgtttgatcttcatgttgagaagtcaagaaaatctggtcctctaggaaatgctccttcaagaaatacttcatttggcggtgctgcttccaactctggacccgtctccaatgctggtggtcgttccaactactctggttctctttcatcttcagttcctggtgctggcggatcagccagagcaaaatcaaactccggaccgctcaataaacatggagagccaacaaagaggtcatctggtccccagtctggaggagtgaccccaatggcacgccagaactctggcccccttccacctgtgcttccgacaactgggcttatcacatctgggcctatctcttcagggccacttaactcgtctggtgctccaaggaaagtatctgggccacttgattctgctgcatcgatgaaaatgcgggctacttcctttgctcacaatcaagctgttactaatctcaacactgaagatggttactcaattcagggaagctttccgaagccaatactctgggctgtgattctgctctttgtgatgggtttcatagcaggtggcttcattctgggtgctgttcacaatgcaattttgctgatagttgttgtggtgatatttggttttgttgctgcacttcttatctggaatgcttgctggggtaggagaggcgcaattgggtttgttaatcgctatcctgatgctgatctcaggactgccaaagatggacagtatgtaaaggttacaggggtggttacttgtggaaatttccccctcgaatcctcgttccaaagggttccaagatgtgtatacacttctactagcttgtatgagtacaggggttgggattccaaagctgccaatactgagcatcggcgttttacctggggtttacgctcaatggagcgacatgcggttgatttctacatctcagattttcagtctgggcttcgagcattggtgaaaacaggatatggtgcacgtgtgaccccttacgtcgatgaatctgttataattgacatcaatccagacaacaaggatatgtcccctgattttttgagatggctaagggagagaaacctttcaagcgatgatcggacaatgcgcctaaaagaaggatacatcaaggaaggtagcactgtgagtgtgatgggggttgtccaaaggaacgacaatgttctgatgattgttcctccatcagagcccatctcaactggttgtcagtggaccaagtgtgttctcccaaccaaccttgacgggcttgttttaagatgcgaagatacttcgaacattgatgtgataccagtttaactggcggtggaagagtcgttgccaaagaaagtgcctgttaaatatttgaatctgtattgtttcatggaatgctagttgagagaaatgtgcaaatgttgggtgtgattatggcaggttgagggtggttggttaagcaggccgttggatgtatagttcttttttcttttaattgtgttttgtcatttctttttctttttaattttcagctgagatctgaaacttgtgtaaccagatgcctcttaatctaaatctgcgtggcacttagattgatttggttttgaagttagaagtttgttctcttttgtgctttgtgttaaggcaattagtatttcagtatttgaaagctagctacaagtgataggacttcagatgtacatttcccctttcattatgttttgccattttttctttttaatttcaactgagatcagaaacttgtgtattgggatgcc

SEQ ID NO: 449 - DNA, 1564 bp, Sorghum bicolor
aacggcatgggtggtattggcgtcagcccgtgcgatctggacagggagttcgcgccccaaatcgcccagctcctcgccacgcctcctctccaatccgctcaggaatattatgatgaactcatacggtccaagaagcttgatggcattagagtgagctacagtggcaagcatgggaaaggtgtttgtgcaaatagggactttgctgaagacgaccttgttctgaaggaccaaatgttggttggtgctcaggacagccttaacaagattgactgtgttgtgtgtagttactgcttccgcttcattggttctatagagttccaaattgggcgtagattgtatttgcaaagccttggtggtagtgttgatggctctactgagagacattgccatgggagtgatgctgggccaagtactggctgctctggtgcatcaagtgggaatagcaatgctgtgccacaagaggtcctgatgtcacttatggatggtaatatgtcattgcctttaactgatcagttctgtctgccatcagttgttgcttgccctggtggatgtgagggagaactctactgcagccaatcatgtgcggattctgattgggattcttatcactctttgctgtgtgctggatccaagaccgaaccattacggaaatccgcccttcagaaatttgtagggcatgctaatggaaccaatgatatttttttgattgctgccaaggctatcactttcaccttgttgagatataggaaactcaaaagacagcatgggtctcatgaatcgagctcttcgctcctcatggaagcctggaaaccactttcaatgggcttcaaaaagagatggtgggaatgtgttgctttgcctgaagatgttgattccagtgaagaagaattgtttagacagcaaataagggatctggcatttacgtcactgcagcttctcaaggatgcaatctttgatcctgagtgtgcacccttgttttcgcttgacatctatggccatataattggcatgtttgagatgaacaatcttgatttagttgtcgcatcaccagttgaagactatttcatacacattgatgatcttccagagagtgagaaggaggaagcagagaaggtaacggggccattcctagatgctttaggtgaagactattcagtcccttgtgagggaacggcgttctttcctttgcagagttgcatgaaccactcatgctgtccaaatgctaaagcatttaagagagacgaggacaaggatggccatgcagtgataattgctctgaggcctatcagcaagggtgaagagattaccatctcctacatcgatgaagaccttccatacgaggagaggcaagcacagcttgcagattacgggttcacgtgtacatgcttgaaatgccaagaagagcaaccggtctgaaaggagaactcagtttgtattttgtggcatttgggaatcttcatgtattttatttctctgggtaatttttgaaagcttggaaaaagtgaaagtgcacaaacaaggggagtttctttttgggttgcaacttgcgaaagatgatatgttc

SEQ ID NO: 450 - DNA, 497 bp, Sorghum bicolor
gattcgaattcgacctcgacgcgatggggttccacctgcttgcgttcgtggcggcgagggggctcatgcaggtgttcaacctctcggcgccgctcaacctgcggctgccgctcgcgcgccaccttcccgaggccttcgccgtcctgtgcgtcgtgctcgcctcgcacgccgcgtgggtcaacgacgccctggcgcgcggcgccgcctggagccacagcgggagccggggcggcgtcgacgagtacgtccgctacgccatgctcagcatctccgactgacgccgcactgatcgatgacggacgacgcgacgacgatcgagtggacgacggccaggcgcgtccgtcctttgctagcttaattagcttaggagatatgatctcttcctccccttgtaatacacactgctcgctcgtttggtttcttcttgctcgtagctagcatgatttttgatagcatcgaaaagattgggatcagggagattgttgtaacatgcaacc

SEQ ID NO: 451 - DNA, 638 bp, Sorghum bicolor
ggtcgatggcgagctcgctggcccgcctgggagcggcgctgccacgcgcgcgcccgtgcgccacggcccgcgccctgccaccggggcggtgggacgccgcggcgctcggcgcctcccgccgcgccgcgctgaacgcttgcaggtgccaagttcattccgacgttaaagtagcccctgcatcggatctgaaggatggtagcaaatctgaaacttggaggatcaagatgctctacgacggtgattgccctctctgtatgcgtgaggtaaacatgctgagagaaagaaacaaatcctatggagcaataaagtttgttgacataagctcgaaagattactctccagacaacaatcaaggccttgattatgaaactgccatggggaggatacatgccattctttcagatggaactgttgtcacagatgttgaggcatttagaaaactgtacgaggaagtaggacttggatgggtctatgctgttactaaatatgagcctgtagctaccatggcaaatgcagtatatggtgtgtgggcgaaataccgtatgcaaattacaggtcgacctccactagaagagattatggcatcccgaagagctgcaggcgaatgtaaagatgacaaagtatgcaagatgtgatga

SEQ ID NO: 452 - DNA, 1562 bp, Sorghum bicolor
ttaggatccgccaccatgctgtcactctcgcacccgcaccccgccgcgtccaccaccgcgccgcgccaccagcggacgccccgcgccgccactcccgtgtggcgccgccgtcgcgccagccacatcgtcgcgagcgccatcctgctccccggcggcggcagcactggcggcggtggcgggcccggcgaccggaggctccccttcacgccgcccccgatggcaccaccgggccagctctaccagccgttccacccgccgccgtcccctctcccgcccagccttcgcaacctcgacctcacccagcgcctccagatcctccgcgaccgcatgggcctgtggcacgagtacgcgcccctcatcgcctcgctctcccgtgacggcttcaacccgtcctccatccaggaggccacgggcatctcgggcgtcgagcagaactccctcgtcgtcgcgtcccaggtccgcgactcgctcctcgacgacaaggttgccgcgttcccgcccgacctgctcccgtacttcgactcctacggcggacccgacctcctgtacgagctccgcttcctgaacgcgcgccagcgtgccgacgccgccaggcacgccatcgactacaggctcgaacccaagggcgtgcgggagctggcgcgcgccatgaagggcttcccgcgctggcgcggggaggaaggctgggaggccttcgggagggactcccccgccgactgcctcgcctacgcgcggttccgccagtcgagggaggccatcgacgtggaggagcgcattgcggagctggagcgcgcgctgcaggtggtggagaccgagtccggtagggcgcgcgtggagctcgagctggagcgcgccaggaagaaggcggccggggaggaggtggtggaggaggatgaccctgccgcctcgcggcccaacgtcacggtggtgcggctccagtacggcgaagtcgccgaggcgaccaccgtcttcatgctgccggtggtcagggagacggacggcgtcgcggccatggagtcggcgcccaggcggaccaagacggacgtggaccttggcattgtggaggtggacaaggcgtgggcgcggtgggccgtgctgcccggatggggccccgtggccgaggcagcggacgacgccgtcgtcgtcgagcttgcggacggccggaggctgccgtggcgcacggccgatgaggagccggtgctagtcattgccaaccggagcaagaaggaggtcgtggagcaggggatatacgtcctcgagaaggatggccggcttgtggtggagagggggaagaagctggctgagcagggcatagccgcggcagctgccgaggtggttatcgttgtccggccgcccaaggatgaggacggcatgattagcgacgaggagtgggactgatcactgatctggagaggaggtttatcaagggttttgcttggttttggagatgccaatttctctttctccattgggtggtaattggtggtaaagctttccccttctcttctttacagtctcgagtcgatcgatcgatgaataagagcaacgaattgggtaccttt

SEQ ID NO: 453 - DNA, 1923 bp, Sorghum bicolor
aatttaggaagatctccaactccttcccccactcgcgctcggtcccagggatcggagcggcccccactcggcggcgtccaccgacggaggggcagtcccaggctcggcggcggcgtcagcggctcctcctcccgcctgtcgccagtcgcctcgcgccctcgcctccgttctccgcgcaccggccggcgaccctgcgtacgcacctccctctcccctcccgcctctgctgtaccgtgggagcccggccagctgcccagggtggccgggccttggctccgccggtgactccaacgttcaagcatggggctactggcactgcagcggctcatgtccctgcagcgcgaccggcagcggcgtcaacgacaaacccgaaccccaatcctgaatggatggattgctgcttcatcactgggtaaaaggaagggctcttcctgtcaaaaagatgctcatggtgattctaaagttgccaaaagaatgagatgctcaatcccagcccttccggaggacatctggcgccatatacattccctattgccactgcgtgatgctgcccgtgctgcttgcttgtctcactcctttctacgttcctggaggtgtcatcccaacctcaccttaaatatgcatgttcttggctcaaatgcaaatgtacctcgagagaattccagctgcataattgacaatatcctgaggaaacactcaggcagccacattaacatactcaagcttcagttatatggtatttatgattcctaccagtatctggacagttggcttcaggttgctgttacacctgggattgaagaactcaccattgagccatgtcatagtagagtcaaaatgaagcagaatgtcccatgcaaagttttatcttatggggtccgaaactcaatccggtgtcttcaactttccttctgcgccttccatcccacagctgaccttggcctgttgagaaacctaacaagtttgtgcctggagtctgtgcatattttggatgatgagtttgagtgctttctttctaactcccctgctttagagcggttagacgtcaataattgctcagagataatgtgcatgaggataccttgcgtgctgctgcagcttcattgcttaaaggtttcttcttgcttgaatctgcgagtgctagagagcaaagctcgaaatctatccagttttattttaaattcaggatgtaatgtaaaagtctcacttggagaaacattgcaaatgaagagccttggcatgcgccgttcaaacctcatatgttatgcccgtgccgaatttccatccaatctgccaaaacttgagtctctttgcatcagttcagattctgagatggtcgatacacctatgctgcctagcaaattcctcttcctcaagcatctgcgtatttatctgggatgggccttttcctcgggctatgattttttttctctggtttctttccttgatgcttctccttgcttggagaatttattgttgaatcttcaggtatcccagcatgcatcggtttttgatggttcatcacagttgaggcagatgcctgaacagcaccatggctgcctcaagagtgtgaagttcataggttttaattcagagaagagcttggttgagctaacatgttatattctcaagaatgccaagtcacttggatgccttacactggacaccacttatggtgatcccaagtgtgataacaaaataatgaccggtggcatgtgcgctcccatgaataaaggttttctcatggaagcccgtagaggtgtcgcagcagttagaacatacattgaagataaagtcccgtctactgttaagctgacagtggtggagcactgtactcggtgccatgctgataacttatctgaataggttagacttgatgaaccatgcttttctttcttggatagcaaggcctgttcaatatag

SEQ ID NO: 454 - DNA, 2322 bp, Sorghum bicolor
aaagtcgacgagcagtcgttcgttgaagaagctagctgctccttcctcctagtataaaggagcctccttttttcctttgccgtgccgcgccgtcccgtccattctgcttccgagccttccttctccccccctttcgccgccgccgccgcgtggttgggtgggtgtgtgctgtgctgtttgttccaacatcaccggagcgcagcgcagcgcagcgagcagccgaggagcggagccggagatgaggtgggcggcgttcctgtgggaaggcgcgtcccgggcgtccggcggccgccgcccgggggtctccaacctcctcctcgtcgtcgcagctgccagtagcggtggcctcgttgcctatgccgactccggatcagatgctgctgttgagaagccgcaacttcctccaaggaaaaaagttgtggtgcttgggactggttggggcggcaccacattcctgaggaatctcgatagcaggttgtacgatgtgcaggttatatctcctcggaactactttgcgtttacgccactgctcccgagtgtcacttctggaacagttgagcctaggagcattgttgagccaatccgtaggatcttggagaagaaaggtggagaaatcaaattttgggaagcagagtgcttcaagattgatccacaaagcaagaaaatccattgtcgctcaaatgttgggacaaatcttgaggggaatggcgagttcttggttgactatgactatctcgtggtagcagttggagctaggacaaatacattcaatactcctggcgtggtagagaattgccacttcttgaaggaagtagaggatgctcaaaagatcagacggagtgtgatggactgctttgagagagcgagcctccccttcctgaatgaagaagagaggaagaagaatcttcatttcgtggttgtgggtggtggacctactggagtggaatttgcatcatctctgcatgattttgttaccgaagatttatccaagctttatccctcggttcagcaccttgtcaagatatcactgattgaagctgcagatcacatactgaccatgtttgacaagaggataactaactttgctgaggataagtttggaagggacggtattgatgtgaaaacaggatacaaagttgtgaaggtttctaaggatgatattactatgcaaaatcctgccactggggatatttcagttccttatggcatggctgtctggtcaactggtattggaactcgcccattcgttgtggaatttatgaaacaaattggccaggccaatcggcgtgtcttagctactgacgaatggctaagggtccgtgaatgtgatggtgtctatgcaataggtgactgtgctacaataaaccagaggaaagtaatggaggacatttcagaaatattcagagttgcagataaggataagtctggaaccttgactgtgaaagaaattcaagatatcctggatgatatttacgtgagatacccacaagtacagctgtaccttaagagcaagcagatgaatggcatcgctgatctagtaaggagtgccaaaggagacgctgaaaaggaatccatggaactgaacatcgaggaattcaagaaggctcttgcactcgtggattcgcaagtcaaattcttacctgcaactgctcaggtcgcatcccagcagggccaatatcttgctaggtgctttaacaagatgaaggatgctgaagaaaaccctgaaggtccaatccgcatcaggggagaaggccgccatcgcttccgccctttcaggtaccggcatctgggccaattcgccccactaggaggggagcaaactgctgcacagcttcccggggactggatctccattggccacagcacccagtggctctggtactccgtgtatgcaaccaaacaaatcagttggcgcacgaggatgctggtggtatctgactggacgcgcagattcatcttcggaagagactcgagttgcatatagtcaagagaaggaaaagattttgctgtgacatataatatatatatattcagatgaacggggccagtagagcctcttcccactttttttagtctgatttcacataaatgttctttttttgttaagggaagaatgcgagttcccttgcactttgtatagtgcaccacgaagaaattcctttgtacctacctttttctggagagagttgtactgcacttttgcggcctgagtaactcagattcttttaatagctatttttttaccactaagatgtgatatgcaaaagggtcagttcggacctgattttgttgtgttaaatccctgctttggctggatccttt

SEQ ID NO: 455 - DNA, 2286 bp, Sorghum bicolor
acgtacgtagtccagctgatttgtccacgcggcatggcgacgcccagcgccgccgcctccagcagcttcctcgtcccggcgaccaccgctgtcgcctcgacaccctctgcatgcccatccacgctccccaagaagaatgccgctggcgctgggcgccggcggcaccgcacaatgcagtgcagggccagcagcggcggaggccgccgtggcgacggcgacgacgtcgacagccgcctcctttggctgccccgtcgtcaagtgctcaccggcctgagcggcgtcgccgccggcttcgtcgggtaccctgacgaccttgcgtccatcgccctcgccctggaggcgaaccccgtggagagctgccgccgcggggagaaggtgacggacaagatcgtggagtgctcggacccgaaccgcggcttcccgtgcccgccggcgacgcggatccccgtcgtcgacttcacgccggagcccaaggtgacgcgcatccggcagccggcgcacctcctggacgccgagtaccaggccaagtacaaggaggccgtccggaagatgcgggcgctggacaagtccaacccgctgagcttcgcggcgcaggcggccgtccacgagtcctactgcgacggccactaccggctggacccgtcggagaagaaccgccccttcgacgtccacttctcctggatcttcgcgccgtggcaccgcatgtacatctacttctacgagcgcgccctcggcgacctcatcggcgacgacaccttcgcgctgccgtactggggctgggacacccccgccggcatggggatccccgccgtcttcaagggggacgacgacaacccgctgttcgacccctaccggaacatggacaacaacgacgccctcatcgacctcgactacctgaaaactccccgacggccgaccgtcccgttcacgccgccgccggtgtccgacgccgccgcgcgccaggcctacgacgacgccgttcggaccaaccttgccaccgtatacattcagcaaatccgtgacggcaaggggcctcgtgcgttcctcggcgagaagctctgcagcgaggcgagctcccgggtgaaggaggtgaacgagcgttccaagaggcggcagggcgccggcgcgccgaaggtgaaggcgagcaacgcgcagggcacgctggaacggatggcgcacacgacggtgcacgtgtgggccggcaggtcgagccccaaggctccggcgacctgcacggtggacggcggcggggtggtggcgcacgacggcaagccgcactgcaacaacgacatggggttcctgggcacggcggggagggacccgctcttctactcgcaccacgccaatgtcgaccggatgtggcacctctggtccaccaagctcggcggcaagggcttcgacgacgcggagtggctcgacaccagcttcgtcttctacgacgacgtcaagagcccgcggctggtgcggatgaagttccgcgacgtgctcgacgtcaccaacctcggctacacctacgacaaggagtcggaggcggcgctgccgtggctcaagagcaagcccacccggttctcgtccggcaagacgccgtcgtcgtcggtgccggcggcggagcccaaggtggcgtcggagttcccgctgacgctgacgaaggaggcggtggacgtgccgtcggtggcgatcccggcgaagcagccagggaaggacctggtgctgctcatcgagggcatcgagtacgacccgcagatcaacaacaagttcgacgtgatcatcaacgtgcccaaggaggacgccggcaaggtggggcccaaggactgcgagtacgccggcagcttcaccgccgtgccgagctccaacgccgccggcgggacgctcgtggggaaggtcacgctcttcatcgacggggtgctggccgacctcgggctcaccaacgagagcgccgtcgacatcgtgctggttcctcacaccgacgaggagatcaagatctacctgccgccgaccatcgagaacgcatgagaacgcattgctggctgttatcttcgccgcgccgccgccggccggtgactgagcagcggcggcgatttctttttaataaggtttaaaaataaattagtaaaatgttctactcctgccgtttgattattgtgtttgtaagtttttaataaactggatgaaatgaaactccggcacattgcggcgggacagtaatatatggaatgcatgattcttgctacatgtaggtaggttttgagaaattgcatatatagtccgatgtggaaattaatgttg

SEQ ID NO: 456 - DNA, 1173 bp, Sorghum bicolor
tggtgcaagaccaagatcaagggggaggagaaggccgcgatggcgagcggcgtcaacgatggcagcgggaagagcctgacgcattggctgcgggagaacgggttcgacgacgacgccgtggcgcgcatgtccaggcggtgcaggaacctgcacagcctcgacgccggcgaggcctcgggcgtctgggactacctcctgacgggcgtcaagatggagcggcggaagctgcggcacgtggtggccaagtgccccaaggtgctcaccctgtccgtggacggcaagctcgtgcccacggtgcagtgcctcgccacgctgcaggccaggcccggcgaggtggcgcaggccatcgccaagttcccacagatactgttccacagcgtcgaggagaagctctgcccgctgctcgccttcttccagacgctcggcgtctccgagaagcagctcgccaagctgctcatggtcaacccgcgcctcatcagctacagcatcgaggccaagttctcgcagaccgtcgacttccttgtcggccttggcatcgacaaggaaggcatgatcggcaagatcctcaccaaggagccgtacatcatgggatacagcgtcgacaagcggctgcgtcccactgccgagttcctcaagtcggcagtcgggttacaggggcaggatctcaaaagggtgatcatgagcttcccggacatactgtcgcgagatgtggataagattctgcggcccaatttagcgttcctgcagagctgtggattcagcaggaatcaggttacggctttggtagctggataccctcctgttctcatcaagagcatcaaacattgcctggagccaaggatgaagttcctggtcgaagaaatgggacgggacatgggcgaggtggtagattacccccagttctttcgccatggactcaagaggagcctggagtaccgtcacaaggtgctcaagcagatgaactcgagttgcagtctcagcgagatgctagactgtaaccagaagaagtttgccatgaaatttggtttggttgcagcagtttaggtactcatcttttctctagttccaatgtagtatgttttattctcaggtgaatcttttgtttgtaccatcaggttgtattgttcttgaatatttgggcaatgataattgataatgcaaggttcgctttca

SEQ ID NO: 457 - DNA, 2686 bp, Sorghum bicolor
aaaggatccgctggatttaagcagagcagagagcagagcagagcaaccgcccgctcgcccactccgcccaccacgatctccctccctccgcacgccgcacgggcagacccagccaaggcacagccgagaaccgaagcacgccggccggcgggcgtcggcgtcgcctcccccgccggcggcctgctgctcgctcgtcctcgcttccgcattggatcacgcggcggttgggcgacttggtgtctgctgctggtggtgattgcgcctagccggtcgacgcggagacggcatcaagtttctaacaatttgaagtacccgaaatgggcgcaagagataatggggagggaagggatgagaagaagggaattggatcagattatgtacctactagagattccttttcttcacaaggtgagtctcgggttccaaggaagctcagtaaaaaggagacaaaagacaataatagcccccgaacaaccaaaagcagtgccagccgtcaagctcaaactaagctgcaacataaaggattaaacagtgtacagaacaagtctcagaaacaaaagaaaacagttagtcctgctaaggctgttgaagttagaaaaccagacattacaagaattccttcccgccctccgtcagaattgtctgaggaaacagatgatataatcagtgatgctggaactgttgatgataaaggcaccgaggaggccaaggagatcgatgtgttagatgaagctccacactgtgatcagagtactggtactgatgacgaaattcctgatatcgaagacaaggtagttgatcatggaaaatcagttgtaggtcaaggcaatggggaattagtgttgaaaattgacaagttggaacacgaacttcgtgaagttgctgctcttgaagtttccctgtactctgtagtccctgagcatggaagttcagcacataagttgcacaccccagctcggcgtctttctaggctatatatccatgcatccaagttttggtctgaagataagagagcttcggtagcaaaaagcattgcttctggtcttgttcttgttgcaaaatccagtagcaatgatgcttcgaggctgacattctggctgtccaacacagttgtcctcagggagataattgtacaaacttttggcatctcacatcaatttactccatccatgacgactatgaacatgaatggtggtgccaaaaaacttgatgggaaatctatgacaatgctgtggagaaacaattccaatggcatgcaagccaaacttgctgcaatgcagatgccagatgattggcaggaaacaagtacacttttggctgcactagagaagatcgaatcttggatattttctcgcattgttgagacagtatggtggcaggcactaactcctcacatgcaaaaacggacggtggaaggcgcatcaactccaaaggctggtagagtgttaggtcctgctttgggtgatcagcagcagggcaccttttctgttaacctgtggaaggctgcgtttcatgatgcattcaacagaatgtgcccccttcgtgcgggtggacatgagtgtggctgtttgccagtattagcaaaactggtgatggagcaatgtgtagcccgtttggatgttgccatgtttaatgccatccttcgtgaatcagcaagtgagataccaacagaccctatatctgacccaattgttgacccaaaagtcctaccgattccagctggtgatctaagctttgggtcaggcgcgcagctgaagaactctattggaaactggtccagatggctgacagataagcttggcatagatgatgatgattctgatgaaataggagatgttgaagatgaaagaagagggagagctgaaacaaaatcgtttcaactgcttaatgaactaagtgatctcctgatgctcccaaaggacatgcttcttgaaaaatctatcaggaaagaggtctgcccttcaattggccttcaattagtgacaagaatcctgtgcaacttcaccccagatgagttttgccctgatgcggttccaagcacggtcttagaagagctgaattctgagagcttgttggagcgtcacaccaacaaagacgtgatcaatgtgtttccatgcatcgctgctcctatagtgtaccgagcaccttcaacgttggatgcggcagagaaagtggcagacataggagttggcgcaaagctggacaggaaagcttcaatggtgcagaggagagggtataccagtgacgatgaccttgatgacctggattctccgcttgcatccctaatcgacaggagcgctccaccttcgccatcaaatggtttcacacatttcagttctcagagaggagtttccatggagaatacaagatacacgctcctaagagaagtatggctggagcaacggtgatggatgaacctgtaaaacctaaaatctcttctacagctgccccatgaggccaaaagaaggccctatttgcgtaggcccttcagcaatctctacactaaaaatgcgccactttcttgtacagtacattcccacaatcttatatatgttagctcttttgtagtatagtggcaagtcagcaactcagatacatacgaataacactatggacggtgcaagtttgtgaaatgaaagtatgtttaccaggccactgttgtgtaggcctgtagggtctcgagttt

SEQ ID NO: 458 - DNA, 3395 bp, Sorghum bicolor
gccccatgccgacgccggtgcccgccgcgcgccagtgcctcgccccgcccgccgtcacggcgctcgacgccgccgtcgcctccgcgcgccgccgggcacacgcgcagaccacatccctccacctcatcgcctcgctgctcgcgcccaccgccgcgccgctgctccgcgacgcgctcgcccgcgcccgcagtgcggcctactctccccgcctccagctcaaggcgctcgacctctgcttcgccgtctccctcgaccgcctcccttccagcagcaatgaccagcacgagccccccgtcgccaactccctcatggccgccatcaagcgctcccaggccaaccagcgccggaacccggacacgttccacttctaccaccaccaccaccaggcgtccgcgtccgccaccgccgtcaaggtcgacctctcccacctcgtgctcgccatcctcgacgacccgctcgtcagccgcgtcttcgccgacgccggattccgcagcaacgagatcaaggtcgccatcctccgccccgcgccgcccgtcccgctgctcgcccgcgccggcctccccacgcgcgcccgcccgccgccgctcttcctctgcagcttcgccgccgcggacgacgccgacgtaccctcgcccgcgcctgccctcgccggggccgcgccgggagaggacaactgccgccgcatcaccgacatcctcgcccgcggacgcaaccccatgctcgtcggcgtcggggccgcgtccgccgccgcagacttcgcccacgcgtcaccgtaccgcgtcctccccgtcaatcatcagacggacctcctcgccgccgtcgcggcggcaccgacgacgacgcccggttctgggatcatcttcaccatcggtgacctcaaggacctggtgcccgacgaggccgacctgcaggacgcggctcgcagggttgtggcggaggtcacgcgcctgctcgagacgcacagagctgccgcccgccagacggtctgggtcatgggctggtcggccacctacgagacctacctcgccttcctttccaagttcccgctcgtcgacaaggactgggaactccagctgctgccaatcaccgccgtgcgcgacgccggccctgcgcccggacttgtgcctcctccagctccagtaaccacggttcctgccttgtccatgcctgccactacaagcttcgtggagtcatttgttccttttggaggttttatgtgcgatacctatgaagcaaattcctgccctcaggccctgcgatgtcaacagtgcaacgatagatatgagcaagaagttgcaactatcattagaggaagtggcattacagctgaagctcaccaagaaggtctaccttccatgctgcacaatggcagcatgatgggtcctaacaatgggtttgatgcactcaaggttagagacgatcatatggtattgagtacaaaaatacagaatctgaagaagaagtggaatgagtactgcctacgactccaccaaggttgcaataggatcaacagagatccttgccagttatttcgacatcacatggatgttcgagttgacagggaaagatgtgcaaatccaaaccaaagttcacagtcacttgcacttcaaagggaggttattagaccttctgcagtgtcttctctacataccaacacaactgcaaagagtatttcggcgccatctatttccacccaaatgaatgcagaccttgcattgaaccttcaagtcaggcaatcaaagagtgatgaacccctccaagatagggctgtgccatcccaacatagcaactcatcaaattgtgacaaccctgaagatcatgtgtcaccatcatctgctgcagctgtgaccactgacttggcgttggccacccctcgtggatcttcttccaaggattcaagtaatgcactgcgtaaacatgtagaggatgctgaagggtcgatccagctgatgcccaagaaggttgatgatctgaatcttaagcctcctcacttctctgcacagccttacacttgctttaggagttcctcaaattgggatcaaacttcacctagtgctctgcatccagcagcttcaggaggtgcttctgcctttggccaatggcagaggccttcacccctcgcagcacaaacttatgatttgagcaattacaagctactcatggaacgactgtttaaggctgttgggaggcaggaggaagccttgagtgctatttgtgcatccattgtgcggtgcaggtcaatggagaggcatcgtggtgcaaacaagaagaatgacatatggtttagtttttatggcccagatagcattgccaagcggagagttgctgtggcacttgctgagctcatgcacagtagctcagagaacctgatatatctggacctaagcctccatgactggggtaaccccaatttcagaggaaagcgtgccactgactgtatctctgaagagttgagaaagaagcggcgatcagttatctttcttgacaatgttgacaaagctgactgccttgttcaggagagcctgattcatgccatggagactggcaggtacaaggacttgcatgggggacgggtggctgaccttaatgactcaattgtggtgttgtctacaagaatgatccaaggatatcaagatgcctctcttgggatggaacaggacaatgctttttcagaagaaaaggttgtggcagctcgtggacatcaactgaagatcatagttgagccaggcacagccaacatcggtggagactctggaggcaaagttgtagtttcctcaaggcattccttgagaaacagtcaagcatctttgttgtctagttctttgagtaagcggaagctccacatctctgatgggcaagaaaagacagcagaatcaccgagcacttcaaagcgactgcatagaacatcaagcattccattcgacttgaacctcccaggtgatgaggccgaagcccatgatggtgatgatgacagcagtagcagccatgagaactcgtccagtgatctagagggatatgtgggcaacctcttacgttcagtggatgagtcaatcaatttcaaaccatttgactttggcaaactttgtgaggacatcatgcaggaatttagcagtactatgagcaagactctaggctccaggtgcaggctggagatcgatgctgtggctatggagcaagtagtggcagcggcatgggcatctgattcacatgagaagaggcctgtgcggacgtgggtggagcaggtgtttgccaggagccttgagcagctgaaagtcaggtgtaagaatttgagcagctgtactctgagattggttgcctgtgagaatgaaatgccggtgaaagaagatggttttggagctttccttccctcgacaatagttctggattggtgatga

SEQ ID NO: 459 - DNA, 1694 bp, Sorghum bicolor
aaacccgggcggttctatatgccatagccagatagccttctagccttattttcctgctactttacttaagggcattcattcctacattttcctgttactttacttaagggatttatacctaattcattgcgcattggttatcctgacaaatgggagcattgctagcagatctctcttctctggataaccacaccaatcatgagggaatcgcctccaacgcagggggagccatctacatcttctgcggttgatgatagttactcagccgacagggttgaagattcacaactattcctctccgtacctgctttaaaccaagctgcatcttatcttgctcagacggcttcattcctcacccaatgcctcccagtacctggttatgtgggtctgtctgaggagggccaagaattagcaacacttccacctgcatcggcctcaggcaggctttctgttcagacttcttcagtagagcctgctggcaccaattcatcccttggtcaggcagattgtggtggaagcccctctcaagaaaacacaggacaaatggtgccttcgcatgtttttcagaatggagcttcactgttccaaggccttgttgagcgtgctcggaaaacggtccgtggttcagcagatgatattggctggctccagcgggatcaaagcttacctacaactgaggatggtacagccagattcttggagattttggactctgtaagaaaaaatgagcacaagctacctgattcagtggtttacttgttggttccaggtctgtttagtaaccatggaccactttactttgtcaagacaaaggcatatttctccaagatgggtctagcttgccatattgccaaaattcatagcgagtcttcagtgagtaaaaatgcacgagagataaaggaatacattgaagaaatatactggggatcaaggaaacgtgtgctacttcttggtcacagcaagggcggtgttgatgcagctgcagccctctccctctactggccacaactcaaagacaaagtcgcaggtttagtattagcccaaagtccatatggtggaagccctgttgcttcagatatcctgcgagaggggcagcttggtgactacgtcaggctgcgtaagatcatggagatcttggtatccaaggtccttaagggtgatctgcaggctctagaagatctgacttatgaaaggcggaaagaattcctgcgacagcacccgttgcctcaggatgttccgatcgtttcgttccacacggaggcaagcatcactcccagtgtgctcacagcgctctctcacgttgcacacctggagctcccaattgctgccgacggcaattccaccaggatcccagttgtaatgccactttcagcggcaatggcagcatgctcgcaactgctggtggcaaggtatggcgagaagagtgacggtcttgtgacgcggaaggatgctgaggttcctgggtcagtggtggtccgtcctgagcggaagctagaccacgcatggatggtgtattcgtcgctgaaggaagagcccagggatcaggcggacacgtcgcaggtatgcgaagccctgctgactctacttgttgaggttgcacagaagagaaggcatgagatggccatgaaagacgagtgaaagtagctttttggtagattttcggtgttggccggagatagtgagatctcgagttt

SEQ ID NO: 460 - DNA, 1888 bp, Sorghum bicolor
aaaggatcccccataatcccttgtaagagaggcttttgctaggtttttgccccaaccgcccgcccaggttcgtgcttctgcccacccacccctccactcccggcgggcggcggctgcctcgccgaagcggtccagccggcgcgcccgagatggcgaagggcgacgacgcgctggcgcggaagcgcaaccgggtgcgccgcaagcgcctccgcagcagcgagaacgctgtctccgcgcgggtcgcggcaatcatcgcctccaagcgccgccgcaagtcggggaagcgccgcggctgcgagggcatgtgcttctcgctccctacgcccgacgacccattcaacgagcgccacggcaagaagcgcaaggtcgatgacgagccgaccgaggacacagccgccgccaaggacggcgacgaccccaagaagaagggcgcgaacaccaaaaaggagcagccggtggcaaaggccggcgccgaggccaaggccaaggccaaggccaaggccaagtcgaaggcagttcgcgagagggcgacgggagcggatgagggccgcgtggacttggaccggccctccaagttcctggtggtctgcctcaacgccatccgggacacgctggcgcccgaggacggcggcggcagcattcacggcgccggcgactggggcgtggagctctggcggtgctgctccgcccaggcgccgtccgacgtgctcgacgctagcggcgcgtgcgccacggtggaccagaccgcgtggctcgtctccaccgcctgcgacatcgtcgctaggaaggagaggcttgggatggtcgtgtcctgccccttcctgctgtacctcgtcccgtcccaggagaaggccgcgcaggtgcgatcgatatgcaaacccctgaagcctcttgggattcattcagtgagcttgcatcctggcgcatccattgaacaccagatttctggactgaaaacttgtgagccggagtttcttatagctacccctgagaggcttcttgaacttgtttcgttaaaggcgattgacatatcaagtgtatcaatgctggtcattgatggactgaaatgtttcgtggaccacaatgccagtgacaaaatattttctattagagacgccatatcaaacaatcctcagattactatcttcaccgatccatctgataaaaaggttgcagcaatggctaaaagcctactccgtggaagaattacaaagctttctatcaatgattctgtttcttcacgaagtgcatttatagcccagcatgtacacttctgtccatcagaggagctgaaaacatcaaaggtcaaggaaattcttgaggggatattgcaaagtcatcctaaaaagacatcgaaggttcttctagtagtcgcaaacgatcaaaaagcgcgatacatgtcatcgtcacttaagctgaaaaattgcacagtgattgatgattcacatggcagctcttttacgatatgcagcagtttggggctgatgaatgtcattgtgaaagatcgggagaacatggcagtgacagatgcagaggaatttgaaacagtgctggtggtggatctgcctccttcagtcgacgaatatgttgagatcctcactggggttgctcttcatgtgattggaggcgaagtgcatagtatattctgtaacgctgatgcgtctattgcaaaacctctggcggagcttcttgcagattgccgtcaggtggtgcctgagtttttcaaaaacctggagtcttcatagcagacttgtgtacacaatcagaatagtcagatcatatcgtggtgcggttgtggcacttaactgtcaccaatcaattttgttattttttgtgttgggttctacatgtaattctcatttgtcagccaacattggtactcgagttt

SEQ ID NO: 461 - DNA, 2591 bp, Sorghum bicolor
aaaggatccgcaatagttactcacctttgatcctcactatactgatacttcaagatggaacaaatttcacttggcaacagatacaaggagtgcaggccacgaagaactagcagctgtcaaacaaaaatacttgttggaaaggatgtattgcatgaactagagcaaaggcgttcatcaccaagtgtgattgcaaaactgatgggaattgatgtgttgccacctaatgtggtcaatagtcggcatcaagaatttaaggatgtttttgaagtgtcagaggagccaccagaggctgtcacaaaagagaggtcccatcatttcccaaaaggcttgccaagcttgaaacaaagtgcactaagattaaaaaagcttatgccatcaaaaacactctacagagatgatacacatgattgtcatgtggatagcacagatggcttgggtcgcttgaactcagtggaaataaataatcctttatttgagaagcgccctcgtgacatgaactattctgcaaattatcagtacgagaaaaatacatcaagtgactgcaggacttaccctgtgggtttagccaattcttcactcagcaatttcagccttttatcaagaggaaaaaacaaagattttaacaacattgttcttctggaaccaccatgcttggacaaagggcatgatccagaaaacgttttttccattccatacctatctcctctcaataagaactgcaggagaggcatgaaacataagcaatctgagtttcctgtaatggagaatggaagagattggcaacatatattaagtactgaagataataatgtgcctcgaattagaaaagaaagattcttgactagtgaccccattgatcgactgcaaattggacaggaagcatcagttcatcagtttggcaatactgatgcgagttgtcctggatcatcacagaggtatttttgtggtaatgataactttaatcaaactaataggtcatcatcaaacagcacgctgttgaaaatacgccggcatgcggaatctgctgttggttcaaaaactcttgcacaaatgtttgctctatctgattctgaaagactcaagctaaattcaaactcacgtgctccaattcggcgtaatatgattgaccgtgataatggtcatagcaaggatggatgctttatagttttaccaaagcatgcacctctgcagtctatccgaagctcaatggacaggaattcttgctcggaaggctcctctcagggtaaaaaaaattcaaatatatccaatatttacaacaacgggaagtgtcagtttgattatttccgggataaaccaagactgctgaagcaaattggcagtggcagtgaagctcactcagctcacttgagcaatgcttgctgtttccaaaacctgacagcagataacttttcaagtcctgattgcttaaatgagaaagtattgttcacaacagatgaagacttagtgctacaaccaccagaattcttagcttctgggttcaacttgcaggtttctaggaaacaacgggtgacaatactgcctttccgttgtcacgaggatgaattaatatctgtttcggatcatactgacagtacaaaatcttgtaaaggctcaaaagaggttgagcaaccgagcccagtgtccatccttgagcctccaattgatgacgatatttgttttccaggatgtttggactatgatgacttgcaagggatggctaatgtagagaaacaaagagatggccatcaatatcacaatgaatctgaagttgccatgtcaagtgatgatgaagaccattctttttaccaatctttggaagcatttcaggtcgaggaaaactgggacttctcatatcttcttgacatacttatatgctctggtatcatagttgctgactggcagctcatctgcaagtcatggtacttgcctggttgccctgttggccctcatgtctttgatagacttgagaggaagtacaacaaaatcgccacatgggcaaagcctgagaggaggcttctgtttgacctcgtgaattcaatcctttctgaggtccttgcaccatgtgttgatgtgcacccatgggtgcggcctaatagacactgtgtggctctttggggtcctgaaggtcctgttgagaaggtttggcagacaattgttaggcagcgggaagattgtgtcacagggcaacctgatgagatggttcttgatacaaaatggctggaagtaggcaacgacatcaatatggtggggaagcagatagctatgatgttacatggcgacctcttggaagaagtcatagtggacttcctgtgatgagttggtagtttcttgaggacctaattaagaacttggcaatggtagcagaatactatggcgacatggggttcgcccaaacttcaagcagattatgctgaagtatgtaacagcttttcaagtgcacatatgctgcatttttcttctggttataataggagctatgaatcgtgccattacactggagagcagaatatacaggccaaaaaaacactaatgcaggtatttctggattctgtactgataagctgtcctatctgatgctttgactcgagttt

SEQ ID NO: 462 - DNA, 1341 bp, Sorghum bicolor
aaaggatcctagaaggaagcaagtgtgtgtccgtctcatacctactggggttggctggtgtggtgtttgagacgtgcggtcgggagagcggatggagaggaagggagggtgctgcctcgcgccgaggtacggcgccgccgggcctgcggccgcgcagcagcaggcaggcgcgtcgtggcagatgggcaggatcatgctcaagttccgcccgattgcacctaagccggcggccatggcgcccgtgccggcaccgacgccggtggtggctgggccgtccgttggtgcggccgggagagggaagcgaaaagccgtgtgcggtgcaggcggcgggaggagggggcggaagcccaagaaggcggctgcggtggtgactgcagcgcctgcgcttgcagcggcggcggcgcaggatgcgggcgactgcaagaaggactgcgagaaggagaagtcgtcgtcgtcgcggtcctcgtcctcgtcggggatgacgtccgtggactcgtcgccgccgccgccgcagcaccacctcccgacgctgctgccgctcatgcccgtgacggcggtggaggataagggccccgctgctggtgctgcgacagaggagcttccggcgcctgtgccgtctcaggtggccgcggcagccacggggtcggcacggccgtttgctccgcgggcgttgcgcccaggctccgcggcttgggcggcttcgttggtgacggtggaggaggtgaccgcgacgtggcgcgacggcgaggcgccgccgtcctccgcggcgtgcgtcgccgacgacgccccggcgttcgtgtcggaccagtggggccgcgtcacgtggaggaacgccgcgttcgtccgggctgtacccgcggacgacggcggcgacgaggtggagacgcagacgcccgtggcgctcagcggcgcgctcccggcgtggggcacctgctcgggattcacgtgccgcgtccgctggcactcgagcccccggcgcgtgggttccacttcctccgtggtggcgccctgcgatgtgtggcggctggacgccggcggcagctacctttggcggctggacctgcaggccgctctcactctcggcggccgcctgtgactgtgaaaacccgcctgtgactgtcaagttctgaaccccagcaacgaatatgctgtagtactcctacgtgcggattagtagtgttttattctgagattggaaaccatatgcgttcttactgacgtacggtatggtttaatcggcgtattgctatcctggtcgggcttaattaaggatgtttgaagccagattgggtattactaattatggattagtttagatcccttggaatgggaggtaccttt

SEQ ID NO: 463 - DNA, 1048 bp, Sorghum bicolor
cgtctcgctcaacatgaggagagcaggcgggctagcgcgcgccggccatggcgcggcgacggcggcggggcgtgcgacgaaggtgatgcgggcggcggtgtccgcgttcttcgccgggtaccactgcttcacctccgtcgcggcgctcctggcgctgccgttctcggcggcggtgctggcgtcggaggccatggcgccgtcgtcggggatcctgcgcggcgtggcggcgcggctccgcgccgtgttcgccgcggccgggttcccaccttccccgttcttcgcgctgctcgaggccaagctgtcccagaccgtcttcacgttcgccgccacgctgccgttcgcgctcaccttcttgctcctcgccaaggcctgcgtcgccgccatgctccgggacgacgtcgacgacgggcaccggcggcggcggcggctcgccgtcgccgtcgccaagctcccgccgtgcggggccgtggcgcgcgcgtacccggcggtggtggcgacgcacctgctcaacgcgttcctcatgctgtccgccaacgcggccgtgttctcgctgctgctgctggcgttcggcgccgccgacctgctgggcctcacctcccacttctggacgctggcgctgtcggccgccggcgccatcgtctactcgctggcggtcggcgtggccaccgtggtgtgcaacctcgccgtggtcgtggccgccacggagcccgggtgcgcgggccacgccgcggtgctcagggcctgcgtggccatccgggggcgggtgtccacggcgctggcgctcgcgctgcccaccaacctcggcatggcggcggccgaggcgctgttcggactccgcgtcgtcgcgcagcggcggaaggacggcggcaggctcgcgccgggcgtcgctggcgaggccttctcgatcgcttacatccatgcgatctgcgtcgtgctggagatcatcgtcagctgcatgttttacaggagctgcaagaggagtgaagccgacgagctcagagagctcgagccagaggagaagggagatctccaggcttgatcagtgtga

SEQ ID NO: 464 - DNA, 464 bp, Sorghum bicolor
aacagctcatccacatccaaagcctttccattccatctcacgcacactctgcgtcggatccaagcaagcaaagcgtctccatggcttcgacgacggcgtccaacctgggcggggcgtggttcggcgagctggcttcagcgctgcaggggacgtggcaggcggtggccgccaccgccggcgaggacccgcggcagctccagcagcagaagccggcacgaggcggcggcagcagcaacaaggcggcgcagggcaaggaggagggggacgtcgcgaggtgcggcggcgccatgtccgacaccacgctctacctgctgctcgaccggttcacgcccaactgagctgaccggacccccttggtcgcccgtcgtgtccgtcggcgcgtgctgtagtactctactgtactgtacaggcggaataactgcgcgccatggttttgtgtaaatgctgtaaattgcaatgccatg

SEQ ID NO: 465 - DNA, 1525 bp, Sorghum bicolor
tactcccagcctcccactcccaccgccgcccgcgcgacacctcgtccccggaatggctgcgggctcgtccgtggtctgggccgcgcaccacccgtcgccgtcccactcccaccaccaccgcccgcgccgcgtcgtcctcttacccccgccgccgccgctaccggcgaggcggggcggcgcgtccctcgcgcgttcgccgcgcgccagcctcgccgccgccgcacccgcggtggcggtgaggacggcgtcggaggaggccgtgtacgaggtcgtgctgcggcaggcggcgctcgtgaagaccgcggcgccgcagcggacgacgcggtgggcggaggaggagaagaaggaagaggaggaaggggtcgtcggctggggcctcctcggcgacgcctacgaccgctgcggcgaggtctgcgccgagtacgccaagaccttctacctcggcacacagctcatgactcctgagaggcgcaaagctgtctgggcaatctacgtgtggtgcagaagaactgatgagctagtggacggtcctaacgcatcttacatcacgccaactgctcttgatcgctgggagaagcgattggaggatctcttcgaaggccgcccgtatgatatgtacgatgccgccctctcagacacggtctcaaagttcccggttgatatccagccgttcaaagacatgattgaaggaatgaggctggacttgtggaagtcgaggtacatgacctttgatgagctctacctctactgctactacgtcgctggcacggttggcctcatgacagttcctgtcatgggcattgcccctgactcaaaggcctcaacagagagcgtgtacaatgctgcactggctcttggcattgctaaccagctgacgaatattctcagagatgtaggcgaagatgcgaggagggggagaatataccttcccttggacgagcttgcacaggcaggtcttacagaagaagacatattcagagggaaagtgacagataagtggaggaggttcatgaagggccagattcagcgtgccagattgttctttgatgaggctgagaagggcgtcgcccatctagactctgctagcagatggccggttcttgcgtctctttggctgtacaggcagatccttgatgccattgaggcaaacgactacaacaacttcaccaagcgtgcgtacgtcggcaaggccaagaagctgctgtcattaccggttgcatatgcaagggctgctgttgcatcatgaaccatctgtagatcagatgtttttgttttgtttttttctttttcttttccaaacccagtttgttaccccctcacctcccatttttttgcttggtttctttgctcttgtatataatcagcttcagctgcctgcatggcataatccttgcctgtcacatacagttcttagttcagaggggactgattccatgtccctcaatactcggctcttgttaccagaaggaatgaagaattagaattcgagaagcatacttgccaattgtcttggatgatctctgtg

SEQ ID NO: 466 - DNA, 1741 bp, Sorghum bicolor
aaaggatcccattactgctccacccatatccagccagagctcggcggccggcgatggacctgcggcggcggcggctggcgctggctgtgttggcggcggtggccatgtgcgccgccacactgacggcggtggtggaggggttcgacatcctggagatcctggggaagcacgacgagttctcgcagttctgcaagctgctcaacgagacgcacctcgccggggacatcaaccgcgaccggaccatcaccgtgctcgccgtcgccaacggcgacatgggccacctcaccggcggccactactcgctcggcacgctccgtcacatcctcgagctccacgtcgtcgccgactactacgacgataagaagctcaagcagctgtcgcacgccgccaccgccgcatccaccatgttccagcgatccggatttgcccccggcatggcaggatacgtgaacataacgcagcaccgcggcggcaaggtgtcgttcatcgtggatgacgcagcggacagcgtgaagcccgtcacctacgtgaagcagatcgagagccaccggtacgactactcggtgctccaggtgagcggcgtgctgtcgtcgccggaggcggaggcgcccgtggccccgccggcgcccgtcaacctcaccgacatcctctccaagaagtactgcaagagcttcgcggcgctgctggccgccgacgccaaggtgttcgacgccatcaatggcaccaaggacacggcgctgaccgtcttctgccccgtcgacgcggcggtggcggcattcatgcccaagttcaagaacctgacggcgaaggcgaagacagccatcctgctgtaccatgccatcccggactactactccatgcagttcctcaagtccaacaagggcaaggtcaccacgctcgccaccaccaacaccaacaagaaggactacacgtatgaggccgagagcaaggatgacacggtcacgctcgacaccaccgtcgtcacctccaccatccaggccaccgtcagggacgacgacccacttgccgtctatgctgtgtccaagttcctgcagcctaaggagctgttcaaggcgaagacggcagaccttgcgcctgcgcctgctccggaagggccaaagaagaagaagaagaagaagcccgccagcggctctgcagccgctgcgccttcggacgatgactctgcagatggcccgtctgccgacgactcatccgatgacgccgccgacaaggccgccgctgcgccggcgtccctgtttgcccggtgggtgacgatcgccgtggcgctggcgctggcgttggcagcctaagtaagaaaataagaagggctatttttaattttatatttatttattaccgcattccataaaaaaaagagagaaaaggtgagaggtgtgtgtgagtgatgtaactcttttgattttgttcattgggtttgtggtgatcattttgtaatgatagtggccaattggagagtgggttaagttttcacatatgagtcatcatatggagtttagaaaagcagcagtgtttgttgcttgctttcattcaacctgtctgtgcttgagctttcggagtcacatgcctcaaaattgtcgcaaaaccctcatggaaaagttacaaaaggggtacaaagaagacattagcatgtgaaggctttgcttcctcgggttgtaaagggatatatgcctatgtgatttagtcactttagctgctacgatgatctgttctgggtaccttt

SEQ ID NO: 467 - DNA, 884 bp, Sorghum bicolor
aaaggatccaaatactccgctcgctctccctgttcctgtttctcggtgttgccccctcggctcggccctcgtcggcggactctgctgctcctcatggcgccgtcctcctcctccccgtcctcgttgtcgtcgtcgggcggctcccacgcgggcctcgccatcgcggccaccgccatggcgctctccggcacgctcgtcctctactccctgtgccgcgccaagcagccgcacctggtcccctccgacgccgccccgtcccctcgtctccgcccgtgcctcgcctcgtccgacaagcggaagaagaagaagcgggagatggcgcggcgagggaagagccagcagaagcgggtgcgcttcgcggacgacgtcgtggacaccaaggacaatggcgccgccaacgccgctgccgccggggcggcgcgggaggaggcggaggcggaggccgagccgtcgtgctgtaccgcggcgctgaggacgacgcccatgccggccaaccgggaggcgctgtaccgcggcatgctccgcggccggtccatgctcagggtcacctgctcctactagctaagctagcagggtagcagtagcaccacctgccggcggccccccgacgtaaccactccatcatccattaatctagacctctccgacctccagcaagcttgctcctctccgtgtctcttctctactcttgtgtgcgcgtgctgtgctgtgctgccaactagtggcggcgctgctaattagttgcccggaattaattaatcgggcctagatagctccctccctcgcccatttgtttgctgggaaagttttgtaattagtggccgtccccgcgaggcgagggagctgatccgtgcgtgctttactgttgatgctgtctcgagttt

SEQ ID NO: 468 - DNA, 1289 bp, Sorghum bicolor
aaaggatccagaggagggagtggcgtctgtcgtcatgctgctgcggagcgcgtcctcgccgctgctcaactgcgtacgtgcgccggctgcgtcggcggcggcggcggtcgagcacctcgcggtggtttcgccgttgctgtcaccggcggtggcggcggcgccgaggcagggggcggtgctgtgccgcgccatgtccgagggtgacctcgcggcgccgctcgtcccggccaagaaggaccacgagggactgcacgggagggcgctgccgaggctgtcggcgtcctcgtcctcgtccgcctccatctcgctcgaggaggacgacagcgagggcgttggcgaggaggaggaggaggaggagaccgtggtcgcggtcggcgccgacgtgccgctgccgctgcgtcggctgctgacgagcacggggctggacgtgtccgcgtccgtgtccgtgtccgcggccgcggcgcgcgaggcgctggcgctcgtggagctgcagggcgtcgggggcagcagcggtggcgggaacgggaaggctctcggcagcagcggtggccagggtggtgtcggggacggcggcggtggcggtggcgacaaccgcgccgccacggacacgcactaccggcagatgatcgaggcggacccgggcaactcgctgctgctggtcaactacgccaggttcctcaaggaggtggagggggacgccgcgagggcgcaggagtactgcgagcgcgccatcctcgccagccccggcgacgccgaggcgctgtcgctctacgcgggcctcgtttgggagaccagccgcgacgctgcccgcgccgacgactactacagccgcgccgtccaggccgcgcccgacgactgctacgtcctgggctcctacgccgggttcctgtgggacgccgaggaggacgacgaagagaatgacaactccgagaccttgccaccgccttcgctgttccagggggcggttcagcatccttccatcacagcggcatcttagatgaacatgaactcgatctagatctcaccaccgcttgtgaacgaagctgaatctggaactctgaagagcaccatgcgagaaaccagaccggccccctacgagtcaccgacatcgctggccggctcctcgccgcttgtgaactgatgaatcacggctgatgaatcacggcacatgtaaaaactgaatctggcagagcacaaacgcgtaagcctcttaaggtttggcacctgaagaatttgcagggctatgtatagtagacatgtagattgagaccctgcagagcggtaccttt

SEQ ID NO: 469 - DNA, 1254 bp, Sorghum bicolor
cgatatcttcctctcccgtagggcaagggcggtggggcgatccgtcggcggcgtcggtggtggtggaggaggatggccgacgtgcagggagacaaggaggcaggcctggaggacgacgattttcccgacgacgggcctttggtgccggaggatccaggtgaaggaggagaaccccgcagcggaggcgacgaggaagaggaggacgacgtcgacggcctcgccagcttcctcgagtcggagatcctctccggatccaacgacgaggatcctattgatcaggagcagcggaagcaggaggaggacggtggtgccgcgaagaataagcggaagcagggctcgggatcggacgggcatggctgcagcggcagcggcagtgagggggagcagaccaagagggcgaggagggaggagatgaggaggcaggcgaaagggaaggccgtggcgcctcagatcgacacgggcatgttcagcaacatcccccctgagctgttcctgcagatcttcaagttcctctcctccgaggacctcatctcctgcgctctggtctgccgcttcatgaacgctgctgcgtccgatgagaccctctggcgccgcttgtactgcatgaggtggggactggcatccaatgccaaattcagggagtgcgcttggaagaacctctacatacagagagatagagaggatatggttgaatttgtgaggaatacccctacagagttcaaggagtactatattcagatgcaggctgcaaaaaggagtcaaactccccatccgtcagaagtcaacgacgacaaggttatgcttgataagacagtagctgatcaagtatctagttggaaaaacagccgggggcttactgatgaagctgtcaaggggcactcttgttctggaaatacatgctcgtacacccagattggcgatgcttacatttgtgagaagactggtcgtgtccatgtttgtgatgacgcttgtcgtgaatttgtcttggaccaatctagtgggctgcttctttgtacaatatctggccactgctttgagaggtggctgtgtcctgatgatgaatgggaagctgatgataatgatctgcaacaagctggtgtagtggatgaagcagagccattcatgggatctggacgctacgcgcgagcaattatgttgggttacaactgcaccgatgagaaggaacttgaggatgccttgggtctctgttgatgtgtttctgtcgatatgtccttcactcttgctacatgatcg

SEQ ID NO: 470 - DNA, 1091 bp, Triticum aestivum
aaaggatcccggcaaccacttgctatgcacactcaaatcatggacatggcctctcctccgagcggagcctccagtgagcaggacggcatccccgtcgtcgacctggccgtcctcctcaacggcgacgccggcgaacggtcgcaggcgatccggcacctcggccgggcgtgccaacactggggcttcttcatggtgaccaaccatggggtgcccgaggctctccagagcgcgatgatggacgcgtgcagggagctgttcggcctaccaccggaggaaaatgcggagttcatggacgccggccccatggaccccgtgcgcgtcggcacgggcttcaactccgccgtcgacggcgccaggtactggcgggactacgtcaagatgttcgcgcaccccgagctccactgccccgccaagcccgacgccctgcggggcgtggccgcggagtacgcggcgcgcaccagggccctgctgctggacctcacggcggccatctccgagagcctggggctccacgccggccgcgtcgctgagcgcctcgacctggggtcctgcttccagatcctcgtcggcaaccattacccgccgtgcgctgccggcccgggcgacgacgacgatggggctgtcgggctgccggctcactctgaccacggcctcctcactctgctctgccagaacggcgtcgatggcctccaggtcaagcacgacggccggtggctcctcgccaagcccatccccggcgcattcttcgtcatcgcgggcgatcagctcgagattgtgagcaatggaaggtataagggcgtgctccaccgcgcattggtcgaccgcgagcaggcgaggatgtcgtgcgtgagcctcatcgggccgtgcctggacgccgtcgtcgagccagtgccggagctggccgtgccacccctgggtctcggcctcgagttcaggggggtcaagtacagggactacatggaacaccagcagagcaacaagctcaacgacaagggagcactggacctcgttcgggtgcagaaacgcccagcaattctttatacctaatttatactagagcatgattcctcaggttaaaattcggtacctaa

SEQ ID NO: 471 - DNA, 1322 bp, Brachypodium distachyon
cagccatgcgtcgtctcagccactttctcctcctcaccgtagtcctcgccgccgtcccgcgcccagctcacccgctcaccgagctcgagtcctcccaaatccgccgcttccaggactacctccgcatctgcaccgcacacccttccccggactacgccggtgcgtccgctttcttcctcccctacgccgcgtccctcggcctcggcgccaccacgctccacttcaccccttgcaagtcaaagcccctcctcctcctcacctggccgggcaccgacccctccctcccttccatcctcctcaactcccacatcgactccgtcccagcggaacccgagcactggatccacccgcccttcgccgcgcaccatgaccccgccaacggccgtgtctacgcccgcggcgcgcaggacgacaagtgcctccccatccagtacctcgaggccatccgcggcctccaggccgccggcttcgctcccccccgcaccgtccacatctcgcttgtccccgacgaggagatcggtggcgaagacggccatgagaagttcgtccagtcggaggagttccgggccctcaatgtagggttcatgctggacgaggggcaggcgtcgctgacggacgagtacagggttttctatggggataggctggtgtggaagctaatcgtgaaggctacaggggctcccggacatgggtcgaggatgttcgacggcgccgccgtggagaatttgatggatatcattgagactgtggctgagttcagggaggcgcagttcagtaaggtgaaggctgggaagaagggtcccggggaggtggtgtcagtgaaccccgtgtacatgaatgccggcacgccgagtcccacgggctttgtgatgaacatgcaaccttcagaagcagaggtgggttttgatatccgcattcctccaaccgaagatattgaacaaatcataagaagaatcgaagaagaatgggcaccagctcataaaaacttgacttaccagctgatgaagaaaggaccagtgagggatgtggcaggacgtcccttagttacccaaaccaatgagtcaaacccatggtggtctgtgtttgaacatgctattatctcttcaggtggaaaactagctaagcctgagattttatcttctaccacggacgcccgcttcgtgaggcagatgggtgttccagcccttggattttctccaatgataaatactccaatattacttcacgaccataacgagtttctggaagataaagtattcttgaggggcattgaaatatatcaacatcttattagagcgctaagctccttcaaaggctgatga

SEQ ID NO: 472 - DNA, 5080 bp, Sorghum bicolor
aaccttaaaccctgcgaacctcgcccaaaccctaaacctcgccgagccgccgccccagccatgccgaaggtctttggcaccggcgtcttcgagttccggcacccccgggcggccgagtacccgctccccgcggacgccgcccccgccacggccgcggcgcccgacaaggtccccgcatcaaccggcggcggctccatcacgctcctcgacatccagcgggaccgcctcacccgcgtcgccaccgagcattggggcacgcccgccgccgcgtcggccttcgacgcggaccttgtcaggaagatctatgccaccgagctccgcgtcgaggggcggggccggaagaccgtgccgctgcagcgcgtcatgatcctcgaggtcagccagtacctcgagaactacctgtggccgcacttcgacccggcgcacgcttccttcgagcacgtgatgtccatcatcctcatggtcaacgagaagtttcgggagaatgtggcggcttggacatgtttccatgaccggaaggatgcattcaaggggttcctgtggcgggttctcaagctcaaggaagaggaaagggctcttaatatggcggagaaaacaaattacctcctgttcatgataaattcatttcagagtttggaggacgagcttgtccgggaaacgatacttcagttagtaagcctaaagctgtggaatactctatcttttggacgacttcagatggaactctgccttaaccctgaattgattaagaagtggaccaaaatcaaaagaagagaggcaaaggaagcaaaaaaggctgaccaacctattgacccttctgaaatgctcgagaataaattccttaggaatctaattgaagagttcttggagattctcgattcaaaggtcatactatccaatcaagatgctggtgaagaatctgtattgaacgagtcgctcagtgggcagatcgatgattcttgtgtcctatattgtgagagatttatggaatttttgattgacatgttaagccagcttcctactagacgatttttgaggcccctagttgctgatgttgctgttgttgccaagtgccacttaagtgcactctatactcatgagaagggacgcctttttgcacagttggttgacttgctgcagttttatgaaggttttgagattaatgatcactctgggacacagctcggtgatgatgatgtcctgcaggcgcattattcccgtttccaagcttttcagctactagcatttaaacaagtgcctaagttgcgagattttgccttgtctagtattggttcacttcataagcgagctgacttagcaaaaaagctacttgtcttgtcagatgtggaactgcaagatctggtttgtaacaagcttaagttaatctcagcgaaagatccatgcagtggaaggcgtgattttcttattgaagtcctagttgctttttttgagaagcggcaatcccaaaaagatgcagtaaacgcacttcctctgtatccaaatgagcagatcatgtgggatgaaagccttgttcctagcattaattactccggagaaggctgccttgccctcccaaaactcaatctccaattcctgacgcttcatgattatttgttaaggaatttcaatctgtttcgtcttgaatcaacctatgaaattcgtgaagacattcaggaagctgttcctcatctacatgcttatatcaacaatgaaggagagactgccttccgtggatggtccagaatggctgttccgattaaggaatttaagattacagaagtgaagcagccaaacattggagaagttaagccttctgctgtaactgctgatgttactttcagcatatcaagctacaggcatcagataaaatctgaatgggatgctctgaaggagcatgatgttctatttttgctgtcaatccgcccctcttttgaacctcttagccctgaagaggctgcaaaatcaactgtgccagaaaggttaggattgcaatatgtacgtggatgtgaggttattgaaattcgtgatgaggaaggaacactcatgaatgacttcacaggaaggataaagcgagaagagtggaaaccacccaaaggtgagattcgtactgtccgagttgccttagatacagcacagtaccacattgatgttactgagacagcagagaagggcgcagaaaatgtgtatggaacatttaatattctaatgagaaggaaacccaaggagaataatttcaaagcaatcttggaatctatacgtgatctaatgaacgaaacatgtgtagttccagaatggttgcataacatattcttgggctatggaaatccttcagctgcacagtggatgaatatgcctgatcttctggaagttatagatttcaaggacacttttcttgatgccagccatgttcagcaaagttttccagattaccaggttacatttatcaattctgatggtacagaaaacctgcatccaagtcccccttttaagattaggctatccaagaaaatgagggaaagcagtcatgctctacctggcaacgtgaactccaatttgactgttaagagtaataatatcgctgatggggagcctcagaaagagaaactgattgttgaaagttacattccagctgatcctgggccatatcctcaagataaacctaaacagaactcagtgaggttcacacccactcagattggtgctataatatcaggtattcaacctgggttgacaatggttgttggtcctcctggtacgggaaaaacagatacagctgtgcagatattaaatgttctatatcacaactgtccttcacaaagaacactgattataacccattccaatcaggctttgaatgacttatttgagaagataatgcagagggatgtgcctgctaggtaccttctccgccttggtcagggtgagcaagaactggccactgatcttgattttagtcgtcaaggtcgtgtcaatgctatgctggtccgacggctagagctgctcggtgaagtttctaaattggcgagatctcttcgtcttccagaagatgtgggctacacatgtgaaactgctgcatatttttggttattacatgtttatgcccgttgggaacaattcttagctgcctgtgctcaaaatcaagacaaaccctctttcgtcaaagatcgcttcccattttcagagttcttttcagatactccgcagcctatttttactggcgagtcatttgagatggatatgcatgcagcgaaaggttgtttcaaacatctttctataatattccaagagctggaagagtgtagggcttttgagctactcaagtcaacagtggagcgagcaaactatctaatgactaaacaggccaagatagttgctatgacttgtactcatgcagcattgaagaggagagactttcttcaattaggtttcaaatttgacaatttgctgatggaagaaagtgcacagatattggagatagaaacttttataccgatgctgctgcagcggcaggaagatggccatgctcgccttaaacgttgcattttaattggtgatcaccatcagttaccccctgttgtgaagaacatggcttttcagaagtacagccacatggaccagagtctctttacaaggtttgttcgacttggtgtcccttatattgagctcaatgctcaaggtcgtgcaagacctagtattgctgaactttataactggagatacagagaactgggagatctgccttatgtccgtgagcaagcaatcttccataaagctaacgctgggttctcttttgagtatcagttagttgatgttcctgattataagggaaaaggcgagtcagcaccttctccttggttctaccagaatgaaggcgaggctgagtatattgttagtgtgtatatctatatgcgcctgattggctaccctgccactaagatttcaatattaaccacctacaatggtcagaagcttcttattcgtgatgttatcaacaaaagatgcaagccatggaatattgagccccctaacaaggttaccactgtggacaagttccagggccagcaaaatgatttcattttactctctcttgtccgtacccgttttgtgggtcatcttcgtgatgtcagaagacttattgtagctatgtcccgtgctcgtctgggcctgtatgtgttctgccgtcgttcactgtttgaacaatgttatgaattgcaaccgacattccagctgctcctccaaagacctgataagctcgccctgaaccttgaggagtgcactccttttaccgagcgacctttggaggaaactggaaacattcattacattactggtactgaagacattgatcatctagtgaagttcaggctggaacatcttcgtcagatgcaatacatgcagtattatgctcctccagcaaatgaactgcctcaagcagtgccagaaaatattgctgatgcaatcccttctgaaaatgggaatgctggtagtgctctgaatgatgcaaatgagcacatggcagtggaagaaaatggtggtgcgactgacacagtgatcgataataggatggaggaagatggtgttgaggcaaaggatgacatgacacaggaagggaacaagggtgaagggagtggcgagggtcacatggctacagaggatacacaaggggaagtacaagctagcacaaatgacaagatggaggatgcagatgccacgtcgacagacaaaatggaagaagcaaatgccatgccgactgacaagatggaggaagcaaatgccacgtcgacggataagacggaggaagcaaatgccacgtcgacggacaagacggaggaagcaaatgccacgctgacagacaagatggaggaggaaaattctgatctgaaggacaagatggatgaagagtgaggtggtggggtagccagttttgaaatagaggtagacctgtgctgtctagccacagatttcgatttggaacatcatatattcaactctgttaccacagatgaaggctgataacatgcccccccaagaggtgtagccgtgggcagaaccaaggttgacgtatgatggcctatgttcc

SEQ ID NO: 473 - DNA, 1145 bp, Brachypodium distachyon
cggccatggcgacgcccgcgcctgcgactctctccaccgcccgcagcttgcgcccgcgctgctctcccttgcgcggcgccctcgctgtacctaccgcccgcctcggccgctggcgccgctcgctgggctcgctgcgcgcggaggccgccgcggaggacgccgcgggggcgggggtcggggtcggggagcagctcaaggccggggtggccgtctacaagccgcgatcgtacgaggtgctcgtcgccgacgccgcgcgctccctcgcctgcgccatcgacgacggcaggacccgcctcgagatcgagttcccgcctctgccgagcaacatctcttcttacaagggatcttcggacgagttcatcgatgccaacgtccagctcgttctcgcggtcgcaaggaatctcaaagagctcagggggactaggtcatgtatagtgtttcctgatcaaccagaaaagagaagggcttcgcagctgttccgaacagctatagattcgattgagggcgttacagtcagttccctggacgatcttccctccggacccatcaacaacttcttcaaatcgatagttagtaccctggatttcgacttctctgacgacaacgaagatcgatggaaatctgacgaaccaccatcgttatatatcttcatcaacagcagtacacgtgacctttcatcaatagagaagtatgtggaaacttttgctccatctacaccttctgttctctttaatcttgaactagataccttgcgttctgacttggggattctgggatttcccccaaaagatttgcattaccggtttctttctcagtttacaccagtattttatatcagacagcgtgactactccaagacaatcgcagtcactccgtacatagtgaactacagtggtgctgtcttccgtcaatacccagggccctggcaagtcatgcttaagcaggctgatggttcttatgcatgtgttgcagagagtgcttctcggttcactttggggcaggccaaggaagaactattgagagttctcggtttgcaagaagaggaaggaagctcgcttgaattcctcaggagaggatacaagaatgccacttggtgggaagagaatgtcgatcaggagaagtcgcccgcatggcgaacctgatga

SEQ ID NO: 474 - DNA, 1897 bp, Sorghum bicolor
caggatcctaggccaaatgcctctctttgataagaaaccattctccttactggagccccctaaggacctggattcaaaggagaaggtgttccaaattcgattcacaaaggagatattccgagattatgaagaatacctaaagaggctaaacctttatcgccagagagtttggacatgtaagatttctggaaaatctaatttaacttttgaagaagctttggtatctgagcataaagcgatggagaaggctcaaaatttgccaactgagctaatggctcatgttcttcggatgactcaatacagcactattggtttacatgaacttgtcaataagatatatgctagtctgctggaagaagtatttgaaggaatagaactacatgctaataaggatggtgctgtggcaccttgcaagatcttgaagattttagattctggttgcacaaagatgtgtgaagttggttggattcgacagggtaaagctgtaaccaacacatcagtaatcaaagctgcagatctgttttaccggagggcacctgttagcaggaataccctgaagatttttattaaagatgctacatcacaaagtaatccatgggttatccatgagaatctcgccaaaaaatttggcatatccatggacccccctgacagcataatgaagaaagggagaaaaagacaagaggatggaactattgaagatgggaggaaaaggctcaagacagatgaagaacaggcatatgtaaagtatccaatagatgatctgctagtaaggcccaatgcagatgatccggctttatttaagagacctcctctggctacagattttagagtaccaagatgttctgtgggagatctccttatggtatgggacttctgctcgtcttttgggagggctctgaatctgtccccatttccactaacagatctggaaaatgcaatttgccacaaagaaagcaatgttcttctcgtggaaatacatgtggctatgtttcacttgcttatgaaggatgaaggtgactatttcactgttgtgcagaacaagaaacggaaattaaagctaagttcagtaacatgggacgagtatctatgtgatttcttggaaatgacaaaaaatgaagaactatccactaacattgcaacagtaaaaagggtttattatggtgttattgacactgatataaagcttaagatcctccgggaactagtggaagaagctattcaaacctctgccataagggagatactaagcgaccgtgtggaccagaaacaagtccttaatgcaacaaaaagagagaacaccagaagggacaaacaagagcaaaatcttaacactgaaattgcaatgaaaaaggaggagaatcagacagatgctgtgcaaggtggccatgagggtgtagatgagctggttaggggaaaagaaaatgacaagagcaatatttctcggagtaggacagaagggaaacgacacctggtacgacaccttgataccgagatcgataaattatccatccgttccagccctcttggtaaagacaggcagtacaataggtactggtttttcaagtgtgaaggaaggctttttgttgaaactgcagattccagagaatggggttactacagcactaaggaagagcttgatgcgctcatgggctcattgaatgtgaaaggtataagggagagagctttgaaacggcaactagagaagttctataataagataagtaatgccctagagaaacgatcaaaagatatcgcaaacaagatgttgcttgaagagggtgtgctgcgccgttccacacgcgtccgggctaacccaaaggacaacccgtccatggcattcctcaagtatgtcaacaagtggaaggataactgaggtactctgagatggtgatcc

SEQ ID NO: 475 - DNA, 5264 bp, Sorghum bicolor
aaagtcgaccggatcgaagaggtacaagcgcttcgggtcggcgtgcctctccttcatggcgccggcgcgaggggtccgatctgggggctcggctgccgcggcggcgctggtctcggttctgctcgtgggttgcctcgtcgcgggcggcgagggggccgagatccgccgccaaaaaaacgtgcagactgcgctccgggccaagtgggctggcacgccgctgctgctcgaagccagtgaattgctttcgaaagaatggaaggatctattttgggactttattgaccactggaaggaactggagaaaggctctgaatgtttaacggcaaaatgctgtgtccagaagattgttgaggatgcccgcacactactcaatgaaccactctcttcaatttttgagttttctcttacccttcgatcagcatcgccaagattagtgctgtacaggcaacttgcaaaggagtcattatcttcatttcctattgatgattcaccagagcaaatttccggtcatggcactggaaaaacttttgatggagctgtggatcctaactcttctggaggaacttgctgctgggtagacaccgggaatgttctattgttcaattcagctgatctacatgaatggcttggtggattgggcaagctagctatggattccactgaacagcctgaactctttgactttgaccatatatatcctcgcacaaatattactgctccggttgctatattttatggggctgttgggacaaattgcttcaaagagatgcatgttcaactagcagaagcatcaaagcagggaaaagtcaggtatgctttgcgtcctgtcctaccatctggatgtgggactacgtccaccttttgtggttcagttggtactgtagatgcagtcaccttgagtggttatggggtggagcttgccctaaaaaacatggaatacaaagccatggatgacactgctataaagaagagtgttcctctagaagatcctaagacagaggacctcagtcaagaagtcagagggtttatattttcgaagattttggaacgcaagccagagctaaatgctgagattatggccttcagagattatctattatcctcgacagtgtctgatacacttgaagtctgggaactcaaagatctgggtcatcagacagcacagcggatcgttcaagcatccgaccctttacagtcaatgcaggaaatcaatcaaaatttcccaagtatagtttcttctctatcacgaatgaagcttgacgattccatcaaagatgaaattattgcaaatcagcggatggttccacctggcaagtcattgatggctttgaatggtgctttgatcaatattgaggatcttgatctttacctgttaatggatatggtccatggagaattatcccttgctgatcagttcgtccggttaaagttgcctcaaagtgctgcccacaagatcctgtcagctcctccaccagcagaatctaattctttccgtgtggacttccggtcttctcatgtgcattgccttaataacttggaggaagatgacatgtatagaagatggagaagcaacatccaggagctcttgatgccggtcttccctggtcagatgcggtacatccgtaaaaatctattccactctgtttatgtgcttgatcctgcttcagcctgcggtgcagagaccattgacatgatcctatctctatatcaagatggtgtccctataaggtttggtatcataatgtattcttcaagattcatcaatgtcattgaagaaagtgatggcactcctacaaataatggagaagacacttccattttgataacaaggcttttcttgtacatcaaagaaacatactcaacacagttggcattccaatttctcagcaatatacataaatcaaggaatggtgaagatgactacaatgaagagcttgtggaagctcatcaagttgaaggggcatttgttgaatcactattgtcaaacgctaaatctcatccacaagatgtgctgctaaagttgcaaaaagagaacgtgtataagcaggaggctgaagaaagttctcgttttgttcacaagcttgggttgtataaactccagtgttgtctattgatgaatggatttgtccatgaagccagtgaggaagcaaccatgaatgctatgaatgatgagcttcctaggattcaagaacaagtttattatgggcatatccagtcccatacagatgttttagagaagtttttgtcagaaaatagctacaagcggtacaacccatcaattactggcaacagtgcagagaagaaatttgtttcgctctttgcatcatatcatcaggacagctctgtatttaatgacatgaagtacttacagtctcctggaactacagatgatgcaaaacctattactcatctacttgctattgatctttcatcaaaagttggaacaaaattgctttctgaggccatacgttacctgatggatggatctgatagagctcgtgttggtctgctactttatgtccacactggtggttcatcacctattttacttctgaaagatatcttcgatagaactatttattctttcagctataaagaaaaggtattggtcttcctgcatggactcttgaaattttatgaagcccaacctttgcctgcctcatctgttgctgacgattggactagaaatatgatggaaaaggtctataccttagctgctgaaactgctttgcctgttgatgactacaaagcatggttcaaaagtttctctgctgatacagttctcaaagggattgataagttatctgacttcttatttgggcaattggggcttgtgtttggtagtaatgctgtgatcaccaatggacgggtttttattatgaatgaaggagaatcatttctagccaatgacttaggtctccttgagtctatcgagtatgatttgagaacaaaatacatatttgaaataattgaagaggttgagtttgctggtgttgaccctgatgacctgacaagccaattctacagcgacattgccatgttgatctcatcatcgatgtctgttcgtgaaaggacatctgaaagagcccgttttgagattttacatgcagaacatagtgctatcaaattgaataatgcaaattcaagtattcacattgatgctgtcattgatccacttagtcccattgggcaaaaacttgccccacttctacgcatactctggaaacagattcagccgagcatgaggattgtacttaatcctattagttcccttgcagatcttcctttaaaaaacttctacagatttgttcttccatcgatggatgattttagcagtacagatcattctgtacacggacctaaagctttctttgcaaacatgccactgtcaaaaacacttacaatgaacatagatgttccagaaccatggcttgttgaaccagttattgccatccatgatttagacaacattcttttagagaatctcggcgatgtcagaactttgcaggcagtatttgaacttgaagctctcctcttgacaggtcattgcattgaaaaggaccgggaccctccccgtggtctgcagtttatccttggtactaaacaaagaccacacttggtagacacacttgtcatggccaacttgggttactggcagatgaaggtctcacctggtgtgtggtacctacaactggctcctggtcgtagtgccgatctgtatgagttacctccaaaactcattgccattgatagcttgagaggcaaactaatgcacattgaagtacaaaagaagaaaggcaaggagcacgaggagttgctaaatgctgccgatgactaccacttccaggaaaagacggataacaaaggctggaataacaaccttttgaaatgggcttctagtcttatcagtggtgatgcatcatccaaaaacaaagctgataaaatcaccgaccgtaaggatgcaagacaaggggagaccataaatatattctctgttgcttctgggcatctgtatgagcgtttcctcaaaataatgattttgagtgttctaaaagagacacagaggccagtgaagttttggttcattaagaattatctatctccacagttcaaggatgtcataccgcacatggctcgggaatatggatttgagtatgagctcatcacatataaatggccaacatggttacacaagcagaaagagaagcaaaggattatatgggcatataagatcttatttctggacgtcatatttccactttcactgaggaaggtgatttttgttgatgctgatcaaattgtgagagcagacatgggagaattgtatgacatgaacctgaagggtcgtccgcttgcatatactccattctgtgataacaacaaggatatggatggctatcgattttggaagcaaggtttttggaaggatcatctgcgaggaagaccataccatatcagtgcgctttatgttgttgatctggccaaatttcggcaaactgcttctggggatactcttcgtgtcttctatgaacaactcagcaaggaccccaatagtctctccaatcttgatcaggatctcccgaattacgcccaacataccgtgcctatattctctcttccacaagaatggctgtggtgtgaatcttggtgtggaaatgccacgaaggcaagagcaaagaccattgatctatgcaacaatccaatgacaaaggagccaaagcttcagggtgctagaagaatagttccggagtggactggtcttgacagtgaagcacgccagttcactgcacgaattttgggcgacgatgtcgagtctgcagaagccacacccccaccatctgagacaccaaagcccgaagataaagacactgatcaggaagtcaaagatgagctatgatcgcaagctgtttccctagcttgaccttactgacagaaagtttgatgccttggcagtcagcagttcaggacactggcacatagctagtggagtgcagagggatagtttaacgcaggtacctgtctacaatttgtcaaaaagactatacctggaatcctggaccacgttgattttgcgcctgaagtttttgccatcaaacatgcaacacaatttaggtattttgtttacaccaatagtttcaatacctttaacccaatcaaatgtggggacgctacgtcctgtatggctatcttgtcagaataggttagcaagtcagccagctggggtgaagaactcgtctgctctctgctgcatacacgaattcttt

SEQ ID NO: 476 - DNA, 1729 bp, Hordeum vulgare
actcactgagcttccttcctctctcgcaagaaccagacgcgcacctagccgccgctcatcttagctctccctcctctctcgcaagaacaagacgcgcgacgatgtgtgtctcacaaccaaatctctgcccaagtaagtaagatattgaagagatcctagctgccatgtgcgtggtcttccaagttcgaagacatggttcatgcatggcgttgtggttcctcgcaactggtaactcggtttgttccacaaattttctgaggttggattctttttttgtttagacctgggattttctgagattctgcgtgatgtgaatatgtgatcagtggagggatggttcgagtcccacacgaggcaaccagtgtctgttggattttcagtcggccagtaaggacaatgttttgagtcggctagaaatttaaccggctataaacgcaattttgtattggtgatggaagcagttcatcatctcttatgggaccattttcttcctcttcttaatattcttccaataatgttagacctacaaaggtttacttaaccttccaaactaattctctctcccccactgattttccgtcctcatccctctattatcaatcacattcttccacctcagtttgtttgtatgtaaaatctgtttgtagatgtagcattactcagattcttctaatcacgtcgaaactagtctagaaatgagttgttacctttgatttaatgcactggactgaactatctttgagcaatttagagatttgttcatcaggcctagctagctaatggaattatgtacccactggctagctgtggctgtgagggagttaatctgggattttaaaaaaggtagcaactaattaaaatttatgcaaggttaccacacagtcgaaaaaggaagtaagaatgaagaagagcacatgtgcattgtggaggacacaaaaatactgctgtttgtttctgataagcgagagcaaaggtgaaccttatataggctctaacattcagttagaaacatgtcacgttctgcaatcgtacgttgcaaggggatgtaatttcctcccttctctacctgagattctataaatagtgtacccggtgccacacaacaacacacggcgcacaaactcaaaccaaaacacacacatcacacaagctcgctgtaagatggctgctcgtaaggcgatggggctgctctttctgctgcttctttcgagcagccagctgatgatgctggcccaggccagcgatgatgacatcttgccatccgatgagctgagcctggaggttctagctcttctggaggacatcatgaagtccaagctgtgcccggctgcctgcgtctcctgcttagtgcaggtcgggaagacctgcccgctgacgatgacgctgtttgctccctgcgtcctcgggaaggtgatgtcccagggttgcttcggcaagcagtgaagccatgagtggcttgctagcactgtgtgcgggtgcttcaggaagcagtgaagccatgagtggcttgctagcactgtgtgcgggtgtgcatgttgttgtggtgccttcttttcgtttccttgtgtgtggtcggtccaggcttgtgtcgtgtgtgtgactagtttcttattcttccctcaatctcactctcttgtgtgtgcctgtgtggtttcgaggacccgatcctctcctgttgtgtgtttcagttgtctccacttaataaataccatcgatgattgtggtttct

SEQ ID NO: 477 - DNA, 629 bp, Hordeum vulgare
tggcgccgtcaggaggcggccccgagctcctcctccgccatgactggcccctggtgaggtcgtcgccatcaaactcgtcgccttccttcctacccgacagcaccaggagaacgcagtgaaccaggaggatccattcccgctgcaaatagccgtcgatcgcctctgcatccacgacgtccacgacggccttcttcctcctctgctccgacgagatcttccgcagagcctattcttcctcgtcgtcacctgcctcctccacgtcgatcctgctacctctcctcgacgcgtaggcaccgggatcggagagagagtacgtggattctggagagtacgtgcaggacgatcaagagcagttccaagctgaagacatcacaggtacatgaacgcctgatgcaggagatcgagacggcacgcagctggcgtgatagtaaaatgaggagaacgaccgtctgtacatgaactacccagaggactgaggccgtggtcgtgatcgtgggccagcatgcgggatatcatagtattttccttgttttatgtagcccgtagcgggactatcttgtctgaataattgtgtggatgtaaccctgatattatactatgtgagatggaaaatgtatgccctatttgtc

SEQ ID NO: 478 - DNA, 5695 bp, Sorghum bicolor
aaagtcgaccgcgctctggttttcttcctctcttcgcgtcggtgttgaaagcgcctcgcctatcccgtctcgcccttcgtcgcctcggcgcgtttgcgttttccatttcttcactctcttcctctcctcgtttcttcttctccggtttgatttgttccgctgctgttgcgcttccgtgctctcgcagattcccttgggggcgtttcgctttcgtgcggcgcgaggagagcgagagcctgagtttggttggcggggttgttcgggtttgcagcttattgttccgattcgtatagcttttgtgtcgatcctgtttcgtcttcgccttctcagcgtgtgggttgcaggattggatccgattgggtgttgggagttgcgtcctatggcgtcgtgtggcgaggagatggaggcaggtcagtcttctgtcagatccggcggttcattggttttgtcacttggacatggattcggtggtttcaggctcaactgtctctcggtgtgatacagtcagttgccatcctagcctacacacaaggtggatttggcatcagatacagatagtgcgcaaggtggattcgagaccttcggtccattcgagattttaacggctgatctcgcttgtggcctttttgggtgtttgtcctcctcttactttagatgcagatgcagaaggaagggtccctgctggttatggagagattagttgaagggtggaggtttgcttatggttccttcctcgttttctatttggtatatggctgttttgatgtcatcatggtggtggtgtgaagatcgccaccggactaactagaagcttgattgtccttcattggaaaaatgttgttagctggatctgcagaggcaagagaggtgatgttttgggcgttgactggactggagttggtagcatcgggagaagatcgtttggatatatctaactatcactcttctattgattcatcatcatactcttaaatttctgtccgctgctattcttatttttttatattggggctggtggttttctccagcaactcgattatatggatggatgggctggcggcgagtcagcaactcgattatatgaatggacgggttggaggagagttcgatccagtttggaactgtccagggttccctgtgtttgttcactaaccatcctctctccccagtcattcttctaaaattgacttccttcataggctccctttgatacttcgttagtaaatctgcagttttgggagacatcactatagagtttgtcctcctatatgcaaaaggaatggtccttggtggttatgtgagagcagttgaattcaagggtggaggtttgcttatgttcgttatttttgatttgttatatggctattctgatgtcaaccatggtggtgtgaagattgccaccggactaattagaagcttgattatccttaattcgtaaattgctgttagctggatctgcagaggcaaccgagggtgatgttttggaggtagattggagatttgattgatgattggactcatgagttcatagcatttggagagacggagaacatcgtttggatatatctacctttcgctctttcattggcgcgtttaaatttcttgtttcttatatttgtgctggtgcttttcttcagcaactggattatatggatggattggagcctgagtttgatttcgctcctgcatgagcaataagaagttctgaactgttcagggttccgttcaataacaatcctctcttgtcaatgttctttgaaaattgaattttcccgtaggctaccattaatgcttctatagtaaatctgacagttccgggagacatcgctacagagataggacttacagctgacattattggcgattgaccaggctttatcctaaacccacatttaatgaagtgttcttgctttttaagtgttctcatctcacaatcaaatagatagttacagaggatggtctcgctgattgcagatctctaggtgataacttgcacgggcacaaaaggaaccagtctctgcgtctattcaaacatacaaccttcaactctcattgtttgttcagtttcttcacctcaaagtagataatgatcggggtcattattgcaggtcttctgatattttttgcatgggcttgtcacatggaatatgtgttaggagtacttctaaccttatcaaatttacaaaattgtatatgaatcatgatacttctattgagttaaaaatcgggtatttctaatttaatctgcagtggtagaaggtactgagcatgtttgggacttgggagattcaagcagagatgggtagaagcacaactttcatttaataatcaacttatttctgctttatcatgaccgaagctttaattcttgtgctactggcatttctgtgtttcgcagatcattttagctcaagtaattggtagtccaacaatcataatgtttggtttgggatttctatctgtggatgctttgtctggctttatcaatgttttcgtgctcgcttttacatgtggttgcaggatgagtttggcaattggaaatccctgttgcaggatgagtctagatcattccggttattttagtttcgtcacttgttttcagtgatttcagatctgaatggtggctaacattctggctctccaaggatattttgctggtagtaatagtaaaagcaaggtttgagatcctggatttattaagcactgtatatagctcaacttggctgtggtatgtgttcgtgtcctttagagatgcaggaggacattggagttggattttcctcaatcggagataacaaattgggaaaaaattgtgactagacctcgcacttctcaacttctgtctatttggtttgcatagctttccattcgttctgatctgtagtcccttattatgtttccagcccacttaaactataaggatggcagggggatgcctaggagttattttgtgctgcaacagtctaaataacaagggggcttctaattcttcgtttctatcaagtcctatccagttacttccttgaaccagtaactctttgaagtttgtgcagatgcgacaaacagaagctgagatagaattttcaaccattggtgctgtctccaaagcccatccctgctccactggccatttgattcgccttggatttgaaggttttttaagcctatccctgaaccaaaatagacagaaatcatggatgagctctttggtaaatataggttttgcttacaattttgaagttcaatctgatcgtgatcataaaatgtgcctatctttcgaattctgctaccttcacttttgctaaccagtgagtttctggatagagtgcattaatgtcaagcttgattacttcgacttacctgctgttcagatgctttgcactagttagtaacctgcccagagtttgcgctaactactattctgactattgactgcacatcactttccagttaacttgattgatttggattggtggtggtttgcttggtttccagttatttgagagcgttaatgcttggatcttaggagtgatggggcacagccacaccttataatatttttcaattaaccagagtttacgcctaatactcttgctcataccggtcatttattttggatccacttatctgatataataagttgatggatgtttggttggattctcgcagttggagctaaagtgtggatggatggttagccattctgagttctagacgtttccacctatggagtcttccttccagtgataaataaacctttgcactaactttattttgaagctgtccttaacctacatgcctcatccaatggtgcaggttcactatttgcctcttgcttgacatccataccttcattgagcaaaattattcagattctaagaggatattttacctgagcatatgtggtcaccatattctttatggtcccagatttccaatttctccgtaggacccctactaatgtttaatctagttcctggtttgcttctggttttacttagtttggtataacccctactcgctcaatatatgtctttcattatcaagttcgtcttattgcacagttccttttaggttacttactaattatactcttgtttgagctctaatatctgaaatcaaagagagattgatcttatgtgacactgttatttaattttgttggttatcatgagaatgattgcctgggactaaccgaacacctcttttactgcatcctttatgccttcatctctattttgtgcagactcaagtctggtgtttgtgacattggccctccctttctttaactgtgttctgcaatttccccactttggacttccatctggtgcatcttatctgttgtggatcaaaaccaagaaagaatgttgctctgtgttcctgccaaaagaaaatctgtctgaacaaacttgtttggctgaacgattgttgcctcctgattatgccagcctatgtgcccgtctcggtgatgcaatgcaagcttctttgtactttgggatggaactggagtcttctgtttgcttgctgtttggtcatttctgttgtggactagcagtactgcttataaacatggattttcaatttcaaaagttcgggttgaagtttgagtcaatcagattattcagggtgttgcattgatattcagtgtttaaagtggaagatctttaggatttgactgtagcagtaaaaactcagtggaagtgggtttcttgaccttgagtgaacttgaatggttggttccatttgtgttatctgtacagtttggtgtttggtcaacttgaatgcaagctaggatgggattgtttctgtctgtgcaactctgtattgtcgccaacttaatatatgttctatagtggttgagtagttaggttaacttcacactaggatttgcatttggttttggttaggtggaaccaaactgcgtgccttgcaaaatggtccaggcaacataggcaatggcaatagtatattaaatattaaactctgaaatgtaccatgtccatgttgcataatctgcacttgttggagctgagaaatgaggatgctagaacgaagaatatcagtttatcaaactattaaccaatgattctaaaccatatttttttatacttcgattgctggttatcaattaatatttggacattgggaggaaacttggtactttagactcgagctggcacctgtgtttccctatcagttctcgtgaagcttcactgtggtcagatttttgtgatatatatgttggatatcttaactgtacaaaagactacatgagtttacactggctggtttttagctacgcccttcctgaaatttctatggtgttgcccttcccatggcatggtttgattggagtctgttcatggaatgatttttgttggagctggttattgtggcaattgagcatcttctgcctagtccaaattagctgaggactagttttattggacaagattaactgcatcttctgcctaggccaaggtagctaaattagctggagcactagttttattggacaaattaagtggaagcatgtgattgttttacgattggcacacaatgatgcaatatcccagatacctgctcacaacttcacatatatttgaactaggtttacttattattgattattgattgttctatcaaagttatagcctgcaaaagaatcccctgaatgttttattggaggcctaaa

SEQ ID NO: 479 - DNA, 954 bp, Sorghum bicolor
agcttctctcctctcggcctcgctcccgaccccgacctcgacgcccctcccgcaccgacgcgcctccgcccccgccttcccctcctcttcctccctctcccaccctcttcctctccctctccccgccgtcgcgacgtgctggctgggttccaccgcatccgcgtgagacacccccggcctgcggcgcggtgacgcgcctagccccataggtggtcctctccgggcagggcgcggcgcgcgcggcccccataggccgccgccgccgtgcctgcccctcagagttatctcctcccgaagatctccatgtcccacgctccaagaaaccctagcttcatctgctcgacggccgactgcgtcgtgaccttcccccggctatgtcgcgagcttccgccggcggcgcgtggactctttgtcggttgcagcggcggcacctcagctcggcgtccggatctgtaagtatattcccccaacatatcagaacttggaaggaaatgctccaatggacctatccgacgcagttcttatatctgaatgcaacccaaagcttgttatggaattgggtcacttctagatcggaatctaatttttctggaggcctcaactacatgctcggcctgcggctatctcaccagggtgcagtactaagatggcaggcaaagcaacttccccaattctccaggatatgcacaaaaggtagcctcccaaagtcccagttaggtagttaggcacaacacaatacataccgcgcatttggtttatagattttatcggacatgctttgttggtagttacatcagagttttcactttataagacatgtccaaatattaactgaaatttataaggtcgagttgtccacaaaatggtcaaaccatgtggatttgtaatttccgctatatgaatatcacattcaattgaatcttgttattccatatatgcacaaactgcaaagat

SEQ ID NO: 480 - DNA, 624 bp, Sorghum bicolor
agctcatttccaccccgcgccgctgctcccagcacgcacccaagcgctgccgccggccggggcatactccgacgacgcaggccacatcgaccttcgcccacaccgctagctccttcgcgttggagcctccaagccggcgtcgctgccacctcgcaccaaggcctcccatctctgatggctcccacacttcaggtccatagggacccgggacatgacgatggagcatgcatggcaatggccacagcaaggcacagcatatctatggaatctaagtttggacccgagaaggctagcactttgaacatgtatgctataatgaagtctggattcaaagaagtggacaattctcagccgtagaccacaaaaccatcttgtagtggacaatttagatctatataggtgctaggacttatgtacgttagctatgactgagatattctttccttttagcgtaatggttgaacattttttaatctgattggagtgtagttgttggacactttaatttgtaatatgtttcaactaaattagttgaatatatttatgtattggattttgattgtatttatgctggattgacatgtcatcattgtgtcaattgagtttagttaccagaatcttaaa

SEQ ID NO: 481 - protein, 547 aa, Hordeum vulgare
MEVASPLLPVQSKPDRSATAMEVARSLPPIQSKPDRSPPAMEVASSPSPLPLQSKPDRSAPAMKVASSPLRVPSKPHRSGPGMEVASSPSPVPVPSKPDRPAPAIEVQVLSSKLVRPAASTDAAVDAGLEYVPLSVFDRATYQIQMAIIYVFAPPAPSTAALEKGLAAALARYRGFAGQLGEAPGGGPAVLLNDHGARVVEAYVDADLVDVAPPMPKPEPLLLHPNLEEGMDEVVVLQLTRFRCGSLAMGFTSSHAVADGRGTSNFLVAWGRATRGVDMGLPPVYNHDELFKSRSLPRVEFDHRNREYYMPVPPLPTNVDVHAKIKKNIVIHKAHFTKDRIARVRASASEGRGRPFSRFQSILAHLWRATTRARGLRHNETSKIRLSVDGRDRLGVPAEYAGNLVLWAFPQATAGDLLNRPLKYAAQTIHDEVARVADAEYFRSFVDFTSSGVIEEEGLAPSAALNLREVLCPDLEVHSWLTFPFYDLDFGTGTPSYIMPSYFPFEGLIFLMPSYIGDGSVDAFVPVFQHNLEAFKQCVYSIDDLHA

SEQ ID NO: 482 - protein, 654 aa, Arabidopsis thaliana
MSNSTPCITPFPVTKTAVAAPATVVEGVNDANSTPISPFPVTKTAVAAPATVVEGVNDASRKRERPKTYRDYRGRFITASGTFTPRSSLRKRRGDMSMRLGGGDFTPHSFTVNKGEDIIKRIMSFTANGSRGISVLSVNGAVANVTILPHGSSRRVMTFKEEYEIVSLTNNTMAISESGGVKNKTGGWRITIGGAAGGRVHGGALAGSLIAASPVQVVIGSFWPLITNPRQKRKYVSKARVAPSITPNLVASSSTGPVQQPEMVGPSHSQKRNSESNRTMVVLSATPPNTLASSSTGQVQQPEMVGLSHSQKRNNESNRIMVVLSATPPNTLAFSSTGPVQQPEMVGPSHSQKRNNESNRTMVVLSATPPNTLASSSTGPVQQPEMVGPSHSQKRNSESNRTMVVLSATQQNKLASSSTGQVQEPDMIGPYHSRQRNDESNDVILLPTVQYLLASSFTGQVQRQPEMTDPSHSQKRNDESQDAVVPPVIPNLLASSFTGQVQRQAEMTGPSHSQKRNNESQAAVVTPEIPNLLASSFTRQVQRQAEMTGPSHSQKRNDESQAVVVPPAIPNLLASSFTGQVQRQAEMTCPSHSQKRNDESQAVVVPPAIPNLLASSFTGPEMIGPSHSEEMNDEFNPSQFLTLGWYSSTPEQDK

SEQ ID NO: 483 - protein, 449 aa, Arabidopsis thaliana
MFSLKSLISSPFTQSTTHGLFTNPITRPVNPLPRTVSFTVTASMIPKRSSANMIPKNPPARQQLYQPFRPPSSPIPTQFRSLDSAGKIEILAGRMALWFEYAPLISSLYTDGFTPPTIEELTGISSIEQNRLIVGAQVRDSILQSIHEPELISAFDTGGAELLYEIRLLSTTQRVAAATFIIDRNIDSKGAQDLARAIKDYPNRRGDVGWLDFDYNLPGDCLSFLYYRQSRENKNPSDQRTSMLLQALGVAESEKAKNRLNTELYGDKEAEKEKEKKKKEEEVKAIRIPVVRLKFGEVAEATSVVVLPVCKAEEGEKKILEAPMEIIAGGDFKVVEAEKGWKRWVVLPSWNPVAAIGKGGVAVSFRDDRKVLPWDGKEEPLLVVADRVRNVVEADDGYYLVVAENGLKLEKGSDLKAREVKESLGMVVLVVRPPREDDDDWQTSHQNWD

SEQ ID NO: 484 - protein, 316 aa, Arabidopsis thaliana
MSVSDEEDECFARFLESEVSSVEDKEETKEPEAKRQRIEKGETKALEKDEDQKENGNKDKTDAKRIESGVFTNVPTELFRHILKFLSSEDLVSCSLVCKFLNFAAADESLWRRLYCIRWGLTLPSRKLRESAWKKLYIDRDEQDMIELVRTCPSDFKEYYVHMQAAKRSQAPLPSQMVDDRIILDNTVLEQVSLWKKSKGLTDKAVTGHICLGTKCSYHQIDDVFICKETGNVHVCDDNCKEVILSPEGDLMVCTISGVCSDTLLVQTEPDADGCYEEEAELEAEVFTDKSRLARAFELGYNCDDEQELERTLRFC

SEQ ID NO: 485 - protein, 91 aa, Hordeum vulgare
MAMRKEPLLLVAMMLALVVAARAAPCEVGQLTVCMPAITTGAKPSGACCANLGAQQGCFCQYAKDPALGRYITSPHARDTLLSCGLAVPRC

SEQ ID NO: 486 - protein, 152 aa, Hordeum vulgare
MAASVREASMRILRPAGEGLRRLIHAPQHSGSISVFGEGYRATQIQQSKEDLYNLIADAQANSAASQEDKMVLKTLCTHVKPRPHDPQWRRITTAKKVTKWTATSIVLATCAIAFPALANRPDYRVTTACEQKTVEQCRLPESVAQQGAQKL

SEQ ID NO: 487 - protein, 114 aa, Hordeum vulgare
MSKWEPVTFEESLSFVKRVKARDYLLYLSLLNVLTRSDQIPLEAYNELLLLFRDHGDLLEELGKFRPLPNFPSTVYRHSSIWMFIFLMPFLLLSLLLAFEKPLDRFLLRQPVAS

SEQ ID NO: 488 - protein, 156 aa, Hordeum vulgare
MASSTCSDDKVAPLVQKHAPAGNPEALTTTKKKKKKVLIAVPEYDVRSVLAYKDEPVDLEVPDYLIRENPKRAAVMFMIKANLAMYNEHTKARMLEEQRDFKHQLKTKGRVTYELEVDEDDPRFKDECTTSSAGAGRRRHRPGVMKKQDGQIKRLN

SEQ ID NO: 489 - protein, 174 aa, Hordeum vulgare
RHEGEVVSVNPVYMNAGTPSPTGFVMNMQPSEAEVGFDLRLPPTEDIEQIERRIKEEWAPAHKNLTYQLMKKGPVRDVTGRPLLTPANASNPWWSVFEQAIISSGGKLAKPEILSSTTDARFVRQMGVPALGFSPMINTPILLHDHNEFLEDKVFLRGIEVYQHLIRALSSFKG

SEQ ID NO: 490 - protein, 285 aa, Hordeum vulgare
MVYGGEEALMRQYSIGDEIGRSRFGTVRRCHSNATGEALALKTTPKAPLRDPLDLALAEQEPKLHLLASSPPCSPHLVALHAAFDDANAVHLVVDLCAGGDLLSLVSARGGRLPEREAVGLAAQLASALAACHRRGVAHRDVKPDNLLFDAATSVLKLADFGSAEWFGDGRPMSGLVGTPYYVAPEVVAWREYGEKVDVWSAGVVLYMMLSGAVPFYGATAPEIFEAVLRGNLRFPPRAFAGVSPEAKDLMRRMLCKDVSRRFSTEQVLKASRGIASCGGDAVAG

SEQ ID NO: 491 - protein, 388 aa, Hordeum vulgare
MADGRDLGDVAAAEPDPDEGQPDLEEEGELEAAGGGGGGEEEEDVDVDGLASFLEFEILSGSSEEDPLDLEEGEEEKETGVNDEAKNGKRKQDSLSEGDGSGSGSGSEDEHQKRARKEKGKGKVLTEGPPQIDTGMFTNVPPELFLQIFKFLSSEDLISCALVCRFMNAAASDETLWRRLYCMRWGLSSNATSNAKLRECAWKSLYIQQDREDMVEFVRYTPTEFKEYYIQMQAAKRSQAPLPSEVNDDKIVLDKTVADQVSSWKSRRGLTDDAVKGHSCSGSTCFYKQIGDAYICEKTGRVHVCDDACREFVLDQTSGLLVCTISGHCFERFLCPDDEWDTCDTDQQQGGVTDEAEPFMGSGRFARAYQLGYSCADEKELEYALRFC

SEQ ID NO: 492 - protein, 222 aa, Hordeum vulgare
NKENPSFVKDRFPFSKFFTDTPQPVFTGESFEKDMHAANGCFKHLSTIFQELEECRAFELLKSTAERANYLMTKQAKIVAMTCTHAALKRRDFLQLGFKYDNLLMEESAQILEIETFIPTLLQRQEDGYARLKRCILIGDHHQLPPVVKNMAFQKYSHMDQSLFTRFVRLGVPYIELNAQGRARPSIAQLYNWRYRELGDLPYVHEEAIFHKANSGFSYEYQ

SEQ ID NO: 493 - protein, 198 aa, Hordeum vulgare
MQDCYLALTGPTRAIAVSVDPSYIEVSLKVKGTTEAEDTDLSDLVLMYRTGCCPGSVFPSRLSTLEIEFRHINRSVEATVHIKVIGGSWPDGFHGEFSAGISSSDDLQVKLLDFEDGGLPVNADGEIKLSRRVVSVGVESNLKVSVRARPINKDHAAESSEAVLKCQRAGTSPSGIKLSVGSCNMEVSVAWSCFRRAW

SEQ ID NO: 494 - protein, 333 aa, Hordeum vulgare
MTGVGGDAKKSLTQWLGDKGFDEEAIGRMSKRCRNLPNLDAGEASGVWDYLLNDVKIEQRKLRYVVTKCPKVLTMSVNEKLIPTVQCLTTLQAKPGEIAQAIIKFPPILFHSVEEKLCPLLAFFQTLSISEKQLAKLLMVNPRLISYSIQAKFSQTVDFLVGLGIDREGMIGKILTKEPYIMGYSIDKRLRPTAEFLKSAVGLQGSYLQRVIMNFPSILSRDVDKTLRPNFVFLQSAGFSKDQIMKLVAGYPPVLIKSIKHCLEPRVKFLVEEMGRDKGEVVDYPQFFHHGLKRSLEYRHKILKRMNSTCSLSEMLDCNQKKFAMKFGLIPVA

SEQ ID NO: 495 - protein, 516 aa, Hordeum vulgare
MPKGDDALARKRGKVRRKRMRSSENAVSTRVAAIIASKRRRKTGKRRGCEGMCFSLPCPEDPFNERHGKKRRTEDAADTNDDHEKKKSKDSKKRPLERATGSNAIPVRKKETEEDRVEYDRPSKFLVVCLNAIRDGAVASEEDGGGIHDSASWGMELWKSCAASPPSDVLDTSHRYATRQQTAWLVSTACDIVARKEKLGVVVSCPFLLYLVPSQEKAVQVRSMCKPLKSLGIHSVSLHPGASIEHQISGLKSCEPEFLISTPERLLELVSLKAIDISNVSMLVIDGLKGFMDLNIIKELRSIRGTISGDAQVTIFSGQCDQSAATVARNLLHGRITKLTTNDSVASRSAFVTQHVHFCTKEEKTSKVKEILEHVLENHASKTAKVLLVAANDNVAQKLSSSLKLEILTVNDGSQGSTFTVCSSMGLINVLVKGCESLATSGVEEFEIVLVADLPPSFDDYVEILTRTARHTVAGEVHVIFSKTDATHAKPLADVLANSGQAVPKLLRQLMDKNHS

SEQ ID NO: 496 - protein, 885 aa, Hordeum vulgare
MASPTLPVTLTCLTLLALLSLAMAADNNNSTGLILVNCGASDQEDDDSGRTWGEDTGSKFAPSLKGVAANAQRQDSSLPSTVPFMTARIFTSNYTYSFPVTPGRMFLRLYFYPTDYPNFAASDSSFSVSVSTPNLVLLDGFNASQTVQAISSAFLVREFSVNVSSGSTLDLTFAPSAHQNGSYAFVNGIEIVPTPDIFTAPDTRTVGDDTSPYTFDTAMAVQTMYRLNVGGQTISPKGDSGFYRSWTNDAPYIAGGSGVTFSKDDNLTITYTSKVPKYTAPADVYGSARSMGTTAQVNLNYNLTWILPVDAGFSYLLRFHFCEIQYPITKINQRSFFIYINNQTAQEQMDVIVWSGGIGRTTYTDYVTMAVGAGQVDMWIALHPDLSSKPEYFDAILNGLEVLKLQNNGSPNNLSGLNPPLPQRPPDAIPSAPSAGGKSVGAIVGAAVGGFAVLLVACFGVCIICKRKNNKKKKISKEPGGKSEDGHWTPLTEYSGSRSTMSGNTATTGSTLPSNLCRHFTFAELQTATKNFDQAFLLGKGGFGNVYLGEVDSGTKVAIKRCNPMSEQGVHEFQTEIEMLSQLRHRHLVSLIGYCEDKSEMILVYDYMAHGTLREHLYSTKNPPLSWKKRLEICIGAARGLYYLHTGVKHTIIHRDVKTTNILLDDKWVAKVSDFGLSKTGPNMDATHVSTVVKGSFGYLDPEYFRRQQLSEKSDVYSFGVVLFEVLCARPALSPSLPKEQISLADWALRCQKQGVLGQIIDPMLQGRIAPQCFVKFTETAEKCVADRSVDRPSMGDVLWNLEFALQLQESDEDTSSLTDGMLSSSGASPLVMTRLQSDEPSTDASTTTTSTTTMSMTGRSIASVDSDGLTPSTVFSQLMRPGGR

SEQ ID NO: 497 - protein, 135 aa, Hordeum vulgare
MKTSCFLVVLLLAVATGSRLSLAAREDGTLGGELIAKAGNFLTSAGRPGADGWHSAAAAEVDASAKKAHGHPAGARKRLKKASVSCIPADMCRRKKVLCGKRCYKTAHAAAAAGGLTHVPSNRCVVRCKKCVPTC

SEQ ID NO: 498 - protein, 457 aa, Hordeum vulgare
MAHGLGILLLLLASSFAGSAFAADATVLSRKAGAGAIAGEDPELKAAPGKYAVIFDAGSTGTRVHVFRFDKKMELVDVGDDIEVFAKVEPGLSSYAGRPQEAAKSITPLLEKAKSAVPRWLMKKTPVKLGATAGLRLIGDDKAEQILEAVRDAVHSKTKFQYNPSWINVLKGSQEGSYLWVALNYLLGKLGGDYSKTVAVIDLGGGSVQMAYAISANAAAAAPTVPQGEDPYVTKEYLKGKDYNVYVHSYLHYGAQASRVEIFKAKNGPVSYCVLRGYDGKYTYNGEQYDAIAAPQGAAYEKCREDVTRALRISAPCAAKNCTFNGAWNGGGGPGQAELYVTSSFYYMAADVGLIDSEASSGKTTPAAFRAAAEEICPMSFLEAKAAYPKVRSVDAPYICMDLVYQYSLLVDGFGLEPTKEITVAQKVKHGEYFIEAAWPLGEAIEAVSPTKRLNDA

SEQ ID NO: 499 - protein, 631 aa, Hordeum vulgare
MPPAACATPAAARPPLPVSRRCPPPPPSAAHVPAARRPSSATACRCTAGSSSSPTAAAASAWDWTRWSRHFAEVDQAESYASVLRFQLEEAVEGEDFAEAAALKRALLDATAGDAVSRVMAELKSAIEEQRYQDASRLTKLAGTSLVGWWVGYAKDTDDSIGRIVRITPGVGRYVAKSYSPRQLITASSGSPLFEIFLVRDEDETYTMKVVHLRPTKGASSASSSVPSTATEDPAKAETESSPDSSVLSEAIAEEANTDTKLKGNEDVEEKAQDTGRTKESGVEGLKSVLNFFKSRIPEFKVQVINVEVPEEAELVADSSEELVQDDVKSTSESSLEEPVAEEFQEEDVSDGDSDSNDESKGPEVKLFISGVVHNKEEAGAKSYVRVPAEINNLERDSFELYIPGKGSDRDLSETKAAKQKVADMAAKLASELMPSDVAKALWGTTKSSSKINKEVQELLKLTLSKARVKLTENTIFNRIVTDSNGSDPFNGLYVGAFSPYGPEVVQLRRKFGHWNSTDDVEFFEYVEAVKLTGDLSVPAGQVTFRAKVAKGSRLENRGAYPEEFGVTASYKGQGRIAQPGFKNPRWVDGELLVLNGKSAIPHIGGAELGFLYSVPEQSFLVLFDRLTLPE

SEQ ID NO: 500 - protein, 958 aa, Hordeum vulgare
MADKEAGNLEAVLKEVVDLENIPLEEVLDNLRCSREGLTAEQAQQRLQIFGPNKLEEKEESKFLKFLGFMWNPLSWVMEAAAIMAIALANGGGKPPDWQDFVGIITLLVINSTISFIEENNAGNAAAALMARLASKAKILRDGRWTEEDAAILVPGDVISIKLGDIIPADARLLEGDPLKIDQSALTGESLPATKGPGDGIYSGSTVKQGEIEAVVIAAGVHTFFGKAAHLVDSTNQVGHFQKVLTAIGNFCICSIAVGMFIEIIVMYPIQHRAYRPGIDNLLVLLIGGIPIAMPTVLSVTMAIGSHRLSQQGAITKRMTAIEEMAGMDVLCSDKTGTLTLNKLTVDKSLVEVFERGITQDQVILMAARASRTENQDAIDTAIVGMLADPKEARAGIQEVHFLPFNPTDKRTALTYIDADGKMHRVSKGAPEQILHLAHNTSEIERRVHAVIDKFAERGLRSLAVAYQEVPDGRKESPGGPWHFAGLMPLFDPPRHDSAETIRRALNLGVNVKMITGDQLAIGKETGRRLGMGTNMYPSSALLGQKNSDESISALPVDDLIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWNFDFPPFMVLIIAILNDGTIMTISKDRVKPSPLPDSWKLAEIFTTGVILGGYLAIMTVIFFWAAYKTNFFPRLFHVESLEKTAQDDFQKLASAIYLQVSTISQALIFVTRSRSWSFAERPGFLLVFAFFVAQLIATLIAVYADWKFAAIKGIGWGWAGVVWLYNIITYFPLDIIKFLIRYTLSGKAWDLVIDQRIAFTRKKDFGKEERELKWAHAQRTLHGLQPPDAKMFSDKGGYNELNHMAEEAKRRAEIARLRELHTLKGHVESVVKLKGLDIETIQQSYTV

SEQ ID NO: 501 - protein, 347 aa, Hordeum vulgare
MFGFGHHGHHGQNPPAHAPPAAGGNQPTFKIFCKADEGYCLSVRDGNVVLAPSNPRDEHQHWFKDMRFSTQIKDEEGNPAFAIVNKATGLAVKHSLGQSHPVKLVPFNPEFLDESVMWTESGDVGKGFRCIRMVNNIRLNFDALNGDKDHGGVHDGTTVVLWEWAKGDNQSWKILPWGEEAYAGGSANAPRGGSSEPTVRIFCKADEGFSATVRNGTVVLAPSNPRDEYQHWFKDMRHSNRIKDEEGYPAFALINKVTGEALKHSQGEGHPVKLVPYNPNYQDESVLWTESRDVGAGFRCIRMVNNIYLNFDALHGDKEHGGVRDGTSLVLWKWCEGDNQRWKILPW

SEQ ID NO: 502 - protein, 489 aa, Hordeum vulgare
MTEDVQMGEPQSAPPPAAAAAPAPSTLQHLKEIAAVIEAGSLSKEVRRISRAVRLTVALRRRLAARDVSAFLAFALPASSDAYARLTPLLPKEDEAEMDVDAAAPPTQISIKHGLPEIEIYCSLLVLIFLIDQKKYDEAKSCATGSIARLKNLNRRTVDVLASRLYFYYSYVYELTNTLAEIRGNLLGLHRMATLHHDELGQETLLNLLLRNYLHYNLYDQAEKLRSKAPRFEAHSNQQFCRYLFYLGKIRTIQLEYTDAKESLLQAARKAPAAARGFRIQCNKWAIIVRLLLGEIPERTVFMQKGMKEALTPYFELTNAVRIGDLELFRAVADKFASTFSADRTHNLIVRLRHNVIRTGLRNISISYSRISLADIAKKLRLDTGNPVADAECIVAKAIRDGAIDATIDHANGWMVSKETGDVYSTNEPQAAFNSRIAFCLNMHNEAVKAMRFPPNSHKEKESAEKRRERLQQEEELAKHMAEEDDDDF

SEQ ID NO: 503 - protein, 283 aa, Hordeum vulgare
MAAAIDLSGEDLVRALEPFIREASAPPPLHSHPSPTSPFSFPHAAYSGYPYGVQAQAQTELSPAQMHYIQARLHLQRQTGQPGHLGPRPQPMKPASAAAATPPRPQKLYRGVRQRHWGKWVAEIRLPRNRTRLWLGTFDTAEEAALAYDQAAYRLRGDAARLNFPDNAASRGPLHASVDAKLQTLCQNITASKNAKKSASVSASTAAATSSTPTSNCSSPSSDEASSSLESAESSPSPTTTAAEVPEMQQLDFSEAPWDEAAGFALTKYPSYEIDWDSLLATN

SEQ ID NO: 504 - protein, 69 aa, Hordeum vulgare
MASLKAVKPTGLEGQAKEPTKVSATKGPAKLSNTATKPAAAKGGIKKAESKPREPKKRVKSTKPAAAKN

SEQ ID NO: 505 - protein, 608 aa, Hordeum vulgare
MATGQIFPKTTQALFYNYKQLPIQRMLDFDFLCGRETPSVAGIINPGSDGFQKLFFGQEEIAIPVHPTIEAACNAHPTADVFINFASFRSAAASSMSALKQPTMRVVAIIAEGVPESDAKQLISYARANNKVIIGPATVGGVQAGAFKIGDTAGTIDNIIQCKLYRPGSVGFVSKSGGMSNELYNTIARVTDGIYEGIAIGGDVFPGSTLSDHILRFNNIPQVKMMVVLGELGGSDEYSLVEALKQGKVQKPVVAWVSGTCARLFKSEVQFGHAGAKSGGELESAQAKNQALRDAGAVVPTSFEALESVIKETFEKLVEEGNIPPVPEVTPPPIPEDLNTAIKSGKVRAPTHIISTISDDRGEEPCYAGVPMSTIIERGYGVGDVISLLWFKRSLPRYCTQFIEICVMLCADHGPCVSGAHNSIVTARAGKDLVSSLVSGLLTIGPRFGGAIDDAARYFKDAYDRGLTPYEFVEGMKKKGIRVPGIGHRIKSRDNRDKRVQLLQKYAHAHFPSVKYMEYAVQVETYTLSKANNLVMNVDGAIGSLFLDLLSGSGMFSKQEIDEIVEIGYLNGLFVLARSIGLIGHTFDQKRLKQPLYRHPWEDVLYTK

SEQ ID NO: 506 - protein, 384 aa, Hordeum vulgare
MAAAASSSSPPAAITCRAAVAWGPGQALVMEDVEVAPPGPMEIRVKVVSTSICRSDVTQWQSTAQPDLFPRIFGHEASGVVESVGEGVTEFQAGDHALTVFIGECMSCKHCVSGKSNMCQRLGLERKGVMHSDQTTRFSIGGKPVYHYCAVSSFSEYAVVHSGCAVKVSPAMPMDRICLLSCGASAGLGAAWNVADVSKGSSVVIFGLGTVGLSVAQGAKLRGASKIIGVDTNPDKQEKGKAFGVTDFINPAELNEPVQQVVKRLTDGGADYSFECVGDTGVVSTALQSCSDGWGLTVTLGVPKAKPEVSAHYGLLLSGRTLKGSLFGGWRPKSDTPLLVEKYTHKEIQIDDLVTHDMPFSDINKALELMLENRCLRCVIHMAK

SEQ ID NO: 507 - protein, 174 aa, Hordeum vulgare
MAPAVMASSATTVAPFQGLKSTTGLPVSRRSSASLGSVSNGGRIRCMQVWPIEGIKKFETLSYLPPLTTEALLKQVDYLIRSKWVPCLEFSKVGFVFREHNSSPGYYDGRYWTMWKLPMFGCTDATQVLNEVEEVKKEYPDAYVRIIGFDNLRQVQCVSFIAFRPPGCEESGKA

SEQ ID NO: 508 - protein, 153 aa, Hordeum vulgare
MAVEEITEGVRGLKVEDGEGAAAPPAAAAGGGGGDGPRRGANGSSNRIQVSNTKKPLFFYVNLAKRYMQQHGDVELSALGMAIATVVTVAEILKNNGLAVEKKIRTSTVEINDESRGRPFQKAKIEIELGKSEKFDELMASAAADAEEGEEEA

SEQ ID NO: 509 - protein, 243 aa, Hordeum vulgare
VSVYKPRSYEVLVSDAARSLAAAIDDGRTRLEIEFPPLPSSISSYKGSSDEFIDANVQLALAVVRDLKKLKGTRSCIVFPDQPEKRRAAQIFKTAIDQIEGISIGSLDDLPTGPVDTFFKSIRITLDFDFSDDNEDRWKSDEPPQLYIFINSSTRDLASIEKYVDQFAASVPAVLFNLELDTLRSDLGLLGFPPKDLHYRFLSQFTPVFYIRQRDYSKDNAVTPYIVNYSGAVFRHTQGAGKS

SEQ ID NO: 510 - protein, 93 aa, Hordeum vulgare
MAASVACAFFFDAEPVGEPGNHALDACALCTKPLARDSDVFMYRGDTPFCSEECRHEQMHLDAVSARQAARRQQRFSAGAESGCARRGVSVGS

SEQ ID NO: 511 - protein, 124 aa, Hordeum vulgare
MAVTSLQLPSPIHWLTPARNGCTRTRPRATLVSCKHNQSTIVQEASRTSRRGTVAYISSALFAMFMVAERAEARTSKQENKRKVMEKLEKIREEALGSKEKKENTSKESVANLLIPPTLVDAYI

SEQ ID NO: 512 - protein, 285 aa, Hordeum vulgare
MSSSLFLCSYQVRYASLPAPLRQPGRHADRLPPAAPAFVSRSLHRPPPLHWTGSGVRMISSCFVVKRRRRRNGIHASLFGVGAPEALVIGVVALLVFGPKGLAEAARSLGKTLRAFQPTIRELQDVSRDFKNTLEREIGLDEDPPSMSYRPPPSMNNSQQPAVDPDVKPETTVPYTSEELMKVTEEQLAASAIAAWNAQQPASSEQQEAAAAAITPSQSSDLALSGGGSDGPGAVTEESNSEAAAATTPSQSSDSTLSGGNDGPGAVTEESNSGNTENAKLRDEA

SEQ ID NO: 513 - protein, 98 aa, Hordeum vulgare
MAEPRRRRAPRTQVAALLIVLLAAASLLQAGDAASGFCAGKCAVRCGRSRARGACIKYCGLCCEECACVPTGRSGSRDECPCYRDMLTAGPRKRPKCP

SEQ ID NO: 514 - protein, 306 aa, Hordeum vulgare
MLSLLPPARLRAAPSDVPVTAPRRQAVILPGLGNNTGDYARLGAALRDGHGVPSVVARVSRPDWLRNAAGLADPSYWRGTLRPRPVLDWYLNRVEEAVSEARELGSPDGKLSLIGHSAGGWLARVYMEEFGTSDISLLLTLGTPHLPPPKGVSGVIDQTRGLLNYVEKNCAPAVYTPELRYVCIAGRYIQGAPLTGSSLAATTDELVAVDAPSEVAEAVMVSADNKTAPTGPTFRARFVGQGYKQVCGRADVWGDGVVPEVSAHLEGALNISFDGVYHSPVGSDDEERPWYGSPAILEQWVHHLLS

SEQ ID NO: 515 - protein, 414 aa, Hordeum vulgare
MGCGLSTPDNEGGGTRRKQGSVGDVVVFLPGLRTPTGVDLSQPLAGRLEKGAVERLSALRARVVDMTMQESASALKPRRKAAARHGSSTANLLQALEDYLPLLLGLVRDGGELRNSVEFVWTNQEDKAEETAMADAWYEVLSVLHLMAMVCLLQANSLLLPRAYGDGYGPRVSEESRRATVDVFLKASGYLDCAIRQVLPQIPTELRRQLPVDLAEGNLKALSLQALGQGVDMQLGLAIDSPKATLAVKRRLACEMVKYWHQVQESIPDLPVSDGWGKKHLLFVKWKYVEAKSAAYYFHGLILDEGNSEKSHGMAIAALEASEEFLKESKRASEAFHATPPTSRSPTPFGTAKYLFDKIPKEASSKVRINQDLYTPERIIGAPPPLPDFSLALTPEDYDLPPLDPLWNKEDGHQ

SEQ ID NO: 516 - protein, 303 aa, Hordeum vulgare
MQQQQQTARRRRSPGGGEWEGAGTVDEASMERSKSFVKALQELKNLRPQLYSASEYCEKSYLNTHQKQMVLDNLKDYAVRAVVNAVDHLGTVAYKLTDLFEQQASEISTFELKLARLNQQVFTCQVYVDKEGSRQQQMMGASMKHHKHYILPSTGYKRTQAVVHLGTDTNQESQPRPYPSAKTLSWHLASDNSPSADGANKPTFILDDTISSKPASDGLHLLGKELPGSPMRRPLQLNRNTKPDVIQKAGTKDQTGVKHMSTFSSFDRPTGREIQKAPANTKSVLASLFMKHKSAKMKSISAR

SEQ ID NO: 517 - protein, 268 aa, Hordeum vulgare
MRPTAAATGPSFFLPRCQSVPAPASSRAAGVAAAADPCKPPNKAIRSWRAASAGSNGGDERGQSVSTVATTPSGRRARLSARRRESIRLLDALPDQGGIGEFLRHPAGVESLLNTRALQSFAPVESESDGTFRCTLHPMGFLGFQVAPVLDLRVTPTRDDCTVEMLSCRFEGSDSIEQQNELFSAVMTNRITWGDNGDEEPCLDIDVNLEVTLEVYTKPFSLLPLSAVEKPGNLLMQGLLDRLVPMLGEQLLRDYHSWVQQQTQSSSS

SEQ ID NO: 518 - protein, 166 aa, Hordeum vulgare
MASYRLLVILVFSAPLLDAAAADTSYQADCPYPCLLPPPTPPASTADCPPPPSAPSGSGYGYPPPSSSGNAPPSPSYWNNPPPSGGYIPGYYQPPSGGGGGRGGGGGGGGGNYGPAPPPPNPILPWYPWYYRSPPSSSAVATTGSAWAAVLCLVAAVTAAAALVGY

SEQ ID NO: 519 - protein, 487 aa, Hordeum vulgare
MPAMASLPPPAPAPAASRRRRFSTASASLRRAASGGGSSWRGERRLMSELERTVTAGAAERVIRGYVGTKSERAVLAALSRLLMDSDPLAVPFYEAVTQARWFKWSSIHAAAVTALLEANGSADESRSLIADSAGRRESTAELALFYCDLMAAFSSRGLKRRAMDFYAQLRAMPTPLAGGGKTYMAMIKSLCMLGLAAEAEEALREMVALGYQPDAFQFGLVAKCYGKAGQLAEMERVIASMSDAGIRLGTGAANIVLSCYSACREHGKMLAWLKKMRKLRVAPTTKAYNFVLNSCPTVVSMARELGPSLPLSAAQLVRKLKSASPWPAEAEVVQELLAASSVLNKAMVWSETEVKLNLHGFSITSAYVLMLQWVDAVRGGRALPLEVSVVCGVGKHSDVRGEPKVRELAQEVLSRMGSPLRLSARNKGRLVAKRDRVKQWLATEWTSVVPEESTDQPPYASDQQPFLPNLLRKLGQFFSSFVAVSR

SEQ ID NO: 520 - protein, 114 aa, Hordeum vulgare
MAATALRTICKRIGGRAIRPSPSTSRLFHSTRKEELYCLMSENRARIENQKGPIKHLSSHVERKPEDPVWRFYRRAKWYHLVIMYSPTILYVCMSVCGVPDGKKEMTPAEKEDG

SEQ ID NO: 521 - protein, 341 aa, Hordeum vulgare
MATQWFSNMVMDEPSFFHQWQTDATLEQYTEQQIAVAFGQGEMEAALMQQQYAAAAVGEHRPRKAAKVNTSWDSCVTEQGSPADSSSPTILSFGGHADAFAKAPQAGSAAAYYGAASAPVAPVKPKQEVDAAAVVAPFQQVKRSYDAMVAEPARAPSRPAAQNQEHILAERKRREKLSERFIALSKIVPGLKKMDKASVLGDAIKYVKTLQEQVKGMEEVARRRPVESAVLVKKSQLAADEDDGSSCDENFEGADAGLPEIEARMSDRTVLVKIHCENRRGVLVAALSELESMDLTIMNTNVLPFTTSSIDITIMATAGEHFSLSVKDIVRKLHQAFKSSP

SEQ ID NO: 522 - protein, 561 aa, Brachypodium distachyon
MRRAQQQQQHQGASAPGVVRVDQASPASTFRQLDDAFLQKQTKIWLGEVLHVRFDEDILVADLLGDGELLFQVSKVIWKRLLRKNKEQLKQSKVYIYERTSFGKSNGKYTPYPKVDSFLKICQILGLAGIDLFTPSDVVEKRNVRKVCMCIRSLSKKAGMMHLNVPDFDVVTHTIAMPNYMVGVIRRSLEQPRCSSSCSSGYSPHANSESIFGQNDQQGDTHYDSDEAESSLYVLEPQENVGEDNLSERLQIGNAPKEQREGYGDSGHGKLEEKSVAEPVGSLDFGVMDADSADSAPFHDNQLCCSTHSSTDQCSRTRTTKCSMSSEESDSISSYLAFDSSKNDLDAPKVKVSERIHDEHDEPSHSSIQGNGKIFVDHPKKEGDDLLKDTSAMDQHCDAFICDRESVSSSSEEPRFGLNGESYSGLTPRNSTGGQLPAVSEDTTASRGLKHEISTKDHIDASRSEDELAKPLDTAEHNNGNAQRNEDDPPKSGKGVLKSVAGGITLVGAVFFIAHLRRSKGRIFTAILPPLSEKSIQSDSRTTNVDKRKAAELYPGGWLKV

SEQ ID NO: 523 - protein, 413 aa, Brachypodium distachyon
MDARRRLCLVAAVLLAAAAAAEGYNITKILGEHPEYSQFNKLLTQTRLAADINKRRTITVLVVANGDMGALAAGRTLQTIRHILQMHVLVDYYGAKKLHQLAHGVTASSSMFQESGAAPGMSGYVNITQHRGGHVTFTAEDASDSASPVSFVKSVKEIPYDLSVLQISKVLSSPEAEAPVAAPAPVNITELLSKKYCKSFAGLLAADADAFSTVNATKDNGLTLFCPVDAAVASFMPKYKNLTAKAKTAILLYHAVPDYYSLQLLTSNSGKVSTLATSSVAKKDYSFDVSKDGETAALDTKVITASVTATVKDDDPLAVYAVSKFLQPKELFKVAKDLAPAPAPEGPKKKSSKKKPSAASSPSDDDDDSAADSPDDDSGSDVDAADKAGAAPPMLARWVTAAAATVAALALAT

SEQ ID NO: 524 - protein, 556 aa, Brachypodium distachyon
MARSTTARWLLLLALVAAYHGGGASVRAAVGAGAHWLGGLSQASFPKGFVFGTATSAYQVEGMAFSDGRGPSVWDAFAHTPGAPKAPIAIAAYYAYHFCCAYCLRESGRFSDKEILWGIKMQTVTTDQYHHYKNCQERIPGTYVFMLAQEDVNLMKGLNFDAYRFSISWSRIFPDGEGKVNEEGVAYYNNLIDYLLQKGITPYINLYHYDLPLALEKKYGGWLNAKTVELFADYADFCFKTFGNRVKHWFTFNEPRIVVLGGYDVGSNPPQRCTKCAAGGNSATEPYIVAHNFILAHGYAVARYRNKYKAAQQGKVGIVLDFNWYEALTNSTDDEAAAQRARDFHVGWFVDPLINGHYPQIMQDLVKERLPRFTPDETKLVNGSADYIGINQYTANYIKGQKLVPQKPTSYSADWQVTYASDRNGIPIGPKANSNWLYIVPTGMYGCVNYLREKYGNPAVVITENGMDQPGNLTRDEYLHDITRIRYYRSYLAELKRAIDGGANVLGYFAWSLLDNFEWISGYTSKFGIVYVDFNSTKLERHPKASAYWFRDMLKV

SEQ ID NO: 525 - protein, 484 aa, Gossypium hirsutum
MGKQPSAWITTQQKKRWPLMILLLLSLSTLMAFLIRSTFDSCSNGSSNNVGNFIREGQEEEKGGTHHQVNHNDEAPTPNPLDFMKSKLVLLVSHELSLSGGPLLLMELACLLREVGADVVWVTNQKQTESDDIIYSLEHKMLNRGVQVFSAKGQEAIDTALKADLVVLNTAVAGKWLDAVLKEHVADVLPKVLWWIHEMRGHYFKLEYVKHLPLVGGAMIDSHTTANYWKNRTRERLGIKMPETYVVHLGNSKELMEVAENRVAKRVLCEHVRESLGVKNEDLVFALINSVSRGKGQDLFLRSFHESLKLIQERKLKVPPIHAVIVGSDMNAQTKFETELRNFVSQNNMQGRVHFVNKTLTVAPYLASIDVLVQNSQARGECFGRITIEAMAFQLPVLGTAAGGTMEIVVNGTTGLLHPAGKEGVMPLSNNIVKLATNVEKRLTMGKKGYERVKERFLEHHMSERIAKVLKEILLHKAKRHSES

SEQ ID NO: 526 - protein, 324 aa, Gossypium hirsutum
MTLSDEEDEFLANFLESELSDEEEPEAKRLRVVKEDEEKEKEDKGGGASSSNMNPNPNPGQVKNNNNRNNPRRIESGTFSKIPPELFTQILKFLSSEDLVSCSMVCSFLNYAASDESLWRRLYCMRWGLLPPTKIRECPWKKLYIQRDEEDMIELVRNCPSEFKEYYIQMQSAKRSQAPLPSQVKDDSIILDKTVADRVSIWKSSRGLTDKVVTDHACSGETCTYYQIGDVFVCEKTGQVHVCDDTCREVILDPNNELLVCTISGHCFDRLLSPSEMELEAEQQQAGGTDEAEPFLGSGRFARAYLLGYNCEDEKELEAALRFC

SEQ ID NO: 527 - protein, 1022 aa, Gossypium hirsutum
MGSLENGISLKRAGSRNERHPFSSRPRSRFSRLLLFKKLDYLQWICTVAVFLFFVVFFQMFLPGSVMDKSQGSFLDDKDSVFGELSYLKEMGALDFGEDIRLEPCKLLEKFQRENKLVNLDSSSGFNRSQHRFHYRKPQLALVFADLLVHPQQLLMVTIATALKEIGYELQVYSLEDGLARNAWQSIGVPVTILKVERNEIAVDWLNYDGILVSSLEAKSVFSSFIQEPFKSIPLIWTIHERALAIRSREYTSSGQIELVNDWKKVFCRATVVVFPNYALPMIYSTFDSGNYYVIPGSPAVVWKGENAMNLLKDSQRIKMGYGPDEVLIAIVGSQFMYKGLWLEHALILQALLPLFADNNSNSHPKIIILSSDSTSNYSMAVERIALNLRYPSGVVKHVAVEEEVDNVLSMTDIVIYGSFLDEPSFPEVLTKAMSLGKPIIAPELSNIRKYVDDRVNGYIFPKENIKVLTQIILQVISNGKLSPLARNIASIGRETVKNLMVQETVEGYAFLLENILKLPSEVAPLKAVAELPSKLKEEWQWNLFGDFLNSTLGDRSANFLNKLEEQWNHSRREKFGSLIAVDDSFSYEIWEEEKRTHILDTKRRREEQELKDRTDQPRGTWEDVYRNAKKADRMRNDLHERDERELERIGQPLCIYEPYFGEGTWPFLHQNSLYRGIGLSTKGRRPGMDDVDGPSRLQLLNNPYYRDTLDEYGAFFAIANRIDRLHRNAWIGFQSWRATARKASLSGIAETSLLDAIEKRKYGDALYFWVRMDTDPRNNMQRDFWSFCDAINAGKCKLAFSETLKRMYGLGQDFNSLPPMPEGEGTWSVMQSWALPTKSFLEFVMFSRMFVDALDAQMYDEHYQSGHCYLSFSKDKHCYSRVLELLINVWAYHSARRIVYVNPETGAMQEYHKFKDRRGKMWIKWFSFNTLKVMDEDLAEEADSDHPKRRWLWPSTGEVVWQGVLDRERNLRNRQKETRKQKSKDKLERMRHKHRQKALGRYVKPLPEDIEISNSTTVTSV

SEQ ID NO: 528 - protein, 183 aa, Zea mays
MTRGENQESQTGNVPAASAAAPGPKPASAGGGKGAEGQSVVRRLQSELMALMMGGDPGVSAFPEGDNMLHWVGTIDGSAGTAYEGTSYRLALAFTAEYPYKPPKVRFDTPCFHPNVDVHGNICLDILQDKWSSAYDVRTILLSIQSLLGEPNNDSPLNTQAAALWANQEEFRKMVEKIYKPAA

SEQ ID NO: 529 - protein, 543 aa, Zea mays
MPPPLQAHRLLISHRRLPTPARRRFTAASSVQSAPATTLAPGPATSSILSIRESLLSGERTAADITSEYLSRLRRTEPTLRSFIHVADAAAEREAEELDRRIASGEKDAVGPLAGVLVGVKDNLCTANMPSTGGSRILDGYRPAYDATAVRRLREAGAIVLGKTNLDEFGMGSTTEGSAFQVTTNPWDDSRVPGGSSGGSAAAVSARQCVVSLGSDTGGSVRQPASFCGVVGLKPTYGRVSRFGLMAYASSLDVVGCFGSSVFDTATILSVVAGHDKMDATSSSQVVPEYASELVSLDLLESKPLNGVRIGIIQETLGEGVASGVVSSIKGAASHLEQLGSVVEEVSLPSFSLGLPAYYILASSEASSNLSRYDGIRYGGQVSADDLNELYGESRANGFGHEVKMRILMGTYALSAGYYDAYYKRAQQVRTLVKQSFKDALERYDILISPAAPSAAYKIGEKINDPLAMYAGDIMTVNVNLAGLPALVVPCGFVEGGAAGLPVGLQMMGSPFCEGNLLRVGHIFEQTLQNLSFVPPLLAEGQL

SEQ ID NO: 530 - protein, 487 aa, Zea mays
MAEANAGKEKKEVVRLERESVIPIMKPKLTMKLAYLIEHQSDREEFLKLCRRVEYTIRAWYHLQFDDMMELFALFDPVHGAKKLEQQNFLPEEIDTLEQNFLSYFFRVMEKSNFNIVNDDEVELAHSGQYLLNLPIKVDESKLDDKLLSKYFKEHRHENLPDFSDKYVIFRRGIGLDRTSNFFFMEKVDMIIARAWRRFLEKTRLQKLFSRKKNSKPKIDSKKNDDLASEIEDKELYVERIRLETMDLSFGNLFGKVTIQEPTFEEVIVLYRRKSPKGQDDRAIHVKHFKNIPMADMELVLPEKKNPSLTPMDWVQFIVSVVIGLVTLISSLEMPKADFWVVIAILSALAGYCAKIYFSFQQNMATYQNLITQSMYDKQLDSGKGTLLHLCDDVIQQEVKEVIIAYYILMENGKATSDDLDLQCEELIQEEFGLQCNFEVMDAVQKLERLGVITRDSIGRICCVPLKRANEIIGATTEELVMKARQS

SEQ ID NO: 531 - protein, 284 aa, Zea mays
MATAFDSPTSSPAAAPFHDDPFLHFDGSAPAAADGFPASPDAYAPSPFGMPHSNGDLHDDPFAAPADSNGGPILPPPTEMGREEGFLLREWCRQNAIHLEEKEKKEKELRSQIIVDAEEFKKAFVEKRKLNAETSKGQNRDREKLFLANQEKFHAGADKQYWKAISELIPHEIANIEKRGARKDKEKKPGIVVIQGPKPGKPTDMARMRQILLKLKHTPPPHMKPPPPPAAATGKDGAPAAAGKDGAKPATVANGSVPEMEKAAAEASVPAAAPPAATEPIAAA

SEQ ID NO: 532 - protein, 273 aa, Zea mays
MARLAVAARAFSAAASGGGVSLVQGASRGIGLEFVRQLLRRSDGGRVVATCRTPGSAAELQKLREEHAPGRLTVLPLDVTDESTIEAAAASITETHGSLDLLINSAGILSIPNVIQPETTLSKVQKSSLMLAYEVNAVGPILVIKHMWPLLKIGGRSETRRGFALVANMSARVSSIGDNALGGWHAYRASKTALNQLTKTVSVEFGRKDNIACVLLHPGTVDTDLSRPFQRNVPEGKLFTREFSVQRLLSVIDSVKKGDNGKFFAWDGQEIPW

SEQ ID NO: 533 - protein, 158 aa, Zea mays
MSKSTEIADKAIILMQDHAKHIYRICNEKLILGKGLTAFEVKELREALEFAAEGLDQDSLFCQEELDATVKEEQLEHDEKVASQMIESPLLLLIRTASYPLKSTLRSFGALITTRTRCLATPTRLRVYGAVKFWMFGCNGILDVYVNCNSGCVDVMVN

SEQ ID NO: 534 - protein, 79 aa, Zea mays
MAIAAVRRLLWREVGTAAAAAALGTDGNLFARLVSEPECRVKATMEEAASSGTHRDGAFWEPPVTALLRASSPTKAHLD

SEQ ID NO: 535 - protein, 553 aa, Zea mays
MALPAPPVRLALLLLVALPFCAAHPGPGAFNAPRHFQTPALHSDGFGLVARRSIAEAPADINVTTNSSFVLAADRTYRRDPLNGFRKYPGGWNISEVHYFASVGYTAIPLFAIALVWFVIFFLVMLGICCRHCCCPHHTYKYSRTAYALSLILLILFTCAAIAGCAMLYDGQGKFHKSTTTTLKFVVSQANYTVDNLRNLSDSLSAAKKVDIAQSFLLPPNVQNEINEIQGKLNSSATDLAIKTTDNAAKIKKVLNRVRLALVVIAAVMLLLAFVGFLLSIFGLEFLVSVLVIIGWILVTGTFILCGVFLLLHNVVSDTCVAMEEWVAHPTEHTALDEVIPCVEPATANESLYRSRQVTFELVNVVNQVITNVSNRNFPPQLTPLYYNQSGPLMPLLCNPFTPDLRDRNCSRGEVTLDNATQVWKKYECQSTTVSGGAEICATVGRVTPSIYGQMTAGVTVSQGLYQYGPFLIQLQDCTFVRDTFTTINQGYCPGLERYSKWVYVGLVMVSSAVMLSLIFWVIYARERRHRVYSKQHQPYPVEDKPAATVPGA

SEQ ID NO: 536 - protein, 376 aa, Zea mays
MALLKAARVADVPTLDVVVAPGLVAVAKARSAAAVGGRFSVIGHRGKGMNALASEDPRLRDVRENTVRSFNDAGRFPVDYVEFDVQVTKDGCPIIFHDNFIFTQDDGKISQKRVADIQLEDFLQYGLQNEQGKVGKPLLRRLKDGRMVNWNVQSEDALCTLEEAFEKVNPRLGFNVELKFDDSLEYTEEELTRILQAILKVVFEYAKDRPILFSSFQPDAAQLMRKLQGTYPVYFLTNGGTELYADVRRNSLEEAVKLCLAGGLQGIVSEARGIFRHPAAVPKIKEANLSLLTYGTLNNVPEAVYMQHLMGVNGVIVDLVPEITEAVSELIALPEPDLDLEVGSLSNQAAARGATTPNFSQREISFLLRLIPELVQ

SEQ ID NO: 537 - protein, 132 aa, Zea mays
MWWEWEGDGGEAPREETPVDFDFIALLAKPKDYYKILEVDYYASEETIRSSYIRLALKWHPDKKQGQGEENSTSKFQEINEAYQVLSNPAKRQEYDKKGILYVQDQNVVDYLNRHKGLILTCNGLGIRYSVW

SEQ ID NO: 538 - protein, 875 aa, Zea mays
MDLFTIDSDSESYTGTSDSEDQECEFTYSDHAQNILSSLDESIGKIDNFLTFERGFLHGDIVCPVSDPSGQLGRVVGVAMFVDLETSSGDIIKDVNSKKLSRVRSFVSGDCVVMGPWIGRVIRAFDLVTLLFSDGAKCEILLRDSDVLKPIPPVLFEDAPYFYYPGQRVRIVDPSVSKSATWLCGSWRPSRDDGIVSHVDVGLVHVNWITSVTNVWGDKSSSPPNIQDPKKLTLLSCFPYANWQLGDWCALMTDNNGCLWMDSGKSCILSEDQKCDSHAHMYFESYGSDCSQTFVVAKTKSTVDVLWQNGTVSLGLEPQALLPVSTLGDHDFWPGQFVLEKLTVEDAARCPRTAIVSDVDALERTVNVKWIGPAHSDIVSYGSDPAVETVSVYELVEHPDFSFCTGEVVIRSAMNIDKSEADPTNGSLASKESLVTSSGFLSCTGNVLGYKDNGIEVQWANGVISKVQHFEIIGLDKLLDNSSVESMNEEHTIGDSLDEAEQEELNHEVCLFIALESTEDCTGSLCKATAFLFPKTAFDFLTNVAASLFGIHGSPSPSSVLVDPRYEIVKMAEMQPCAEETPKEEQIVKFVAQIDKPILSSEDAISKRFDVVTDCLDHHFVKENGHESVTRGWLKKVRLEWNILQNDLPDGIHVRVYEERMDLLRACIVGAPGTPYHDNLFFFDIFFPPDYPHEPPSVHYHSGGLRLNPNLYESGKVCLSLLKTWTGTGNEVWNAESSTVLQLLLSLQALVLNEKPYFNEAGYDKFVGKADGEKNSITYNENAFLLSCKSMMYVLRKPPKHFETLVKEHFTCRAPHILDACEAYLGGDLVGHAHDKAYVAEDGNKNCSTGFKIMLGKLLPKLVTAFCEAGITSDR

SEQ ID NO: 539 - protein, 267 aa, Zea mays
MEKTSENAIPPAASPLMLFGSWASSYTHRVQLALRLKGLEYDYVEEDLGNKSDELLRHNPVHKKVPVLVHGGRALPESVIILQYLDDAWPETRPLLPADAFDRALARFWCHFADDKLGPAVGAVFASTGEGQEAAVRQVHENLALIESELRDGAFRGRRFFGGDEVGLLDVVLGCGSYWLAVFEEVTGVRLVDADAFPRFHAWLRDFEALDEVRETIPAVDRLLEYARGLRHMLLGLAGAGAGAGADAPSTDAPAAPPASADIAVDI

SEQ ID NO: 540 - protein, 1113 aa, Zea mays
MALAHASAMFPPSSPSHKTWEDPSFFKWRKREAHVPLRSQDTLEAALKYWHERRNVNYHNADTAVWNDDAVRGALESAAFWSKGLPYAKSLSGYWKLLLSPSAESIPERFYYAHFDDSNWSGLPVPSNWQMHGFDRPIYTNVTYPFPLNPPFVPADNPTGCYRTVFHIPKEWKGRRILLHFEAVDSAFFAWVNGVLVGYSQDSRLPAEFEITDCCHPCDSDKENVLAVQVMRWSDGSYLEDQDHWRLSGIHRDVLLLSKPQIFITDYFFKATLDENFSLADIEVEVEIDSHKQDQEHVPTLSIEATLIDNSGLSNSIDADLSSANAVNLKPKPKRTRSPCLGFHGYVLGGKIENPKLWSSEHPNLYTLVVLLKDANGKLIDCESCQVGIRNVVMAHKQMLVNGCPVVLRGVNRHEHHPRLGKTNLEACMIKDLILMRQNNINAVRNSHYPQHPRWYELCDIFGLYVIDEANIETHGFDESNTFKHPTLEPIWANAMLDRVVSMVERDKNHACIIVWSLGNESSYGPNHASMSGWIRERDPTRLLHYEGGGSRTSSTDIVCPMYMRVWDVVKIAKDPSETRPLILCEYSHAMGNSNGNIDAYWMAIDNTFGLQGGFIWDWADQGLLKEDSDGSKFWAYGGDFGDTPNDSNFCLNGIVWPDRTIHPALHEVKYLHQPIKISSADNMLKIENGHFFETTEALDFSWVLHGDGCVLGSGPLNIPTLAPQTSQLINMESSPWFALWSACAAKEVFLSVNVKQRHETRWAKAGHLLASAQLCLPQKNGFVPSVIALSSSPLVCERIGDNVTICKNNAWKIKVNSQLGTIDSWKVNDVELMSKGILPCFWRAPTDNDKGGFFTKPYDSRWREAFLDNVSFHSSQFSVKELPDNTVEFSTLYYGVPGHLPKPDDEASESILFRVKMVCRIHGSGDVVLDYEVNPRSDLPPLPRVGVVFSAGRSLSHVTWYGRGPFECYPDRKAAAHVGVYESSVEELHVPYIAPVECGGRADVRWVALRDAGGLGLYASAHGGSPPMQMSASYYGAAELDRATHVHRLVKGDDIEVHLDHRHMGLGGDDSWSPCVHEQYLLPPTRYAFSLRLCPLLPSSSCHDIYRSQLPS

SEQ ID NO: 541 - protein, 145 aa, Unknown
  Sequence found in Organisms: Zea mays, Saccharum officinarum
MPKIKTSRVKYPEGWELIEPTIRELDAKMREAENDPHDGKRKCEALWPIFRISHQRSRYIYDLYYRRKEISQELYEFCLDQGYADRNLIAKWKKPGYERLCCLRCIQTRDHNFATTCVCRVPKHLREEQVIECVHCGCRGCASGD

SEQ ID NO: 542 - protein, 645 aa, Zea mays
MPRKSHKARGAAAHAAVGLTAGPRPPLKATAPNPSAAAELPQVVVAETEGLKVPDAGASAAADALERLHVAPASDGDPPPPEPVHEPAAPPQPPPAEASSSGRSAAGGSWEEEAVRKLRELAEVSRDETELTEEEVRANDQRQEDEICALEAIFGDAVVILDRKGGQRSFQVLVHIEVPDYIDVSTKLSYGDGTLNYASTHDDDDLFYKFRVEHLPPILLTCLLPTSYPSHRPPFFTISTYWLDKGMISPLCRMLDMLWEEQQGMEVTYQWVQWLQSCSLSHLGFANEVVLRKSDVTCYADGEDKRACPDYASPDVIIPRMMRYNDNKHHEAFLHAIHDCMICLSECPGVDFIKLPCHHFFCWKCMQTYCKMNVKEGNVVKLLCPDTKCEGAVPPNVLKRLLGEDEYERWEGLLLQRTLDAMKDVVYCPRCQTACLEDVGNEAVCSSCLFSFCTLCRNRRHIGEQCMSPEERLMILEKRQESGNVQGDQMKVLQELRSLKEIMKDSKQCPKCRMAISKTEGCNKMHCENCGEYFCYQCNRAITGYEHFRGSCVLFPQEELDRWEMQMNQRVGRQIVAHAHAAIHGQNGQAHPCPTCRQPSPKIGNNNHLFCWACQKHFCALCHKAVQKPAQHYGPKGCKQHTADP

SEQ ID NO: 543 - protein, 413 aa, Zea mays
MASSWVLALVLALSAGASLARGSEPWWNETQVYATTANSGGGNGVFVGLTLIQSAAAKGAVCLDGSLPGYHLHRGFGSGANSWLVNLEGGGWCNDRSSCVFRKGSRRGSSNHMERQLQFTGILSNKPEENPDFYNWNRVKVRYCDGGSFTGDGSDAAAGLYFRGQRIWQAAMDDLMAQGMRYANQALLSGCSAGGVSTILHCDEFHGLFPSNTRVKCLADAGMFLDTVDVSGRREMRSFFNGIVRLQGSGRSLPRSCTSHMDKTSCFFPQNVLPTIRTPTFVLNTAYDVWQLQQSVAPRTADPQGLWSKCRTNHAFCNSNQLQFLQGFRNQMLDAVRGFSASRQNGLFINSCFAHCQSERQDTWYANNSPRLGNKKIADAVGDWFFERGNAKYTDCPYPCDGTCHHLVFRGDH

SEQ ID NO: 544 - protein, 445 aa, Zea mays
MFGTPSITPAFGNPSSTPVFGTPSATPAFGATSSTPAFGTLSSTPAFGTPSSTPAFGTPSSTPAFGTASTTPAFGASSSTPAFGTTSTTPPFGSLNFGTPSSTSAFGTPSSAPAFGALNFGTPSSTSAFGTPSSAPAFGATPSPSPFGFQQQATPSPSPFGLLGGGGAQITTQMAPVAPLPLSPSDRDIQAIVDAYKEDPGNPRYAFRHLLFSVTEPSQRVKPVAASDIMWAEAMGKLECMDSADRERLWPQLVQGFKDLSHRLKLQDEVLVSDTDRLSMTHSNVKKLQRHFQADTYPWIQRLKQQELAIQRRLLRFVRIVEALENRGYRCPLTKEEADLYERLVAILKRLKGHNADLAKRVNTLVSTSRLLASSGGAGGSVYIPSSAKVDERSVTELLEALQQQTEAVAKLGNVLKRDIRDMEIIQSEGTDMAEDNVGRRAQKI

SEQ ID NO: 545 - protein, 369 aa, Zea mays
MAAPAATRLHSPFLLLPSPPHPHPSLRLRFLLPSPPPLRLRRHFPLLAAAAVSAAAGAGGGGEEVAARKDDKARQLQKRVLVGVAIGVGAGGIVVAGGRVFAAAVAAAVLAGSREYFELVRSTVAGGGTPPPRYVSRVCSAICALMPILTLYYGRMDVTVAFSAFVIAIALLLQRGNPRFAQLTSSVFGLFYCGYLPSFWVKLRSGLAAPALNTSIAYNWPILLGGQAHWTVGLVATLMAISSIIAADTSAFLCGRAFGRTPLTNISPKKTLEGALAGLAGCVLTTVLLSTALRWPRSLLSATAYGILIFLGSLFGDLVESLIKRDAGVKDSGSLIPGHGGILDRVDSYVFTGALCYSFVRVALPLYGV

SEQ ID NO: 546 - protein, 187 aa, Zea mays
MKGSSEHGETSKQAPLGSSRGVSKGVSVLDLILRFIAIIGTLASAIAMGTTNETLPFFTQFIRFKAQYSDLPTLTFFVVANSIVCAYLTLSLPLSIVHIIRSRAKYSRLLLVVLDAAMLALVTAGASAAAAIVYLAHKGNVRANWLAICQQFDSFCERISGSLIGSFGAMVMLVLLLLLSAIALARR

SEQ ID NO: 547 - protein, 872 aa, Zea mays
MSPAVASASSGDRIRTYEDFVRVHAYLLAAAGIPPSLHRRLYRKLADEVFDGGEVFAVEPCEDGRQRRLVLTADQSLGKESDVFLVDHAWSFRLPDALKQLREVPGLAERMAALMCVDLDRKIEADEQDDDESGSLEHVSQVVEKERARVQERSDSTAWLELEELGIDDDMLVALDLSANFPNLVALNLWGNKLRDPEKVMQEIRKCTKLKALWLNENPVLGKSIDKAVFDGLSGLEIYNSHFTSKAGEWALGFCADIVGADNPCSSVESTLFGSIGTIDLSDRCIHKLPEVFSPSKLPSLSKLNIRGNPLDQISGDDLLKLFGGFTQLQELEVDIPGPLGNSAISILESLPNLSLLNGVDSSSIIESGKHIVDSALEPRLPEWSPEEPLAERVIGAMWLYLMTYRLADDEKIDETPVWYVMDELGSAMRHSDNANFRIAPFLFMPEGKLHTAISYTILWPTHDVHTGEECTRDFLFGIGEDKQRSARLTAWFRTPENYFIQAILRYQEQLQSNSICSSTKIEETQTPSTKSVRSRDGRVLRVYTDIPHVEEFLTRPEFVLTTDPKEADIIWVSMQVDSEVKNAVGLTDQQYTNQFPFEACLVMKHHLAETVHKAWGSPEWLQPTYNLETHLSPLIGDYCVRKRDGMDNLWIMKPWNMARTIDTTVTGDLSAIIRLMETGPKICQKYIERPALFQGRKFDLRYIVLVRSIRPLEIFLSDVFWVRLANNQYTLEKTSFFEYETHFTVMNYIGRMNHMNTPEFVKGFEKEHQVKWLDIHESVRSTIRRIFEAAAAVHPEMQNPFSRAIYGVDIMLDNRFKPKVLEVTYCPDCGRACKYDTQALVGSQDTIRGRDFFNSVFGCLFLDEQTHVLPL

SEQ ID NO: 548 - protein, 241 aa, Zea mays
LSPFPLTDLENTICHKESNVLLVEIHAAMKDEGDYFTVLQNKKRKLKVSSVTWAEYLCDFLEMTKNEERSTNIATVIRGYYGLIDTDIKLKILRELVEEAIQTSAIKEILSDRVDQKQVLNATKRENTRKDKQEKNLNTEIAMKSQENQTDDVQVGHGGVDELVRRKEENDKSNISRSRTEGKRHLVQHLETEIEKLSIRSSPLGKDRQYNRYWFFKREGRLFVETADSREWGYYNTKEEL

SEQ ID NO: 549 - protein, 242 aa, Zea mays
MAAAASASSVKEVLPSPLTSASEPPPLFDGTTRLYVAYLCPFAQRAWIARNYKGLQDKIKIVAIDLADRPAWYKEKVYPENKVPSLEHDNQVKGESLDLVKYIDSNFEGPSLLPEDHAKQQFAEELLGYTDAFNKAFYSCLVDREDVSEEAVAALDKIEDALGKFNDGPFFLGQFSLVDVAYVPFIERFQILYSNIKNYDVTKGRPNLQKFIEEVNKIDAYTQTKLDPQFLLEQTKKRLGIA

SEQ ID NO: 550 - protein, 304 aa, Zea mays
MARKCSHCGNYGHNSRTCGLGLGLGHREIMLCEGGDDNNGRSGLRLFGVQVRIGGGGGAGSASMKKSYSMDCLQLAAPHACSSLVSSPSSSSLCSSSSPSSLLLSIDDGLQRGAADGYLSDGPHGRAVQERKKGVPWSEEEHRQFLAGLDKLGKGDWRGIARSYVPTRTPTQVASHAQKFFLRQSSMGKKKRRSSLFDMVPICENSASISDPLDVARHGVASADSERAAVDVDLMNSTTEGDDGRSRDVVSSASGAGTALRFPAAAAQTEPLHPSSSHGHGRGHHCSPLDLELGMSLPAPSVGT

SEQ ID NO: 551 - protein, 428 aa, Zea mays
MTFGSADMEAGGGGERRHGQQEEQSSDERRARFAEDWGCCACACAGLFLGPNPMVARYLYALIFLVTNLLAWTLRDYGDSALAELQRLKVCQGALYCLGAEGVLRVSLGCFVFFFVMFLSTVNARKVHDCRNSWHSEWWPAKLALWLGLTAVTFLAPSPLVQLYGKVAHFGAGAFLVIQLISVTRFIMWLNDWCRAEMTQKRYHLQIQAVSIVTYVGSLLGIVLMYVWYAPSPACRLNILFITVTLALVQLMTFVSMSSKVKAGYVAPGLMGIYVVFLCWSAIRSEPHTEVCNRKAEVATSADWVNIASFVIAVVVIVAATFSTGIDSKCLQFKQAEGESEEEEEDDIPYGLGFFHLVFSMGAMYFAMIFVGWNANASHTMERWTIDVGWASTWVRVGNEWLAAIVYIWMMIAPVIWKTRQVGSAAET

SEQ ID NO: 552 - protein, 842 aa, Zea mays
MSDWSSPAAPTFFPFGPQAEGWDVTFKVKYGDTLKRFYGCANGSHFDMNLSALRARIDTAFKFGPDVDFVLTYTDEDGDIVMLDDDDDLRDAALRQRLNPLRITVQLKKNQPTEKKDTSAPVKSAAQDPLSQLMSAIEGLKPVQEDSLAHIKSAIGEAIKSIPEPIPDALAKLSHEILDAAPPPLAELMKPFAQLMAPNNNGNGPSDVHAEGSSSSSSAQVPAEAKNEPKVRPSLGLKTVLKEAAGPVPNAGASQVQQPLMYPSVEEMLFPCNSVDKSVCKGKIDAQSKGKSVTSSGIQPAPHSLRTHAPPPPHPCISEWSRAQRSQHRQLKFEDNAKTTNDSRWRIPMYKMPYAPPPPAVPPPGYVPSPHFPYPGRLLSSGHPYGDLAGNMENSAPHSLHRWIQCDGCGAQPIVGPRYKSNVKEDYDLCDSCFQRMGNEMEYTKIDKPILPHRFLRDPHVYRKVHHPRVLMKSRREKLESRFILDVTVLDGTLMTPSTPFTKIWRMHNNGSVVWPRGTQLVWVGGDQFALQTSVPLEIPVDGFPVDKEIDVPVDFVAPTRPGRYISYWRLASPSGQKFGQRVWVHIQVEDPSFVNDNNRNAAINLNLPPESYSSNTTNLIDVNIEPADSALSAHAKRTKEFHFCSTDFPEPSKSVPFTLATTSLSAAAPTNQTGDVPMSSTPAAACLPSVNVPMHEVVTTHTPSPITPVLPTTIHFSAPVSAPAIAPELASGAVGVPPPVSAVVPELSELDVHNEEKLLRELEEMGFRQVDLNKEILRQNNYNLEQSVDDLCGVNEWDPLLAELEEMGFDDTEMNKELLAKNEGSIKRAVMELIAREKKDK

SEQ ID NO: 553 - protein, 613 aa, Zea mays
MQHDQRKKGSVEAEFFTEYGDASRYKIQEVIGKGSYGVVCSAVDVHTGEKVAIKKIHDIFEHISDAARILREIKLLRLLRHPDIVEIKHIMLPPSRREFKDIYVVFELMESDLHQVIKANDDLTKEHYQFFLYQLIRALKYIHTANVYHRDLKPKNILANSNCKLKICDFGLARVAFNDTPTTIFWTDYVATRWYRAPELCGSFFSKYTPAIDIWSIGCIFAEVLTGKPLFPGKNVVHQLDLMTDLLGTPSMDTISRVRNEKARRYLSSMRKKETISFSQKFPNADPLALDLLQRLLAFDPKDRPTAEQALAHPYFKGLAKVEREPSCQPITKMEFEFERRRVTKEDIRELIFREILEYHPQLLKDYINGTERTTFLYPSAVDQFRKQFAHLEENSGNGPVIPMERKHTSLPRSTIVHSSPIPVKEQPRIGPCRERPSSDESYRNPRETEQYSGNLPRTSQAPQRVPTARPGRVVGPVMPYQNGDTKDPYDTRRLAMSSGYPPQQIPQTFGYYQTHGKPACCEPSQAERYTLHQQAAYACANRTAASDVALDMRAPPFQHLSAGQRSDSCDRLTAETNLYTRSTNGIAATAAGVAATTHRKVGVVPFGMSNMY

SEQ ID NO: 554 - protein, 235 aa, Zea mays
MDMEAAAISGTASASSSTSRRGRSISRLPARVAGAVIRGLVTFVFAAVGMVLGAVTGALIGLATESGLVRGAGIGSISGAVVSMEVVDSSVAIWRSDESGIWSVLYVLDVLWSLLTGRLVREKVDPAVQSAVDSQMNAADSQDMAPTLADMFETGAADAKGMPAAAVAALPIMAFTEHTVADGSGEPIGCSVCLQDFEAGETARSLPECGHTFHLPCIDVWLLRHASCPLCRRAV

SEQ ID NO: 555 - protein, 118 aa, Zea mays
MAEATDTAAATPPPAPAMATLSPPPKSGIPPRYNLDAKWDACLDLSIRRVAYSSLAGALAGLLLFRSPTTRWASVTLGAGVGIGAAYTECSYLFSGGPPNWSPKVSTIPSAHSEGEDK

SEQ ID NO: 556 - protein, 118 aa, Zea mays
MAMVASTSFAYHKPRFAVVCRKNRDGRDRERDGKEHKHPFKVVEITPPPRCLGVRCFPTNIHCGESVTIEGQAYTVSAVTHRYQLRKGRYEPSEKRLDVLSTGRYILNLYLQNLLDQS

SEQ ID NO: 557 - protein, 553 aa, Zea mays
MMGNKTGKPVFSELKSTEFSLLESTLVQDHCAIPTCVPLDFLKAITSDFSKEQELGRGGFGVVYKGLLKNGKAIAVKKLSEMNLDDDQFHNEVTYLFGLKHKNIVQLKAYCAESRWEAIELRRKYVMAESRKRLLCFECINNKSLDKHLSAESHGVEWHIRYEIIKGICHGLHYLHTDCQIVHLDLKPENILLDDNMEPKITDFGMSRLFGLQQSKIITKTCGGTLGYMAPEYLLKGLISVKADIFSLGVIIIEVMTGGRNYPTCEKSCEQFAVDVVGRWRKRLLEEAGRYTPLEKYVEQVETCILIGLMCVDDDPNKRPTTLDIIERLTKVDVTNTDRGPPKTLEAATGLTGHPNLATRSFLDRFRRTIVIGMLKKALKIQDVSQLEQLLAKEVLLELHKIGTNATGNRSFLERLHASITMATLVQALHSLDLDPSAALRMEVLFLALENMRGKNNSRRRSEDVLELEERPEQIRSVLEAGTRARLSDEEHMPSVSVQAEDQAFPKPKLAKVRATAPVCVSAVWLAAGIGFLCGFTLGEMRGLRRTRVHERT

SEQ ID NO: 558 - protein, 291 aa, Zea mays
MAPGSACPWPSFLGSASISSSSLSLRAFPDARLAPRAGLWCSAAQLPLLATHAQPLPRTRVPLLFPQPRAVLLLCSLVAMAMATELPCRGFLLPRRARSVPSFPAVTPSWCFLARSSPQLPFVVVASRRPSSDSISPTPAPSRRLLGFASLRPAKFTPACSRGFLCTAFLLPGLCRARQHVIHVEAAASIPCVMLTRSSLTSSICAIIFGYRFRRLSIFLFAMVITTIVPIRASLARQPSRHLYLLGRALPRSLRCVAAFTSLCHRELVDILLWYLDRACCWAYASSPKVF

SEQ ID NO: 559 - protein, 547 aa, Zea mays
MDDAPAAIVKAKGGRGAFLAHFFIVLPVVTLCVVVYAPRYFSGPPPYYGGGANDVGGISAPRPSSMTRTSSSSSAHLGGLGYVAGRRDADEDDQQLGVGDGGALPQQVVLDNQVGSPCSSLPNHTICCDRSDYHSDVCFMAGDVRTDAASLALLLFPPRAASSAPEPPAAEERIRPYTRKWDAYITKTIHEVTLRVARPEEAAAAAHRCDVRHDAPVLVVTAGGYSHNMFHVFNDGFLPLWLTAQHLRRRAVLAVLSYSPRWAGTYGEILAGLSRYHAIDLLRDKRTHCFPGAVVGTRYHDYLAVNSTRLRDNKTIADFHDFLAGVYSDDDVRNDKAAGGSSSSRRPEMAWYERRRPRLGIVSRKGRRVVENQAAVAQLAASVGFDVDIMETANGAPLSAVYASVSSYDALVGVHGADLTTFLFLRPGRAALAQIAPLGITMLSRNLFGVPAARMGLHYVQYDVSARESSLSRRYPLDHVVVADPARARREQGKQEWELVEHVYLRGQNVSLDLGRFRETLARIHSRLKEQQQGHASRSSPDASPQI

SEQ ID NO: 560 - protein, 319 aa, Zea mays
MERKGGCCLAPRYAATAAAQQAGAAWQMGRIMLKFRPIAPKPAAMAPAPAPASAPVTGSAAGAGRGKRKAACGGGGRRGRKPKKAAKVAMVTAAPAATAAAQDVGDCREHCDKEKSSSSPSSSSSGTSSVDSSPPPRPQQRQLATLPLMPVTAAEDKAAACPATVGPDQLVPSQVATAARPLAPRAMRPAAAAAYLVTVEEVTATWRDGEAPASATGADEAPAFVSDQWGRVTWWNAAFVRAASADDGDEAAAPVVLGGALPAWGTCAGFTCRVRARHWSARRVGSPVVAPCDVWRLDAAGSYLWRLDLQAALTLGGCL

SEQ ID NO: 561 - protein, 1453 aa, Zea mays
MSGAWGGTTQKCASCGRRVYPVEELAADGRVYHRPCFRCHHCKSTLQFSNYSSVEGVLYCKPHYDQILKSTGSLEKSFEGVARSAKSEKSNGHKGQQSSRFSNMFVGTQEKCVVCNKTVYPLEKVALNGNSYHKSCFRCTHGGCTLSPSNHITHEGKLYCKTHHSQLFMVKGNFSQFEDNSGNAKVTIEKLPETEEATKNPDQGDEATRKPVENEPTDEKTSKNNVAAEKQLQSGVDVTKPSESTTAENERGTEGESKSNVVNKKPSESIVEKPLQNSVVDVKPSGNSAAMRKPWQRSMQTDKPFLSSTSTVNPSSSSDTTEKLSSSNGVDMKQSESSTLVKTTCKQNSPTENPPQSVLPSDKPSATSVDDAKPSESSKVIKKPWQRNMAAEKQLQNSAPSQKSVATDKPSPTTGMKSLDNTTEVKSPWGRRMFNNKSLKRSVDTEKSSETSVVDVRPGETSTVAPVPQQQTENVEKPSATSADDAKSADDTKSADDVKPSVASPDAKSTDDVKSSENNAAVVRKPWQRNIGTGKQPLTTVVGPKTTETSGTVKRLWQRSAATASKSGTAVVTPLQSSVVVSKPFQSNVAVKKTWQRSVTPENQLESNMSSNKPLPSKVVVESLLQSNTVEKVFQSTVPTEEPQKGIMATENQSQTIKVTKKSNETSMELSVTSETTKPPPLAATVLQSDVSTEQPSQTDMPTMAPSQIPEPTEKPSESDFNAEKLSESVVKAEKSSTTDTAAEKPLPSMITEKVESVAGTLKPSQSDTALQEILERNMATEEILQTAMAVEDAPPTNLITEKSLMKDASEEPVQTNEPSEQPLKTEEIEKPQQSEKIATDTRGSEVSTEEMLELESNATKLNKDQSELEGLSSGRNPPNFQSNPNAGQRSESKGIVAEKAADHIMEAEDDVDAEHSSESQSVAPAEVRKEQPSEHQKDVDMEQLLEPQNQDHPWNPLDPVSDTAAKDSSEPKSDIATEKPAESQNNAEQSVEQQSEPQSDKSTERPEVHQSNTSNDELSRLQNDAGTDKLSVQSSDPESNASVSKPSESQTDVATMEALEPQIDAPPDKATDQPVKPQDDASAKNPMGTESDAVCDKPSESSSDTETLLVCHQNSSITTDEPVQGGISYDTPHQRSAPIETTPGSETVVDDCIHHEDTSSKPSEENKAIEEPEEVSAKLPDDHVTSEKSSEEDKENAEASVDSAPLGNPLEVNEESSNPSGDTVTPEKPLEEDKTSAEPSESDASFGKILEADEVSANPSEDIATPEKPLEEGVGSVEPSEDNSVLDKPLEEEEVDAKPVKDVVTPEKPLEEGSTTAEPLEDNAAHEEAKEEDEVIAKPLSSVALEKSLEGSEASVEPSEDNAALEKPSEDDEANAKSSEDSVYVEKPQQEEDDNGVKALEEGVSPEKSAAGKPLEEDPVHEKPADAVAEPSSQDDTATEKPSATTDTAETA

SEQ ID NO: 562 - protein, 436 aa, Zea mays
MESAAAAKTVERLAQRLVPPAEPTPTAPHRLSWLDRYPTQMALIESLHVFKPDPARDGLSPAETIERALARALVDYYPLAGRLAVSDSAGGLHVDCSAEGVWFIEAAVRCRLEDVDYLEYPLQIPKDELLPHPLPRPSHEEESKLILLVQVTAFACGGFVVGFRFSHAVADGLGAAKFMGAVGELARGADQVSVAPTWARDAIPDPSGALVGSLPEPTGAKRLEYLAIDISADYIDHFKSQFAAATGGGRCSAFEVLIAKAWQSRTRAAGFEDPDTPVQLCFAMNARPLLGARLPRGGAGFYGNCYYIMRVASTADKVSSSSVTDVVKIIREGKKRLPLEFARWAAGEEGADGVDPYQITSDYRTLLVSDWTRLGFAEVDYGWGPPAHVVPLTNLDYIATCILVKPWAHKPGARLITQCVTPDRVSRFHDAMVDMN

SEQ ID NO: 563 - protein, 347 aa, Zea mays
FIPYSTLSIRQLQVFISPAVILPAASSSSPPQIFPSRRSSAWISQAAALVWDKIPLPSLSSSPLRQLPRRPSPCSRPTSPQPRRPLFLPAGRLPLQSCARPAPLPPPWPAPPSAPLLGSPSHGASLCRPPIFLLGSRPARSLRLLLAASPCSLISPCSLLSHGVPARSLCSLSRPPAPARRAPPCFSPRRSAVPTPSLHARFSALCARYFSSMPRRPCSSSSPRPGFHGCALGFCTELCAPSPLRSPPHHGAFPPAPSSPSRFSVGRCSARPRPLLRALVRSALCSPSQPATPLLLPRPCRGVLLAPWCRAGVSSSSPWRSCARVGPSLVSPMTRGFLREFCCVQLH

SEQ ID NO: 564 - protein, 237 aa, Zea mays
MSQLLHLPDLAAPRTRMGSALAAGARVKQGEAGTARGRVLRVADPVRRECLVPVPPPPVLAAGRRGDDDDVDEERQRYYLNLGYAIRTLREELPDVLCKDHSFDIYREDIVFRDPLNTFKGLGNYKRLFWALRLTGRVFFRASWVEVVSIWQPAENSILLRWTAHGVPRVPWGWWDAAHARFDGASVYKLDRNGKIYEHKVHNVATNPPAKSKVLPVHELVRSLGCPSTAQPTCSDF

SEQ ID NO: 565 - protein, 261 aa, Zea mays
MATSDKKTRGYVPWNDEMDKVLLDTFVDYYNKGDRCQNGWKSHVYTAAVKNVCEKCNVTITKENISSRSKTFDKHYNIINGLLSTSGFGWDWEKNKLKVDSDTVWDEYVERNKEAKGYRHKVVKFWDLLSLVYNKDQANGEGAKTAAESSKEMAKENDTGGKDAPYSVSSSSSLKRQRSDDSFNSIWCDKFDMLTSSLKDDGPKLPSSAEVLAALQEVEGLDEDTELELYDILTSNARKFESMMALPMERRKRWLMMQLRK

SEQ ID NO: 566 - protein, 439 aa, Zea mays
MSPPTQMASLAVLVCLVCAALASDAAAVRVELTRVHADPSVTASQFVRAALHRDMHRHNARKLAASSSDGTVSAPVSPTTVPGEFLMTLAIGTPPLPFLAIADTGSDLIWTQCAPCSRQCFQQPTPLYNPSSSTTFSALPCNSSLGLCAPACACMYNMTYGSGWTYVFQGTETFTFGSSTPADQVRVPGIAFGCSNASSGFNASSASGLVGLGRGSLSLVSQLGAPKFSYCLTPYQDTNSTSTLLLGPSASLNDTGVVSSTPFVASPSSIYYYLNLTGISLGTTALPIPPNAFSLKADGTGGLIIDSGTTITMLGNTAYQQVRAAVLSLVTLPTTDGSAATGLDLCFELPSSTSAPPSMPSMTLHFDGADMVLPADNYMMSLSDPDSDSSLWCLAMQNQTDTDGVVVSILGNYQQQNMHILYDVGKETLSFAPAKCSTL

SEQ ID NO: 567 - protein, 278 aa, Zea mays
MGMGPLDNAASAALEAAAAAAAAPSRAGSYAVLQCGEDSEYVRQKYGGYFAVFRALLEEDGERWRVYSAVRGELPADAEAAGFDGFVISGSCADAHGDEPWILALVDLTRRVHAAGKRVLGVCFGHQILCRALGGRTGRSAKGWDIGVSCIHPTAAAARLFAPLKLPVHMPVIEFHQDEVWELPPGAEALARSDKTRVEMFRLGGRAMGVQGHPEYSKDVLMSIADRLLRHNHILDCQVEVAKTSFDVRQPDKELWSKVCRGFLKGRLQSSQQQGVAL

SEQ ID NO: 568 - protein, 148 aa, Zea mays
MAATAYSVALLGGARLPAAPRSALLPRRSVCQLRFQDAPRLSLLRAKAASEDTSASGDELIEDLKAKWDAVEDKPTVLLYGGGAVVALWLTSVVVGAINAVPLLPKILELVGLGYTGWFVYRYLLFKESRKELAADIETLKKKIAGTE

SEQ ID NO: 569 - protein, 267 aa, Oryza sativa
MASLLSLPRLTLTPTPRANPGRRSARPTPASITCGPRDNRGPLQRGRSLSTEAILAVQSLKRLTSSDRSPAAAAAAASTSLGRLLKGDLLAAMAELQRQGHWSLALAALHVARAEPWYRPDPALYATFVSSSPATEDGAAAVDALVEAFLEEKERGGGFVDGEEDVYKLTRLVRALVAKGRARAAWRVYEAAVRMGGCEVDEYMYRVMARGMKRLGFEAEAAEVEADLREWEARISPPARDVLDEMRAREEQHNCGLTVNLIIVLET

SEQ ID NO: 570 - protein, 241 aa, Oryza sativa
MRTSLVRFFLTILANTFLHSPYQHSSPPESSQCSTPLGSESGGKRRRGRRGKQKGLGEVVSVHEKKEAKTSPFPLLLLCRATRRRITEVYDEMYQIVRAKRNDTGKVHEFINCLVDARNELLHKSEMVQRSCRIKKALLSNPCSRRANSYDRLCEQVHKLEAEHKRLKKDADIYNYIQEQLQMSESYKLLIELSALVEKAEREDALATEAAEMTFEELLAQEKSDAAFWQRHRKLTSILPK

SEQ ID NO: 571 - protein, 466 aa, Oryza sativa
MMHCHLAYACGWPTAASGPHPVASPRNKTGATRASENGQESGVLASLSISSASRRATPRHATPPPTPALRPIRSRRAATQQAGMSLTGHGGGGGEGTAPALELLDEYWFFSNTLGKNGRHGGGGGGGGRPPMLPRSPSTVSGGGGRPGKGVEAVGTSRLFASAGRRLLRTPSLPSPRVGMEIAKEDEEVVEEAPAAAGGGGDQEADAEDDDLNWSSIYEGVLRTRIAEEGVRSALRRAPSMPVTSSATGRDDDARREDTAAAATGSTTPGMSRLRHAHSTLERHCRSHTPTTKADRTPRTSGGGDGGHRRQPPRRELRSFSANQQPLVRHQSLFHDKKWKSSSDLESIEVQGFRDLGFVFDQEELRESLADVLPGLRGKPTPTGSGSASDNDDANTATTATGSDAVAAVRRPYLSEAWYHVRRPAPRSPAAAAMRLQQADARSAAEMKDQLRMWAQAVACNVRQEC

SEQ ID NO: 572 - protein, 446 aa, Oryza sativa
MAAAAAVAAVAAAAAAAEPTVSKSAPELVPPAGPTPRGALPLSSIDKTAAVRVSVDFIQVFPPATGGPAADGQEDAVARMRDGFARALVPYYPVAGRIAEPAPGDVVVDCTGEGVWFVEATASCTLADVNNLERPLLIAKEHLLPRPPPEEKLEDLILMAQVTKFTCGGFAVGICFSHLVFDGQGAAQFLKAAGEMARGLPAPSVPPVWDRDAIPDPPKPPPRGPPPSFTAFNFVTQVVDVSPESIARIKEDFSASPTGGGQACSTFDAVTAVVFRCRALAASSLPDDAEVRLGFAASTRHLLAGVLPAVDGYYGNCVYPVGIARHRGAVRGAALAEVVGVVREAKEALAARFTDWLGGGGGGDHYDVPLDYGTVTVSDWSRVGFNEVDYGFGEPGYVFTLNDDVNIVASVIYLRPPAPKRGIRLMLRCVEEPHAAAFADELAKFA

SEQ ID NO: 573 - protein, 58 aa, Oryza sativa
MASLKAVKPAGLAKEPAAKLSETATKPAAAKGGVKKAEQKPREPKKKVKSSKPAAAKN

SEQ ID NO: 574 - protein, 316 aa, Oryza sativa
MVETTVDVMIRKGTNMRLESYEFLSDFKHGNAVVLLDYTESGNKGSFIVTQVDGSFTAWFETGGKELCFDSSGHITQLFKDMIVDFYDLTWSLHKRHLVMQNFVKENIYVKIFDGVPKLMILLTEVKLVDQLGPFKQDWSHVQGLMTWCKEQSGLKMDFLTKSFYDFIGSTDCTVIKLRNYPDDWDEKKKGDYLLTLAEVNHGVLKDKLKSRDDFHWPFVKLPKLEQNLPPMLQQILSGERQMKRKFDVTFFCDYINLLRNSYKKFNELPENVKALCINQDGFIKLIDGWSPEFWTKIYEKIGWPDYNIWKWPCKK

SEQ ID NO: 575 - protein, 420 aa, Oryza sativa
MGYVLSAVARVLEQPTAWGAACEMAVLAGPLWAAALLGLLLGWAWRPRWAAGLVATADSHPAPLTFATLEFWRTQLPARIRAPLAQYVGAAGPAPPPQQEDDSSLLGSSEMANEQLAVGKDDLMNLWRLVEGRDGGPAWIKMMEKALPAMTYQAWRRDPQTGPPQYQSSTIFENANPEEVRDFFGDDQFRMSNKWDDMLIYHKTLEECQTTGTMKVHWVRKFPFFCSDREYIIARRIWKLGGAYYCVTKGVPCSSIPRRNKPRRVDVYYSSWCIRPVESRRGNSGLTACEVLLFHHEDMGIPYEIAKIGIRQGMWGCVKRIEPGLRAYQKARAAGEPLSQSALMAHINTKVGDNFVRGLESNDDQSDIVEAEEKPAKNRVARFLVLGGAVALACTLDQGLLTKALIFGVARKFVGQRNTL

SEQ ID NO: 576 - protein, 252 aa, Oryza sativa
MAMTPQLAFSRMPPGFRFQPTDEQLVVDYLQRRTAAQPCVTPDITDIDVYNVDPWQLPAMAMYGSDHDRYFFTMAAREAQARRTTPSGFWKPTGTKKTIFVVAGGHEVPTAVKRRFVFYLGHHQPSGSNNNNKTSWIMHEYRLMNSPRAAVPSSSSVNRLPTDDLTEEMVLCRISNKDLPKPPFIHNSLLQFSSVGLNGDGYNYLILDHLEPPAMEYPNVGIGNVDDAAAGTDDPGDLDEEIDDSMQRNHGG

SEQ ID NO: 577 - protein, 1601 aa, Oryza sativa
MEAARGARSRVPVAAVVAVVLVAGLAAGGSAAEIRRQKNVQVALRAKWAGTPLLLEASELLSKEWKDLFWDFIDHWKELDKASECLTAKCCVHKIVEDARSFLSEPLASIFEFSLTLRSASPRLVLYRQLAEESLSSIPVKDGTLEQTSGPSTGENFHEAVKGTCCWVDTGSALLFNSADLRKWLDGLGKLAVDSTQQPELFEFDHIYPQSNITAPIAIFYGAFGTKCFKELHVHLAEASKQGKVRYALRHVLPSGCQATSSFCGSVGAIDAVTLSGYGVELALKNMEYKAMDDTAIKKGVALEDPKTEDLSQEVRGFIFSKILERKPALNAEIMSFRDYLLSSTVSDTLEVWELKDLGHQTAQRILHASDPLQSMQEINQNFPSIVSSLSRMKLDDSIKDEIIANQRMVPPGKSLMALNGALINIEDLDLYLLMDMVHEELSLADQFVKLKIPGSAVHKILSAAPPTESNSFRVDFRSSHVHYLNNLEEDALYKRWRSNINELLMPVFPGQMRYIRKNLFHAVYVLDPASTIDMVLSLYQDSVPIRFGIILYSSRLISVIEENDGNLPVNNGSKTEEDISILIIRLFLYIKETYSTQLAYQFLSNIHKSQNSGDDYNEESVEAHHVEGAFVDSLLSSAKSHPQDVLLKLQKENMHKQEAEESSRFVHKLGLYKLQCCLLMNGLVHESSEDATMNAMNDELPRIQEQVYYGHIQSHTDVLEKFLSESSYKRYNPSITGKSTENKRFVSLVVPYHQGDSTLHDITYLHSHGTTDDAKPVTHLVAVDISSKIGIKLLHEAIRYLFVSDLDEPIFVLSYKEKVLDFLHELCKFYEGQHVPSSGVGDKISTMREKVYSIAAETGLPVDNYKAWFTSYSHDAVLRGMNKLSDFLFGKLGLEFGSNAVITNGRLLQSDLSAASVVHDFMLFLTFQVFVVNEGDSFLTDDLGLLESMEYELRTKHIYEIIEEIEWTGVDPDDLTSKFYSDVAMLISSSMSIRERPSERAHFEILHAEHSAIKLNGMSSGVHIDAVIDPLSPAGQKLAPLLRILWRQIQPSMRIVLNPISSLADLPLKNYYRFVLPSMDDFSSTDYSVHGPKAFFANMPLSKTLTMNIDVPEPWLVEPVIAIHDLDNILLENLGDVRTLQAVFELEALLLTGHCKEKDRDPPRGLQFILGTKRRPHLVDTLVMANLGYWQMKVSPGVWYLQLAPGRSADLYELPSKLIAIDSLRGKLMHIEVQKRGGKEHEDLLNADDDNHFQEKMDNKGWNNNLLKWASSFISGDSSSKKKDEKISDLKATRQGETINIFSVASGHLYERFLKIMILSVLKQTQRPVKFWFIKNYLSPQFKDVIPHMAQEYGFEYELVTYKWPTWLHKQKEKQRIIWAYKILFLDVIFPLSLRKVIFVDADQIVRADMGELYDMNLKGRPLAYTPFCDNNKEMDGYRFWKQGFWKDHLRGRPYHISALYVVDLAKFRQTASGDTLRVFYETLSKDPNSLSNLDQDLPNYAQHTVPIFSLPQEWLWCESWCGNATKARAKTIDLCNNPMTKEPKLQGAKRIVPEWVDLDSEARQFTARILGDNPESPGTTSPPSDTPKSDDKGAKHDEL

SEQ ID NO: 578 - protein, 419 aa, Oryza sativa
MPSPSHLAGALDAARPFLRGEEEQVDPALPKLAAVLRAAGAGECWHKHGTFLAHLLDVHRILRLWGAPDAVARCGLYHSAYSNSYVNLAIFEPDVGRDHVRPIVGAAAERLVHLFCVVPRHQLIHDDLLFHYADQDLVADLAASEASLQDARRGLFHHDGEAWRLKIQRLLPPHGITVKHIRTGEDVALSRRIAATFLLMTMADFSDQLFDWQDRLFDNTNGRLEFSGNTWTSLWPGTGKPGLWTASISRMGALYSLIVREEEIHIAQRKHSNNGQEDDRDEDIELVIPPVFNGCTQVLTADDQKAARDLYWDAVCSGGEDETDWRKVEEILRRCIGRNPFVGEPHLVLAQVLLNMEMYEEAEEQIEAGVKLLLEWGSSWDKRMPWEAWVSWGRAMLIKAKDKDWPHTSFGILSIGLVK

SEQ ID NO: 579 - protein, 251 aa, Oryza sativa
MGVAVTMASYAAVLRPHASSTRTPRGPRRPAGAVPPTPRRAALRATTRSPPAVAATPPPRERVQQQQQPGDGQTTTRLYSLAPCPLLLAALLPGAEPVRAVFEPFVELVKTWGLPGWLVHWGHPGNMAVVLFAMGGYGTYLGFRIKLSDDPEEKAKAKDLHPKLLAGMFFFFAAGATGGVTALLTSDKPIFESPHAVTGIIGLALLTIQSILPTLFEGNPSLRNAHGLLGSGIMTLFLIHAAFGLQLGLSF

SEQ ID NO: 580 - protein, 820 aa, Oryza sativa
MARGGGGGCCPPMDLMRSEAMQLVQVIIPTESAHLTVSYLGELGLLQLKDLNADKSPFQRTYAAQIKRCGEMARKLRFFKEQMSKAGISTSAQLTEISLDFDDLEIKLGELEAELAEVNANNEKLKRTYNELLEYSTVLQKAGEFFYSAQRSAAAQQREMEANQSGESSLESPLLEQDTLTDASKQVKLGSLSGLVPKEKAMAFERILFRATRGNIFLRQESVDEPVTDPVSGEKVAKNAFVIFYSGDRAKAKILKICDAFNANRYPFPEDVARQLHAVQEVSAKISELKATIDMGLAHRDNILKNIASEFENWNRLANKEKIIYHTLNMLSVDVTKKCLVGEGWSPVFATTQIQDALQRATLDSKSQVGSIFQVLNTTESPPTYFQTNKFTSAFQEIVDAYGIAKYQEANPGVFTIVTFPFLFAVMFGDWGHGICILVSTLYLIIREKKFASQKLGDIMEMMFGGRYVIIMMALFSIYTGLIYNEFFSVPFELFGKSAYACRDPSCGDAATEGLLKVRRTYPFGVDPVWHGSRSELPFLNSLKMKMSILLGVAQMNLGIVISYFNAKFFRNSVNVWYQFIPQLIFLNSLFGYLSMLIIIKWSTGAKADLYHTMIYMFLSPTDELGENQLFPGQKTVQLVLLLLALVSVPWMLIPKPFFLKMEHERRHQGQQYAMLQSTDDSVVAEMGHHNGSNHHEEFEFSEVFVHQLIHTIEFVLGAVSNTASYLRLWALSLAHSELSSVFYDKVLLLAFGYNNILIRIAGITIFICATVGVLLVMETLSAFLHALRLHWVEFQNKFYEGDGYKFAPFSFALISEEED

SEQ ID NO: 581 - protein, 177 aa, Oryza sativa
MASQSTKPAQAAAEPSPPAATAAAGEAPPAPNPASAATPAQNPTAAAGAAAGGATDLEKKMRRAERFGTAVVMSEEEKRSSRAERFGTGSSNEKAEEQKRKSRAERFGLASSSADEDAKKKARLERFGQSTNVDKGEEEKRKARALRFAETSSGPSQENGKDSSKPTQDAATVAGTA

SEQ ID NO: 582 - protein, 1498 aa, Oryza sativa
MTKLAYLHEPGVLHNLACRYGINEIYTYTGNILIAVNPFRRLPHLYDVHMMEQYKGAAFGELSPHLFAIADACYRAMINEQGSQSILVSGESGAGKTETTKMLMRYLAFMGGRSGTEGRTVEQQVLESNPVLEAFGNAKTVKNNNSSRFGKFVEIQFDKYGKISGAAVRTYLLERSRVCQVSDPERNYHCFYMLCSAPPEDVKKFKVGDPRSFHYLNQTNCYEVANVDDAREYLETRNAMDVVGIGQEEQDAIFRVVAAILHLGNINFSKGQEIDSSKLRDEKSVYHLKIVAELLMCDEKALQDSLCERVIVTPDGNITKPLDPDSAALSRDALAKTVYSRLFDWIVDKINNSIGQDPDATNIIGVLDIYGFESFKINSFEQLCINLTNEKLQQHFNQHVFKMEQEDYTREEIDWSYVEFVDNQDVLDLIEKKPGGIIALLDEACMFPKSTHETFAQKMYQTYKAHKRFSKPKLARTAFTINHYAGDVTYQADQFLDKNKDYVVAEHQALLNSSRCPFVANLFPPLPEETSKQSKFSSIGTRFKQQLQALMETLSTTEPHYIRCVKPNAVLKPGIFENFNVLNQLRCGGVLEAIRISCAGYPTKRTFDEFIDRFGMLAAELVDSSDEKAACAAICDKMGLKGYQIGKTKVFLRAGQMAELDARRAEVLANAARLIQRRIKTHLTRKEFINLRKASIQSQKFWRARLARIFFEHMRRNAASIRIQKHARTHSARKSYLQMYESAIVIQTGLRAMAACNEHRFRRETKASIIIQTRWRQHKAYVDYKKQKRATLILQCLWRARIARKELRKLKMEARETGALKEAKDKLEKRVEELTWRLDVEKHLRIDLEEAKGQEISNLKSVLQEMQEKLSEAHAAIEKEKEDAKLAIEQAPPKIVEVPVVDNAKVELLTRQNKELEDELVTFRTKAEDLEKRLLEVQKESDELSREILEKDSKLNQLQEMIERLETNLSSLESENQVLRQQSLLASADDDKSKQIESLESKIAILESENQLLRSKSSVAVQAVITPEVIQPSAMEGLVNRYQLEEHKILIEEVVVPPIKNLSKQKSLTDRQQENHDVLIKSLAEDRRFDNGRPAAACIVYKSLLHWHSFEAEKTNIFDRIIHTIRSSIEHAESSTELAYWLSTTSTLLYLLQNTLKSSSSAGKGSNRSRTTTGNLFSRMVQNARSSSLGSGISSGYSGMVGRPDTASKVEAKYSALRFKQQLTAYVEKIYGMIRDNLKKEINPFLIMCIQAPRAVRVRSSRGSLKSVHSNSLSRQTSSVHWQSIIKCLNHTLETMNNNHVPPMIIRKTFNQAFAFMNVQLFNSLLLRRECCSFSNGEFLKAGLQELEQWCSVTTEEYAGTSWDEFQHIRQAVGFLVLHQKTHKTLEEITDELCPVLSITQIYRIGTMFWDDKYGAQGLSQEVIGKMRTMATDDSITTPNSSFLLDDDSSIPISLDDIARLMLDIDLSDVEPTPLLRQNSQFHFLLQHHATQTDGIVC

SEQ ID NO: 583 - protein, 570 aa, Oryza sativa
MESINVAPGTTATPRMAPPPPPPCITNLQSTLRYNNLLLHRKTKGWKPRNVSCRVDRRDVLLGISGAAAMVATQGGGGALAAPIQAPDLGDCHQPVDVPATAPAINCCPTYSAGTVAVDFAPPPASSPLRVRPAAHLADRAYLAKYERAVSLMKKLPADDPRSFEQQWRVHCAYCDGAYDQVGFPGLEIQIHSCWLFFPWHRMYLYFHERILGKLIGDETFALPFWNWDAPDGMSFPAMYANRWSPLYDPRRNQAHLPPFPLDLDYSGTDTNIPKDQLIDQNLNIMYRQMISGARKAELFMGQPYRAGDQPEPGAGTVESVPHNPVHRWTGDPRQPNGEDMGIFYSAARDPVFFAHHGNVDRMWHIRRGLLFPGDTDFTDPDWLDASFFFYDEEARLVRVRVRDTLDPSALRFTYQDVGLPWLNAKPSTGAASTPAPAAGAFPATLDKTVRVAVTRPRASRSREEKEEEEEVEIPDHSTYVKFDVFVNAPESGDGAATCAATCAGSVALAPHGIHREGQLSPRKTEARFGICDLLDDIGADGDKTIVVSIVPRCGCDSVTVAGVSIGYAK

SEQ ID NO: 584 - protein, 86 aa, Oryza sativa
MAGAAKASWMVAMSVGAVEALKDQGGLCRWNYALRSIHKAAKANAAGVSQGKKLPASAAAVAERRRAEKAEEGLRTVMYLSCWGPN

SEQ ID NO: 585 - protein, 281 aa, Oryza sativa
MGELASSPPPAAVLPVVFVDGDQTVDLGTVTVQPSLGVRKLQAVVADRVGLAPQQILASLARPRRARRVPLEEGTDLAAAVAREGSGCYVLAALRRSRRERRGGRSRREKKAAAAAAAAGAAPAAPTQERTILKRLPAMDLASLASTPSPAAAAMFGVWDYEAQLQELQRQREWYLMHTAAADPYFPLAPEREDPPFWSAQPLLRQGTPSSCPECEAAAAMMREPGFHWCVRDAVTVGFRSLVGPIERPAKKSPSPSPSPPPLPPTPGRLPPSFVGMMPVY

SEQ ID NO: 586 - protein, 203 aa, Oryza sativa
MDHHQHHEQQQQRMVEMRMGMAMGEAYVGGGEVVAREAAAQALGAVVQLHFDKTLEKKRAADAQKQELWRLFLAFFLFLAILLSAVAQSPPSRLQCRHLWAPAGLLSLAHLAFYAAVAHHLRCLNGFRYQRRCHKLTLALAADRLRMLKSGGDVVAAADVEVPYQEPPESYLAKFKRSWAIHFAFLITTFAFSVAAAVAILCF

SEQ ID NO: 587 - protein, 308 aa, Oryza sativa
MVVPVIDFSKLDGTAAERAETMAQIDNGCEEWGFFQLVNHGVPKELLDRVKKVCLESYRLREAAFMESEPVRTLEGLMAAERRGEAAAPVDDMDWEDIFYLHDDNQWPSNPPEFKETMREYRAALRGLAERVMEAMDENLGLDKGRMRRAFTGDGRHAPFFGTKVSHYPPCPRPDLITGLRAHTDAGGVILLFQDDRVGGLQVLRGGEWVDVQPLADAIVVNTGDQVEVLSNGRYRSAWHRVLPMRDGNRRSVASFYNPAFEATISPAVGAGGEYPEYVFGEYMDVYAKQKFDAKEPRFEAVKAPKSA

SEQ ID NO: 588 - protein, 369 aa, Oryza sativa
MGNPPELYYRILNISRDTSPKEIRAAYKTLVRQWHPDKHPPSSKNEAEARFKAITEAYEALLDQQENRAAFGARGNVDAVDEKGDRTAAAGGGGGGGATTTGGVGGDGRAPSSAMPRAQGAEKKKAPSAAAPPPTRTAPCGTPAREFKKPVLYSSTGLGEAAGGGRRRAFAEFSSCVVRKAPPLERRVECTLEELCSGCKKEVKYTRDVVAKNGLVSKKEETKTIRVKPGWKKGMKVTFEGMGDERPGCLPGDAVFTISERKHKVFKRKGNDLVLKAEVPLVSALTGWSFSFRLIGGEKMSFTFRDEVISPGYEKVVAGEGMPVVAAGGGGEKAAAARGDLRVKFDVVFPKNLTGEQRAGLASILRACP

SEQ ID NO: 589 - protein, 397 aa, Oryza sativa
MMNGSNGSQGYHVNGKQVQSVVPSIQNNGPRHRPLTLMRRCRGMLCLVIMPLTAFMMMVYLSPVTTFLIRLFSVHYSRKSTCFLFGMWLAMWPFLFEKINKTKFVFSGETVPPKERVLLFANHRTEVDWMYLWDLALRKGRLQCIKYILKKSLMKLPIFNWAFHIIEFIPVERKWEVDEPLIRSRLSELKNPKDPLWLAVFPEGTDYTEKKCIKSQEYAKEHGLPILNNVLLPKTKGFHCCLQELRDSMDSVCDITIAYKHRPPTFMDNVYGIDPSEVHIHVKIIQVSDIPTSEDEVADWLIERFKLKNKLLSDFSALGHFPNEGTEDDLSTLKCIANFVAVISTTTVLTYLTLFSSVWFKIFVAFSSAFLTFATLYSIHLPQLICSPEAGTHAKKS

SEQ ID NO: 590 - protein, 1157 aa, Oryza sativa
MEDVCEGKDFSFPAEEERVLKLWSELDAFHEQLRRTKGGEEFIFYDGPPFATGLPHYGHILAGTIKDVVTRHQSMRGRHVSRRFGWDCHGLPVEFEIDKQLGITNRQQVFDLGIGKYNETCRGIVTKYVAEWEAVVTRTGRWIDFKDDYKTMDINFMESVWWVFSQLWEKDLVYKGFKVMPYSTGCKTALSNFEAALDYRTVPDPAIMVSFPIIGDADNAALVAWTTTPWTLPSNLALCVNANLVYVKVKDKSTGAVYVVAESRLGQLPAKAKSSGKKQAPSKGGTAEVVQGGLDTEAYELLAKFPGSSLVGLKYKPLFDFFLELQETAFRVIADNYVTDDSGTGVVHCAPAFGEDDHRVCLAAGIIEASGLVVAVDDDGCFIEKISEFSGRYVKEADRDIINSVKDKGRLVSKGSIEHSYPFCWRSGTPLIYRAVPSWFVKVEKIRDQLLECNKQTYWVPDYVKEKRFHNWLEGARDWAVSRSRFWGTPLPLWISQDGEEIVVMDSIEKLERLSGVKVNDLHRHYVDGITIPSSRGPEYGVLKRVEDVFDCWFESGSMPYAYIHYPFENRELFEKNFPGNFVAEGLDQTRGWFYTLMVLSTALFGKPAFKNLICNGLVLAEDGKKMSKSKKNYPSPVEVIDEYGADALRLYLINSPVVRAESLRFKRSGVFGVVKDVFLPWYNAYRFLVQNAKRLEIEGFSAFSPIDQASLLKSSNVLDHWINSATESLVVPYLVKYIDNLTNIYVRFNRKRLKGRTGEEDCRVSLSTLYHALVTTCVAMAPFTPFFTETLYQNLRKVSTKPEDSIHFCSFPSTTGERDERVEQSVNRMMTIIDLARNIRERHNKALKTPLKEMVIVHPDNEFLEDITGKLKEYVMEEMNVKTVTPCNDPMLYASLRAEPNFSVLGKRLGKDMGKVSNEVKKMTQEQILAFEQSGEISFFGHCLKLDDIKVIRQFKRPANVAENEIDAAGDGDVLVVLDLRADQSLFEAGVAREVVNRIQKLRKTAQLEPTDLVDVYYKPMDDGKNTLVEIVQSQDQYIRDALGNPLIPKMAAPPDAVMICEESHNVQDMSFVIYIARVSPVVTDDLLVHAAGNREHFDALKVYLLSRSISRLKNEFQAGNGKITVDFIEGFPPIDLQLGKHVFLSTGDFYLATRS

SEQ ID NO: 591 - protein, 1808 aa, Oryza sativa
MAPRGDGKKGKGSGKPDQLRPKSKQFKKHSRKEEVAGEGEQQERPAAPDSAAVLAAAAADDGDFPRGGRSLLSRDEVAEARAEADADFEREERRGKRKRKGASSSGAGGDDDLGSLFGGATTGKLPRFANRVTLKNISPNMKLWGVVIEVNQKDIVVSLPGGMRGFVRSEEVHDITSQETRKVLTAQVKSIEDHGYILHFGVSSFSGFMPKADRESAKIESGQLIQCVVKAIDKAREIVHLSSDEDLLSKSIIKDLKGLSIDHLIPGMMVNARVHSVLENGVMLSFLTYFTGTADIFNLSNSFPSGSWKDDYIKNKKVNARILFVDPSTRAVGLTLNQQLLRLKVPSINVKAGEIYDKARVLRMDKRAGLFLEIPSPTPSPGFVSIHDVSDKDVKNVEKKFKEGSMARVRVLGVRHLEGVAIGTLKESAFEGSVFTHADVKPGMVFSSGVKALCPLPHMSELEHVVKPPKKFKVGVELTFRVLGCKSKRITVTFKKSLVKSKLDVLASYADAKIGLLTHGWITKIEKHGCFVKFYNGVQGFVSRSELGLEPGTEAENVYHVGQVVKCRVVSVVPASRKINVTFLISTNRVIQADTPKVGSIVSGVVERLTPAAVVVSVNGFCKGSILNEHLADHRDVEGQNLVLSAKQSLINCASDIPSEISQMHAGSVFHGYVCNIIEAGCFVRFLGHLTGFSPKDKAVDRSVEKLSNAFYVGQSVRSHILNVNVESARVKLSLQQSMCSSADCSFVQGYFLLDQKITELKYSDPSSSFHDWLNTFAIGNLVEGEVGAIEEYGVILNFQSHPDVVGLIEHHQLGDSSVEVGSSVKGLVIDLSDGVVNISLKSELVRSVSKVGKKKKRHRAAVMDLELHEEVNAIVEIVKESHVVLSIPEYNYAIGFAPLMDYNSQLLPCCNYENGQRITVVVGSMPSSGPTGRLLLLPKASGKNSSVSSSKRAKKKSDFKVGSLVEAEIIDIKPLELLLKFGSNLHGRIHITEVFDDDSNDCPFSELQIGRSVQARIVAEAEHSGKGGKNSKWELSIRPSLLQGGLEDFTPPKAELRHSIGGIVHAYVVKVDREWIWLTVSRDVMAHLFILDSSAEPGELEKFQQRYSVGQAVKGRIIGVNREKRLLRLKALDSQSLPENIGETQKPLSATVEHTKQGDIIGGRIQKILPGVGGLVIQIGPHLHGRVHYTEIVDSWVQEPISGFHEGQFVKCKVLDVSRSSEGSVRVDLSLRSSMCANSNQSRRLFDDSRIRTSRFEKINDLCPGTEVKGYVKSVNSKGCFIMVSRTIEARIILSNLSDEYVENPQNDFPVGLLVHGRVLSSEPQSGKVEVSLRKNTGSKSQKSDDISYSDLHVGDIIAGQVKRVESFGLFVTIQGSELVALCHVSELSDEPVLDIHSCHKAGDKVKAKILKIDEERHRVSIGMKKSYIGPDSTGDTSDDEDDEIVPEEISRNPVMGRDRNHALVLPKPESRASVLPLQVSLDESEGSDQENDNKGQEIANGTEVDDKKSNKRLKEKARKQRELEISALEERALQRDIPQTPDEFEKLVRSSPNSSFVWINYMAFLLDLADVDKARAVAERALRTINIREEEEKLNVWVAYFNLENEYGSPREDAVKKIFQRALQYCDPKKVHLALLAMYERTEQYTLADELLDRMTKRFKTSCKIWLRCIQLSLKQSKDVECIKLIVKRALLSLPQSKRRKFLSQTAILEFKCGVPEEGRSRFELILREYPKRTDLWSVYLDQEIRLGDTEIIRALFERVTCLSLPPKKMKFLFKKYLEYEKSQGDEERIEHVKQKALEYVQSSLA

SEQ ID NO: 592 - protein, 163 aa, Oryza sativa
MELEVGEETEEVGVEVACECCGLTEECTAPYIAGVRARYEGRWICGLCGDAVGEELGRASPPISPAEALDRHAFVCGAGRRSTAPPSPAESADDLISALRHLLRRRLGSPPLPPPRKVRSTPSSPRRDVPTSATAIVSVDTGGGGGAGGALARTESCFAALVE

SEQ ID NO: 593 - protein, 197 aa, Oryza sativa
MASAVVAKPPAAAPASRRRCFVFVERAAAAAVGVNAAIAAVDDHRPVPAAAAAAMDDVVGRVARPARPSARAIMEGTHKQISSGGASGGYCTVPWCSICTGNNPFAIAEFLLCCNLCGVPLAGRPSFIYIGEKAFCKEECRSRYVVEEALREAREEKRRAAAAAAASPEKKKEAAAARKGGEECREGSIFFICADDL

SEQ ID NO: 594 - protein, 394 aa, Oryza sativa
MQHLHGDVLESAVERVPAPDLAAAALVSREWLRAVRAALRRRMLRLPWLVVHVIHLRGQRRLAAAYDPRSGAWLAVPTAPPARHGATSPPQPHSHVRLMRGASGDRVCALSLSGLAVARDALGMDDDALVVALKAPGVWRVDPVLAAVGDRVVAMGGACRLALGDGEDTSAVEVHERGGWTHCGAVPTALRESAAAAATWLSTAATDQRVYVADRATGTASWFDPAKQQWGPTSRLRPDATVSTWGLAAGRAGAEKIILFGVKHADSRVVIRSWEVDGDSLSLSHGAAAAHDTMPSEMSERLFPHGDDGEEETSSPSIGVCGNTAGGYVYNAAVPATGAVLYELRRGGVEGGGVERWAWVACAPVVAEAEALGRVILACSPVGLHELADERLAH

SEQ ID NO: 595 - protein, 297 aa, Oryza sativa
MTTSMEKPRQVVRKFLARPQHEGVGAVVRRSIGRFELRYFDPFLVLDEFSVSAPAGFPDHPHRGFETVTYMLEGAVTHEDFEGHRGTIKAGDVQWMTAGRGIVHSEMPAGPGTSRGLQLWVNLSSHNKMIEPGYQEIQSKDIASTTSDGVTVRVIAGQSMGARSPVRTRTPTMYLDFTVRPHAAARQPVCATWNAFAYVLEGEGVFGGGGGDKAGAHHLLLLGQGDGVEVWNRSDKPLRFLLIAGEPIGEPVAQLGPFVMNTEEEIDMTINDFEFSINGFEKAKHWKSQALVALGLE

SEQ ID NO: 596 - protein, 335 aa, Oryza sativa
MASLLRLQALALNLTAPRRLPFLPLRVTTATAPLAGRLSTAAASGSSPESPASEPDLDSGLYLVATPIGNLEDITLRALRILKCADVILSEDTRHSGKLLQHYNIKTPLLSFHKFNEREREPNILKRLHEGEAVALISDAGTPGISDPGMELARLCATEGIPVIPIPGPSAAIAALSASGLPTDEFTFVGFLPKHARSRKERLEISACQAATQIFYVPPHGIHQFLSDAASSFGDSRSCVIAREITKLHEEFWRGTIGEANEAFATRQPKGEITVLIEGKLISADETPSEDFLEHELRELMTQGHPLSAAVKMVSEATSAKKKDVYALALRLFGK

SEQ ID NO: 597 - protein, 179 aa, Oryza sativa
MLADASSFIWDTFEQPGDGGDRKPVDAVTLTVEDIDGVAFTSGDGIHLSARYVGGYSAAGDVRAEVTGVLYHEATHVWQWDGRGGADGGLIEGIADFVRLRAGYAPPHWVQPGQGDRWDQGYDVTARFLDYCDSPAVVQGFVAQLNGKMKDGYSDDFFVQISGKTIDQLWQDYKAKYGG

SEQ ID NO: 598 - protein, 74 aa, Oryza sativa
MIIPVRCFTCGKVIGNKWDLYLDLLQADYTEGDALDALGLVRYCCRRMLMTHVDLIEKLLNYNTLEKTETTAGN

SEQ ID NO: 599 - protein, 169 aa, Sorghum bicolor
MTPRSHLRRAVASRDAALAASSFDHGWPRGRHSTAEPPRCPATPAPATADLKPVASTSALRSRDHRARRRAPTRPRPRHGHRVKLLSLSSPSQTPVSSPRPKFSPSCVHHAEIGLRAVFYTLQGGCALGAPLPHGWTTLLPSANPWTRCSKPQPLPTSRSKPQLVSGRS

SEQ ID NO: 600 - protein, 1001 aa, Sorghum bicolor
MAMAPSTAAATTLLLPVFLLIATATHCTAADSSSSPDAAALLNLSAALADPSGYLSTHWTPDTALCSWPRVSCDATDTRVISLDLSGLNLSGPIPAAALSSLPHLQSLNLSNNILNSTAFPDEIIASLKSLRVLDLYNNNLTGPLPAALPNLTDLVHVHLGGNFFSGSIPRSYGQWSRIRYLALSGNELTGEIPEELGNLTTLRELYLGYYNNFTGGIPPELGRLRALVRLDMANCGISREIPPEVANLTSLDTLFLQINALSGRLPTEIGAMGALKSLDLSNNLFVGEIPASFASLKNLTLLNLFRNRLAGEIPEFIGDLPNLEVLQLWENNFTGGIPTNLGVAATSLKIVDVSTNKLTGVLPSKLCAGERLETFIALGNSLFGDIPDGLAGCPSLTRIRLGENFLNGTIPEKLVTLPNLTHVELHDNLLSGELRLDGENVSPSIGELSLFNNRLTGQVPTGIGGLLGLQKLLLAGNRLSGELPTEVRKLQQLSKADLSGNLISGAVPAAIGRCRLLTFLDISSNKLSGSIPPELASLRILNYLNVSHNALEGEIPPAIAGMQSLTAVDFSYNNLSGEVPSTGQFAYFNGTSFAGNAGLCGAFLSPCRSHGVATSGFGSLSSTSKLLLVLGLLALSIIFAAAAVLKARSLKRSAEARAWRLTAFQRLDFAVDDVLDCLKEENVIGKGGSGIVYKGAMPGGAVVAVKRLPAIGRSGAAHDDYGFSAEIQTLGRIRHRHIVRLLGFAANRETNLLVYEYMPNGSLGEVLHGKKGGHLQWATRFKIAVEAAKGLCYLHHDCSPPILHRDVKSNNILLDADFEAHVADFGLAKFLRGNAGGSECMSAIAGSYGYIAPEYAYTLKVDEKSDVYSFGVVLLELIAGRKPVGEFGDGVDIVQWVRMVTGSSKEGVMKIADPRLSTVPLYELTHVFYVAMLCVAEQSVERPTMREVVQILADVPGSTSTSIDVPLVIEPKENGSPGEKKQEQQEGSHDSPPQQDLLSI

SEQ ID NO: 601 - protein, 114 aa, Sorghum bicolor
MSSSKHLHADTNFTSNCVVHRFSNKFRFPTRLNQHPSQPRIQMTHLQRILAPRSPAEAPNARRHLFKDVGAVDERVADDESFTAPGLIQDDMSIPTGSPPQPQTKRARSEICRG

SEQ ID NO: 602 - protein, 279 aa, Sorghum bicolor
MAQHRFQNLRIIDKTELRDIDATMSGNTVFATVPDTISDTFNHYDLAEAIQQQFQINIEVEDISRYNEGYFLRVHTQQARTNMLHRGFIIVRNYLIGLRPWNPEHGSTAVSLQTVLTSCPLNIHLATYIPLSDPYEHLTIHITGVPPHLCCNSLIHKLFHKICIIHSVNFISATTEYEISARGRVTMIPQTAHLGIRNLSGQSEVINIWQLSYQTFTDEMLGRQTPPGDRRSDLCGYSDIDTEQRLELVDSNGNNEATSRLQVASDTSTMDTSDNSIEE

SEQ ID NO: 603 - protein, 243 aa, Sorghum bicolor
MSPATASPERLVLGTTSALAPRPRRAAAEPRPWPRPADAAKHHCARLGRAPTSVSSFITTRGSAAVPSSLRSGLARRRRARCPRRVELRPRPAAWTPQPGRASASPPWESPRPRRLQPRRPSASTTVSTASPRAVMELTSSSRHAVDRATDAARRAPEQAPSPSTRCAPLPRPRQDIAMVTASAPAVVIATPTTTPCSSCHGDRELPFCWLPITTERAAAAAPPRAKLFSAAGEPPVPKCPPC

SEQ ID NO: 604 - protein, 90 aa, Sorghum bicolor
MHSLALAFGLVPPPAITLAVVVRVAHAWRSVRSGSRDLTMTVQGQGLATPAQGSGPSTQHLCDCHTVQPPHRCPTSPHVSISIWIFDGPT

SEQ ID NO: 605 - protein, 693 aa, Sorghum bicolor
MVALHAKQPTLRLLPAPTSHVIARPPTAAANVRLGAPPPPDVVLDCKRLDALMKSGRLSDALDLFDRMPRKNVVAWTTAISGCTRNGQPEAAAAMFADMLESGVAANDFACNAALAACAAAGAGALSLGEQVHSLAVRAGFAADAWIGSCLIELYSRCGSMWAAEEVFRRMEAPDVVGYTSLVSALCRNGDLARAVEVLCQMMRQGLQPNEHTMTSMLAECPRMIGEQIHGYMLKVMGSQSVYASTALIDFYSRYGDFDMAETVFENLDSKNVVSWCSMMQLCIRDGRLEDALRVFSEMISEAVEPNEFAFSIALGACGSVCLGRQIHCSAIKCNLMTDIRVSNALLSMYGRSGFVSEVEAVLGKIENPDLVSWTAAISANFQNGFSEKAVALLLQMHSEGFTPNDYAFSSGLSSCADLALLDQGRQLHCLALKLGCDFKVCTGNALINMYSKCGQIGSARLAFDVMNLHDVMSWNSLIHGLAQHGAANLVLEAFSEMCSSGWQPDDSTFIAVLVGCNHAGLVKEGETFFRLMTDRYGLTPTPSHYACMIDMLGRNGRFDEALHMIKNMPFEPDVLIWKTLLASCKLHKNLDIGKLATDKLMELSERDSASYVLMSNLYAMHEEWQDAERVRRRMDEIGVKKDAGWSWIEVKNEVSTFVARDTSHSDSASIYQMLAELVVVMQDTELDVHMQI

SEQ ID NO: 606 - protein, 690 aa, Sorghum bicolor
MASRATLLPLFLLLLAAPALATSGTIVFTTLGRSRYAFDIFALPLSPLSSAAASAELRLTDGVSVNYNGNFAPSSSSSEPPSLLFVSERNGSLNLYRTPVPLSASAARRREALEEEDDSPTLTPLLPWDPIALKDRPSLTPDGAHLVYVSTAEPAGSPRRSWAAVYSTSLASGATRRLTPRGVADFSPAVSPSGDWTAAASPGPRGWDGEVEDLRTDIYVFRTSDGSRRTLAVPDAGWPTWADDSTVFFHRRDGDGWYGVYRAKLSFTDDDDGGVAVASVVDRITPPGIHAFTPAASPGAPGLVAVATRRPGSDYRHIEVIDVSGGGGANAAYFDVTRAVAPRAHHFNPFISPDGERVGYHRCRGSGNGDSPLLLESIKSPAPDTFSLFRIDGSFPSFSHDGKRIAFVGLPGLFVVNSDGSGGRRRVFSGNAFPTTWDWKRKGVIYTSVGPDFASESTEVDVVAVSLGDDDDPKVSIKKLTVGGENNAFPSPSPDGKWVVFRSGRSGHKNLYIMDAEDGEASGIRRLTEGPWSDTMCNWSPDGEWIAFASDRHNPGGGSFGIYMVHPNGTGLRRVVHSTDGGRTNHPWFSPDSKTLVFTSDYAAVSAEPISNPHHYQPYGEIFTVNIDGSGIRRLTHNSFEDGTPSWTPHYLKPEDVGETLQASGTCAFEDCHWLNIAAQPDGLMCGKHG

SEQ ID NO: 607 - protein, 354 aa, Sorghum bicolor
MLWVDKYRPKTLDKVTVHDQVAQNLRKLVSEQDCPHLLFYGPSGSGKKTLILALIKQMFGAGAEKVKLENKTWKIDTGTRTLEIELAMLSSAHHVEMNPSDAGFQDRYVVQEVIKEMAKNRPIDAKGKRAFKVLVLNEVDKLSREAQHSLRRTMEKYSSSCRLILCCNSSSKVTEAVRSRCLNVRVNAPSEDQIVQVLEFIGKKENLRLPAGFAARIAAQSNRNLRRAILFFETCKVQQYPFTSNQAAPPLDWEQYVSEIATDILTEQSPKRLFAVRQKFYELLVNCIPPESILKKLLAELLRKLDADLKHEICHWAAHYEHKMRLGSKAIFHLEAFVAKFMSIYKEFLVATFG

SEQ ID NO: 608 - protein, 356 aa, Sorghum bicolor
MATQWFSNMVMDEPSFFHQWQSDALLEQYTEQQIAVAFGQGEVDHAVAAALSTMPQQQQQQQPAVAAEHRPRKAAKVNTSWDSCITEQGSPADSSSPTILSFGGHAAAAFAKPEPHPHQAPSAAAYYGAAAAAAKAPKQEVLDAAALPFPAKRSYDDMAEAANKAPAATTRPASQNQDHILAERKRREKLSQRFIALSKIVPGLKKMDKASVLGDAIKYVKQLQDQVKGLEDEARRRPVEAAVLVKKSQLSADDDEGSSCDENFVGTDASGTLPEIEARVSDRTVLVRIHCENRKGVLIAALSEIERLGLSIMNTNVLPFTTSSLDITIMAMAGDDFCLSVKDIVKKLNQAFKSSF

SEQ ID NO: 609 - protein, 136 aa, Sorghum bicolor
MDHGDRRSGATGRPWRGAGAGVAAGGGGPPPPKVYRVEPRDFRELVQRLTGAGTPSAAAGAPGPSPHQRATTLTPAMVTADSRRAQAAAAVPVPGPTEQFDYASWFSAPLLSPAAYGAPGFGGGHQQHQGSSGPLL

SEQ ID NO: 610 - protein, 280 aa, Sorghum bicolor
MAEMAVTVAAANGTLRTCSGVSPTAPGGRRAAVLGRWRALAPANLRLSSPAVRVPRATSAAAVEDWSNTDIVPIPKVIIDQDSDPDATIVEITLGDRLGELLDTMNALKNLGLNVVKASVCLDSTGKHNKFSITKASTGRKIDDPELLEAIRLTIINNMLVYHPESSSQLAMGATFGPEAPTEEVDVDIATHIDIYDGPERSLLVVETADRPGLLVDLVKIISDININVQSGEFDTEGLLAKAKFHVSYRGKPLMEALKQVLSNSLRYFLRRPTTEDASF

SEQ ID NO: 611 - protein, 882 aa, Sorghum bicolor
MFGDCQVLSSMAAMAGASSSADALFIPNPGALAGFMSSSAAAMPFHHFSTTAASLIPKEEGGIMGALQVAKDEDMDQLEMDMELSGGSGSAHLDGLLSFADVDDDRTEQKPQHSGLELQTTVDAAGQQQQQQQLATANGKKKRYHRHTAHQIQQMEALFKECPHPDDKQRLKLSQELGLKPRQVKFWFQNRRTQMKAQQDRADNVLLRAENESLKSDNYRLQAAIRNVVCPNCGHAAVLGEMSYEEQQLRIENARLKDELDRLACIATRYGGGRQPSMSSALGCLSAPPPVLMPPLDLDMNVYARHFTDQSSVMGCGDLIQSVLAPQQQIPVGGAEHHATSSFMGAAIGPVQEQDRQLVLDLAATAADTLAKMCRAGEPLWLRRRGASSEVMVADEHARMFSWPVDGGQQGSASTGAAARTEGSRDSAVVIMNSITLVDAFLDANKWMELFPSIVSKARTIQVINHGARSGHMGSGSLLLMQAEVQFPSPLVPAREVVFFRYCMHNGDEGTWSVVDFPADGFQLEGLQTSSVVKCCRRPSGCIIQDMPNGYSSVVWVEHMEMVGEEKPLHQVFKDYVASGYAFGATRWVSLLQRQCERLASELARNIADLGVIRTPEARTNMMKLSQRMITTFSANISASGSQSWTALSETTEDTIRVTTRKNTDPGQPSGVILTAVSTSWLPFSHQQVFELLADEQQRCQLEILSNGGSLHEVAHIANGSHPRNCISLLRINAASNSSQNVELMLQETSTHPDGGSLVVFATVDVDAIQVTMSGEDPSYIPLLPLGFAIFPATNPSPAATSTSSGNGESSPGNTDEPTSGCLLTVGMQVLASAVPSAKLNLSSITAINSHVCNAIHQITTALKGQGAGVSGVEPVAAAGSD

SEQ ID NO: 612 - protein, 143 aa, Sorghum bicolor
MLHPLLAAVTAAVSSSFVSPPRRVPASPGPGRRRRRPGGFAVRCAPNGGGVTAGADTKSKLKVGSPIVIVEAPVMLKTAASVPSLRHNSGQVKAGDVGRIMARKPKDVWVVRLAVGSYLLDGKFFSPLDSDDGDGDEPQAQDE

SEQ ID NO: 613 - protein, 139 aa, Sorghum bicolor
MMRLLTGADQRDKQNRGGGGGFVFSPRSVDAFGSTVIAEGADDARQLYWVHAWTVGPDGVITQLREYFNTDLTVTLLSGSGAVSSTKKADIAGALPKLQDAASSSSSSSPSAAAGPKCLWQSRRADSAHKSLPGLVLAI

SEQ ID NO: 614 - protein, 448 aa, Sorghum bicolor
MERYHPSEVYELFVRHMNTPRVVVDNGVCATATLVQVHSARKHGVLLEAVAALSDHGVCVRKGYISSDDGRWFMDVFHVTDASGRKVADADALLARLESSLTADALPPRTPPAAAVGNGAGPAMPTLLELVGADRPGLLSEVFAVLHDLRCDIADARAWTHGGRVAALVFVRDVETGAPIDDAARVRRVESRLRHVLRGGALGARMVREDAAAVNMDRRLHQLLNEDGEAECRADQADATAVAVQDWGERGYSVVTVSCRDRPKLLFDVVCTLTDLDYVVYHGTFDTDGDHAQQEFYIRRLDGRPISSAAERRRVIQCLQAAIERRASEGVRLELRITDRRGLLAYVTRVFRENSLSVTHAEITTRGDKAMNVFHVTDVAGRPADPKTIDEVIQRIGTESLRVDEERWPRLCSTEGDAGRGGGGAGIFSLGSLVKKNLASLGLIRSCS

SEQ ID NO: 615 - protein, 194 aa, Sorghum bicolor
MAMAAAEGKSRRFALACGVLSQYVKAEQQMAAAAAPAARAPATTLSLMPGADVGAEQEPTPAAATRGEEMAGPASTAAPLTIFYGGRVVVFEDFPAEKAAEVMRLAAGGAERAAVPAPAPAPAPAPRDDLPIARKASLQRFLAKRKDRLVERAPYTRPSPSPAEEAEKTKQPASSSWVGLGGSTTDAERLTIAL

SEQ ID NO: 616 - protein, 188 aa, Sorghum bicolor
MVGRKPMRRRRSDRQPPPQSFGATARPSSPRSLASTPASAAAVAADLDELLLTAPPPSASEPRSFSYAVKQQCWEKAERVPGRDPERWRRDALGNIVFRKLVGCPGCLCHDYDHIVPYSKGGKSTLENCQVLQATVNRSKGNKTEISKSELIQKSAYCRVSGRDMDLVELSAYGNVRRGPDSGGCKIQ

SEQ ID NO: 617 - protein, 531 aa, Sorghum bicolor
MLRKSGTERRQPALWRRCRSLRQIKQVHALMVLRGFLSDPSALRELIFASSVGVRGGTAHARLVFDRIPHPDRFMYNTLIRGAAHSYAPRDAVSIYARMARHSAGCGGGVRPDKRTFPFVLRACAAMGASETGAQVHAHVVKAGCESDAFVRNALIGMHATCGDLGAAAALFDGEAREDAVAWSAMISGFARRGDIGAARELFDESPVKDLVSWNVMITAYAKLGDMAPARELFDGAPDRDVVSWNAMISGYVRCGSHKQAMELFEQMQAMGEKPDTVTMLSLLSACADSGDMDAGRRLHRFLSGRFSRIGPSTVLGNALIDMYAKCGSMTSALEVFWLMQDKNVSTWNSIIGGLALHGHVTEAIDVFQKMLQGNVKPDEITFVAVLVACSHGGMVDKGHEYFNLMQQRYMIEPNVKHYGCMVDMLSRAGLLKEAFEFIGTMKIEPNPVIWRTLLGACRIHGELELAEHANQELLKARSDASGDFVLLSNIYASVGEWLGSENMRKLMDDSGVNKEAGCAVVDGSSKDVID

SEQ ID NO: 618 - protein, 237 aa, Sorghum bicolor
MVATMASSLLLRPRAVLPHHPSSSSSSRRPLPAPRVQLQPIIQQKPGLAARSDGERRRPAGTRLYSLAPYPLLLAALLPGAEPVTAVFAPFVELVKTWDLPGWLVHWGHPGNMAVVLFAMGGYGTYLGFRIKLSDDIEEKAKAKDLHPKLLAGMFFFFALGATGGITALLTSDKPIFESPHAVTGVIGLALLTVQSILPKLFEGNPGLRTTHGLLGSGIMTLFLIHAALGLQLGISF

SEQ ID NO: 619 - protein, 525 aa, Sorghum bicolor
MPLHATSPAGVLAYAALALAALRLLLSYKSALYALRRLWRCADEWAQAYQYHEVPRFAGAGCDGAENPLFRKAAAYVAALPSLEDADAACVVSSASRTNGGLSLQLGPGHTARDAFLGARLSWTSAGGGPERLVLRVRRHDRSRVLRPYLQHVESVADEMEQRRRELRLFANAGTDADTGAPRWASAPFTHPATLDDVAMDPDLKARVRADLESFLKGRAYYHRLGRVWRRSYLLYGPPGTGKSTFAAAMARFLGYDVYDVDLSRAVASGDDLRALLLHTTPRSLVLVEDLDRYLQGGGGDGEARAARVLSFMDGVASCCGEERVMVFTMRGGKDAVDAAVLRPGRLDVHIQFTLCDFEAFKALASNYLGLKDHKLYPQVEEGFHAAGARLSPAELGEIMLANRASPSRALRSVITKLQHVASGGGAAPRYPSHRRNTSWSGGGHQWEDQAQSARASADSALADDETAAGAPPTCGVFGKEAPMREFKKLYGLIKIRSRREGSGVVPQEGDAHGPPTPGNHDRDR

SEQ ID NO: 620 - protein, 470 aa, Sorghum bicolor
MDPCPFVRVLVGNLALKMPASTTAPRSTAASGSGVHPTTAPCYCRIRLNKLPYQTASAPLLPPTEEGPASCTGAFAAAFHVSKADLDRAAAKPALLLGARLRRRTARLKVAVYAGRGGGASCGGGGGGVNSGRLIGKLVVPLDLGAAMAKPVVFHSGWVAIGKRRSGGRGKTAARAQLNLTVRAEPDPRFVFEFDGEPECSPQVLQVKGSMKQPMFTCKFSCRSNSDLRSRSVQSDPGTAGPRNWLAKFGSDRERAGKERKGWSVTVHDLSGSPVALASMVTPFVASRGTDRVSRSNPGGWLILRPVDGTWTPWGRLECWRERSGSGGGGDTLGYRFELVPGHTNAGVCVAESGLPASRGGRFAIDLTAAQPFGSPGCSPRGSGDLGHYHGGGVWPFGTFRGFVMSAAVQGEGRCSRPTVEVGVGHVGCAEDAAAFVALAAAVDLSMDACRLFSCKLRRELSASRAELVR

SEQ ID NO: 621 - protein, 230 aa, Sorghum bicolor
MGAGDQGTSSEGVDILKNPTAEEPQAPAGTRKKGKEASAPEGGDLGLKLKEASTLGLGGKILKKRKEAMAALDIMLPTKPAARKAQPAGVEKKRKKVVRKKLPQDVIDSIVAKPCKIVYELSDEDLADKSQQFREAYRRAMLVHEKVRSYEQALMEQYRATGSVEDEIEVTDDEDEGTGENVTGDEETSANKVTGSVEDEIEVTDDEDERTGENVTGDEETSHISEQGHR

SEQ ID NO: 622 - protein, 520 aa, Sorghum bicolor
MEASSSSSLWGGLNSGIVLSLLAVAWTMLWQALQGLQLHHFFDRHSRRLSRRLAAILDPDLTVTIAEYNGGRMRRSDAYKEAKAYLERATREARGGGAGGGVRHLRAEPDKDPDRVLLSMDDDEEITDEFRGAVVTWRACTAPQREDTGPAYFWRGGAGQRAERRSYKLLFSERHRDLVLGEYLTHVRREGRAVMVKNRQRKLFTNISGDGSWDSDGVWSHVVFEHPKTFATLAMDPAKKKEVMDDLDAFRNGKDYYARVGKAWKRGYLLYGPPGTGKSTMIAAMANHLDYDVYDIELTSVRTNTDLRKLFIETTSKSIIVIEDIDCSLDLTGKRKRKKKKKEEEEEEGKKDGDKEKEDDSNKAGSSKVTLSGVLNFIDGLWSACGGERIIVFTTNHVEKLDPALIRRGRMDKHIEMSYCCVESFKFLAKVYLDVDDHPRFDAVAALLREVDMTPADVAENMTPKAPGENADSCLAALVEALEKAKVDAALAKKKKAKGNKEDAGAADDEDEEEEEEEEE

SEQ ID NO: 623 - protein, 479 aa, Sorghum bicolor
MARSGREGEERKLVLGKYELGRLLGQGTFAKVYYARDLSSSGAAGGTGSGGSSSSSSVAIKVIDKARLRRTEGMVEQLRREISIMRMVRHPNVVGIREVLASRSRVFVVMEYARGGELFAKVARGRLTEDHARRYFQQLVAAVGFCHRRGVAHRDLKPENLLLDEEGRLKVTDFGLAALPEQLRHDGLLHTQCGTPAYVAPEVLRKRGYDGARADLWSCGVVLYVLLCGFLPFQHDNYVKMYQKIFKAEYQVPPWVSGDARRLIARLLVVDPAKRASIAEIMCTPWFRKGFVPPVLSPPVTPPKKRLDEDHDAAGDLFDTDDDDNSSSCSNSGATATSPRSCNAFQLISSMSSGFDLSGLFENEQKAATVFTARAAAATVVEKLESVARTLGFEITRGKESGKVRMEAKAEGTNGRLAVTAEVLEVAVDVAVVEFAHDAGDALDFNKFCAVDVRPGLAEIVWAWQGDSPPAPAAAVGTA

SEQ ID NO: 624 - protein, 994 aa, Sorghum bicolor
MDSRPRETDAPGDPANGAAPPQAAAVTSATATGDVEIIRPRNDKRGYRRVVLPNSLECLLISDPDTDKAAASMNVSVGYFCDPDGLEGLAHFLEHMLFYASEKYPEEDSYSKYIAEHGGSTNAFTSSEHTNFYFDVNSDSLHDALDRFAQFFIKPLMSPDATLREIKAVDSENQKNLLSDPWRMSQLQKHLCAENHPYHKFSTGNWNTLEVKAKEKGLDTRLELIKFYDSHYSANLMQLVVYGKDSLDNLQNLVENKFCDIRDVGRKPFSFPGHPCTREHLQILVKAVPIKQGHTLRILFPITPNIRRYKEGPCKYISHLIGHEGEGSLFYILKKLGWAISLEAGEGDWSHDFSFFSVVIQLTDVGQEHMEDTVGLLFRYIKLLQTSGTPKWIFDELQAICETGFHYRDKSPPINYVVNISSNMQIFPPEDWLIASSVPSKFSPDAIQNILNELTPETVRIFWESKKFEGKTNLAEPWYGTSYSVEAVPPSIIQNWVDKAPKEDLDLPKRNIFIPNDLSLKCVEEKASFPAMLRKTSFSRLWYKPDTMFFTPKAYIKMDFHCPLSQSSPESAVLTDVFTRLLMDYLNDYAYDAQVAGLYYAVKPNDTGFQVTMVGFNDKMRTLLETVIGKIAEFEVKADRFSVIKEAMTKEYENFKFRQPYQQVLYYCSLILEDQAWPWDEEFSALSHLEASDLGIFLPRLLSKTFIECYFAGNIEANEAKNIVHHLEDVLFNAPISACKPLSPSQHLAKRIVKLEKGLRYYYPAMCSNHQDENSALLHYIQTHQDNVKQNVLLQLLALVGKQPAFHQLRSVEQLGYIALLRQRNDSGVRGLQFIIQSTVKDPANLDARVVNFLNMFEGTLYNMSDTEFKSNVSALIDMKLEKYKNIREESAFFWGEISEGTLKFDRKQEEVAALRELKKEELIDFFNDHVKVNAPQKKILSIQVYGGLHSAEYETIVQNAPPPQSCEITDIYSFRRSRPLYGSFRGGVGQMKL

SEQ ID NO: 625 - protein, 313 aa, Sorghum bicolor
MAYRTLEVTLLSAKDLKRVNLISRMEVYAVVTISGDPLTRQCTQPDPYGGRHPCWNTSFRFNVPPSAATATGCLHVLLRTERALGDRDVGEVIVPLADILAGGGAASDPGSRPPQLASYQVRKVHRCEPRGVLNVSYRLGPIVAPQARAVDEAAGGAGAFVGYPVPRQFYAPSYAYLPSPLSLAPPPPPAQAAGRDAQLHPPPQYSLPAATYSQAYPQQPAANYPQQPAAGRAALPAPASGESNGKLDFGVGLGAGLVSGAIGGMLVAGDVMMSDAAAYNSGYRAGLADGGAAAVYKNSYRVHDKVEAKRAAV

SEQ ID NO: 626 - protein, 180 aa, Sorghum bicolor
MAAAAASVWLQLQVPPHRLHSPPVLSLPSNHSSSHACPPVYKYKKHAAPGRGNLLLCRASGASSSSVVTKEQEGAASDPSSEEGYSEPQIYSYKDDPNFRGCKGCGRDELERGCNGEGRIQGGIAAVPGFGWWPIKAYRPCPGFVASGGRYRRQGQSMDDVASGRGKKKPSPAKKKSDNK

SEQ ID NO: 627 - protein, 273 aa, Sorghum bicolor
MAAPPQTIALAGLMLLNFVLAVAALCLHVLGRRRPRQQVPSPPPPPLEPAVAGEEGGGEERPHNQRRRRNGTQEEEEEGSAAAAAADGGGHGADGDRDAAAKAAGKEALLPRRPQFPLASVAGALQRRINARYDDLARASEAQCLTIEQVNEFVNSLIDARNELLQRYENVERSFKIKKAMLSNHRNYRSSYERLFEQVRRLETERDNLKKDAAIYNYIQERLQKSAAYKMIMELGTMEMEAQEISFEELLAKEKEDTAFWQRNGKMRSFSSK

SEQ ID NO: 628 - protein, 126 aa, Sorghum bicolor
MGGGHDMHGHNGGVKGYVSNLVHGGGGGGHGHGYGGGHGGYGGHGHGYGGHGQGYGHAYPPPAAAGAYPPPHGGYPPAAAYPAHSAHYGNMGSYHSSHSHGGGHHGGYGGKHKGGMFGGGKFRKWK

SEQ ID NO: 629 - protein, 450 aa, Sorghum bicolor
MKEFSYEEVEAATGGFAAKNLVGKGSHGSVYRARLRGGGGRMTTVVAVKRPSHAQGVAKLANEIAVLSAAPRHPGVIGIVGVSSSSSSPQPPPPPAASGPRLPPLLVMEFMPNGSLHDLLHRSPRPPPWPRRVEIALDVARAVHALHAAAPRVIIHRDVKSANVLLGRDGRARLADFSLAVSVKAVHAPPGAAGACGGGEEEEEDDDDEEEDEEGGSSSAGPAPAGTIGYLDPCYTEPGRLGPASDVFSFGVVLLELVSGRKVMDVNSCPSSIVSWAAPLIAAGRAREVLDGRVAAPPTARAHRALARVLAVAARCVSETVERRPAMDEVVSELRGALESAGWRWRHHRRGDSGGGGVVERVCRRVASWGQRVRRRSKRVVRATKVECTEHSDSGGVATGSSSCAAALPSHRSNNGMMSGAGAAHSNESSKAKENALNRFESELDLVFSS

SEQ ID NO: 630 - protein, 511 aa, Sorghum bicolor
MGSGDLSSEMERKVLGLTLWVWIAIGVVALLVAILLMICIWVASRRRTKRTMDTLRQTQIPIYSKEIPVDRVGGRSLAQTMHEREKPSLPPPDKYNASREPAGATLGHLALSKSSDHDNMSQGSSVCNVDRAGSVHSGEDGSSGPRRKPNSPAAFVSASPLVGLPEFSHLGWGHWFTQRDLELATDRFSKENVLGEGGYGVVYRGRLVNGTEVAIKKIFNNMGQAEKEFRVEVEAIGHVRHKNLVRLLGYCVEGVNRMLVYEFVNNGNLEQWLHGAMHQRGVFSWENRMKVVTGTAKALAYLHEAIEPKVVHRDIKSSNILIDDEFNGKVSDFGLAKLLGSDKSHITTRVMGTFGYVAPEYANTGMLNEKSDVYSFGVLLLETVTGRNPVDYSRSSNEVNLVEWLKTMVANRRAEEVADPSLEVRPSIRALKRALLVALRCVDPDSEKRPKMGQVVRMLESEEVPYREDRRNRRSRTGSMDIESIAEGSNSAEFGKKVERTGSSTSDRSQP

SEQ ID NO: 631 - protein, 1074 aa, Sorghum bicolor
MPAAAVPGGGGAADAEELFRTKRIPEIRAAEGATRREISAKEEELRQLVGRSYRDLLDSADSILLIKQSSDAISDNLARISGSLSSLSPPPEPSPAVSAASPSPSAGGRARLYALAARAKYLVDTPEHIWGRLDEGLLLEAAGRYLRAQVVHGRLSRDAAAAARFPLLAHQAQLVEAFRPQIAQRARERLADRRLPVAAHADALAAVAAIDAPSLAPAQALLLFLTSRRAWISQALAGLASDLSSYTSVLCDISRIVRITLGHVGQLFVPALSDMPLFFKTVLEKTPPEQLFGGIPDPDDEARLWKEHMNQIEATMVLLEPDAVARACTDWLKECCTEIFGVIAGEQKLVDAIGSGELLGSVQRLVRDALDGRDGLEGSLEQWLKSVFGSDIESPWDQIRGLILKDGKDIFEDWMEEAFVRRMKDIVHSELDGLGACVNVKESVHAIGANADPKDAGDFLAYLRKSSKGGGFWFSESKIKKGGVLAHLKPIADENDFHSCLTSYFGPEVSRIRSAIDSKCKNILDDLLSFVESHNSAPRLKELVPYLQEKCYRTISRVLKELEAELRKLSALLGTKKEGNDIPAASIIAERSLFIGRLLFALRYHSSHVPLILGSPREWVKEAGGAAFARLSSPTPRHSRASFDSLVSFTPRRRTFDGPRSPGRQFSDSPRKQTIAAAVSLFGADDRSNPRLDELNKTLQSLCVMAHNVWIAWVSTELSRILSYDLNKDDSLSSSTPLRGWEVTVIKQEESTEGPLEMQIALPSMPSLYIISFLYQACLEIHKVGGHILDRIILHNFAWELLQKVINIYEKFLSSVESGNSPVSEKGILQILLDLCFIGDVLSGGKSSSANTTEMQTKQDSLPSTVTKTSFRRKQSQLQADSAVIEPINKLINRLSQRLDPIDWATYEPYLWENEKQSYKRYVVLFGFLVQLNHMYTGTVQKLPTKSNTDSNIMRCSQVPRFKYLPISAPAISSRSHKSSLQSPSSDSTSKSPWKSYSNGDRSTTPEFDDNASLVGAAPLLKSFVTQVGSKFGENTSRWGSMLSDGQVGKLSDILPGPAAGFFSSFTSGTRYDS

SEQ ID NO: 632 - protein, 474 aa, Sorghum bicolor
MAAAATGETRGCGCHIVAVPFPGRGHVNAMMNLSRLLAARGAAVTFVVTEEWLGLIRSSSTHAEAAGIRIRTIPNVIPSEHGRAANHSGFLDAVATEMEAPFERLLDGLEGPPPAALVADAYVPWVVGVGNRRGVPVWSLFPMSAAFFSAYYHFDRLPAWLTDYEHAPDSGETIGNSDQRLGHYIARHASSSIRLSDLEPLIHDKRKVKHILATISSVRNAQSLLFTTMYELEASVIDSLRSVLSCPVYPIGPCVPYMTLEDQHTMSNGEVAGQRDYFTWLDSQPVNSVLYVSLGSFVSVSASQLEEIALGLVASQVKFFWILREQSPRVQELLAGINNGMILPWCEQLKVLCHHSVGGFLTHCGMNSTLEAVFAGVPMLALPLFFDQPIDGRLIVEEWKVGLNFRDWASKDDLIGREDIARAVKKLMSSDETETKALRERALELKEASRRAVDKGGSSYCNLSSLMETVCTPK

SEQ ID NO: 633 - protein, 836 aa, Sorghum bicolor
MPCPWLAAAMATRGGGPAAAAVLLQLLGFLFLLRGVPSRAEDDTVAAGRPLSGGQSLVSKRGKFRLGFFQPGATDNSTQRWYLGIWYNQISVHTTVWVANRVTPISDPESSQLSISGDGNMVIVDHSSRSTVVWSTNVTATNSSTVGVILDNGNLVLADASNTSAVLWQSFDHLGDTWLPGGKLGRNKLTGEVTHLVAWKGYKDPTPSLFALELDPRGSSQYLLNWNGSEQYWSSGNWTGTAFAAVPEMTPTGASPVSEYTFGYVDGANESYFIYDVKDESVVTRFQVDVTGQIQFLTWVAAANEWVLFWSEPKRQCDVYSVCGPFGVCTENALPSCTCPRGFRQRDLAQWLQDDHTAGCARNTALQPCSAAAARDGQKKHSRRNDDRFYTMPNVRLPSNAQSTAAASAHDCELACLRNCSCTAYSYSGGGGCSLWYGDLINLQDTTSSGTTGGSSSSISIRLAASEFSSNGNTKKLIIGLVVGGFVTAVTAIVLATTFILRKRRIKSLRRVEGSLVAFTYRDLQLVTKNFSEKLGGGAFGSVFKGALPDGTLVAVKKLEGVRQGEKQFRAEVSTIGTIQHVNLIRLLGFCSEGSKRRLLVYEHMPNGSLDRHLFGASSQGQGVLSWDTRYQIALGVARGLDYLHEKCRDCIIHCDIKPENILLDDAFVPRVADFGLAKLMGRDFSRVLTTMRGTVGYLAPEWIAGTAVTAKADVFSYGMMLFEIVSGRRNVGQRADGTVDFFPSTAVSLLLDGDVRSAVDSQLGGSADVAQVERACKVACWCVQEDESLRPSMGMVVQILEGLVDVNVPPIPRSLKVLADPSKYAVEFFSGLPST

SEQ ID NO: 634 - protein, 483 aa, Sorghum bicolor
MGSTGRDPEVTRADFPDGFVFGVATSAYQIEGARREGGKGDSIWDVFTDDKERVLDKSNAEIAVDHYHRYKEDIELMASLGFSAYRFSISWARIFPDGLGEKVNEQGVAFYNDLINFMISKGIEPYATLYHWDLPNNLQKTLGGWISDKIVEYFALYAEACFANFGDRVKRWITINEPLQTAINGYGIGIFAPGGCQGETARCYLAAHHQILAHAAAVDVYRRKFKAAQGGEVGFVVDCEWAEPFSEKAEDQIAAQRRIDFQLGWYLDPIYFGDYPESMRQRLGSDLPTFSEKDKEFIRNKIDFIGLNHYTSRLIAHHQNPDDVYFYQVQQMERIEKWNSGEKIGERAASEWLFIVPWGLRKVLNYIVKKYNNPVIYITENGMDDEDDQSATLDQVLNDTTRVGYFKGYLNSVAQAIKDGADIRGYFAWSFLDNFEWAMGYTKRFGIVYVDYKNGLSRHPKASALWFSRFLKGEAAENKPDTN

SEQ ID NO: 635 - protein, 1005 aa, Sorghum bicolor
MTVTARGRSGGGVGMEEKCDAPGFGFLGLDRMRVLLPPLRLPEKLSASRTLRTHLFTNYRMRKVRDSSRWLIPLWVTIWVFIASLLYLRMSYQAVDKRRESLAIMCDDRARMLQDQLNVSMNHLQALAILVSTFHHSKTPSAIDQKTFAWYAERTAFERPLTSGVAYGVKVTHAEREQFERQQGWSIKKMYSSKTKKQSQGQGNGEDAEVREPAEEYAPVIFAQDAYKHVISFDLLSGADDRDNVLRARESGKGVLTAPFKLLNNRLGVISTYAVYKYELPPNATPQDRIQAAIGYLGGIFDIEALVDKSLHQLAGKQSIMVNVYDTTNEKPISMYGSNDTGSGMCQVSTLNFGDPTRKHEMHCRFIQSPPWPWLAITTSIGIFVIGLLVGYIVYATAKRIARVEDDFQEMSLLKKRAEDADIAKSQFLATVSHEIRTPMNGVLGMLQMLMDTDLDTTQQDYVRTAQASGKALVSLINEVLDQAKIESGKLELEAVPFDLRTVCDDILSLFCGKAQEKGLELAVFVSDQVPQTLIGDPGRIRQIITNLVGNSIKFTEKGHIYLTVHVVEEIMHCLEVETTNTLSRYPVANRKRSWENFQLFSRELNSSEMPFAPGASDSISLIISVEDTGVGIPPDAQSRVFTPFMQVGPSIARIHGGTGIGLSISKCLVGLMKGEIGFASKPQVGSTFTFTAVLTRAHSSGNENKSSEFKEINALVVDHRPVRAKVTKYHLQRLGVHTELTTDLDQYISKINCGSQIAKLVLIDKETWLEESHSMPHLVTKLRNKDQPDSTKLFLLENPKSSVKSSLHIFREYNLNVIMKPLRASMLQVSLQRALGGIDKLHCRNGVVGNSTLGSLLHKKRIIVVDDNIVNLKVAAGALKKYGAEVTCADSGKKAITLLKPPHRFDACFMDIQMPEMDGFEATRRIRVMERDLNEQIERGEAPLECAGVRQWRTPILAMTADVIQATHEQCLKSEMDGYVSKPFEGEQLYREVARFFLNQDQVQ

SEQ ID NO: 636 - protein, 572 aa, Sorghum bicolor
MPLPLAAQSALVAAAVAIATATVLLLVPWTPTPRDRFADMVLANATIYTADPARPFADAMAVRDGRVLRVGTYESVKELNGRHTHELSLSGNVVLPGFIDSHVHFIDGGFQLARVPLRGIRNKDDFIGRVEEAVRDKHPGQWILGGGWNNDFWGGDLPAAAWLDDMSPDNPVWLSRMDGHMGVANSLAMKIAGIDKNTDDPIGGTIMRTTGGEPTGLLVDTAMKLIFDVIEKVSNHERREALLRASKHALMRGVTTVVDVGSYFPGTSTEKTWQDFADIYEWAHSMEKMIMRVCLFFPMPTWSRVSDLIDEHGRSLSQWIHLGGVKAFLDGSLGSSSALFHEPYEGDPGNYGLQVTDLDSLLNRTLESDKSGLQVAIHAIGDKANDLLLDMIDKVVDLNGVKDRRFRIEHAQHLAPGAANRFGKHGIIASVQPDHLLDDANSAGNKIGVERAERSSYTFRSLLDGGAQLAFGSDWPVSDINPLQAIRTAMFRKPPGWEVPWIPAERLTLDESLKAHTMSAAYACFLDHAVGSLSEGKYADFVVLPSTSWDEFSNDVPGQVLATYVSGRQAYP

SEQ ID NO: 637 - protein, 1322 aa, Sorghum bicolor
MYPANHYMDPYHSHYRNHAPYPYYPPPRWEIPSGHPRAMDSSYYYRPPSCGTWPYNHDMHHSHPSELHCCCNQTYPPGYYSFRPPFPQELPPPHLYYHGPFPQHPNAWPSYFVPSHPYPVDHTPYGYDKFKGHCCGCPNHVCPGAEKSNVKIEEERPDVKLESEHKNADSGSIIQHPNSKYPFIWLPPGNMKGKENGEHYELSPQIFNEWAPLSSKRLGDVKQQEQDNQKGKQFQWPMVWMPAGYDAPKQKAKEMNDTEGTPKSPKISEESPQSPKIKIIPLSWFENGHHHDQKLAAKNDSGDHNKRSAVKNQPVLTNNEDEDSMTLEGNPKTTSAVPKSINDEKKPLRESCKTIPVVPEKEINEKKASTCRTIPVMKGSDEKKIGMKEKKEAKETNSVEKVEENRKTKHSDSSIAKHSKLPPVCLRVDPLPRKKPGNGSSRSPSPPTRKDADSAKDMKNPQNQNLEPKQSGTSNHIAVSEVKEKSPYEMKKEIGFRNETVQASAVEHSQDEEAPTSEDHQNVQAGSTMVGTQENTGTKSIQGGAVQENVGAGSLNGCDKSKNEDGTVIESEAAKDDKSKNEDGTVIESAKDDARTYRVNLSEPDAAVRIQSAYRGYDVRRWQPLDKLRKIRHVHEQMQGVKKQLQCLEDSCNKPTQKEQVAIGETIMNLLLKLDTIQGLHPNVREARKSVARELICLQEKLDTLCKAPFGDLDHTNSNDDGESERTKSIIQTAAPTVTTEASDRERAVEMGKVEEPSSVSMEPCNTVPSEVSWEVRPDADFSERSEKQESCSPTVDEAHEEGKAEEQIEFQVASSMDMTSDEVFIEHPTDNQEHGIRESNVNSVEQVTEEEKPAAADEVKESPLVNSMAPLYYAASLEDSSGLKQYTASTHQNLYAESPASTEDINISALTASVESEVATEKDGPVDSQVHETAALENVELKDDVSCAENEHNKSGSPVHLEDPLVPLKDVEKHDLTPAKDFVVSNTEDQQEARDIRLQVQDVDSMEDSGKVPDGTIEASTDDDLELGTADVEKHDQPNLLEPRLESVSAPELSVLDESDDKMQCGVSGKDEVPHVDEKTETTVDKVTGGSANCEDLLCESSRTEPDIQESHTSLGEEVDVTITTGGTVFPDSVSCDLSCPHDGGMTVYEGSETVSSENQTDAQKENIHSDVSQTDECTKTQKVPPVGTQGENSAEDSDVQVSEMDKCNEMPKEAPAHATGANPAEDEASLKEDITVQTDNKPSASPAPEDPKVSDKEKLAEENQKLKELLQKLLASGNDQMGVITDLSEKVKALERKLARKKRPKVRVHRPSGHVTAKVH

SEQ ID NO: 638 - protein, 810 aa, Sorghum bicolor
MKMSPPALAAGTTSLLSPPTAAVSAHPFPPTNHKPHSARIRLSSAAAATSSSRWVNPRAPPPRRGAGRSGANQRLHHLVHLGDLDAALLLVESMRDPERPAAVPCTLLIKKLCAAGRLDDAERVLGASERAGTADAVTRNTLVAGYCRAGGRLADAERMLASLALSGSADVVTYNTLVAGYCREGRLNDARRLVADMPFAPNSYTNSTLLKGLCSNKEWDDAEELLSEMIRSGCPPNDLTFGMIIHSLCQNGLADRAMGVLDQMSKCRCTRGVIVYNEIISCLAELGRVEEALHLFDQMPCKPDIFSYNTVMKGLCRDGRWEDAGTLIAGMVRKDCPPDEVTFNTVISYLCHRGLVDCAMEVVEQMPKYGCKPDNFTYSALVNALSERGCVDDALELLRTIPWKPNTVCYRSVLKGLCRADRWDDVGKLVAEMIRNQLNLDEVTFGLIIDCLCQKGLVDYGAEVLREMTKFGCSPDIIIYNSLINGFSENGSVDDALELFKNMSCKRNVVTYNYMLKGLCRAEQWEDAGKLVAEMVKDECLPNEVTFSTLISYLCQKGFVECAIEVFEKMPKYNCMPNVIIYSTLINGLSDQECVDDALKLLNDMPCKPDTICYSAALKGLCRAERWEDAGELILEMIRKNCLPDEVTFSILINNLCHKGFLESATEVSELMLKYECMPNVFIYSSLINGFAEQYRAEDALQLLRNMPCEPDTICYSAALKGLCRAKRWEDARELIAEMFRKQCPLDEATFSMLIGSLCQNGLVDMATEVFEQMSVYGCSPNRKIHSSLVNGYSEQRRVDEGLKLLSSMP

SEQ ID NO: 639 - protein, 418 aa, Sorghum bicolor
MIYTAIDTFYLTDEQLRDSPSRKDGIDEATETALRVYGCDLIQESGILLKLPQAVMATAQVLFHRFYCKKSFVRFSAKRVAASCVWLAGKLEESPRRSKHIIFVFHRMECRRENLPIEFLDVFSKKYSELRHDLIRTERHLLKEMGFICHVEHPHKFISNYLATLEAPPELTQEAWNLANDSLRTTLCVRFKSEVVACGVVYAAARRHRVPLPEDPPWWTVFDADEAGIQEVCKVLAHLYSLPKAQYIPVYKDNDSFTVRRISDPQASKESPASAVASDKGTPIPSSSSQEKDSVTKTILNKVKEKSDDEGKPLPAELDGKENLVVNSKNEKSDSGVDRSRERERERSRGRERDARGRDSDRDSRGRDSDRERDRRRRSRERSSGHSDKEKSRRHSSRDRVDYYSSHSSREKDRHRHH

SEQ ID NO: 640 - protein, 210 aa, Sorghum bicolor
MKISWGKNSKVKKQSVVVSTIPGLPFGVGSDNDEVEREEKSDANTNCPGTKPVETAELLQSQGDKLAEEGKYHEALAKWEAALILTPDNAILHEQKAQVLLEVGDAWRALTAATRATELDPFWPEAWVTLGRAQLNFGEPDSAILTFDKALAIKPDYNDAKADRETAARLVKKRGQLHTSGLSANKRRFTVGEYPEKGAEGEEKGKETAV

SEQ ID NO: 641 - protein, 276 aa, Sorghum bicolor
MSDHQRIHPVDLEGGSNRPTAPLVPGGSSFRSDKGDPAAARSANHHHQQRADLDACPLPPPPRRVAPAAPLPPPPPRKRRGRGCCCRLLCCAVVTAVVLAVLAAAVVGALYLALDPKAPRYSVDRLSVSAFQVDPSTVTARARFDVTVTAVNPNSRIGIQYEPGSSLGVWYRSYRLARGALPAFYQGHRNTTVLPLALAGEVQLATAVVSGLQDAQRTGAVPLVFRTDVPVRVEVGSFKLWKVTSRVRCDLVIDRLMDVSSPIKIKASNCKFSLKL

SEQ ID NO: 642 - protein, 174 aa, Sorghum bicolor
MAATTAYSTALLGGARLPSARGAAAPPSSLGLLPLRSPLPLRLQVQDSAPPRLSLLRVKASSDDSSAASGDELIADLKAKWDAVENKSTVLTYAGGAVVALWLTSVIVGAINSVPLLPKIMELVGLGYTGWFVYRYLLFKESRKELADDIESLKKKIAGSEPRIASVAGQGNGC

SEQ ID NO: 643 - protein, 382 aa, Sorghum bicolor
MSVASVAALRTAASGSGRCHGAGSPQVGLNGGRFLMMQRRELVTKAGIALAVSCSMATSPAPANGSAQGLEVLPFKADGYNFWTWRGRRIHYVEQGAGQPIVLIHGFGASAFHWRYNIPELAKKYKVYAIDLLGFGWSEKALVDYEATIWMEQVSDFLREIVKEPAVLVGNSLGGFTTLFTATEVPELVRGVVLLNSAGQFGDPNKPAAAPAEEEEGSPLSRFIVKPLKEAFQRVVLGFLFWQSKQPARVEKVLKSVYIDSSNVDDYLVGSITAPAADPNAGEVYYRLMSRFMSNQSRYTLDRLLGKLSCPLLLLWGDLDPWVGPAKAARIQEFYADTAVVHLQAGHCPHDEAPEQANRALLEWLAALDARAKPAEPSLQTV

SEQ ID NO: 644 - protein, 109 aa, Sorghum bicolor
MERISSSLQSWVEEHKLSTIGAVWATAVGASVAYSRRRAPARATSLRLIHARMHAQALTLAVLGGAALAHHYSGSSAGKQRQEELDYGFYSQLPPATDADGNENERWSW

SEQ ID NO: 645 - protein, 936 aa, Sorghum bicolor
MAGGGAATSTSIPAAAAAAGTSKTVSASLWWDSFVALSDDLDRATAGPSVPDAFSKRIKSHHAWLRGSVSMFEKPNVASRSALDAGEVVVGEHRLTVKTELKEAALRASKCLNLDEVQSYILVKRSSEISPTICDADAEEFLHLVSVQYYLERQCLLKCIRRIFVHASDGSDSTDPIRDEASLLISEEIERKLISIIEDCFSAASSVKAEAEFTVSSLEETLIEVNLILDILFLAFYGNFSRCNGRLWITLCSIFKDILCGSYDIRKFVVSLEAKNSFHYAKAQLLLILIETLDFENLLWMIHDEVPLSGGCSAFSVGDILEMDVEISKFPEFSMVESGALILAWAVFLCLVLSLPESNTNLEIDHTSYARRAFEFAPFNYLLGVLCSSIFRESDGPVSGYRGILRTFISAFIASYEVSYEKEDSSLDTISSILCEVYDGEESLCMQFWDKDSFVDGPIRSVLHMVEKEYPFQISELIHFLSAVCHGTWPAHCVYNYLERMNGVTTIFTIPSVADGVDYGHQIESHHPVSIPGIEGITLPRGTHGYILKVLREDTVLVRWEFPHSGVFFLLITLAQELHSCNYKEASDIMDLLYRMVSSNKDLCFALLHVDKSPAVQTSKNLGQIENHVRIDIAKIFCNSIFKYVRDVNNADILSKTLGLLAEMIKCAPYHVFYAAFECNIFTSQLNGPSSDWLLSGALARMLFAASEGNGDCSSLTSSVLDFAIQVLRKGAADDDMISPLIVFSIQYIMVNHVNWKHKECSRWKTTLRVFELVKSCIQVKPFSSKLGGIIWEILLYDSSVHGVLWTILSVSTQLLHDSYRSNYHGHKDIEDIQLVLCNGLDIMYHILSNLPEDLLPNPPFITMVLSSSLKPFSFITALISLMSFHNPDMQLAAARAFSALCFIAYKAQPQLMENASFTGDVSEIRRLESMYILHS

SEQ ID NO: 646 - protein, 469 aa, Sorghum bicolor
MARVAGLCELLLLLLLATATASAATPLGRKGGHEADDDGELELAAKNENDGVVAAAGSRTSAGRYAVIFDAGSTGSRVHVFKFDKKLHLVQIGDDIEFFAKVKPGLSSYAGRPQEAASSLLPLLEQADKIVPRRLQKNTPLKLGATAGLRLIGDEKAEEILEAVRDLVHTKSKFQYNPKYISVLEGSQEGSYLWVALNYLLGKLGGDYSKTVGVIDMGGGSVQMAYAISTDAAANAPAVPDGKDPYITKEYLKGKDYNLYVHSYLYYGALAARVEILKAKNGPFSHCILRGFSGKYTYNGKEYDATASPEGAVYDKCREEIIKALKLNAPCESKNCTFNGVWNGGGGAGQDNLYVASFFFDKATQFGFIDSKAPSAKSTPEAFKGAADKVCSLSAQEAKVMYPNVLDVPYICMDLIYQYTLLVDGFGLAPTKEITLVARVKYGEYYIEAAWPLGTAIEAIAPKKMRQDA

SEQ ID NO: 647 - protein, 384 aa, Sorghum bicolor
MDCGGALQLPPGFRFHPTDDELVMYYLLRKCGGLPLAAPVIAEVDLYKFDPWQLPEKAYGGEKEWYFFSPRDRKYPNGSRPNRAAGTGYWKATGADKPVGSPRPVAIKKALVFYAGKPPKGVKTNWIMHEYRLADVDRSAAARKKTNNALRLDDWVLCRIYNKKGVIERYDTVDDDADDAVAEDVKPAPASRNNPRGTASGRGGAAAAAAPMKVEFPEYGGYYDYEDLEATPSAGMLCFDRPSAAVPTAPASAPAPAPGPALSSPPPAADSDPERDDDSNNSVAWTMHHTHAHTDNYSSCGSEHVLSPSPDLPDRDHAESQSAGLWWPVGVGGDWAAAEDGFMVDVDVDDGSSLFGPPSPGLPFARVDAAAFGDMLASYLHKPF

SEQ ID NO: 648 - protein, 1715 aa, Sorghum bicolor
MSSSSAMPPPASPREHVERIRRERYYIGRGEQNPLAEDMHQAVNYLSQELYSKDVHFLMELVQNAEDNEYPSEVAPSLEFLITSKDITGCGASSTLLIFNNERGFSSTNIESICRVGKSTKKGNRHQGYIGEKGIGFKSVFLISSQPYIFSNGYQIKFNEKPCAECNIGYIVPQWVESTPSLSDIEAIYGCSKVLPTTTIILPLKSEKIDAVKSQLSSMHPEMLLFLTKIRKLSVREDKSDPNNTTVSEISISSEKNYQARKNMHAESYTLHLSSEETGKDEAECGYYMWRQKFPVKPENRVNKRAEIDEWVITLAFPHGERLSRGKQLSPGIYAFLPTEMVTSFPFIIQADFLLGSSREAILFDNPWNKGILDCVPSAFMNAFVTLVKSKADAPAMSLPSMFSFLPVNSSLIPLLEPVRSGIKYKVLTENIVPLESYASQKIFCKPSEVARLKPAFWAILGKAREFGVDLKSLSTHGTYILSSHFDKSRYNSVLEFLGIKSVSTEWYAKCIEGSNLVKEVDEQLYLEILHFVASNWENCFSGTNMMSVPLLKYVDRNGVLSFWSISRASQQKDRLCIASDMKYRSWLISWNKEFLSSNKFFLHPSTQAALDGFSQKMTVESWLRNHARVEVVSVYSYGSTVVDSLSNDQRSVLAFAHFLYHSFKMEHIESFWLSKLCCAMPIVDRYGNVVNKTENIIVPAKGSKWVGLLGTYPWRNQGYIELSADYKSVGHFAGNYTSEDQLLEFLKIHLHASDVPLIRPPNVRFHTVSSPLNVDNTFLLLEWIRNIRSNGVTLPDQFLACVEEGSWLKTSVGYKPPNESFLSSANWGSLLQSGPSFIDIPMIDQQFYQNKLHIYKQELKVIGVRFEFEEASSYIGSRLMSMAASNVLTRDCVYSLLRLIRFLREKVLSPSQLIDSVKDGCWMKSTVGYRRPSDCIIKDSEWAVASCISDQPFLDVEFYGEDILSYKSELELLGVIVGFKNNYHLVIDNFKFRSSAITSESTVLILKCIRYVGSCQDFIRKLRDLKWVKTNVGFCAPNVSFLVDSEWECLVKIFKGVPIIDLGFYGSVISSYKEELKKAGLITRFEEASMAIANVFKRMVSESSLTKANVLALLLAYRQLRTHSPLPVELFNCMRTEKWIHTSLGFQSPSNTILFDNAWQYLSPISILPFIDDGDTCNGLGMDIYGYKDELRELGVTVEVKFGARFALAGLSIPDDPSILSKATILSFLECIKNYFASATEPPKGFKDQICKKLLKTSLGYQYPDECILFDAKNCFLQMEDGPFIDEAFYGSDIASFKHPLAMIGVTVDVNSAQDLIARYLRNKKDIDTISRIYMYLKKCNWKPDKNNNNNRNWIWIPKETEGGDWVSSRSCVLYDKNNLFGLQLHVLDKYYDRKLLDFFSLAFSVRHGPCSEDYCKLWATWESSVHELPISDCLAFWKFIAKNWTKKTEELLSGCVKVPVCIDGKIILSNKENVFIPDDLLLADLFRKHPKQSLFIWYPSSALPSMSRARFNSIYGSIGVRTISEAVAKNDSFTSANSHFKTAVLSKVIKVGLLQIVLAFLSNPNFDIPAKDRHHLVSCLLNVTIEETDEPITMAYSVSLSSGEMVEVKARRMLRWERENSKLYMQRSDGASSYEDKIELATYFAHEISHGLLFQMPDQISSLTELIKIGSLVDFQQAAVAFLLKSKNLQLFPEDEDFLNSSVLGGSKKPVDN

SEQ ID NO: 649 - protein, 266 aa, Sorghum bicolor
MSRRSKREMASPPQISSPSVPMMPAARPREMAPPPQISSPSASDFLSGPGCFPTPPASINTTMGSAAPSPWWCGPPVPQQGMSWWPAPSCGGGATASSSQSVQKDDIDSDPKECCRGLDNRPPGGFLSYFNHPWSQSLPQPTPPHLFDGNRGKGSPTMLASESHRRRRPLINLDNDEDNANGASRTDIRLKYTKPEEVRLVSCIICIYRWMMSYSSLQNFRAQMKVEKRCWKPRNMFQERSLNHLDLITSLPKKMLNRLCWRLTEH

SEQ ID NO: 650 - protein, 1442 aa, Sorghum bicolor
MEAALEAARAKDTKERLAGVERLHEALDATARRGLAAAEVTALVDTCMDLTRDANFRIAQGGLQALSAAAVVAGDHFKIHLNALVPAAVERLGDGKQPVRDAARQLLITLMEVSSPTIIVERAGSYAWTHRSWRVREEFVRTVATAVGLFASTEISLQRVLLSPVLQLMNDSNQSVRDAAISCIEEMYKHMGSQFHEELQRHNLPSYMLKEINSRLDKIEPKVRSSDTAMQYKAVESRSVSANPKRGSPRTKSIPRESTLFGGDTDVTEKPVEPVKVHSEKELLREFEKIAATLVPEKDWSLRIAAMQRIEALVYGGAIDYPSFLMLLKQLVPPLSTQLSDRRSSIVKQACHLLNILSKELLGDFEPCAEQFIPMLFKLVVITVLVIAESADTCIKTILRNCKVARILPRIVDTAKNDRSAILRARCCEYALLVLEYWADAPEIQRSADLYEDMIKCCVADAMSEVRATARTCYRMFAKTWPERSRRLFMSFDPAIQRIINDEDGGVHKRYASPSLRDRVVQPSRASSHSSSTHVPGYGTSAIVAMDKSAAISSDSSFPSNNLRLSQSKTIGRSSERSLESVLSSSKEKVSAIESLLKGVSMSGQNFTAARSTSLDLGVDPPSSRDPPVPLAAPASNVLSLQNSALLDSSLPTIPPSSRNGGSRLLDTMTTHLPTKERSRSPYLSNMSSESMSGLSLPYSRRSSERLQEGGRMDESYDIRSARRIPQMHFERNYADMSYRDSSHRDSHNNHVPNFQRPLLRKQVMSRASASGRHSFDDSHVPSGDVSGYTDSLASLNDALSEGLSPSSDWVARVSAFEFIRNLLKQGQKGIQEITQNFEKVMKLFFRHLDDPHHKVAQAAFSALAEIIPACKKPFESYVERILPYVFSRLIDPKELVKKPCSVTLEIVGRTYAIDMLLPALVRSLDEQRSPKAKLAVLEFANKSFSKYTVDSDGYSNSGFLKLWLSKLAPLVNEKNAKLKEASISGIISVYSHFDSTAVLNFILSLSVEDQNLLRRALKIKTPRIEVDLVNYLQSKKERSRPKSYDQADFGTSSEDGYALTSKNSYPFGRFSSSSLDAEGGKKINSMQEPVLHNVSIGRTASDMSMDHAIQSLESSTGAEVHLTRSREPKTNSNSVVEAARSWTNYPEKTDASLDGETATGTPRLDFSRFLTSDGHNTVGSTPEESVQEGDMIVNLSSIKTSLQTDNGLSIPQLLHQISNDTEVSSSEKREALQQLVDASLDNNSSIWAKYFNQILTAVLEVLDDSDSSTRELALSLIAEMLNNQKDSIEDSMEIVLEKLLHVTKDAVAKISNEANQCLNVLLAKYDPFRCLAIIVPLLVSDDEKILVVCINCLTKLVGRLSQEELIDQLPTFLPALFDAFNNQSPDVRKTVVFCLVDIYIMLGKAFAPYLEGLSSTQLRLVTIYANRISQARSGKPIDSNQ

SEQ ID NO: 651 - protein, 686 aa, Sorghum bicolor
MEAVDKIAEPKDPFVLTSQKVQSLEPPIPIKASWKGKYSQEQEEKDLPADGEESFRSLDSSDEGGRSSFSGASHPPEPIDMDIMKTVYVAIDEEKSEPPVCLVRGVSVKGPFIDDLSIRVAGTKANLLVGAGGAEGMAEERKVSASAVASVATARSSQATSLPQDSEEKECVWDASLPPSGNVSPHSSIDSMGVVTAMSTLHSCASTYKSEAIAGEAMLNVERNCESVKGVRGDLLESAKTSMSRASDSSGVSDDSSWSHITGGASKPHKGNDPRWKAIHAVRTRDSVLGMSHFRLLKRLGCGDIGSVYLSELSGTRCYFAMKVMDKASLASRKKLNRAQTEREILQLLDHPFLPTLYTHFETDRFSCLVMEFCPGGDLHTLRQRQPGKHFSEYAARFYAAEVLLALEYLHMLGVVYRDLKPENVLVRDDGHIMLSDFDLSLRCAVSPTLIRTSAFDSDPRRAGGSFCVQPACMEPTSACIQPACFLPKFFGQKSKKKTRKARSELGQNAGTLPELVAEPTSARSMSFVGTHEYLAPEIIKGEGHGSAVDWWTFGIFLHELLYGKTPFKGSGNRATLFNVVGQQLKFPESPSTSYSSRDLIRGLLVKEPQSRLGVKRGATEIKQHPFFEGVNWALIRCSTPPEVPRPVEAELPVKYGVAEAIGSNSKRIAGADVKSGGKYLDFEFF

SEQ ID NO: 652 - protein, 481 aa, Sorghum bicolor
MASRLSHQLSNGLYVSGRPEQPKEKAPTICSTAMPYTGGDIKKSGELGKMFDLHVEKSRKSGPLGNAPSRNTSFGGAASNSGPVSNAGGRSNYSGSLSSSVPGAGGSARAKSNSGPLNKHGEPTKRSSGPQSGGVTPMARQNSGPLPPVLPTTGLITSGPISSGPLNSSGAPRKVSGPLDSAASMKMRATSFAHNQAVTNLNTEDGYSIQGSFPKPILWAVILLFVMGFIAGGFILGAVHNAILLIVVVVIFGFVAALLIWNACWGRRGAIGFVNRYPDADLRTAKDGQYVKVTGVVTCGNFPLESSFQRVPRCVYTSTSLYEYRGWDSKAANTEHRRFTWGLRSMERHAVDFYISDFQSGLRALVKTGYGARVTPYVDESVIIDINPDNKDMSPDFLRWLRERNLSSDDRTMRLKEGYIKEGSTVSVMGVVQRNDNVLMIVPPSEPISTGCQWTKCVLPTNLDGLVLRCEDTSNIDVIPV

SEQ ID NO: 653 - protein, 469 aa, Sorghum bicolor
MGGIGVSPCDLDREFAPQIAQLLATPPLQSAQEYYDELIRSKKPDGIRVSYSGKHGKGVCANRDFAEDDLVLKDQMLVGAQDSLNKIDCVVCSYCFRFIGSIEFQIGRRLYLQSLGGSVDGSTERHCHGSDAGPSTGCSGASSGNSNAVPQEVLMSLMDGNMSLPLTDQFCLPSVVACPGGCEGELYCSQSCADSDWDSYHSLLCAGSKTEPLRKSALQKFVGHANGTNDIFLIAAKAITFTLLRYRKLKRQHGSHESSSSLLMEAWKPLSMGFKKRWWECVALPEDVDSSEEELFRQQIRDLAFTSLQLLKDAIFDPECAPLFSLDIYGHIIGMFEMNNLDLVVASPVEDYFIHIDDLPESEKEEAEKVTGPFLDALGEDYSVPCEGTAFFPLQSCMNHSCCPNAKAFKRDEDKDGHAVIIALRPISKGEEITISYIDEDLPYEERQAQLADYGFTCTCLKCQEEQPV

SEQ ID NO: 654 - protein, 84 aa, Sorghum bicolor
MGFHLLAFVAARGLMQVFNLSAPLNLRLPLARHLPEAFAVLCVVLASHAAWVNDALARGAAWSHSGSRGGVDEYVRYAMLSISD

SEQ ID NO: 655 - protein, 209 aa, Sorghum bicolor
MASSLARLGAALPRARPCATARALPPGRWDAAALGASRRAALNACRCQVHSDVKVAPASDLKDGSKSETWRIKMLYDGDCPLCMREVNMLRERNKSYGAIKFVDISSKDYSPDNNQGLDYETAMGRIHAILSDGTVVTDVEAFRKLYEEVGLGWVYAVTKYEPVATMANAVYGVWAKYRMQITGRPPLEEIMASRRAAGECKDDKVCKM

SEQ ID NO: 656 - protein, 460 aa, Sorghum bicolor
MLSLSHPHPAASTTAPRHQRTPRAATPVWRRRRASHIVASAILLPGGGSTGGGGGPGDRRLPFTPPPMAPPGQLYQPFHPPPSPLPPSLRNLDLTQRLQILRDRMGLWHEYAPLIASLSRDGFNPSSIQEATGISGVEQNSLVVASQVRDSLLDDKVAAFPPDLLPYFDSYGGPDLLYELRFLNARQRADAARHAIDYRLEPKGVRELARAMKGFPRWRGEEGWEAFGRDSPADCLAYARFRQSREAIDVEERIAELERALQVVETESGRARVELELERARKKAAGEEVVEEDDPAASRPNVTVVRLQYGEVAEATTVFMLPVVRETDGVAAMESAPRRTKTDVDLGIVEVDKAWARWAVLPGWGPVAEAADDAVVVELADGRRLPWRTADEEPVLVIANRSKKEVVEQGIYVLEKDGRLVVERGKKLAEQGIAAAAAEVVIVVRPPKDEDGMISDEEWD

SEQ ID NO: 657 - protein, 521 aa, Sorghum bicolor
MGLLALQRLMSLQRDRQRRQRQTRTPILNGWIAASSLGKRKGSSCQKDAHGDSKVAKRMRCSIPALPEDIWRHIHSLLPLRDAARAACLSHSFLRSWRCHPNLTLNMHVLGSNANVPRENSSCIIDNILRKHSGSHINILKLQLYGIYDSYQYLDSWLQVAVTPGIEELTIEPCHSRVKMKQNVPCKVLSYGVRNSIRCLQLSFCAFHPTADLGLLRNLTSLCLESVHILDDEFECFLSNSPALERLDVNNCSEIMCMRIPCVLLQLHCLKVSSCLNLRVLESKARNLSSFILNSGCNVKVSLGETLQMKSLGMRRSNLICYARAEFPSNLPKLESLCISSDSEMVDTPMLPSKFLFLKHLRIYLGWAFSSGYDFFSLVSFLDASPCLENLLLNLQVSQHASVFDGSSQLRQMPEQHHGCLKSVKFIGFNSEKSLVELTCYILKNAKSLGCLTLDTTYGDPKCDNKIMTGGMCAPMNKGFLMEARRGVAAVRTYIEDKVPSTVKLTVVEHCTRCHADNLSE

SEQ ID NO: 658 - protein, 581 aa, Sorghum bicolor
MRWAAFLWEGASRASGGRRPGVSNLLLVVAAASSGGLVAYADSGSDAAVEKPQLPPRKKVVVLGTGWGGTTFLRNLDSRLYDVQVISPRNYFAFTPLLPSVTSGTVEPRSIVEPIRRILEKKGGEIKFWEAECFKIDPQSKKIHCRSNVGTNLEGNGEFSVDYDYLVVAVGARTNTFNTPGVVENCHFLKEVEDAQKIRRSVMDCFERASLPFLNEEERKKNLHFVVVGGGPTGVEFAASLHDFVTEDLSKLYPSVQHLVKISLIEAADHILTMFDKRITNFAEDKFGRDGIDVKTGYKVVKVSKDDITMQNPATGDISVPYGMAVWSTGIGTRPFVVEFMKQIGQANRRVLATDEWLRVRECDGVYAIGDCATINQRKVMEDISEIFRVADKDKSGTLTVKEIQDILDDIYVRYPQVQLYLKSKQMNGIADLVRSAKGDAEKESMELNIEEFKKALALVDSQVKFLPATAQVASQQGQYLARCFNKMKDAEENPEGPIRIRGEGRHRFRPFRYRHLGQFAPLGGEQTAAQLPGDWISIGHSTQWLWYSVYATKQISWRTRMLVVSDWTRRFIFGRDSSCI

SEQ ID NO: 659 - protein, 659 aa, Sorghum bicolor
MATPSAAASSSFLVPATTAVASTPSACPSTLPKKNAAGAGRRRHRTMQCRASSGGGRRGDGDDVDSRLLWLPRRQVLTGLSGVAAGFVGYPDDLASIALALEANPVESCRRGEKVTDKIVECSDPNRGFPCPPATRIPVVDFTPEPKVTRIRQPAHLLDAEYQAKYKEAVRKMRALDKSNPLSFAAQAAVHESYCDGHYRLDPSEKNRPFDVHFSWIFAPWHRMYIYFYERALGDLIGDDTFALPYWGWDTPAGMGIPAVFKGDDDNPLFDPYRNMDNNDALIDLDYLKTPRRPTVPFTPPPVSDAAARQAYDDAVRTNLATVYIQQIRDGKGPRAFLGEKLCSEASSRVKEVNERSKRRQGAGAPKVKASNAQGTLERMAHTTVHVWAGRSSPKAPATCTVDGGGVVAHDGKPHCNNDMGFLGTAGRDPLFYSHHANVDRMWHLWSTKLGGKGFDDAEWLDTSFVFYDDVKSPRLVRMKFRDVLDVTNLGYTYDKESEAALPWLKSKPTRFSSGKTPSSSVPAAEPKVASEFPLTLTKEAVDVPSVAIPAKQPGKDLVLLIEGIEYDPQINNKFDVIINVPKEDAGKVGPKDCEYAGSFTAVPSSNAAGGTLVGKVTLFIDGVLADLGLTNESAVDIVLVPHTDEEIKIYLPPTIENA

SEQ ID NO: 660 - protein, 334 aa, Sorghum bicolor
MASGVNDGSGKSLTHWLRENGFDDDAVARMSRRCRNLHSLDAGEASGVWDYLLTGVKMERRKLRHVVAKCPKVLTLSVDGKLVPTVQCLATLQARPGEVAQAIAKFPQILFHSVEEKLCPLLAFFQTLGVSEKQLAKLLMVNPRLISYSIEAKFSQTVDFLVGLGIDKEGMIGKILTKEPYIMGYSVDKRLRPTAEFLKSAVGLQGQDLKRVIMSFPDILSRDVDKILRPNLAFLQSCGFSRNQVTALVAGYPPVLIKSIKHCLEPRMKFLVEEMGRDMGEVVDYPQFFRHGLKRSLEYRHKVLKQMNSSCSLSEMLDCNQKKFAMKFGLVAAV

SEQ ID NO: 661 - protein, 695 aa, Sorghum bicolor
MGARDNGEGRDEKKGIGSDYVPTRDSFSSQGESRVPRKLSKKETKDNNSPRTTKSSASRQAQTKLQHKGLNSVQNKSQKQKKTVSPAKAVEVRKPDITRIPSRPPSELSEETDDIISDAGTVDDKGTEEAKEIDVLDEAPHCDQSTGTDDEIPDIEDKVVDHGKSVVGQGNGELVLKIDKLEQELREVAALEVSLYSVVPEHGSSAHKLHTPARRLSRLYIHASKFWSEDKRASVAKSIASGLVLVAKSSSNDASRLTFWLSNTVVLREIIVQTFGISHQFTPSMTTMNMNGGAKKLDGKSMTMLWRNNFNGMQTKLAAMQMPDDWQETSTLLAALDKIESWIFSRIVETVWWQALTPHMQKRTEGASTPKAGRVLGPALGDQQQGTFSVNLWKAAFHDAFNRMCPLRAGGHECGCLPVLAKLVMEQCVARLDVAMFNAILRESASEIPTDPISDPIVDPKVLPIPAGDLSFGSGAQLKNSIGNWSRWLTDKLGIDDDDSDEIGDVEDERRGRAETKSFQLLNELSDLLMLPKDMLLEKSIRKEVCPSIGLQLVTRILCNFTPDEFCPDAVPSTVLEELNSESLLERHTNKDVINVFPCIAAPIVYRAPSTLDAAEKVADIGVGAKLDRKASMVQRRGYTSDDDLDDLDSPLASLIDRSAPPSPSNGFTHFSSQRGVSMENTRYTLLREVWLEQR

SEQ ID NO: 662 - protein, 1128 aa, Sorghum bicolor
MPTPVPAARQCLAPPAVTALDAAVASARRRAHAQTTSLHLIASLLAPTAAPLLRDALARARSAAYSPRLQLKALDLCFAVSLDRLPSSSNDQHEPPVANSLMAAIKRSQANQRRNPDTFHFYHHHHQASASATAVKVDLSHLVLAILDDPLVSRVFADAGFRSNEIKVAILRPAPPVPLLARAGLPTRARPPPLFLCSFAAADDADVPSPAPALAGAAPGEDNCRRITDILARGRNPMLVGVGAASAAADFAHASPYRVLPVNHQTDLLAAVAAAPTTTPGSGIIFTIGDLKDLVPDEADLQDAARRVVAEVTRLLETHRAAARQTVWVMGWSATYETYLAFLSKFPLVDKDWELQLLPITAVRDAGPAPGLVPPPAPVTTVPALSMPATTSFVESFVPFGGFMCDTYEANSCPQALRCQQCNDRYEQEVATIIRGSGITAEAHQEGLPSMLHNGSMMGPNNGFDALKVRDDHMVLSTKIQNLKKKWNEYCLRLHQGCNRINRDPCQLFRHHMDVRVDRERCANPNQSSQSLALQREVIRPSAVSSLHTNTTAKSISAPSISTQMNADLALNLQVRQSKSDEPLQDRAVPSQHSNSSNCDNPEDHVSPSSAAAVTTDLALATPRGSSSKDSSNALRKHVEDAEGSIQLMPKKVDDLNLKPPHFSAQPYTCFRSSSNWDQTSPSALHPAASGGASAFGQWQRPSPLAAQTYDLSNYKLLMERLFKAVGRQEEALSAICASIVRCRSMERHRGANKKNDIWFSFYGPDSIAKRRVAVALAELMHSSSENLIYLDLSLHDWGNPNFRGKRATDCISEELRKKRRSVIFLDNVDKADCLVQESLIHAMETGRYKDLHGGRVADLNDSIVVLSTRMIQGYQDASLGMEQDNAFSEEKVVAARGHQLKIIVEPGTANIGGDSGGKVVVSSRHSLRNSQASLLSSSLSKRKLHISDGQEKTAESPSTSKRLHRTSSIPFDLNLPGDEAEAHDGDDDSSSSHENSSSDLEGYVGNLLRSVDESINFKPFDFGKLCEDIMQEFSSTMSKTLGSRCRLEIDAVAMEQVVAAAWASDSHEKRPVRTWVEQVFARSLEQLKVRCKNLSSCTLRLVACENEMPVKEDGFGAFLPSTIVLDW

SEQ ID NO: 663 - protein, 479 aa, Sorghum bicolor
MRESPPTQGEPSTSSAVDDSYSADRVEDSQLFLSVPALNQAASYLAQTASFLTQCLPVPGYVGLSEEGQELATLPPASASGRLSVQTSSVEPAGTNSSLGQADCGGSPSQENTGQMVPSHVFQNGASLFQGLVERARKTVRGSADDIGWLQRDQSLPTTEDGTARFLEILDSVRKNEHKLPDSVVYLLVPGLFSNHGPLYFVKTKAYFSKMGLACHIAKIHSESSVSKNAREIKEYIEEIYWGSRKRVLLLGHSKGGVDAAAALSLYWPQLKDKVAGLVLAQSPYGGSPVASDILREGQLGDYVRLRKIMEILVSKVLKGDLQALEDLTYERRKEFLRQHPLPQDVPIVSFHTEASITPSVLTALSHVAHLELPIAADGNSTRIPVVMPLSAAMAACSQLLVARYGEKSDGLVTRKDAEVPGSVVVRPERKLDHAWMVYSSLKEEPRDQADTSQVCEALLTLLVEVAQKRRHEMAMKDE

SEQ ID NO: 664 - protein, 529 aa, Sorghum bicolor
MAKGDDALARKRNRVRRKRLRSSENAVSARVAAIIASKRRRKSGKRRGCEGMCFSLPTPDDPFNERHGKKRKVDDEPTEDTAAAKDGDDPKKKGANTKKEQPVAKAGAEAKAKAKAKSKAVRERATGADEGRVDLDRPSKFLVVCLNAIRDTLAPEDGGGSIHGAGDWGVELWRCCSAQAPSDVLDASGACATVDQTAWLVSTACDIVARKERLGMVVSCPFLLYLVPSQEKAAQVRSICKPLKPLGIHSVSLHPGASIEHQISGLKTCEPEFLIATPERLLELVSLKAIDISSVSMLVIDGLKCFVDHNASDKIFSIRDAISNNPQITIFTDPSDKKVAAMAKSLLRGRITKLSINDSVSSRSAFIAQHVHFCPSEELKTSKVKEILEGILQSHPKKTSKVLLVVANDQKARYMSSSLKLKNCTVIDDSHGSSFTICSSLGLMNVIVKDRENMAVTDAEEFETVLVVDLPPSVDEYVEILTGVALHVIGGEVHSIFCNADASIAKPLAELLADCRQVVPEFFKNLESS

SEQ ID NO: 665 - protein, 750 aa, Sorghum bicolor
MEQISLGNRYKECRPRRTSSCQTKILVGKDVLHELEQRRSSPSVIAKLMGIDVLPPNVVNSRHQEFKDVFEVSEEPPEAVTKERSHHFPKGLPSLKQSALRLKKLMPSKTLYRDDTHDCHVDSTDGLGRLNSVEINNPLFEKRPRDMNYSANYQYEKNTSSDCRTYPVGLANSSLSNFSLLSRGKNKDFNNIVLLEPPCLDKGHDPENVFSIPYLSPLNKNCRRGMKHKQSEFPVMENGRDWQHILSTEDNNVPRIRKERFLTSDPIDRLQIGQEASVHQFGNTDASCPGSSQRYFCGNDNFNQTNRSSSNSTLLKIRRHAESAVGSKTLAQMFALSDSERLKLNSNSRAPIRRNMIDRDNGHSKDGCFIVLPKHAPLQSIRSSMDRNSCSEGSSQGKKNSNISNIYNNGKCQFDYFRDKPRLLKQIGSGSEAHSAHLSNACCFQNLTADNFSSPDCLNEKVLFTTDEDLVLQPPESVASGFNLQVSRKQRVTILPFRCHEDELISVSDHTDSTKSCKGSKEVEQPSPVSILEPPIDDDICFPGCLDYDDLQGMAKKQRDGHQYHNESEVAMSSDDEDHSFYQSLEAFQVEENWDFSYLLDILICSGIIVADWQLICKSWYLPGCPVGPHVFDRLERKYNKIATWAKPERRLLFDLVNSILSEVLAPCVDVHPWVRPNRHCVALWGPEGPVEKVWQTIVRQREDCVTGQPDEMVLDTKWLEVGNDINMVGKQIAMMLHGDLLEEVIVDFL

SEQ ID NO: 666 - protein, 334 aa, Sorghum bicolor
MERKGGCCLAPRYGAAGPAAAQQQAGAAWQMGRIMLKFRPIAPKPAAMAPVPAPTPVVAGPSVGAAGRGKRKAVCGAGGGRRGRKPKKAAAVVTAAPALAAAAAQDAGDCKKDCEKEKSSSSRSSSSSGMTSVDSSPPPPQHHLPTLLPLMPVTAVEDKGPAAGAATEELPAPVPSQVAAAATGSARPFAPRALRPGSAAWAASLVTVEEVTATWRDGEAPPSSAACVADDAPAFVSDQWGRVTWRNAAFVRAVPADDGGDEVETQTPVALSGALPAWGTCSGFTCRVRWHSSPRRVGSTSSVVAPCDVWRLDAGGSYLWRLDLQAALTLGGRL

SEQ ID NO: 667 - protein, 341 aa, Sorghum bicolor
MRRAGGLARAGHGAATAAGRATKVMRAAVSAFFAGYHCFTSVAALLALPFSAAVLASEAMAPSSGILRGVAARLRAVFAAAGFPPSPFFALLEAKLSQTVFTFAATLPFALTFLLLAKACVAAMLRDDVDDGHRRRRRLAVAVAKLPPCGAVARAYPAVVATHLLNAFLMLSANAAVFSLLLLAFGAADLLGLTSHFWTLALSAAGAIVYSLAVGVATVVCNLAVVVAATEPGCAGHAAVLRACVAIRGRVSTALALALPTNLGMAAAEALFGLRVVAQRRKDGGRLAPGVAGEAFSIAYIHAICVVLEIIVSCMFYRSCKRSEADELRELEPEEKGDLQA

SEQ ID NO: 668 - protein, 85 aa, Sorghum bicolor
MASTTASNLGGAWFGELASALQGTWQAVAATAGEDPRQLQQQKPARGGGSSNKAAQGKEEGDVARCGGAMSDTTLYLLLDRFTPN

SEQ ID NO: 669 - protein, 397 aa, Sorghum bicolor
MAAGSSVVWAAHHPSPSHSHHHRPRRVVLLPPPPPLPARRGGASLARSPRASLAAAAPAVAVRTASEEAVYEVVLRQAALVKTAAPQRTTRWAEEEKKEEEEGVVGWGLLGDAYDRCGEVCAEYAKTFYLGTQLMTPERRKAVWAIYVWCRRTDELVDGPNASYITPTALDRWEKRLEDLFEGRPYDMYDAALSDTVSKFPVDIQPFKDMIEGMRLDLWKSRYMTFDELYLYCYYVAGTVGLMTVPVMGIAPDSKASTESVYNAALALGIANQLTNILRDVGEDARRGRIYLPLDELAQAGLTEEDIFRGKVTDKWRRFMKGQIQRARLFFDEAEKGVAHLDSASRWPVLASLWLYRQILDAIEANDYNNFTKRAYVGKAKKLLSLPVAYARAAVAS

SEQ ID NO: 670 - protein, 418 aa, Sorghum bicolor
MDLRRRRLALAVLAAVAMCAATLTAVVEGFDILEILGKHDEFSQFCKLLNETHLAGDINRDRTITVLAVANGDMGHLTGGHYSLGTLRHILELHVVADYYDDKKLKQLSHAATAASTMFQRSGFAPGMAGYVNITQHRGGKVSFIVDDAADSVKPVTYVKQIESHRYDYSVLQVSGVLSSPEAEAPVAPPAPVNLTDILSKKYCKSFAALLAADAKVFDAINGTKDTALTVFCPVDAAVAAFMPKFKNLTAKAKTAILLYHAIPDYYSMQFLKSNKGKVTTLATTNTNKKDYTYEAESKDDTVTLDTTVVTSTIQATVRDDDPLAVYAVSKFLQPKELFKAKTADLAPAPAPEGPKKKKKKKPASGSAAAAPSDDDSADGPSADDSSDDAADKAAAAPASLFARWVTIAVALALALAA

SEQ ID NO: 671 - protein, 155 aa, Sorghum bicolor
MAPSSSSPSSLSSSGGSHAGLAIAATAMALSGTLVLYSLCRAKQPHLVPSDAAPSPRLRPCLASSDKRKKKKREMARRGKSQQKRVRFADDVVDTKDNGAANAAAAGAAREEAEAEAEPSCCTAALRTTPMPANREALYRGMLRGRSMLRVTCSY

SEQ ID NO: 672 - protein, 320 aa, Sorghum bicolor
MLLRSASSPLLNCVRAPAASAAAAVEHLAVVSPLLSPAVAAAPRQGAVLCRAMSEGDLAAPLVPAKKDHEGLHGRALPRLSASSSSSASISLEEDDSEGVGEEEEEEETVVAVGADVPLPLRRLLTSTGLDVSASVSVSAAAAREALALVELQGVGGSSGGGNGKALGSSGGQGGVGDGGGGGGDNRAATDTHYRQMIEADPGNSLLLVNYARFLKEVEGDAARAQEYCERAILASPGDAEALSLYAGLVWETSRDAARADDYYSRAVQAAPDDCYVLGSYAGFLWDAEEDDEENDNSETLPPPSLFQGAVQHPSITAAS

SEQ ID NO: 673 - protein, 237 aa, Sorghum bicolor
MGHGHGGGCRCCELCGAPAAVHCAADAAFLCAACDAKVHGANFLASRHHRTRLHLAGTPDEEEYESAAASSCVSTADSASSSAAPRRRRRPAPAGSGSGSPRLRPPCEAVLEAWAKRAGLAAGAAARRRAARAVRACAHDLASARVPPRVAMAAALWREVAGRGGGIIGAGGGGGCGHDEALRRLEACAHVPARLVVAVATSLARARARRRRRAATDAVEGWDECAWAGPKSSPARS

SEQ ID NO: 674 - protein, 379 aa, Sorghum bicolor
MADVQGDKEAGLEDDDFPDDGPLVPEDPGEGGEPRSGGDEEEEDDVDGLASFLESEILSGSNDEDPIDQEQRKQEEDGGAAKNKRKQGSGSDGHGCSGSGSEGEQTKRARREEMRRQAKGKAVAPQIDTGMFSNIPPELFLQIFKFLSSEDLISCALVCRFMNAAASDETLWRRLYCMRWGLASNAKFRECAWKNLYIQRDREDMVEFVRNTPTEFKEYYIQMQAAKRSQTPHPSEVNDDKVMLDKTVADQVSSWKNSRGLTDEAVKGHSCSGNTCSYTQIGDAYICEKTGRVHVCDDACREFVLDQSSGLLLCTISGHCFERWLCPDDEWEADDNDLQQAGVVDEAEPFMGSGRYARAIMLGYNCTDEKELEDALGLC

SEQ ID NO: 675 - protein, 339 aa, Triticum aestivum
MHTQIMDMASPPSGASSEQDGIPVVDLAVLLNGDAGERSQAIRHLGRACQHWGFFMVTNHGVPEALQSAMMDACRELFGLPPEENAEFMDAGPMDPVRVGTGFNSAVDGARYWRDYVKMFAHPELHCPAKPDALRGVAAEYAARTRALLLDLTAAISESLGLHAGRVAERLDLGSCFQILVGNHYPPCAAGPGDDDDGAVGLPAHSDHGLLTLLCQNGVDGLQVKHDGRWLLAKPIPGAFFVIAGDQLEIVSNGRYKGVLHRALVDREQARMSCVSLIGPCLDAVVEPVPELAVPPLGGLEFRGVKYRDYMEHQQSNKLNEKGALDLVRVQKRPAILYT

SEQ ID NO: 676 - protein, 437 aa, Brachypodium distachyon
MRRLSHFLLLTVVLAAVPRPAHPLTELESSQIRRFQDYLRICTAHPSPDYAGASAFFLPYAASLGLGATTLHFTPCKSKPLLLLTWPGTDPSLPSILLNSHIDSVPAEPEHWIHPPFAAHHDPANGRVYARGAQDDKCLPIQYLEAIRGLQAAGFAPPRTVHISLVPDEEIGGEDGHEKFVQSEEFRALNVGFMLDEGQASLTDEYRVFYGDRLVWKLIVKATGAPGHGSRMFDGAAVENLMDIIETVAEFREAQFSKVKAGKKGPGEVVSVNPVYMNAGTPSPTGFVMNMQPSEAEVGFDIRIPPTEDIEQIIRRIEEEWAPAHKNLTYQLMKKGPVRDVAGRPLVTQTNESNPWWSVFEHAIISSGGKLAKPEILSSTTDARFVRQMGVPALGFSPMINTPILLHDHNEFLEDKVFLRGIEIYQHLIRALSSFKG

SEQ ID NO: 677 - protein, 1632 aa, Sorghum bicolor
MPKVFGTGVFEFRHPRAAEYPLPADAAPATAAAPDKVPASTGGGSITLLDIQRDRLTRVATEHWGTPAAASAFDADLVRKIYATELRVEGRGRKTVPLQRVMILEVSQYLENYLWPHFDPAHASFEHVMSIILMVNEKFRENVAAWTCFHDRKDAFKGFLWRVLKLKEESMDKSGCWQLYVFHFGQDERALNMAEKTNYLLFMINSFQSLEDELVRETILQLVSLKLWNTLSFGRLQMELCLNPELIKKWTKIKRREAKEAKKADQPIDPSEMLENKFLRNLIEEFLEILDSKVILSNQDAGEESVLNESLSGQIDDSCVLYCERFMEFLIDMLSQLPTRRFLRPLVADVAVVAKCHLSALYTHEKGRLFAQLVDLLQFYEGFEINDHSGTQLGDDDVLQAHYSRFQAFQLLAFKQVPKLRDFALSSIGSLHKRADLAKKLLVLSDVELQDLVCNKLKLISAKDPCSGRRDFLIEVLVAFFEKRQSQKDAVNALPLYPNEQIMWDESLVPSINYSGEGCLALPKLNLQFLTLHDYLLRNFNLFRLESTYEIREDIQEAVPHLHAYINNEGETAFRGWSRMAVPIKEFKITEVKQPNIGEVKPSAVTADVTFSISSYRHQIKSEWDALKEHDVLFLLSIRPSFEPLSPEEAAKSTVPERLGLQYVRGCEVIEIRDEEGTLMNDFTGRIKREEWKPPKGEIRTVRVALDTAQYHIDVTETAEKGAENVYGTFNILMRRKPKENNFKAILESIRDLMNETCVVPEWLHNIFLGYGNPSAAQWMNMPDLLEVIDFKDTFLDASHVQQSFPDYQVTFINSDGTENLHPSPPFKIRLSKKMRESSHALPGNVNSNLTVKSNNIADGEPQKEKLIVESYIPADPGPYPQDKPKQNSVRFTPTQIGAIISGIQPGLTMVVGPPGTGKTDTAVQILNVLYHNCPSQRTLIITHSNQALNDLFEKIMQRDVPARYLLRLGQGEQELATDLDFSRQGRVNAMLVRRLELLGEVSKLARSLRLPEDVGYTCETAAYFWLLHVYARWEQFLAACAQNQDKPSFVKDRFPFSEFFSDTPQPIFTGESFEMDMHAAKGCFKHLSIIFQELEECRAFELLKSTVERANYLMTKQAKIVAMTCTHAALKRRDFLQLGFKFDNLLMEESAQILEIETFIPMLLQRQEDGHARLKRCILIGDHHQLPPVVKNMAFQKYSHMDQSLFTRFVRLGVPYIELNAQGRARPSIAELYNWRYRELGDLPYVREQAIFHKANAGFSFEYQLVDVPDYKGKGESAPSPWFYQNEGEAEYIVSVYIYMRLIGYPATKISILTTYNGQKLLIRDVINKRCKPWNIEPPNKVTTVDKFQGQQNDFILLSLVRTRFVGHLRDVRRLIVAMSRARLGLYVFCRRSLFEQCYELQPTFQLLLQRPDKLALNLEECTPFTERPLEETGNIHYITGTEDIDHLVKFRLEHLRQMQYMQYYAPPANELPQAVPENIADAIPSENGNAGSALNDANEHMAVEENGGATDTVIDNRMEEDGVEAKDDMTQEGNKGEGSGEGHMATEDTQGEVQASTNDKMEDADATSTDKMEEANAMPTDKMEEANATSTDKTEEANATSTDKTEEANATLTDKMEEENSDLKDKMDEE

SEQ ID NO: 678 - protein, 378 aa, Brachypodium distachyon
MATPAPATLSTARSLRPRCSPLRGALAVPTARLGRWRRSLGSLRAEAAAEDAAGAGVGVGEQLKAGVAVYKPRSYEVLVADAARSLACAIDDGRTRLEIEFPPLPSNISSYKGSSDEFIDANVQLVLAVARNLKELRGTRSCIVFPDQPEKRRASQLFRTAIDSIEGVTVSSLDDLPSGPINNFFKSIVSTLDFDFSDDNEDRWKSDEPPSLYIFINSSTRDLSSIEKYVETFAPSTPSVLFNLELDTLRSDLGILGFPPKDLHYRFLSQFTPVFYIRQRDYSKTIAVTPYIVNYSGAVFRQYPGPWQVMLKQADGSYACVAESASRFTLGQAKEELLRVLGLQEEEGSSLEFLRRGYKNATWWEENVDQEKSPAWRT

SEQ ID NO: 679 - protein, 619 aa, Sorghum bicolor
MPLFDKKPFSLLEPPKDLDSKEKVFQIRFTKEIFRDYEEYLKRLNLYRQRVWTCKISGKSNLTFEEALVSEHKAMEKAQNLPTELMAHVLRMTQYSTIGLHELVNKIYASLLEEVFEGIELHANKDGAVAPCKILKILDSGCTKMCEVGWIRQGKAVTNTSVIKAADLFYRRAPVSRNTLKIFIKDATSQSNPWVIHENLAKKFGISMDPPDSIMKKGRKRQEDGTIEDGRKRLKTDEEQAYVKYPIDDLLVRPNADDPALFKRPPLATDFRVPRCSVGDLLMVWDFCSSFGRALNLSPFPLTDLENAICHKESNVLLVEIHVAMFHLLMKDEGDYFTVVQNKKRKLKLSSVTWDEYLCDFLEMTKNEELSTNIATVKRVYYGVIDTDIKLKILRELVEEAIQTSAIREILSDRVDQKQVLNATKRENTRRDKQEQNLNTEIAMKKEENQTDAVQGGHEGVDELVRGKENDKSNISRSRTEGKRHLVRHLDTEIDKLSIRSSPLGKDRQYNRYWFFKCEGRLFVETADSREWGYYSTKEELDALMGSLNVKGIRERALKRQLEKFYNKISNALEKRSKDIANKMLLEEGVLRRSTRVRANPKDNPSMAFLKYVNKWKDN

SEQ ID NO: 680 - protein, 1619 aa, Sorghum bicolor
MAPARGVRSGGSAAAAALVSVLLVGCLVAGGEGAEIRRQKNVQTALRAKWAGTPLLLEASELLSKEWKDLFWDFIDHWKELEKGSECLTAKCCVQKIVEDARTLLNEPLSSIFEFSLTLRSASPRLVLYRQLAKESLSSFPIDDSPEQISGHGTGKTFDGAVDPNSSGGTCCWVDTGNVLLFNSADLHEWLGGLGKLAMDSTEQPELFDFDHIYPRTNITAPVAIFYGAVGTNCFKEMHVQLAEASKQGKVRYALRPVLPSGCGTTSTFCGSVGTVDAVTLSGYGVELALKNMEYKAMDDTAIKKSVPLEDPKTEDLSQEVRGFIFSKILERKPELNAEIMAFRDYLLSSTVSDTLEVWELKDLGHQTAQRIVQASDPLQSMQEINQNFPSIVSSLSRMKLDDSIKDEIIANQRMVPPGKSLMALNGALINIEDLDLYLLMDMVHGELSLADQFVRLKLPQSAAHKILSAPPPAESNSFRVDFRSSHVHCLNNLEEDDMYRRWRSNIQELLMPVFPGQMRYIRKNLFHSVYVLDPASACGAEASLLLTTIDMILSLYQDGVPIRFGIIMYSSRFINVIEESDGTPTNNGEDTSILITRLFLYIKETYSTQLAFQFLSNIHKSRNGEDDYNEELVEAHQVEGAFVESLLSNAKSHPQDVLLKLQKENVYKQEAEESSRFVHKLGLYKLQCCLLMNGFVHEASEEATMNAMNDELPRIQEQVYYGHIQSHTDVLEKFLSENSYKRYNPSITGNSAEKKFVSLFASYHQDSSVFNDMKYLQSPGTTDDAKPITHLLAIDLSSKVGTKLLSEAIRYLMDGSDRARVGLLLYVHTGGSSPILLLKDIFDRTIYSFSYKEKVLVFLHGLLKFYEAQPLPASSVADDWTRNMMEKVYTLAAETALPVDDYKAWFKSFSADTVLKGIDKLSDFLFGQLGLVFGSNAVITNGRVFIMNEGESFLANDLGLLESIEYDLRTKYIFEIIEEVEFAGVDPDDLTSQFYSDIAMLISSSMSVRERTSERARFEILHAEHSAIKLNNANSSIHIDAVIDPLSPIGQKLAPLLRILWKQIQPSMRIVLNPISSLADLPLKNFYRFVLPSMDDFSSTDHSVHGPKAFFANMPLSKTLTMNIDVPEPWLVEPVIAIHDLDNILLENLGDVRTLQAVFELEALLLTGHCIEKDRDPPRGLQFILGTKQRPHLVDTLVMANLGYWQMKVSPGVWYLQLAPGRSADLYELPPKLIAIDSLRGKLMHIEVQKKKGKEHEELLNAADDYHFQEKTDNKGWNNNLLKWASSLISGDASSKNKADKITDRKDARQGETINIFSVASGHLYERFLKIMILSVLKETQRPVKFWFIKNYLSPQFKDVIPHMAREYGFEYELITYKWPTWLHKQKEKQRIIWAYKILFLDVIFPLSLRKVIFVDADQIVRADMGELYDMNLKGRPLAYTPFCDNNKDMDGYRFWKQGFWKDHLRGRPYHISALYVVDLAKFRQTASGDTLRVFYEQLSKDPNSLSNLDQDLPNYAQHTVPIFSLPQEWLWCESWCGNATKARAKTIDLCNNPMTKEPKLQGARRIVPEWTGLDSEARQFTARILGDDVESAEATPPPSETPKPEDKDTDQEVKDEL

SEQ ID NO: 681 - protein, 190 aa, Hordeum vulgare
GSSSILAHLWRATTRARGLRHNETSKIRLSVDGRDRLGVPAEYAGNLVLWAFPQATAGDLLNRPLKYAAQTIHDEVARVADAEYFRSFVDFTSSGVIEEEGLAPSAALNLREVLCPDLEVHSWLTFPFYDLDFGTGTPSYIMPSYFPFEGLIFLMPSYIGDGSVDAFVPVFQHNLEAFKQCVYSIDDLHA

SEQ ID NO: 682 - protein, 574 aa, Arabidopsis thaliana
MSNSTPCITPFPVTKTAVAAPATVVEGVNDANSTPISPFPVTKTAEAAPATVVEGVNDASRKRERPKTYRDYKGRFITASGTFTPRSSLRKRRGDMSMRLGGGDFTPHSFTVNKGEDIIKRIMSFTANGSRGISVLSVNGAVANVTILPHGSSRRVMTFKEEYEIVSLTNNTMAISESGGVKNKTGGWRITIGGAAGGRVHGGALAGSLIAASPVQVVIGSFWPLITNSRQKRKYVSKAMVAPSITPNLVASSSTRPVQQPEMVGPSHSQKRNSESNRTMVVLSATPPNTLASSSTGPVQQPEMVGPSHSQKRNSESNKTMVVLSATPPNTLASSSTGPVQQPEMVGPSHSQKRNSESNRTTVVFSATPPNTLASSSTGQVQGPDMIGPSHSQEKKDESNNAMAVFSPTAPSFLASSSTEQVQQPDMIGPYHSRQRNDESNDVILLPTVQYLLASSFTRQVQRQPEMTGPSHSQKRNDESQAAVVTPAIPNSLASSFTGQVQRQAEMTGPSHSQKRNNESQAAVVTPEIPNLLASSFTGPEMIGPSHSEEMNDEFNPSQFLTLGWYSSTPEQDK

SEQ ID NO: 683 - protein, 462 aa, Arabidopsis thaliana
THSATPLTQISFTMFSLKSLISSPFTQSTTHGLFTNPITRPVNPLPRTVSFTVTASMIPKRSSANMIPKNPPARQQLYQPFRPPSSPIPTQFRSLDSAGKIEILAGRMALWFEYAPLISSLYTDGFTPPTIEELTGISSIEQNRLIVGAQVRDSILQSIHEPELISAFDTGGAELLYEIRLLSTTQRVAAATFIIDRNIDSKGAQDLARAIKDYPNRRGDVGWLDFDYNLPGDCLSFLYYRQSRENKNPSDQRTSMLLQALGVAESEKAKNRLNTELYGDKEAEKEKEKKKKEEEVKAIRIPVVRLKFGEVAEATSVVVLPVCKAEEGEKKILEAPMEIIAGGDFKVVEAEKGWKRWVVLPSWNPVAAIGKGGVAVSFRDDRKVLPWDGKEEPLLVVADRVRNVVEADDGYYLVVAENGLKLEKGSDLKAREVKESLGMVVLVVRPPREDDDDWQTSHQNWD

SEQ ID NO: 684 - protein, 129 aa, Hordeum vulgare
RGQGPDAPHALQGRLPQALRRTSPKASVDRELRRGCGRRLKRSMDQHNLHALHPPIDRRSSPQTTTARSMRLCSVSPANRRWAEAAVVPELSSVSRSFTLGLEICGEAGTAEAFTRVSLNVCLFVVFVM

SEQ ID NO: 685 - protein, 212 aa, Hordeum vulgare
MTGVGGDAKKSLTQWLGDKGFDEEAIGRMSKRCRNLPNLDAGEASGVWDYLLNDVKIEQRKLRYVVTKCPKVLTMSVNEKLIPTVQCLTTLQAKPGEIAQAIIKFPPILFHSVEEKLCPLLAFFQTLSISEKQLAKLLMVNPRLISFSIQAKFFQEGDFLVGPGIHREGMIGKILTKEPYIMGYSIAKPVRPNGEVLKSPGGVTGSNLQRAS

SEQ ID NO: 686 - protein, 265 aa, Hordeum vulgare
GTRPLSWKKRLEICIGAARGLYYLHTGVKHTIIHRDVKTTNILLDDKWVAKVSDFGLSKTGPNMDATHVSTVVKGSFGYLDPEYFRRQQLSEKSDVYSFGVVLFEVLCARPALSPSLPKEQISLADWALRCQKQGVLGQIIDPMLQGRIAPQCFVKFTETAEKCVADRSVDRPSMGDVLWNLEFALQLQESDEDTSSLTDGMLSSSGASPLVMTRLQSDEPSTDASTTTTSTTTMSMTGRSIASVDSDGLTPSTVFSQLMRPGGR

SEQ ID NO: 687 - protein, 552 aa, Hordeum vulgare
YASVLRFQLEEAVEGQDFSEAAALKRALLDATAGDAVSRVMAELKSAIEEQRYQDASRLTKLAGTSLVGWWVGYAKDTDDSIGRIVRITPGVGRYVAKSYSPRQLITASSGSPLFEIFLVRDEDETYTMKVVHLRPTKGASSASSSVPSTATEDPAKAETESSPDSSVLSEAIAEEANTDTKLKGNEDVEEKAQDTGRTKESGVEGLKSVLNFFKSRIPEFKVQVINVEVPEEAELVADSSEELVQDDVKSTSESSLEEPVAEEFQEEDVSDGDSDSNDESKGPEVKLFISGVVHNKEEAGAKSYVRVPAEINNLERDSFELYIPGKGSDRDLSETKAAKQKVADMAAKLASELMPSDVAKALWGTTKSSSKINKEVQELLKLTLSKARVKLTENTIFNRIVTDSNGSDPFNGLYVGAFSPYGPEVVQLRRKFGHWNSTDDVEFFEYVEAVKLTGDLSVPAGQVTFRAKVAKGSRLENRGAYPEEFGVTASYKGQGRIAQPGFKNPRWVDGELLVLNGKSAIPHIGGAELGFLYSVPEQSFLVLFDRLTLPE

SEQ ID NO: 688 - protein, 574 aa, Hordeum vulgare
RHEADPKEARAGIQEVHFLPFNPTDKRTALTYIDADGKMHRVSKGAPEQILHLAHNTSEIERRVHAVIDKFAERGLRSLAVAYQEVPDGRKESPGGPWHFAGLMPLFDPPRHDSAETIRRALNLGVNVKMITGDQLAIGKETGRRLGMGTNMYPSSALLGQKNSDESISALPVDDLIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWNFDFPPFMVLIIAILNDGTIMTISKDRVKPSPLPDSWKLAEIFTTGVILGGYLAIMTVIFFWAAYKTNFFPRLFHVESLEKTAQDDFQKLASAIYLQVSTISQALIFVTRSRSWSFAERPGFLLVFAFFVAQLIATLIAVYADWKFAAIKGIGWGWAGVVWLYNIITYFPLDIIKFLIRYTLSGKAWDLVIDQRIAFTRKKDFGKEERELKWAHAQRTLHGLQPPDAKMFSDKGGYNELNHMAEEAKRRAEIARLRELHTLKGHVESVVKLKGLDIETIQQSYTV

SEQ ID NO: 689 - protein, 77 aa, Hordeum vulgare
SARGSSPGYYDGRYWTMWKLPMFGCTDATQVLNEVEEVKKEYPDAYVRIIGFDNLRQVQCVSFIAFRPPGCEESGKA

SEQ ID NO: 690 - protein, 231 aa, Hordeum vulgare
GKLSLIGHSAGGWLARVYMEEFGTSDISLLLTLGTPHLPPPNGVSGVIDQTRGLLNYVEKNCAPAVYTPELRYVCIAGRYIQGAPLTGSSLAATTDELVAVDAPSEVAEAVMVSADNKTAPTGPTFRARFVGQGYKQVSDTPKQCHAVEYSTFIFQTETTEQYPKSHTRFACGRADVWGDGVVPEVSAHLEGALNISFDGVYHSPVGSDDEERPWYGSPAILEQWVHHLLS

SEQ ID NO: 691 - protein, 195 aa, Hordeum vulgare
LNSCPTVVSMARELDPSLPLSAAQLVRKLKFASPWPAEAEVVQELLAASSVLNKAMVWSETEVKLNLHGFSITSAYVLMLQWVDAVRGGRALPLEVSVVCGVGKHSDVRGEPKVRELAQEVLSRMGSPLRLSARNKGRLVAKRDRVKQWLATEWTSVVPEESTDQPPYASDQQPFLPNLLRKLGQFFSSFVAVSR

SEQ ID NO: 692 - protein, 138 aa, Hordeum vulgare
TRHTSRAGRGGASVLRRRASPSPSAPAASHGYRRAVLRSPDDSPLHPRAAIPHLDAGPGARSAIRRRRRRELHPALRRARRPCLVDRLQVVEPLLIMDEDGDGAKFQKAILGSRAFMVILQPGMVTDFRNPPLEGKRK

SEQ ID NO: 693 - protein, 114 aa, Hordeum vulgare
MAATALRTICKRIGGRAIRPSPSTSRLFHSTRKEELYRLMSENRARIENQKGPIKHLSSHVERKPEDPVWRFYRRAKWYHLVIMYSPTILYVCMSVCGVPDGKKEMTPAEKEDG

SEQ ID NO: 694 - protein, 217 aa, Hordeum vulgare
MATQWFSNMVMDEPSFFHQWQTDATLEQYTEQQIAVAFGQGEMEAALMQQQYAAAAVGEHRPRKAAKVNTSWDSCVTEQGSPADSSSPTILSFGGHADAFAKAPQAGSAAAYYGAASAPVAPVKPKQEVDAAAVVAPFQQVKRSYDAMVAEPARAPSRPAAQNQRHILAERKRREKLSERFIALSKIVPGLKKMDKASVLGDAIKYVKTLQEQVKGM

SEQ ID NO: 695 - protein, 527 aa, Brachypodium distachyon
MARSTTARWLLLLALVAAYHGGGASVRAAVGAGAHWLGGLSQASFPKGFVFGTATSAYQVEGMAFSDGRGPSVWDAFAHTPGAPKAPIAIAAYYAYHFCCAYCLRESGRFSDKEILWGIKMQTVTTDQYHHYKNCQERIPGTYVFMLAQEDVNLMKGLNFDAYRFSISWSRIFPDGEGKVNEEGVAYYNNLIDYLLQKGITPYINLYHYDLPLALEKKYGGWLNAKTVELFADYADFCFKTFGNRVKHWFTFNEPRIVVLGGYDVGSNPPQRCTKCAAGGNSATEPYIVAHNFILAHGYAVARYRNKYKAAQQGKVGIVLDFNWYEALTNSTDDEAAAQRARDFHVGWFVDPLINGHYPQIMQDLVKERLPRFTPDETKLVNGSADYIGINQYTANYIKGQKLVPQKPTSYSADWQVTYASDRNGIPIGPKGEVWKSSSRHNRKRYRYCSMYLRMDQPGNLTRDEYLHDITRIRYYRSYLAELKRAIDGGANVLGYFAWSLLDNFNSTELERHPKALAYWFRDMLKV

SEQ ID NO: 696 - protein, 322 aa, Gossypium hirsutum
ELKDRTDQPRGTWEDVYRNAKKADRMRNDLHERDERELERIGQPLCIYEPYFGEGTWPFLHQNSLYRGIGLSTKGRRPGMDDVDGPSRLQLLNNPYYRDTLGEYGAFFAIANRIDRLHRNAWIGFQSWRATARKASLSGIAETSLLDAIEKQKNGDALYFWVRMDTDPRNNMQRDFWSFCDAINAGKCKLAFSETLKRMYGLGQDFNSLPPMPEGEGTWSVMQSWALPTKSFLEFVMFSRMFVDALDAQMYDEHYQSGHCYLSFSKDKHCYSRVLELLINVWAYHSARRIVYVNPETGAMQEYHKFKDRRGKCGSNGFHSTL

SEQ ID NO: 697 - protein, 79 aa, Zea mays
MAIAAVRRLLWRELGTAAAAAALGTDGNLFARLVSEPECRVKATMEEAASSGTHRDGAFWEPPVTALLRASSPTKAHLD

SEQ ID NO: 698 - protein, 144 aa, Zea mays
MWWEWEGDGGEAPREETPVDFDFIALLAKPKDYYKILEVDYYASEETIRSSYIRLALKWHPDKKQGQGEENSTSKFQEINEAYQVLSNPAKRQEYDKKGILYVQDQNVVDYLNRHKGLILTCNGLGIRMAYMDFCVYDRWGQWG

SEQ ID NO: 699 - protein, 875 aa, Zea mays
MDLFTIDSDSESYTGTSDSEDQECEFTYSDHAQNILSSLDESIGKIDNFLTFERGFLHGDIVCPVSDPSGQLGRVVGVAMFVDLETSSGDIIKDVNSKKLSRVRSFVSGDCVVMGPWIGRVIRAFDLVTLLFSDGAKCEILLRDSDVLKPIPPVLFEDAPYFYYPGQRVRIVDPSVSKSATWLCGSWRPSRDDGIVSHVDVGLVHVNWITSVTNVWGDKSSSPPNIQDPKKLTLLSCFPYANWQLGDWCALMTDNNGCLWMDSGKSCILSEDQKCDSHAHMYFESYGSDCSQTFVVAKTKSTVDVLWQNGTVSLGLEPQALLPVSTLGDHDFWPGQFVLEKLTVEDAARCPRTAIVSDVDALERTVNVKWIGPAHSDIVSYGSDPAVETVSVYELVEHPDFSFCTGEVVIRSAMNIDKSEADPTNGSLASKESLVTSSGFLSCTGNVLGYKDNGIEVQWANGVISKVQHFEIIGLDKLLDNSSVESMNEEHTIGDSLDEAEQEELNHEVCLFIALESTEDCTGSLCKATAFLFPKTAFDFLTNVAASLFGIHGSPSPSSVLVDPRYEIVKMAEMQPCAEETPKEEQIVKFVAQIDKPILSSEDAISKRFDVVTDCLDHHFVKENGHESVTRGWLKKVRLEWNILQNDLPDGIHVRVYEERMDLLRACIVGAPGTPYHDNLFFFDIFFPPDYPHEPPSVHYHSGGLRLNPNLYESGKVCLSLLKTWTGTGNEVWNAESSTVLQLLLSLQALVLNEKPYFNEAGYDKFVGKADGEKNSITYNENAFLLSCKSMMYVLRKPPKHFETLVKEHFTCRAPQILDACEAYLGGDLVGHAHDKAYVAEDGNKNCSTGFKIMLGKLLPKLVTAFCEAGITSDP

SEQ ID NO: 700 - protein, 940 aa, Zea mays
GRRILLHFEAVDSAFFAWVNGVLVGYSQDSRLPAEFEITDCCHPCDSDKENVLAVQVMRWSDGSYLEDQDHWRLSGIHRDVLLLSKPQIFITDYFFKATLDENFSLADIEVEVEIDSHKQDQEHVPTLSIEATLIDNSGLSNSIDADLSSANAVNLKPKPKRTRSPCLGFHGYVLGGKIENPKLWSSEHPNLYTLVVLLKDANGKLIDCESCQVGIRNVVMAHKQMLVNGCPVVLRGVNRHEHHPRLGKTNLEACMIKDLILMRQNNINAVRNSHYPQHPRWYELCDIFGLYVIDEANIETHGFDESNTFKHPTLEPIWANAMLDRVVSMVERDKNHACIIVWSLGNESSYGPNHASMSGWIRERDPTRLLHYEGGGSRTSSTDIVCPMYMRVWDVVKIAKDPSETRPLILCEYSHAMGNSNGNIDAYWMAIDNTFGLQGGFIWDWADQGLLKEDSDGSKFWAYGGDFGDTPNDSNFCLNGIVWPDRTIHPALHEVKYLHQPIKISSADNMLKIENGHFFETTEALDFSWVLHGDGCVLGSGPLNIPTLAPQTSQLINMESSPWFALWSACAAKEVFLSVNVKQRHETRWAKAGHLLASAQLCLPQKNGFVPSVIALSSSPLVCERIGDNVTICKNNAWKIKVNSQLGTIDSWKVNDVELMSKGILPCFWRAPTDNDKGGFFTKPYDSRWREAFLDNVSFHSSQFSVKELPDNTVEFSTLYYGVPGHLPKPDDEASESILFRVKMVCRIHGSGDVVLDYEVNPRSDLPPLPRVGVVFSAGRSLSHVTWYGRGPFECYPDRKAAAHVGVYESSVEELHVPYIAPVECGGRADVRWVALRDAGGLGLYASAHGGSPPMQMSASYYGAAELDRATHVHRLVKGDDIEVHLDHRHMGLGGDDSWSPCVHEQYLLPPTRYAFSLRLCPLLPSSSCHDIYRSQLPS

SEQ ID NO: 701 - protein, 620 aa, Zea mays
MPRKSHKARGAAAHAAVGLTAGPRPPLKATAPNPSAAAELPQVVVAEAEGLKVPDAGASAAADALERLHVAPAPDGDPPPPEPVHEPAAPPQPPPAEASSSGRSAAGGSWEEEAVRKLRELAEVSRDETELTEEEVRANDQRQEDEVLVHIEVPDYIDVSTKLSYGDGTLNYAATHDDDDLFYKFRVEHLPPILLTCLLPTSYPSHRPPFFTISTYWLDKGMISPLCRMLDMLWEEQQGMEVTYQWVQWLQSCSLSHLGFTNEVVLRKSYVTCYADGEDKRACPDYASPDVIIPRMMRYNDNKHHEAFLHAIHDCMICLSECPGVDFIKLPCHHFFCWKCMQTYCKMNVKEGNVVKLLCPDTKCEGAVPPNVLKRLLGEDEYERWEGLLLQKTLDAMKDVVYCPRCQTACLEDVGNEAVCSSCLFSFCTLCRNRRHIGEQCMSPEEKLMILEKRQESGNVQGDQMKVLQELRSLKEIMKDSKQCPKCRMAISKTEGCNKMHCENCGEYFCYQCNRAITGYEHFRGSCVLFPQEELDRWEMQMNQRVGRQIVAHAHAAIHGQNGQAHPCPTCRQPSPKIGNNNHLFCWACQKHFCALCHKAVQKPAQHYGPKGCKQHTADP

SEQ ID NO: 702 - protein, 275 aa, Zea mays
MLCEGGDDNNGRSGLRLFGVQVRIGGGGGAGSASMKKSYSMDCLQLAAPHACSSLVSSPSSSSLCSSSSPSSLLLSIDDGLQRGAADGYLSDGPHGRAVQERKKGVPWSEEEHRQFLAGLDKLGKGDWRGIARSYVPTRTPTQVASHAQKFFLRQSSMGKKKRRSSLFDMVPICENSASISDPLDVARHGVASADSERAAVDVDLMNSTTEGDDGRSRDVVSSASGAGTALRFPAAAAQTEPLHPSSSHGHGRGHHCSPLDLELGMSLPAPSVGT

SEQ ID NO: 703 - protein, 427 aa, Zea mays
MTFGSADMEAGGGEHRHAQQEEQSSDERRARFAEDWGCCACACAGLFLGPNPMVARYLYALIFLVTNLLAWTLRDYGDSALAELQRLKVCQGALYCLGAEGVLRVSLGCFVFFFVMFLSTVKARKVHDCRNSWHSEWWPAKLALWLGLTAVTFLAPSPLVQLYGKVAHFGAGAFLVIQLISVTRFIMWLNDWCRAEMTQKRYHLQIQAVSIVTYVGSLLGIVLMYVWYAPSPACRLNILFITVTLALVQLMTFVSMSSKVKAGYVAPGLMGIYVVFLCWSAIRSEPHTEVCNRKAEVATSADWVNIASFVIAVVVIVAATFSTGIDSKCLQFKQAEGESEEEEEDDIPYGLGFFHLVFSMGAMYFAMIFVGWNANASHTMERWTIDVGWASTWVRVGNEWLAAIVYIWMMIAPVIWKTRQVGSAAET

SEQ ID NO: 704 - protein, 191 aa, Zea mays
FHAVGMVLGAVTGALIGLATESGLVRGAGIGSISGAVVSMEVVDSSVAIWRSDESGIWSVLYVLDVLWSLLTGRLVREKVDPAVQSAVDSQMNAADSQDMAPTLADMFETGAADAKGMPAAAVAALPIMAFTEHTVADGSGEPIGCSVCLQDFEAGETARSLPECGHTFHLPCIDVWLLRHASCPLCRRAV

SEQ ID NO: 705 - protein, 1342 aa, Zea mays
MSGAWGGTTQKCASCGRRVYPVEELAADGRVYHRPCFRCHHCKSTLQFSNYSSVEGVLYCKPHYDQILKSTGSLEKSFEGVARSAKSEKSNGHKGQQSSRFSNMFVGTQEKCVVCNKTVYPLEKVALNGNSYHKSCFRCTHGGCTLSPSNHITHEGKLYCKTHHSQLFMVKGNFSQFEDNSGNAKVTIEKLPETEEATKNPDQGDEATRKPVENEPTDEKTSKNNVAAEKQLQSGVDVTKPSESTTAENERGNSAAMRKPWQRSMQTDKPFLSSTSTVNPSSSSDTTEKLSSSNGVDMKQSESSTLVKTTCKQNSPTENPPQSVLPSDKPSATSVDDAKPSESSKVIKKPWQRNMAAEKQLQNSAPSQKSVATDKPSPTTGMKSLDNTTEVKSPWGRRMFNNKSLKRSVDTEKSSETSVVDVRPGETSTVAPVPQQQTENVEKPSATSADDAKSADDTKSADDVKPSVASPDAKSTDDVKSSENNAAVVRKPWQRNIGTGKQPLTTVVGPKTTETSGTVKRLWQRSAATASKSGTAVVTPLQSSVVVSKPFQSNVAVKKTWQRSVTPENQLESNMSSNKPLPSKVVVESLLQSNTVEKVFQSTVPTEEPQKGIMATENQSQTIKVTKKSNETSMELSVTSETTKPPPLAATVLQSDVSTEQPSQTDMPTMAPSQIPEPTEKPSESDFNAEKLSESVVKAEKSSTTDTAAEKPLPSMITEKVESVAGTLKPSQSDTALQEILERNMATEEILQTAMAVEDAPPTNLITEKSLMKDASEEPVQTNEPSEQPLKTEEIEKPQQSEKIATDTRGSEVSTEEMLELESNATKLNKDQSELEGLSSGRNPPNFQSNPNAGQRSESKGIVAEKAADHIMEAEDDVDAEHSSESQSVAPAEVRKEQPSEHQKDVDMEQLLEPQNQDHPWNPLDPVSDTAAKDSSEPKSDIATEKPAESQNNAEQSVEQQSEPQSDKSTERPEVHQSNTSNDELSRLQNDAGTDKLSVQSSDPESNASVSKPSESQTDVATMEALEPQIDAPPDKATDQPVKPQDDASAKNPMGTESDAVCDKPSESSSDTETLLVCHQNSSITTDEPVQGGISYDTPHQRSAPIETTPGSETVVDDCIHHEDTSSKPSEENKAIEEPEEADEVSANPSEDIATPEKPLEEGVGSVEPSEDNSVLDKPLEEEEVDAKPVKDVVTPEKPLEEGSTTAEPLEDNAAHEEAKEEDEVIAKPLSSVALEKSLEGSEASVEPSEDNAALEKPSEDDEANAKSSEDSVYVEKPQQEEDDNGVKALEEGVSPEKSAAGKPLEEDPVHEKPADAVAEPSSQDDTATEKPSATTDTAETA

SEQ ID NO: 706 - protein, 237 aa, Zea mays
MSQLLHLPDLAAPRTRMGSALAAGARVKQGEAGTARGRVLRVADPVRRECLVPVPPPPVLAAGRRGDDDDVDEERQRYYLNLGYAIRTLREELPDVLCKDHSFDIYREDIVFRDPLNTFKGLGNYKRLFWALRLTGRVFFRASWVEVVSIWQPAENSILLRWTAHGVPRVPWGGWDAPHARFDGASVYKLDRNGKIYEHKVHNVATNPPAKSKVLPVHELVRSLGCPSTAQPTCSDF

SEQ ID NO: 707 - protein, 433 aa, Zea mays
MASLAVLVCLVCAALASDAAAVRVELTRVHADPSVTASQFVRAALHRDMHRHNARKLAASSSDGTVSAPVSPTTVPGEFLMTLAIGTPPLPFLAIADTGSDLIWTQCAPCSRQCFQQPTPLYNPSSSTTFSALPCNSSLGLCAPACACMYNMTYGSGWTYVFQGTETFTFGSSTPADQVRVPGIAFGCSNASSGFNASSASGLVGLGRGSLSLVSQLGAPKFSYCLTPYQDTNSTSTLLLGPSASLNDTGVVSSTPFVASPSSIYYYLNLTGISLGTTALPIPPSAFSLKADGTGGLIIDSGTTITMLGNTAYQQVRAAVLSLVTLPTTDGSAATGLDLCFELPSSTSAPPSMPSMTLHFDGADMVLPADNYMMSLSDPDSDSSLWCLAMKNQTDTDGVVVSILGNYQQQNMHILYDVGKETLSFAPAKCSTL

SEQ ID NO: 708 - protein, 250 aa, Oryza sativa
MTPQLAFSRMPPGFRFQPTDEQLVVDYLQRRTAAQPCVTPDITDIDVYNVDPWQLPAMAMYGSDHDRYFFTMAAREAQARRTTPSGFWKPTGTKKTIFVVAGGHEVPTAVKRRFVFYLGHHQPSGSNNNNKTSWIMHEYRLMNSPRAAVPSSSSVNRLPTDDLTEEMVLCRISNKDLPKPPFIHNSLLQFSSVGLNGDGYNYLILDHLEPPAMEYPNVGIGNVDDAAAGTDDPGDLDEEIDDSMQRNHGG

SEQ ID NO: 709 - protein, 158 aa, Oryza sativa
MQRLVSKKEETKTIRVKPGWKKGMKVTFEGMGDERPGCLPGDAVFTISERKHKVFKRKGNDLVLKAEVPLVSALTGWSFSFRLIGGEKMSFTFRDEVISPGYEKVVAGEGMPVVAAGGGGEKAAAARGDLRVKFDVVFPKNLTGEQRAGLASILRACP

SEQ ID NO: 710 - protein, 396 aa, Oryza sativa
MNGSNGSQGYHVNGKQVQSVVPSIQNNGPRHRPLTLMRRCRGMLCLVIMPLTAFMMMVYLSPVTTFLIRLFSVHYSRKSTCFLFGMWLAMWPFLFEKINKTKFVFSGETVPPKERVLLFANHRTEVDWMYLWDLALRKGRLQCIKYILKKSLMKLPIFNWAFHIIEFIPVERKWEVDEPLIRSRLSELKNPKDPLWLAVFPEGTDYTEKKCIKSQEYAKEHGLPILNNVLLPKTKGFHCCLQELRDSMDSVCDITIAYKHRPPTFMDNVYGIDPSEVHIHVKIIQVSDIPTSEDEVADWLIERFKLKNKLLSDFSALGHFPNEGTEDDLSTLKCIANFVAVISTTTVLTYLTLFSSVWFKIFVAFSSAFLTFATLYSIHLPQLICSPEAGTHAKKS

SEQ ID NO: 711 - protein, 1668 aa, Oryza sativa
MKLWGVVIEVNQKDIVVSLPGGMRGFVRSEEVHDITSQETRKVLTAQVKSIEDHGYILHFGVSSFSGFMPKADRESAKIESGQLIQCVVKAIDKAREIVHLSSDEDLLSKSIIKDLKGLSIDHLIPGMMVNARVHSVLENGVMLSFLTYFTGTADIFNLSNSFPSGSWKDDYIKNKKVNARILFVDPSTRAVGLTLNQQLLRLKVPSINVKAGEIYDKARVLRMDKRAGLFLEIPSPTPSPGFVSIHDVSDKDVKNVEKKFKEGSMARVRVLGVRHLEGVAIGTLKESAFEGSVFTHADVKPGMVFSSGVKALCPLPHMSELEHVVKPPKKFKVGVELTFRVLGCKSKRITVTFKKSLVKSKLDVLASYADAKIGLLTHGWITKIEKHGCFVKFYNGVQGFVSRSELGLEPGTEAENVYHVGQVVKCRVVSVVPASRKINVTFLISTNRVIQADTPKVGSIVSGVVERLTPAAVVVSVNGFCKGSILNEHLADHRDVEGQNLVLSAKQSLINCASDIPSEISQMHAGSVFHGYVCNIIEAGCFVRFLGHLTGFSPKDKAVDRSVEKLSNAFYVGQSVRSHILNVNAESARVKLSLQQSMCSSADCSFVQGYFLLDQKITELKYSDPSSSFHDWLNTFAIGNLVEGEVGAIEEYGVILNFQSHPDVVGLIEHHQLGDSSVEVGSSVKGLVIDLSDGVVNISLKSELVRSVSKVGKKKKRHRAAVMDLELHEEVNAIVEIVKESHVVLSIPEYNYAIGFAPLMDYNSQLLPCCNYENGQRITVVVGSMPSSGPTGRLLLLPKASGKNSSVSSSKRAKKKSDFKVGSLVEAEIIDIKPLELLLKFGSNLHGRIHITEVFDDDSNDCPFSELQIGRSVQARIVAEAEHSGKGGKNSKWELSIRPSLLQGGLEDFTPPKAELRHSIGGIVHAYVVKVDREWIWLTVSRDVMAHLFILDSSAEPGELEKFQQRYSVGQAVKGRIIGVNREKRLLRLKALDSQSLPENIGETQKPLSATVEHTKQGDIIGGRIQKILPGVGGLVIQIGPHLHGRVHYTEIVDSWVQEPISGFHEGQFVKCKVLDVSRSSEGSVRVDLSLRSSMCANSNQSRRLFDDSRIRTSRFEKINDLCPGTEVKGYVKSVNSKGCFIMVSRTIEARIILSNLSDEYVENPQNDFPVGLLVHGRVLSSEPQSGKVEVSLRKNTGSKSQKSDDISYSDLHVGDIIAGQVKRVESFGLFVTIQGSELVALCHVSELSDEPVLDIHSCHKAGDKVKAKILKIDEERHRVSIGMKKSYIGPDSTGDTSDDEDDEIVPEEISRNPVMGRDRNHALVLPKPESRASVLPLQVSLDESEGSDQENDNKGQEIANGTEVDDKKSNKRLKEKARKQRELEISALEERALQRDIPQTPDEFEKLVRSSPNSSFVWINYMAFLLDLADVDKARAVAERALRTINIREEEEKLNVWVAYFNLENEYGSPREDAVKKIFQRALQYCDPKKVHLALLAMYERTEQYTLADELLDRMTKRFKTSCKIWLRCIQLSLKQSKDVECIKLIVKRALLSLPQSKRRKFLSQTAILEFKCGVPEEGRSRFELILREYPKRTDLWSVYLDQEIRLGDTEIIRALFERVTCLSLPPKKMKFLFKKYLEYEKSQGDEERIEHVKQKALEYVQSSLA

SEQ ID NO: 712 - protein, 252 aa, Oryza sativa
ASLLSRRYATEQGTPFFLHRICTPPFSRGRSRGAHGRRGRDGRRRDVRRDEHGVEHRRRAAVDREVGVDYAKQMLADASSFIWDTFEQPGDGGDRKPVDAVTLTVEDIDGVAFTSGDGIHLSARYVGGYSAAGDVRAEVTGVLYHEATHVWQWDGRGGADGGLIEGIADFVRLRAGYAPPHWVQPGQGDRWDQGYDVTARFLDYCDSPAVVQGFVAQLNGKMKDGYSDDFFVQISGKTIDQLWQDYKAKYGG

SEQ ID NO: 713 - protein, 424 aa, Sorghum bicolor
GEVPSTGQFAYFNGTSFAGNAGLCGAFLSPCRSHGVATSGFGSLSSTSKLLLVLGLLALSIIFAAAAVLKARSLKRSAEARAWRLTAFQRLDFAVDDVLDCLKEENVIGKGGSGIVYKGAMPGGAVVAVKRLPAIGRSGAAHDDYGFSAEIQTLGRIRHRHIVRLLGFAANRETNLLVYEYMPNGSLGEVLHGKKGGHLQWATRFKIAVEAAKGLCYLHHDCSPPILHRDVKSNNILLDADFEAHVADFGLAKFLRGNAGGSECMSAIAGSYGYIAPEYAYTLKVDEKSDVYSFGVVLLELIAGRKPVGEFGDGVDIVQWVRMVTGSSKEGVMKIADPRLSTVPLYELTHVFYVAMLCVAEQSVERPTMREVVQILADVPGSTSTSIDVPLVIEPKENGSPGEKKQEQQEGSHDSPPQQDLLSI

SEQ ID NO: 714 - protein, 279 aa, Sorghum bicolor
MAQHRFQNLRIIDNTELRDIDATMSGNTVFATVPDTISDTFNHYDLAEAIQQQFQINIEVEDISRYNEGYFLRVHTQQARTNMLHRGFIIVRNYLIGLRPWNPEHGSTAVSLQTVLTSCPLNIHLATYIPLSDPYEHLTIHITGVPPHLCCNSLIHKLFHKICIIHSVNFISATTEYEISARGRVTMIPQTAHLGIRNLSGQSEVINIWQLSYQTFTDEMLGRQTPPGDRRSDLCGYSDIDTEQRLELVDSNGNNEATSRLQVASDTSTMDTSDNSIEE

SEQ ID NO: 715 - protein, 230 aa, Sorghum bicolor
RAAAAVAQGRAAPALAPATASVRPRIHRRVSRCGHGRRGWPQRPWSPSARAIKAAAAARPSSTRRRRHSRLEAPHPHQAPRPRPRPAHLHHRARSRRDAVDRHHDVARNCVARASRPRHHLGTRTAPSPSSSRAAAMASPCRRRQAPLRPPRPCPYLCVKLHHHAGVSRGAVLAAQRPRPATSSPLPSPRRASTTAGRVDATARPSLCLATVGVAAATTPSAPAPLRVYD

SEQ ID NO: 716 - protein, 154 aa, Sorghum bicolor
QTHLPHKPPLPSTARPPSRFRRAARLVRSPTKAECPLPDLGLVPPLGGWPNEHRAMATAGEPPPRSTSRSRRWWQSYSQPDPGSSIRGARRRWRLHCWLTVQPSRVLKSSPATHSPMLRAPHLLSSKDPAAKALHTCRPKLALLLIWKKAGTSL

SEQ ID NO: 717 - protein, 203 aa, Sorghum bicolor
MVRHLFPSSSSAFALHPLVPAAEPGPPSITRVWCLRSPCSTVHPPPPPQSSPSALLPHDSYVAQHSCTCDALASPRLRPRAAASHHPCRRGEGGARVEKREVGFEGSDDDSARTRAGNAGARVGAFYSALVRLPYRTTSSSMSNLATCVDLDLDLRWSNLNLTLYWNLETEAASWWSTYLPSIYIQLTNTARKYTSSYHGENM

SEQ ID NO: 718 - protein, 277 aa, Sorghum bicolor
MAVTVAAANGTLRTCSGVSPTAPGGRRAAVLGRWRALAPANLRLSSPAVRVPRATSAAAVEDWSNTDIVPIPKVIIDQDSDPDATIVEITLGDRLGELLDTMNALKNLGLNVVKASVCLDSTGKHNKFSITKASTGRKIDDPELLEAIRLTIINNMLVYHPESSSQLAMGATFGPEAPTEEVDVDIATHIDIYDGPERSLLVVETADRPGLLVDLVKIISDININVQSGEFDTEGLLAKAKFHVSYRGKPLMEALKQVLSNSLRYFLRRPTTEDASF

SEQ ID NO: 719 - protein, 120 aa, Sorghum bicolor
MAMAAAEGKSRRFALACGVLSQYVKAEQQMAAAAAPAARAPATTLSLMPGADVGAEQEPTPAAATRGEEMAGPASTAAPLTIFYGSMEKEEAEKTKQPASSSWVGLGGSTTDAERLTIAL

SEQ ID NO: 720 - protein, 430 aa, Sorghum bicolor
MKEFSYEEVEAATGGFAAKNLVGKGSHGSVYRARLRGGGGRMTTVVAVKRPSHAQGVAKLANEIAVLSAAPRHPGVIGIVGVSSSSSSPQPPPPPAASGPRLPPLLVMEFMPNGSLHDLLHRSPRPPPWPRRVEIALDVARAVHALHAAAPRVIIHRDVKSANVLLGRDGRARLADFSLAVSVKADDDEEEDEEGGSSSAGPAPAGTIGYLDPCYTEPGRLGPASDVFSFGVVLLELVSGRKVMDVNSCPSSIVSWAAPLIAAGRAREVLDGRVAAPPTARAHRALARVLAVAARCVSETVERRPAMDEVVSELRGALESAGWRWRHHRRGDSGGGGVVERVCRRVASWGQRVRRRSKRVVRATKVECTEHSDSGGVATGSSSCAAALPSHRSNNGMMSGAGAAHSNESSKAKENALNRFESELDLVFSS

SEQ ID NO: 721 - protein, 827 aa, Sorghum bicolor
MATRGGGPAAAAVLLQLLGFLFLLRGVPSRAEDDTVAAGRPLSGGQSLVSKRGKFRLGFFQPGATDNSTQRWYLGIWYNQISVHTTVWVANRVTPISDPESSQLSISGDGNMVIVDHSSRSTVVWSTNVTATNSSTVGVILDNGNLVLADASNTSAVLWQSFDHLGDTWLPGGKLGRNKLTGEVTHLVAWKGYKDPTPSLFALELDPRGSSQYLLNWNGSEQYWSSGNWTGTAFAAVPEMTPTGASPVSEYTFGYVDGANESYFIYDVKDESVVTRFQVDVTGQIQFLTWVAAANEWVLFWSEPKRQCDVYSVCGPFGVCTENALPSCTCPRGFRQRDLAQWLQDDHTAGCARNTALQPCSAAAARDGQKKHSRRNDDRFYTMPNVRLPSNAQSTAAASAHDCELACLRNCSCTAYSYSGGGGCSLWYGDLINLQDTTSSGTTGGSSSSISIRLAASEFSSNGNTKKLIIGLVVGGFVTAVTAIVLATTFILRKRRIKSLRRVEGSLVAFTYRDLQLVTKNFSEKLGGGAFGSVFKGALPDGTLVAVKKLEGVRQGEKQFRAEVSTIGTIQHVNLIRLLGFCSEGSKRRLLVYEHMPNGSLDRHLFGASSQGQGVLSWDTRYQIALGVARGLDYLHEKCRDCIIHCDIKPENILLDDAFVPRVADFGLAKLMGRDFSRVLTTMRGTVGYLAPEWIAGTAVTAKADVFSYGMMLFEIVSGRRNVGQRADGTVDFFPSTAVSLLLDGDVRSAVDSQLGGSADVAQVERACKVACWCVQEDESLRPSMGMVVQILEGLVDVNVPPIPRSLKVLADPSKYAVEFFSGLPST

SEQ ID NO: 722 - protein, 816 aa, Sorghum bicolor
MYSSKTKKQSQGQGNGEDAEVREPAEEYAPVIFAQDAYKHVISFDLLSGADDRDNVLRARESGKGVLTAPFKLLNNRLGVISTYAVYKYELPPNATPQDRIQAAIGYLGGIFDIEALVDKSLHQLAGKQSIMVNVYDTTNEKPISMYGSNDTGSGMCQVSTLNFGDPTRKHEMHCRFIQSPPWPWLAITTSIGIFVIGLLVGYIVYATAKRIARVEDDFQEMSLLKKRAEDADIAKSQFLATVSHEIRTPMNGVLGMLQMLMDTDLDTTQQDYVRTAQASGKALVSLINEVLDQAKIESGKLELEAVPFDLRTVCDDILSLFCGKAQEKGLELAVFVSDQVPQTLIGDPGRIRQIITNLVGNSIKFTEKGHIYLTVHVVEEIMHCLEVETTNTLSRYPVANRKRSWENFQLFSRELNSSEMPFAPGASDSISLIISVEDTGVGIPPDAQSRVFTPFMQVGPSIARIHGGTGIGLSISKCLVGLMKGEIGFASKPQVGSTFTFTAVLTRAHSSGNENKSSEFKEINALVVDHRPVRAKVTKYHLQRLGVHTELTTDLDQYISKINCGSQIAKLVLIDKETWLEESHSMPHLVTKLRNKDQPDSTKLFLLENPKSSVKSSLHIFREYNLNVIMKPLRASMLQVSLQRALGGIDKLHCRNGVVGNSTLGSLLHKKRIIVVDDNIVNLKVAAGALKKYGAEVTCADSGKKAITLLKPPHRFDACFMDIQMPEMDGFEATRRIRVMERDLNEQIERGEAPLECAGVRQWRTPILAMTADVIQATHEQCLKSEMDGYVSKPFEGEQLYREVARFFLNQDQVQ

SEQ ID NO: 723 - protein, 808 aa, Sorghum bicolor
MSPPALAAGTTSLLSPPTAAVSAHPFPPTNHKPHSARIRLSSAAAATSSSRWVNPRAPPPRRGAGRSGANQRLHHLVHLGDLDAALLLVESMRDPERPAAVPCTLLIKKLCAAGRLDDAERVLGASERAGTADAVTRNTLVAGYCRAGGRLADAERMLASLALSGSADVVTYNTLVAGYCREGRLNDARRLVADMPFAPNSYTNSTLLKGLCSNKEWDDAEELLSEMIRSGCPPNDLTFGMIIHSLCQNGLADRAMGVLDQMSKCRCTRGVIVYNEIISCLAELGRVEEALHLFDQMPCKPDIFSYNTVMKGLCRDGRWEDAGTLIAGMVRKDCPPDEVTFNTVISYLCHRGLVDCAMEVVEQMPKYGCKPDNFTYSALVNALSERGCVDDALELLRTIPWKPNTVCYRSVLKGLCRADRWDDVGKLVAEMIRNQLNLDEVTFGLIIDCLCQKGLVDYGAEVLREMTKFGCSPDIIIYNSLINGFSENGSVDDALELFKNMSCKRNVVTYNYMLKGLCRAEQWEDAGKLVAEMVKDECLPNEVTFSTLISYLCQKGFVECAIEVFEKMPKYNCMPNVIIYSTLINGLSDQECVDDALKLLNDMPCKPDTICYSAALKGLCRAERWEDAGELILEMIRKNCLPDEVTFSILINNLCHKGFLESATEVSELMLKYECMPNVFIYSSLINGFAEQYRAEDALQLLRNMPCEPDTICYSAALKGLCRAKRWEDARELIAEMFRKQCPLDEATFSMLIGSLCQNGLVDMATEVFEQMSVYGCSPNRKIHSSLVNGYSEQRRVDEGLKLLSSMP

SEQ ID NO: 724 - protein, 202 aa, Sorghum bicolor
ADLDACPLPPPPRRVAPAAPLPPPPPRKRRGRGCCCRLLCCAVVTAVVLAVLAAAVVGALYLALDPKAPRYSVDRLSVSAFQVDPSTVTARARFDVTVTAVNPNSRIGIQYEPGSSLGVWYRSYRLARGALPAFYQGHRNTTVLPLALAGEVQLATAVVSGLQDAQRTGAVPLVFRADVPVHVEVGSFKLWKGREKDRVYFN

SEQ ID NO: 725 - protein, 987 aa, Sorghum bicolor
MKTTDHNASTNDHGKGVSVTSKSNTELADQILDYIERSVELMNRSPLVLLSILDLLKALWESGIQFLYILEKLRSSLTFWDNLSRCIRATLDICSIDNVNAVDEKFSLRYHCQGKIFEIMSHELFLQGKLLAETSNTVRDDPKGQKEHKSGPCHSSVVLKWFDNAILDDLISNLSSNAYKKELLHHAKVAACLCIIHLITKLSTGDSGSLSFSFMKKIQIISTKLSQHHAFLALLSQYSRNGYSGEQELNNLVINDLYYHICGELEGRQISSGPFQELLSFLLEFKLFEHNPLEQLQNTYLMPNEKFVFDVEHIHDELGVDLWTDSDRKRSKEVAKKMLDIMRKANLMKCYADAKLSALRSFLTFLSVYTGAVSNKNLDLPGGGISVAATQSAIRCACKSFESAVDSLLPQADTNEVLFPLLSGQVELLLTLARILFHQEKKNKKSSHLCPDIVLLMKTSVASTSFFVDLMPSAHALKKPVKALLVLLLSSYEFMYSKVHIKDLPNDVNMFGELALLSVSLLPILCKLAQNRECSDLAVASMDLILKGFIPSNVWVPILQKHFHLQAILHKCQNGDLLSTQVILNFLLTLGRTKDGAKVLQSANIFAFLKVLLSQLSLDDSCLRNSLSTQVKDVNLWGLGLGIVASLNHCLDDDISHNNVANSTISFLSGQVPLMSSYLSAQSAATHQSKKRALLQKSQTSLSALSLTENILILLCILAKYHFPRDTGKKEVDSELREIIIHLLAFISKGSVKTGDASNWNSSFFCPAVIKEEVALNEKPPLICSKYGWFKFAASCTLSTAAVSVSPSAALLVVRSDKSSGDSDSIRQTRYTEILAVQIYRIAFLIMKFLCSQAKEAVKRAEELEFLDLAHFPELPMPDILHGLQDQVVCIVTEVFEANGSSTLNPETEKVCQLLLVTLETSLYMELCVSQSCGIRPVLGRLEDFCKGMKALLQAIEKHSRFKPFVRSLTEITTLLYPGLLHSNLLM

SEQ ID NO: 726 - protein, 1709 aa, Sorghum bicolor
MPPPASPREHVERIRRERYYIGRGEQNPLAEDMHQAVNYLSQELYSKDVHFLMELVQNAEDNEYPSEVAPSLEFLITSKDITGCGASSTLLIFNNERGFSSTNIESICRVGKSTKKGNRHQGYIGEKGIGFKSVFLISSQPYIFSNGYQIKFNEKPCAECNIGYIVPQWVESTPSLSDIEAIYGCSKVLPTTTIILPLKSEKIDAVKSQLSSMHPEMLLFLTKIRKLSVREDKSDPNNTTVSEISISSEKNYQARKNMHAESYTLHLSSEETGKDEAECGYYMWRQKFPVKPENRVNKRAEIDEWVITLAFPHGERLSRGKQLSPGIYAFLPTEMVTSFPFIIQADFLLGSSREAILFDNPWNKGILDCVPSAFMNAFVTLVKSKADAPAMSLPSMFSFLPVNSSLIPLLEPVRSGIKYKVLTENIVPLESYASQKIFCKPSEVARLKPAFWAILGKAREFGVDLKSLSTHGTYILSSHFDKSRYNSVLEFLGIKSVSTEWYAKCIEGSNLVKEVDEQLYLEILHFVASNWENCFSGTNMMSVPLLKYVDRNGVLSFWSISRASQQKDRLCIASDMKYRSWLISWNKEFLSSNKFFLHPSTQAALDGFSQKMTVESWLRNHARVEVVSVYSYGSTVVDSLSNDQRSVLAFAHFLYHSFKMEHIESFWLSKLCCAMPIVDRYGNVVNKTENIIVPAKGSKWVGLLGTYPWRNQGYIELSADYKSVGHFAGNYTSEDQLLEFLKIHLHASDVPLIRPPNVRFHTVSSPLNVDNTFLLLEWIRNIRSNGVTLPDQFLACVEEGSWLKTSVGYKPPNESFLSSANWGSLLQSGPSFIDIPMIDQQFYQNKLHIYKQELKVIGVRFEFEEASSYIGSRLMSMAASNVLTRDCVYSLLRLIRFLREKVLSPSQLIDSVKDGCWMKSTVGYRRPSDCIIKDSEWAVASCISDQPFLDVEFYGEDILSYKSELELLGVIVGFKNNYHLVIDNFKFRSSAITSESTVLILKCIRYVGSCQDFIRKLRDLKWVKTNVGFCAPNVSFLVDSEWECLVKIFKGVPIIDLGFYGSVISSYKEELKKAGLITRFEEASMAIANVFKRMVSESSLTKANVLALLLAYRQLRTHSPLPVELFNCMRTEKWIHTSLGFQSPSNTILFDNAWQYLSPISILPFIDDGDTCNGLGMDIYGYKDELRELGVTVEVKFGARFALAGLSIPDDPSILSKATILSFLECIKNYFASATEPPKGFKDQICKKLLKTSLGYQYPDECILFDAKNCFLQMEDGPFIDEAFYGSDIASFKHPLAMIGVTVDVNSAQDLIARYLRNKKDIDTISRIYMYLKKCNWKPDKNNNNNRNWIWIPKETEGGDWVSSRSCVLYDKNNLFGLQLHVLDKYYDRKLLDFFSLAFSVRHGPCSEDYCKLWATWESSVHELPISDCLAFWKFIAKNWTKKTEELLSGCVKVPVCIDGKIILSNKENVFIPDDLLLADLFRKHPKQSLFIWYPSSALPSMSRARFNSIYGSIGVRTISEAVAKNDSFTSANSHFKTAVLSKVIKVGLLQIVLAFLSNPNFDIPAKDRHHLVSCLLNVTIEETDEPITMAYSVSLSSGEMVEVKARRMLRWERENSKLYMQRSDGASSYEDKIELATYFAHEISHGLLFQMPDQISSLTELIKIGSLVDFQQAAVAFLLKSKNLQLFPEDEDFLNSSVLGGSKKPVDN

SEQ ID NO: 727 - protein, 233 aa, Sorghum bicolor
MFRTRFRMTKHLFLRIVNALSEWSPYFTLRADCANRQGLSPLQKCTSAIRMLAYGTPADALDEYLKIGKSTALECLDKFAQGVIEVFSGEYMRAPRVEDVQRLLQVNESRGFPGMLGSIDCMHWRWENCPVAWKGQFTRGDYGVPTIILEAVADKDLRIWHAFFGVPGSNNDINVLNQSPLFIEALKGQAPQVQFSVNGRQYNTGYYLADGIYPEWAAFVKSIKAPQMEKHLN

SEQ ID NO: 728 - protein, 156 aa, Hordeum vulgare
MASSTCSDDKVAPLVQKHAPAGNPEALTTTKKKKKKVLIAVPEYDVRSVLAYKDEPVDLEVPDYLIRENPKQAAVMFMIKANLAMYNEHTKARMLEEQRDFKHQLKTKGRVTYELEVDEDDPRFKDECTTSSAGAGRRRHRPGVMKKQDGQIKRLN

SEQ ID NO: 729 - protein, 284 aa, Hordeum vulgare
MVYGGEEALMRQYSIGDEIGRGRFGTVRRCHSNATGEALALKTTPKAPLRDPLDLALAEQEPKLHLLASSPPCSPHLVALHAAFDDANAVHLVVDLCAGGDLLSLLSSRGGRLPEREAAGLAAQLASALAACHRRGVAHRDVKPDNLLFDAATGALKLADFGSAEWFGDGRPMSGLVGTPYYVAPEVVAGREYGEKVDVWSAGVVVYMMLSGAVPFYGATAPEIFEAVLRGNLRFPPRAFAGVSPEAKDLMRRMLCKDVSRRLSAEQVLRHPWIASCGGDAVAG

SEQ ID NO: 730 - protein, 885 aa, Hordeum vulgare
MASPTLPVTLTCLTLLALLSLAMAADNNNSTGLILVNCGASGQEDDDSGRTWGEDTGSKFAPSLKGVAANAQRQDSSLPSTVPFMTARIFTSNYTYSFPVTPGRMFLRLYFYPTDYPNFAASDSSFSVSVSTPNLVLLDGFNASQTVQAISSAFLVREFSVNVSSGSTLDLTFAPSAHQNGSYAFVNGIEIVPTPDIFTAPDTRTVGDDTSPYTFDTAMAVQTMYRLNVGGQAISPKGDSGFYRSWTNDAPYIAGGSGVTFSKDDNLTITYTSKVPKYTAPADVYGSARSMGTTAQVNLNYNLTWILPVDAGFSYLLRFHFCEIQYPITKINQRSFFIYINNQTAQEQMDVIVWSGGIGRTTYTDYVTMAVGAGQVDMWIALHPDLSSKPEYFDAILNGLEVFKLQNNGSPNNLSGLNPPLPQRPPDAIPSAPSAGGKSVGAIVGAAVGGFAVLLVACFGVCIICKRKNNKKKKISKEPGGKSEDGHWTPLTEYSGSRSTMSGNTATTGSTLPSNLCRHFTFAELQTATKNFDQAFLLGKGGFGNVYLGEVDSGTKVAIKRCNPMSEQGVHEFQTEIEMLSKLRHRHLVSLIGYCEDKSEMILVYDYMAHGTLREHLYSTKNPPLSWKKRLEICIGAARGLYYLHTGVKHTIIHRDVKTTNILLDDKWVAKVSDFGLSKTGPNMDATHVSTVVKGSFGYLDPEYFRRQQLSEKSDVYSFGVVLFEVLCARPALSPSLPKEQISLADWALRCQKQGVLGQIIDPMLQGRIAPQCFVKFTETAEKCVADRSVDRPSMGDVLWNLEFALQLQESDEDTSSLTDGMLSSSGASPLVMTRLQSDEPSTDASTTTTSTTTMSMTGRSIASVDSDGLTPSTVFSQLMRPGGR

SEQ ID NO: 731 - protein, 70 aa, Hordeum vulgare
MASLKAVKPTGLEGQAKEPTKVSATKGPAKLSNTATKPAAAKGGIKKAESKPREPKKRQVKSTKPAAAKN

SEQ ID NO: 732 - protein, 608 aa, Hordeum vulgare
MATGQIFSKTTQALFYNYKQLPIQRMLDFDFLCGRETPSVAGIINPGSDGFQKLFFGQEEIAIPVHPTIEAACNAHPTADVFINFASFRSAAASSMSALKQPTMRVVAIIAEGVPESDAKQLISYARANNKVIIGPATVGGVQAGAFKIGDTAGTIDNIIQCKLYRPGSVGFVSKSGGMSNELYNTIARVTDGIYEGIAIGGDVFPGSTLSDHILRFNNIPQVKMMVVLGELGGSDEYSLVEALKQGKVQKPVVAWVSGTCARLFKSEVQFGHAGAKSGGELESAQAKNQALRDAGAVVPTSFEALESVIKETFEKLVEEGNIPPVPEVTPPPIPEDLNTAIKSGKVRAPTHIISTISDDRGEEPCYAGVPMSTIIERGYGVGDVISLLWFKRSLPRYCTQFIEICVMLCADHGPCVSGAHNSIVTARAGKDLVSSLVSGLLTIGPRFGGAIDDAARYFKDAYDRGLTPYEFVEGMKKKGIRVPGIGHRIKSRDNRDKRVQLLQKYAHAHFPSVKYMEYAVQVETYTLSKANNLVMNVDGAIGSLFLDLLSGSGMFSKQEIDEIVEIGYLNGLFVLARSIGLIGHTFDQKRLKQPLYRHPWEDVLYTK

SEQ ID NO: 733 - protein, 384 aa, Hordeum vulgare
MAAAASSSSPPAAITCRAAVAWGPGQALVMEDVEVAPPGPMEIRVKVVSTSICRSDVTQWQSTAQPDLFPRIFGHEASGVVESVGEGVTEFQAGDHALTVFIGECMSCKHCVSGKSNMCQRLGLERKGVMHSDQTTRFSIGGKPVYHYCAVSSFSEYAVVHSGCAVKVSPAMPMDRICLLSCGASAGLGAAWNVADVSKGSSVVIFGLGTVGLSVAQGAKLRGASKIIGVDTNPDKQEKGKAFGVTDFINPAELNEPVQQVVKRLTDGGADYSFECVGDTGVVSTALQSCSDGWGLTVTLGVPKAKPEVSAHYGLLLSGRTLKGSLFGGWRPKSDIPLLVEKYTNKEIQIDDLVTHDMPFSDINKALELMLENRCLRCVIHMAK

SEQ ID NO: 734 - protein, 174 aa, Hordeum vulgare
MAPAVMASSATTVAPFQGLKSTAGLPVSRRSSASLGRVSNGGRIRCMQVWPIEGIKKFETLSYLPPLTTEALLKQVDYLIRSKWVPCLEFSKVGFVFREHNSSPGYYDGRYWTMWKLPMFGCTDATQVLNEVEEVKKEYPDAYVRIIGFDNLRQVQCVSFIAFRPPGCEESGKA

SEQ ID NO: 735 - protein, 153 aa, Hordeum vulgare
MAVEEITEGVRGLKVEDGEGAAAPPAAAGGGGGGDGPRRGANGSSNRIQVSNTKKPLFFYVNLAKRYMQQHGDVELSALGMAIATVVTVAEILKNNGLAVEKKIRTSTVEINDESRGRPFQKAKIEIELGKSEKFDELMASAAADAEEGEEEA

SEQ ID NO: 736 - protein, 93 aa, Hordeum vulgare
MAASVACAFFFDAEPVGEPGNHALDACALCTKPLARDSDVFMYRGDTPYCSEECRHEQMHLDAVSARQAARRQQRFSAGAESGCARRGVSVGS

SEQ ID NO: 737 - protein, 124 aa, Hordeum vulgare
MAVTSLQLPSPIHWLTPARNGCTRTRPRATLVSCKHNQSTIVQEASRTSRRGTVAYISSALFAMFMVAERAEARTSRQENKRKVMEKLEKIREEALGSKEKKENTSKESVANLLIPPTLVDAYI

SEQ ID NO: 738 - protein, 285 aa, Hordeum vulgare
MSSSLFLCSYQVRYASLPAPLRQPGRHADRLPPAAPAFVSRSLHRPPPLHWTGSGVRMISSCFVVKRRRRRNGIHASLFGVGAPEALVIGVVALLVFGPKGLAEAARSLGKTLRAFQPTIRELQDVSRDFKNTLEREIGLDEDPPSMSYRPPPSMNNSQQPAVDPDVKPETTVPYTSEELMKVTEEQLAASAIAAWNAQQPASSEQQEAAAAAITPSQSSDLALSGGGSDGPVAVTEESNSEAAAATTPSQSSDSTLSGGNDGPGAVTEESNSGNTENAKLRDEA

SEQ ID NO: 739 - protein, 98 aa, Hordeum vulgare
MAEPRRRRAPRTQVAALLLALLAAASLLQAGDAASGFCAGKCAVRCGRSRARGACIKYCGLCCEECACVPTGRSGSRDECPCYRDMLTAGPRKRPKCP

SEQ ID NO: 740 - protein, 306 aa, Hordeum vulgare
MLSLLPPARLRAAPSDVPVTAPRRPAVILPGLGNNTGDYARLGAALRDGHGVPSVVARVSRPDWLRNAAGLADPSYWRGTLRPRPVLDWYLNRVEEAVSEARELGSPDGKLSLIGHSAGGWLARVYMEEFGTSDISLLLTLGTPHLPPPNGVSGVIDQTRGLLNYVEKNCAPAVYTPELRYVCIAGRYIQGAPLTGSSLAATTDELVAVDAPSEVAEAVMVSADNKTAPTGPTFRARFVGQGYKQVCGRADVWGDGVVPEVSAHLEGALNISFDGVYHSPVGSDDEERPWYGSPAILEQWVHHLLS

SEQ ID NO: 741 - protein, 414 aa, Hordeum vulgare
MGCGLSTPDNEGGGTRRKQGSVGDVVVFLPGLRTPTGVDLSQPLAGRLEKGAVERLSALRARVVDMTMQESASALKPRRKAAARHGSSTANLLQALEDYLPLLLGLVKDSGELRNSVEFVWTNQEDKAEETAMADAWYEVLSVLHLMAMVCLLQANSLLLPRAYGDGYGPRVSEESRRATVDVFLKASGYLDCAIRQVLPQIPTELRRQLPVDLAEGNLKALSLQALGQGVDMQLGLAIDSPKATLAVKRRLACEMVKYWHQVQESIPDLPVSDGWGKKHLLFVKWKYVEAKSAAYYFHGLILDEGNSEKSHGMAIAALEASEEFLKESKRASEAFHATPPTSRSPTPFGTAKYLFDKIPKEASSKVRINQDLYTPERIIGAPPPLPDFSLALTPEDYDLPPLDPLWNKEDGHQ

SEQ ID NO: 742 - protein, 487 aa, Hordeum vulgare
MPAVASLSPPAPGPAASRRRRFFPASASLRRAASGGGSSWRGERRLMSELERTVTAGAAERVIRGYVGTKSERAALAALSRLLMDSDPLAVPFYEAVTQARWFKWSSIHAAAVAALLEANGRADESRSLIADSAGRLESTAELALFYCDLMAAFSSRGLKRRAMDFYAQLRAMPTPLAGGGKTYMAMIKSLCMLGLAAEAEEALREMVALGYQPDAFQFGLVAKCYGKAGQLAEMERVIASMSEAGIRLGTGAANIVLSCYSACREHGKMLAWLKKMRKLRVAPTTKAYNFVLNSCPTVVSMARELGPSLPLSAAQLVRKLKSASPWPAEVEVVQELLAASSVLNKAMVWSETEVKLNLHGFSITSAYVLMLQWVDAVRGGRALPLEVSVVCGVGKHSDVRGEPKVRELAQEVLSRMGSPLRLSARNKGRLVAKRDRVKQWLATEWTSVVAEESTDQPPYASDQQPFLPNLLRKLGQFFSSFVPVSR

SEQ ID NO: 743 - protein, 341 aa, Hordeum vulgare
MATQWFSNMVMDEPSFFHQWQTDATLEQYTEQQIAVAFGQGEMEAALMQQQYAAAAVGEHRPRKAAKVNTSWDSCVTEQGSPADSSSPTILSFGGHADAFAKAPQAGSAAAYYGAASAPVAPVKPKQEVDAAAVVAPFQQVKRSYDAMVAEPARAPSRPAAQNQDHILAERKRREKLSERFIALSKIVPGLKKMDKASVLGDAIKYVKTLQEQVKGMEEVARRRPVESAVLVKKSQLAADEDDGSSCDENFEGADAGLPEIEARMSDRTVLVKIHCENRRGVLVAALSELESMDLTIMNTNVLPFTTSSIDITIMATAGEHFSLSVKDIVRKLHQAFKSSP

SEQ ID NO: 744 - protein, 561 aa, Brachypodium distachyon
MRRAQQQQQHQGASAPGVVRVDQASPASTFRQLDDAFLQKQTKIWLGEVLHVRFDEDILVADLLGDGELLFQVSKVIWKRLLRKNKEQLKQSKVYIYERTSFGKSNGKYTPYPKVDSFLKICQILGLAGIDLFTPSDVVEKRNVREVCMCIRSLSKKAGMMHLNVPDFDVVTHTIAMPNYMVGVIRRSLEQPRCSSSCSSGYSPHANSESIFGQNDQQGDTHYDSDEAESSLYVLEPQENVGEDNLSERLQIGNAPKEQREGYGDSGHGKLEEKSVAEPVGSLDFGVMDADSADSAPFHDNQLCCSTHSSTDQCSRTRTTKCSMSSEESDSISSYLAFDSSKNDLDAPKVKVSERIHDEHDEPSHSSIQGNGKIFVDHPKKEGDDLLKDTSAMDQHCDAFICDRESVSSSSEEPRFGLNGESYSGLTPRNSTGGQLPAVSEDTTASRGLKHEISTKDHIDASRSEDELAKPLDTAEHNNGNAQRNEDDPPKSGKGVLKSVAGGITLVGAVFFIAHLRRSKGRIFTAILPPLSEKSIQSDSRTTNVDKRKAAELYPGGWLKV

SEQ ID NO: 745 - protein, 484 aa, Gossypium hirsutum
MGKQPSAWITTQQKKRWPLMILLLLSLSTLMAFLIRSTFDSCSNGSSNNVGNFIREGQAEEKGGTHHQVNHNDEAPTPNPLDFMKSKLVLLVSHELSLSGGPLLLMELACLLREVGADVVLVTNQKQTESDDIIYSLEHKMLNRGVQVFSAKGQEAIDTALKADLVVLNTAVAGKWLDAVLKEHVADVLPKVLWWIHEMRGHYFKLEYVKHLPLVGGAMIDSHTTANYWKNRTRERLGIKMPETYVVHLGNSKELMEVAENRVAKLVLREHVRESLGVKNEDLVFALINSVSRGKGQDLFLRSFHESLKLIQESKLKVPPIHAVIVGSDMNAQTKFETELRNFVSQNNMQGRVHFVNKTLTVAPYLASIDVLVQNSQARGECFGRITIEAMAFQLPVLGTAAGGTMEIVVNGTTGLLHPAGKEGVMPLSNNIVKLATNVEKRLTMGKKGYERVKERFLEHHMSERIAKVLKEILLHKAKRHSES

SEQ ID NO: 746 - protein, 323 aa, Gossypium hirsutum
MTLSDEEDEFLANFLESELSDEEEPKAKRLRVVKEDEEKEKEGKGDGASSNMNPNPNPGQVKNNNNWNNPRRIESGTFSKIPPELFTQILKFLSSEDLVSCSMVCSFLNYAASDESLWRRLYCMRWGLLPPTKIRECPWKKLYIQRDEEDMIELVRNCPSEFKEYYIQMQSAKRSQAPLPSQVKDDSIILDKTVADQVSIWKSSRGLTDKVVTDHACSGETCTYYQIGDVFVCEKTGQVHVCDDTCREVILDPNNELLVCTISGHCFDRLLSPSEMELDAEQQQAGGTDEAEPFLGSGRFARAYLLGYNCEDEKELEAALRFC

SEQ ID NO: 747 - protein, 1022 aa, Gossypium hirsutum
MGSLENGISLKRAGSRNERHPFSSRPRSRFSRLLLFKKLDYLQWICTVAVFLFFVVFFQMFLPGSVMDKSQGSFLDDKDSVFGELSYLKEMGALDFGEDIRLEPCKLLEKFQRENKLVNLDSSSGFNRSQHRFHYRKPQLALVFADLLVHPQQLLMVTIATALKEIGYELQVYSLEDGLARNAWQSVGVPVTILKVERNEIAVDWLNYDGILVSSLEAKSVFSSFIQEPFKSIPLIWTIHERALAIRSREYTSSGQIELVNDWKKVFCRATVVVFPNYALPMIYSTFDSGNYYVIPGSPAVVWKGENAMNLLKDSQRIKMGYGPDEVLIAIVGSQFMYKGLWLEHALILQALLPLFADNNSNSHPKIIILSNDSTSNYSMAVERIALNLRYPSGVVKHVAVEEEVDNVLSMTDIVIYGSFLDEPSFPEVLTKAMSLGKPIIAPELSNIRKYVDDRVNGYIFPKENIKVLTQIILQVISNGKLSPLARNIASIGRETVKNLMVQETVEGYAFLLENILKLPSEVAPLKAVAELPSKLKEEWQWNLFGDFLNSTLGDRSANFLNKLEEQWNHSRREKFGSLIAVDDSFSYEIWEEEKRTHILDTKRRREEQELKDRTDQPRGTWEDVYRNAKKADCMRNDLHERDERELERIGQPLCIYEPYFGEGTWPFLHQNSLYRGIGLSTKGRRPGMDDVDGPSRLQLLNNPYYRDTLGEYGAFFAIANRIDRLHRNAWIGFQSWRATARKASLSGIAETSLLDAIEKQKNGDALYFWVRMDTDPRNNMQRDFWSFCDAINAGKCKLAFSETLKRMYGLGQDFNSLPPMPEGEGTWSVMQSWALPTKSFLEFVMFSRMFVDALDAQMYDEHYQSGHCYLSFSKEKHCYSRVLELLINVWAYHSARRIVYVNPETGAMQEYHKFKDRSGKMWIKWFSFNTLKVMDEDLAEEADSDHLKRRWLWPSTGEVVWQGVLDRERNLRNRQKETRKQKSKDKLERMRHKHRQKALGRYVKPLPEDIEISNSTTVTSV

SEQ ID NO: 748 - protein, 183 aa, Zea mays
MTRGENQESQTGNVPAASAATPGPKPASAGGGKGAEGQSVVRRLQSELMALMMGGDPGVSAFPEGDNMLHWVGTIDGSAGTAYEGTSYRLALAFTAEYPYKPPKVRFDTPCFHPNVDVHGNICLDILQDKWSSAYDVRTILLSIQSLLGEPNNDSPLNTQAAALWANQEEFRKMVEKIYKPAA

SEQ ID NO: 749 - protein, 543 aa, Zea mays
MPPPLQAHRLLISHRRLPTPARRRFTAASSVQSAPTTTLAPGPATSSILSIRESLLSGERTAADITSEYLSRLRRTEPTLRSFIHVADAAAEREAEELDRRIASGEKDAVGPLAGVLVGVKDNLCTANMPSTGGSRILDGYRPAYDATAVRRLREAGAIVLGKTNLDEFGMGSTTEGSAFQVTTNPWDDSRVPGGSSGGSAAAVSARQCVVSLGSDTGGSVRQPASFCGVVGLKPTYGRVSRFGLMAYASSLDVVGCFGSSVFDTATILSVVAGHDKMDATSSSQVVPEYASELVSLDLLESKPLNGVRIGIIQETLGEGVASGVVSSIKGAASHLEQLGSVVEEVSLPSFSLGLPAYYILASSEASSNLSRYDGIRYGGQVSADDLNELYGESRANGFGHEVKMRILMGTYALSAGYYDAYYKRAQQVRTLVKQSFKDALERYDILISPAAPSAAYKIGEKINDPLAMYAGDIMTVNVNLAGLPALVVPCGFVEGGAAGLPVGLQMMGSPFCEGNLLRVGHIFEQTLQNLSFVPPLLAEGQL

SEQ ID NO: 750 - protein, 79 aa, Zea mays
MAIAAVRRRLWRGLGTAAAAAASGTDGNLLARLVSEPECRVKATMEEAASSGTHRDGAFWEPPVTALFRASSPTKAHLD

SEQ ID NO: 751 - protein, 553 aa, Zea mays
MALPAPPVRLALLLLVALPFCAAHPGPGAFNAPRHFQTPALHSDGFGLVARRSIAEAPADINVTTNSSFVLAADRTYRRDPLNGFRKYPGGWNISEVHYFASVGYTAIPLFAIALVWFVIFFLVMLGICCRHCCCPHHTYKYSRTAYALSLILLILFTCAAIAGCAMLYDGQGKFHKSTTTTLKFVVSQANYTVDNLRNLSDSLSAAKKVDIAQSFLLPPNVQNEINEIQGKLNSSATDLAIKTTDNAAKIKKVLNRVRLALVVIAAVMLLLAFVGFLLSIFGLEFLVSVLVIIGWILVTGTFILCGVFLLLHNVVSDTCVAMEEWVAHPTEHTALDEVIPCVEPATANESLYRSRQVTFELVNVVNQVITNVSNRNFPPQLTPLYYNQSGPLMPLLCNPFTPDLRDRNCSRGEVTLDNATQVWKKYECQSTTVSGGAEICATVGRVTPSIYGQMTAGVTVSQGLYQYGPFLIQLQDCTFVRDTFTTINQGYCPGLERYSKWVYVGLVMVSLAVMLSLIFWVIYARERRHRVYSKQHQPYPVEDKPAATVPGA

SEQ ID NO: 752 - protein, 376 aa, Zea mays
MALLKAARVADVPTLDVVVAPGLVAVAKARSAAAVGGRFSVIGHRGKGMNALASEDPRLREVRENTVRSFNDAGRFPVDYVEFDVQVTKDGCPIIFHDNFIFTQDDGKISQKRVADIQLEDFLQYGLQNEQGKVGKPLLRRLKDGRMVNWNVQSEDALCTLEEAFEKVNPRLGFNVELKFDDSLEYTDEELTRILQAILKVVFEYAKDRPILFSSFQPDAAQLMRKLQGTYPVYFLTNGGTELYADVRRNSLEEAVKLCLAGGLQGIVSEARGIFRHPAAVPKIKEANLSLLTYGTLNNVPEAVYMQHLMGVNGVIVDLVPEITEAVSELIALPLPEPDLEVGSLSNQAAARGATTPNFSQREISFLLRLIPELVQ

SEQ ID NO: 753 - protein, 413 aa, Zea mays
MASSWVLALVLALSAGASLARGSEPWWNETQVYATTANSGGGNGVFVGLTLIQSAAAKGAVCLDGSLPGYHLHRGFGSGANSWLVNLEGGGWCNDRSSCVFRKGSRRGSSNHMERQLQFTGILSNKPEENPDFYNWNRVKVRYCDGGSFTGDGSDAAAGLYFRGQRIWQAAMDDLMAQGMRYANQALLSGCSAGGVSTILHCDEFRGLFPSNTRVKCLADAGMFLDTVDVSGRREMRSFFNGIVRLQGSGRSLPRSCTSHMDKTSCFFPQNVLPTIRTPTFVLNTAYDVWQLQQSVAPRTADPQGLWSKCRTNHAFCNSNQLQFLQGFRNQMLDAVRGFSASRQNGLFINSCFAHCQSERQDTWYANNSPRLGNKKIADAVGDWFFERGNAKYTDCPYPCDGTCHHLVFRGDH

SEQ ID NO: 754 - protein, 445 aa, Zea mays
MFGTPSITPAFGNPSSTPVFGTPSATPAFGATSSTPAFGTLSSTPAFGTPSSTPTFGTPSSTPAFGTASTTPAFGASSSTPAFGTTSTTPPFGSLNFGTPSSTSAFGTPSSAPAFGALNFGTPSSTSAFGTPSSAPAFGATPSPSPFGFQQQATPSPSPFGLLGGGGAQITTQMAPVAPLPLSPSDRDIQAIVDAYKEDPGNPRYAFRHLLFSVTEPSQRVKPVAASDIMWAEAMGKLECMDSADRERLWPQLVQGFKDLSHRLKLQDEVLVSDTDRLSMTHSNVKKLQRHFQADTYPWIQRLKQQELAIQRRLLRFVRIVEALENRGYRCPLTKEEADLYERLVAILKRLKGHNADLSKRVNTLVSTSRLLASSGGAGGSVYIPSSAKVDERSVTELLEALQQQTEAVAKLGNVLKRDIRDMEIIQSEGTDMAEDNVGRRAQKI

SEQ ID NO: 755 - protein, 186 aa, Zea mays
MKGSSEHGETSKQAPLGSRGVSKGVSVLDLILRFIAIIGTLASAIAMGTTNETLPFFTQFIRFKAQYSDLPTLTFFVVANSIVCAYLTLSLPLSIVHIIRSRAKYSRLLLVVLDAAMLALVTAGASAAAAIVYLAHKGNVRANWLAICQQFDSFCERISGSLVGSFGAMVMLVLLLLLSAIALARR

SEQ ID NO: 756 - protein, 872 aa, Zea mays
MSPAVASASSGDRIRTYEDFVRVHAYLLAAAGIPPSLHQRLYRKLADEVFDGGEVFAVEPCEDGRQRRLVLTADQSLGKESDVFLVDHAWSFRLPDALKQLREVPGLAERMAALMCVDLDRKIEEDEQDDDESGSLEHVSQVVEKERARVQERSDSTAWLELEELGIDDDMLVALDLSANFPNLVALNLWGNKLRDPEKVMQEIRKCTKLKALWLNENPVLGKSIDKAVLDGLSGLEIYNSHFTSKAGEWALGFCADIVGVDNPCSSVESTLFGSIGTIDLSDRCIHKLPEVFSPSKLPSLSKLNVRGNPLDQISGDDLLKLFGGFTQLQELEVDIPGPLGNSAISILESLPNLSLLNGVDSSSIIESGKHIVDSALEPRLPEWSPEEPLAERVIGAMWLYLMTYRLADDEKIDETPVWYVMDELGSAMRHSDNANFRIAPFLFMPEGKLHTAISYTILWPTHDVHTGEECTRDFLFGIGEDKQRSARLTAWFRTPENYFIQEFRRYQEQLQSNSICSSTKIEDTQTPSTKSVRPRDGRVLRVYTDIPHVEEFLTRPEFVLTTDPKEADIIWVSMQVDSEVKNAVGLTDQQYTNQFPFEACLVMKHHLAETIHKAWGSPEWLQPTYNLETHLSPLIGDYCVRKRDGMDNLWIMKPWNMARTIDTTVTGDLSAIIRLMETGPKICQKYIERPALFQGRKFDLRYIVLVRSIRPLEIFLSDVFWVRLANNQYTLEKTSFFEYETHFTVMNYIGRMNHMNTPEFVKGFEKEHQVKWLDIHESVRSTIRHIFEAAAAVHPEMQNPFSRAIYGVDIMLDNRFKPKVLEVTYCPDCGRACKYDTQALVGSQDTIRGRDFFNSVFGCLFLDEQTHVLPL

SEQ ID NO: 757 - protein, 242 aa, Zea mays
MAAAAPASSVKEVLPSPLTSASEPPPLFDGTTRLYVAYLCPFAQRAWIARNYKGLQDKIKIVAIDLADRPAWYKEKVYPENKVPSLEHDNQVKGESLDLVKYIGSNFEGPSLLPEDHAKQQFAEELLGYTDAFNKAFYSCLVDREDVSEEAVAALDKIEDALGKFNDGPFFLGQFSLVDVAYVPFIERFQILYSNIKNYDVTKGRPNLQKFIEEVNKIDAYTQTKLDPQFLLEQTKKRLGIA

SEQ ID NO: 758 - protein, 302 aa, Zea mays
MARKCSHCGNYGHNSRTCGLGLGLGHREIMLCEGGDDNNGRSGLRLFGVQVRIGGGGGAGSASMKKSYSMDCLQLAAPHACSSLVSSPSSSSLCSSSSPSSLLLSIDDGLQRGAADGYLSDGPHGRAVQERKKGVPWSEEEHRQFLAGLDKLGKGDWRGIARSYVPTRTPTQVASHAQKFFLRQSSMGKKKRRSSLFDMVPICENSASISDPLDVARHGVASADSERAAVDLMNSTTEGDDGRSRDVVSSASGAGTALRFPAAPAQTEPLHPSSSHGHGRGHHCSPLDLELGMSLPAPSVGT

SEQ ID NO: 759 - protein, 428 aa, Zea mays
MTFGSADMEAGGGEHRHAQQEEQSSSDERRARFAEDWGCCACACAGLFLGPNPMVARYLYALIFLVTNLLAWTLRDYGDSALAELQRLKVCQGALYCLGAEGVLRVSLGCFVFFFVMFLSTVNARKVHDCRNSWHSEWWPAKLALWLGLTAVTFLAPSPLVQLYGKVAHFGAGAFLVIQLISVTRFIMWLNDWCRAEMTQKRYHLQIQAVSIVTYVGSLLGIVLMYVWYAPSPACRLNILFITVTLALVQLMTFVSMSSKVKAGYVAPGLMGIYVVFLCWSAIRSEPHTEVCNRKAEVATSADWVNIASFVIAVVVIVAATFSTGIDSKCLQFKQAEGESESEEEDDIPYGLGFFHLVFSMGAMYFAMIFVGWNANASHTMERWTIDVGWASTWVRVGNEWLAAIVYMWMMIAPVIWKTRQVGSAAET

SEQ ID NO: 760 - protein, 842 aa, Zea mays
MSDWSSPAAPTFFPFGPQAEGWDVTFKVKYGDTLKRFYGCANGSHFDMNLSALRARIDTAFKFGPDVDFVLTYTDEDGDIVMLDDDDDLRDAALRQRLNPLRITVQLKKNQPTEKKDTSAPVKSAAQDPLSQLMSAIEGLKPVQEDSLAHIKSAIGEAIKSIPEPIPDALAKLSHEILDAAPPPLAELMKPFAQLMAPNNNGNGPSDVHAEGSSSSSSAQVPAEAKNEPKVRPSLGLKTVLKEAAGPVPNAGASQVQQPLMYPSVEEMLFPCNSVDKSVCKGKIDAQSKGKSVTSSGIQPAPHSLRTHAPPPPHPCISEWSRAQRSQHRQLKFEDNAKATNDSRWRIPMYKMPYAPPPPAVPPPGYVPSPHFPYPGRLLSSGHPYGDLAGNMENSAPHSLHRWIQCDGCGAQPIVGPRYKSNVKEDYDLCDSCFQRMGNEMEYTKIDKPILPHRFLRDPHVYRKVHHPRVLMKSRREKLESRFILDVTVLDGTLMTPSTPFTKIWRMHNNGSVVWPRGTQLVWVGGDQFALQTSVPLEIPVDGFPVDKEIDVPVDFVAPTRPGRYISYWRLASPSGQKFGQRVWVHIQVEDPSFVNDNNRNAAINLNLPPESYSSNTTNLIDVNIEPADSALSAHAKRTKEFHFCSTDFPEPSKSVPFTLATTSLSAAAPTNQTGDVPMSSTPAAACLPSVNVPMHEVVTTHTPSPITPVLPTTIHFSAPVSAPAIAPELASGAVGVPPPVSAVVPELSELDVHNEEKLLRELEEMGFRQVDLNKEILRQNNYNLEQSVDDLCGVNEWDPLLAELEEMGFDDTEMNKELLAKNEGSIKRAVMELIAREKKDK

SEQ ID NO: 761 - protein, 613 aa, Zea mays
MQHDQRKKGSVEAEFFTEYGDASRYKIQEVIGKGSYGVVCSAVDVHTGEKVAIKKIHDIFEHISDAARILREIKLLRLLRHPDIVEIKHIMLPPSRREFKDIYVVFELMESDLHQVIKANDDLTKEHYQFFLYQLIRALKYIHTANVYHRDLKPKNILANSNCKLKICDFGLARVAFNDTPTTIFWTDYVATRWYRAPELCGSFFSKYTPAIDIWSIGCIFAEVLTGKPLFPGKNVVHQLDLMTDLLGTPSMDTISRVRNEKARRYLSSMRKKETISFSQKFPNADPLALDLLQRLLAFDPKDRPTAEQALAHPYFKGLAKVEREPSCQPITKMEFEFERRRVTKEDIRELIFLEILEYHPQLLKDYINGTERTTFLYPSAVDQFRKQFAHLEENSGNGPVIPMERKHTSLPRSTIVHSSPIPVKEQPRIGPCRERPSSDESYRNPRETEQYSGNLPRTSQAPQRVPTARPGRVVGPVMPYQNGDTKDPYDTRRLAMSSGYPPQQIPQTFGYYQTHGKPACCEPSQAERYTLHQQAAYACANRTAASDVALDMRAPPFQHLSAGQRSDSCDRLTAETNLYTRSTNGIAATAAGVAATTHRKVGVVPFGMSNMY

SEQ ID NO: 762 - protein, 118 aa, Zea mays
MAEATDTAAATPPPAPAMATLSPPPKSGIPPRYDLDAKWDACLDLSIRRVAYSSLAGALAGLLLFRSPTTRWASVTLGAGVGIGAAYTECSYLFSGGPPNWSPKVSTIPSAHSEGEDK

SEQ ID NO: 763 - protein, 1463 aa, Zea mays
MSGAWGGTTQKCASCGRRVYPVEELAADGRVYHRPCFRCHHCKSTLQFSNYSSVEGVLYCKPHYDQILKSTGSLEKSFEGVARSTKSEKSNGHKGQQSSRFSNMFVGTQEKCVVCNKTVYPLEKVALNGNSYHKSCFRCTHGGCTLSPSNHITHEGKLYCKTHHSQLFMVKGNFSQFEDNSGNAKVTIEKLPETEEATKNPDQGDEATRKPVENEPTDEKTSKNNVAAEKQLQSSVDVTKPSESTTAENERGTEGESKSNVVNKKPSESIVEKPLQSSVVDVMPSRNSAAMRKPWQRSMQTDKPFLSSTSTVNPSSSSDTTEKLSSSNGVDMKQSESSTLVKTTCQQNSPTENPPQSVLPSDKPSATSVDDAKPSESSKVIKKPWQRNMAAEKQLQNSAPTDKSQKSVGTDKPSPTTGMKSLDNTTEVKSPWGRRMFNNKSLKRSVDTEKSSETSVVDVRPGETSTVAPVPQQQTENVDKPSATSADDAKSADDTKSADDVKPSVASPDDAKSTDDAKSTDDVKSSENNAAVVRKPWQRNIGTGKQPLTTVVGPKTTETSGTVKRLWQRSAATASKSGTAVVTPLQSSVAVSKPFQSNVAVKKTWQRSVTPENELQSNMSSNKPLPSKVVVESLLQSNTVEKVFQSTVPTEEPQKGIMATENQSQTIKVTKKSNETSMELSVTSETTKPPPLAATVLQSDVSTEQPSQTDMPTMGPSQIPEPTEKPSESDFNAEKLSESVVKAEKSSTTDTAAEKPLQSMITEKVESVAGTLKPFQSDTALQEILERNMATEEILQTAMAVEDAPPTNLITEKSLMKDASEEPVQTNEPSEQPLKTEEIEKPQQSEKIATDTRGSEVSTEEMLELESNATKLNKDQSELEGLSSGRNPPNFQSNPNAGQRSESKGIVAEKAADHIMEAEDDVDAEHSSESQSVAPAEVRKEQPSEHQKDVDMEQLLEPQNQDHPWNPLDPVSDTAAKDSSEPKSDIATEKRAESQNNAEQSVEQQSEPQSDKSTEKPEVHQSNSSNDELSRLQNDAGTDKLSVQSSDPESNASVSKPSESQTDVTTMEALEPQIDAPPDKATDQPVKPQDDASAKNPMGTESDAVCDKPSESSSDTETLLVCHQNSSITTDEPVQGGISCDTPHQRSAPIETTPGSETVVDDCIHHEDTSSKPSEENKAIEEPEEVSAKLPDDHVTSEKSSEEDKENAEASVDSAPLGSPLEVNEESSNPSGDTVTPEKPLEEDKTSAEPSESDASFGKILEADEVSANPSEDIATPEKPLEEGVGSVEPSEDNSVLDKPLEEEEVDAKPLKDVVTPEKPLEEGSTTAEPLEDNAAHEEAKEEEVIAKPLSSVALEKSLEGSEASVEPSEDNAALEKLSEDDEANAKSSEDSVYVEKPQQEEDDNGVKALEEGVSPEKSAAGKPLEEEDPVQEKPADAVAEPSSQDDTATEKPSATTDTAETA

SEQ ID NO: 764 - protein, 436 aa, Zea mays
MESAAAAKTVERLAQRLVPPAEPTPTAPHRLSWLDRYPTQMALIESLHVFKPDPARDGLSPAETIERALARALVDYYPLAGRLAVSDSAGGLHVDCSAEGVWFIEAAVRCRLEDVDYLEYPLQIPKDELLPHPLPRPSHEEESKLILLVQVTAFACGGFVVGFRFSHAVADGLGAAKFMGAVGELARGADQVSVAPTWARDAIPDPSGALVGSLPEPTGAKRLEYLAIDISADYIDHFKSQFAAATGGGRCSAFEVLIAKAWQSRTRAAGFEDPDTPVQLCFAMNARPLLGARLPRGGAGFYGNCYYIMRVASTADKVSSSSVTDVVKIIRDGKKRLPLEFARWAAGEEGADGVDPYQITSDYRTLLVSDWTRLGFAEVDYGWGPPAHVVPLTNLDYIATCILVKPWAHKPGARLITQCVTPDRVSRFHDAMVDMN

SEQ ID NO: 765 - protein, 258 aa, Zea mays
MATSDKKTRGYVPWNDEMDKVLLDTFVDYYNKGDRCQNGWKSHVYTAAVKNVCEKCNVTITKENISSRSKTFDKHYNIINGLLSTSGFGWDWEKNKLKVDSDTVWDEYVEEAKGYRHKVVKFWDLLSLVYNKDQANGEGAKTTAESSKEMAKENDTGGKDAPYSVSSSSSLKRQRSDDSFNSIWCDKFDMLTSALKDDGPKLPSSAEVLAALQEVEGLDEDTELELYDILTSNARKFESMMALPMERRKRWLMMQLRK

SEQ ID NO: 766 - protein, 274 aa, Zea mays
MGMGPLDNAASAALEAAAAPSRAGSYAVLQCGEDSEYVRQKYGGYFAVFRALLEEDGERWRVYSAVRGELPADAEAAGFDGFVISGSCADAHGDEPWILALVDLTRRVHAAGKRVLGVCFGHQILCRALGGRTGRSAKGWDIGVSCIHPTAAAARLFAPLKLPVHMPVIEFHQDEVWELPPGAEALARSDKTRVEMFRLGGRAMGVQGHPEYSKDVLMSIADRLLRHNHILDCQVDVAKASFDVRQPDKELWSKVCRGFLKGRLQSSQQQGVAL

SEQ ID NO: 767 - protein, 175 aa, Oryza sativa
MASQSTKPAQAAAEPSPPAATAAAGEAPPAPNPASAATPAQNPTAAAGAAAGGATDLEKKMRRAERFGTAVVMSEEEKRSSRAERFGTGSSNEKAEEQKRKSRAERFGLASSSADEDAKKKARLERFGQSTNVDKGEEEKRKARALRFAETSSGPSQENGKDSSKPDAATVAGTA

SEQ ID NO: 768 - protein, 1172 aa, Oryza sativa
MEDVCEGKDFSFPAEEERVLKLWSELDAFHEQLRRTKGGEEFIFYDGPPFATGLPHYGHILAGTIKDVVTRHQSMRGRHVSRRFGWDCHGLPVEFEIDKQLGITNRQQVFDLGIGKYNETCRGIVTKYVAEWEAVVTRTGRWIDFKDDYKTMDINFMESVWWVFSQLWEKDLVYKGFKVMPYSTGCKTALSNFEAALDYRTVPDPAIMVSFPIIGDADNAALVAWTTTPWTLPSNLALCVNANLVYVKVKDKSTGAVYVVAESRLGQLPAKAKSSGKKQAPSKGGTAEVVQGGLDTEAYELLAKFPGSSLVGLKYKPLFDFFLELQETAFRVIADNYVTDDSGTGVVHCAPAFGEDDHRVCLAAGIIEASGLVVAVDDDGCFIEKISEFSGRYVKEADRDIINSVKDKGRLVSKGSIEHSYPFCWRSGTPLIYRAVPSWFVKVEKIRDQLLECNKQTYWVPDYVKEKRFHNWLEGARDWAVSRSRFWGTPLPLWISQDGEEIVVMDSIEKLERLSGVKVNDLHRHYVDGITIPSSRGPEYGVLKRVEDVFDCWFESGSMPYAYIHYPFENRELFEKNFPGNFVAEGLDQTRGWFYTLMVLSTALFGKPAFKNLICNGLVLAEDGKKMSKSKKNYPSPVEVIDEYGADALRLYLINSPVVRAESLRFKRSGVFGVVKDVFLPWYNAYRFLVQNAKRLEIEGFSAFSPIDQASLLKSSNVLDHWINSATESLVSFVHQEMDAYRLYTVVPYLVKYIDNLTNIYVRFNRKRLKGRTGEEDCRVSLSTLYHALVTTCVAMAPFTPFFTETLYQNLRKVSTKPEDSIHFCSFPSTTGERDERVEQSVNRMMTIIDLARNIRERHNKALKTPLKEMVIVHPDNEFLEDITGKLKEYVMEEMNVKTVTPCNDPMLYASLRAEPNFSVLGKRLGKDMGKVSNEVKKMTQEQILAFEQSGEISFFGHCLKLDDIKVIRQFKRPANVAENEIDAAGDGDVLVVLDLRADQSLFEAGVAREVVNRIQKLRKTAQLEPTDLVDVYYKPMDDGKNTLVEIVQSQDQYIRDALGNPLIPKMAAPPDAVMICEESHNVQDMSFVIYIARVSPVVTDDLLVHAAGNREHFDALKVYLLSRSISRLKNEFQAGNGKITVDFIEGFPPIDLQLGKHVFLSTGDFYLATRS

SEQ ID NO: 769 - protein, 394 aa, Oryza sativa
MQHLHGDVLESAVERVPAPDLAAAALVSREWLRAVRAALRRRMLRLPWLVVHVIHLRGQRRLAAAYDPRSGAWLAVPTAPPARHGATSPPQPHSHVRLMRGASGDRVCALSLSGLAVARDAIGMDDDALVVALKAPGVWRVDPVLAAVGDRVVAMGGACRLALGDGEDTSAVEVHERGGWTHCGAVPAALRESAAAAATWLSTAATDQRVYVADRATGTASWFDPAKQQWGPTSRLRPDATVSTWGLAAGRAGAEKIILFGVKHADSRVVIRSWEVDGDSLSLSHGAAAAHDTMPSEMSERLFPHGDDGEEETSSPSIGVCGNTAGGYVYNAAVPATGAVLYELRRGGVEGGGVERWAWVACAPVVAEAEALGRVILACSPVGLHELADERLAH

SEQ ID NO: 770 - protein, 279 aa, Sorghum bicolor
MAQHRFQNLRIIDNTELRDIDATMSGNTVFATVPDTISDTFNHYDLAEAIQQQFQINIEVEDISRYNEGYFLRVHTQQARTNMLHRGFIIVRNYLIGLRPWNPEHGSIAVSLQTVLTSCPLNIHLATDIPLSDPYEHLTIHITGVPPHLCCNSLIHKLFHKICIIHSVNFISATTEYEISARGRVTMIPQTAHLGIRNLSGQSEVINIWQLSYQTFTDEMLGRQTPPGDRRSDLCGYSDIDTEQRLELVDSNGNNEATSRLQVASDTSTMDTSDNSIEE

SEQ ID NO: 771 - protein, 881 aa, Sorghum bicolor
MFGDCQVLSSMAAMAGASSSADALFIPNPGALAGFMSSSAAAMPFHHFSTTAASLIPKEEGGIMGALQVAKDEDMDQLEMDMELSGGSGSAHLDSLLSFADVDDDRPEQKPQHSGLELQTTVDAAGQQQQQQLATANGKKKRYHRHTAHQIQQMEALFKECPHPDDKQRLKLSQELGLKPRQVKFWFQNRRTQMKAQQDRADNVLLRAENESLKSDNYRLQAAIRNVVCPNCGHAAVLGEMSYEEQQLRIENARLKDELDRLACIATRYGGGRQPSMSSALGCLSAPPPVLMPPLDLDMNVYARHFTDQSSVMGCGDLIQSVLAPQQQIPVGGAEHHATSSFMGAAIGPVQEQDRQLVLDLAATAADTLAKMCRAGEPLWLRRRGASSEVMVADEHARMFSWPVDGGQQGSASTGAAARTEGSRDSAVVIMNSITLVDAFLDANKWMELFPSIVSKARTIQVINHGARSGHMGSGSLLLMQAEVQFPSPLVPAREVVFFRYCMHNGDEGTWSVVDFPAEGFQLEGLQTSSVVKCCRRPSGCIIQDMPNGYSSVVWVEHMEMVGEEKPLHQVFKDYVTSGYAFGATRWVSLLQRQCERLASELARNIADLGVIRTPEARTNMMKLSQRMITTFSANISASGSQSWTALSETTEDTIRVTTRKNTDPGQPSGVILTAVSTSWLPFSHQQVFELLADEQQRCQLEILSNGGSLHEVAHIANGSHPRNCISLLRINAASNSSQNVELMLQETSTHPDGGSLVVFATVDVDAIQVTMSGEDPSYIPLLPLGFAIFPATNPSPAATSTSSGNGESSPGNTDEPTSGCLLTVGMQVLASAVPSAKLNLSSITAINSHVYNAIHQITTALKGQGAGVSGVEPVAAAGSD

SEQ ID NO: 772 - protein, 448 aa, Sorghum bicolor
MERYHPSEVYELFVRHMNTPRVVVDNGVCATATLVQVHSARKHGVLLEAVAALSDHGVCVRKGYISSDDGRWFMDVFHVTDASGRKVADADALLARLESSLTADALPPRTPPAAAVGNGAGPAMPTLLELVGADRPGLLSEVFAVLHDLRCDIADARAWTHGGRVAALVFVRDVETGAPIDDAARVRRVESRLRHVLRGGALGARMVREDAAAVNMDRRLHQLLNEDGEAECRADQADATAVAVQDWGERGYSVVTVSCRDRPKLLFDVVCTLTDLDYVVYHGTFDTDGDHAQQEFYIRRLDGRPISSAAERRRVIQCLQAAIERRASEGVRLELRITDRRGLLAYVTRVFRENSLSVTHAEITTRGDKAMNVFHVTDVAGRPADPKTIDEVIQRIGTESLRVDEERWPRLCSTEGDEGRGGGGAGIFSLGSLVKKNLASLGLIRSCS

SEQ ID NO: 773 - protein, 194 aa, Sorghum bicolor
MAMAAAEGKSRRFALACGVLSQYVKAEQQMAAAAAPAARAPATTLSLMPGADVGAEQEPAPAAAARGEEMAGPASTAAPLTIFYGGRVVVFEDFPAEKAAEVMRLAAGGAERAAVPAPAPAPAPAPRDDLPIARKASLQRFLAKRKDRLVERAPYTRPSPSPAEEAEKTKQPAASSWLGLGGSTTDAERLTIAL

SEQ ID NO: 774 - protein, 479 aa, Sorghum bicolor
MARSGREGEERKLVLGKYELGRLLGQGTFAKVYYARDLSSSGAAGGTGSGGSSSSSSVAIKVIDKARLRRTEGMVEQLRREISIMRMVRHPNVVGIREVLASRSRVFVVMEYARGGELFAKVARGRLTEDHARRYFQQLVAAVGFCHRRGVAHRDLKPENLLLDEEGRLKVTDFGLAALPEQLRHDGLLHTQCGTPAYVAPEVLRKRGYDGARADLWSCGVVLYVLLCGFLPFRHDNYVKMYQKIFKAEYQVPPWVSGDARRLIARLLVVDPAKRASIAEIMCTPWFRKGFVPPVLSPPVTPPKKRLDEDHDAAGDLFDTDDDDNSSSCSNSGATATSPRSCNAFQLISSMSSGFDLSGLFENEQKAATVFTARAAAATVVEKLESVARTLGFEITRGKESGKVRMEAKAEGTNGRLAVTAEVLEVAVDVAVVEFAHDAGDALDFNKFCAVDVRPGLAEIVWAWQGDSPPAPAAAVGTA

SEQ ID NO: 775 - protein, 450 aa, Sorghum bicolor
MKEFSYEEVEAATGGFAAKNLVGKGSHGSVYRARLRGGGGRMTTVVAVKRPSHAQGVAKLANEIAVLSAAPRHPGVIGIVGVSSSSSSPQPPPPPAASGPRLPPLLVMEFMPNGSLHDLLHRSPRPPPWPRRVEIALDVARAVHALHAAAPRVIIHRDVKSANVLLGRDGRARLADFSLAVSVKAVHAPPGAAGACGGGEEEEEDDDDEEEDEEGGSSSAGPAPAGTIGYLDPCYTEPGRLGPASDVFSFGVVLLELVSGRKVMDVNSCPSSIVSWAAPLIAAGRAREVLDGRVAAPPTARAHRALARVLAVAARCVSETVERRPAMDEVVSELRGALESAGWRWRHHRRGDSGGGGVVERVCRRVASWGQRVRRRSKRVVRATKVECTEHSDSGGAATGSSSCAAALPSHRSNNGMMSGAGAAHSNESSKAKENALNRFESELDLVFSS

SEQ ID NO: 776 - protein, 1074 aa, Sorghum bicolor
MPAAAVPGGGGAADAEELFRTKRIPEIRAAEGATRREISAKEEELRQLVGRSYRDLLDSADSILLIKQSSDAISDNLARISGSLSSLSPPPEPSPAVSAASPSPSAGGRARLYALAARAKYLVDTPEHIWGRLDEGLLLEAAGRYLRAQVVHGRLSRDAAAAARFPLLAHQAQLVEAFRPQIAQRARERLADRRLPVAAHADALAAVAAIDAPSLAPAQALLLFLTSRRAWISQALAGLASDLSSYTSVLCDISRIVRITLGHVGQLFVPALSDMPLFFKTVLEKTPPEQLFGGIPDPDDEARLWKEHMNQIEATMVLLEPDAVARACTDWLKECCTEIFGVIAGEQKLVDAIGSGELLGSVQRLVRDALDGRDGLEGSLEQWLKSVFGSDIESPWDQIRGLILKDGKDIFEDWMEEAFVRRMKDIVHSELDGLGACVNVKESVHAIGANADPKDAGDFLAYLRKSSKGGGFWFSESKIKKGGVLAHLKPIADENDFHSCLTSYFGPEVSRIRSAIDSKCKNILDDLLSFVESHNSAPRLKELVPYLQEKCYRTISRVLKELEAELRKLSALLGTKKEGNDIPAASIIAERSLFIGRLLFALRYHSSHVPLILGSPREWVKEAGGAAFARLSSPTPRHSRASFDSLVSFTPRRRTFDGPRSPGRQFSDSPRKQTIAAAVSLFGADDRSNPRLDELNKTLQSLCVMAHNVWIAWVSTELSRILSYDLNKDDSLSSSTPLRGWEVTVIKQEESTEGPLEMQIALPSMPSLYIISFLYQACLEIHKVGGHILDRIILHNFAWELLQKVINIYEKFLSSVESGNSPVSEKGILQILLDLRFIGDVLSGGKSSSANTTEMQTKQDSLPSTVTKTSFRRKQSQLQADSAVIEPINKLINRLSQRLDPIDWATYEPYLWENEKQSYKRYVVLFGFLVQLNHMYTGTVQKLPTKSNTDSNIMRCSQVPRFKYLPISAPAISSRSHKSSLQSPSSDSTSKSPWKSYSNGDRSTTPEFDDNASLVGAAPLLKSFVTQVGSKFGENTSRWGSMLSDGQVGKLSDILPGPAAGFFSSFTSGTRYDS

SEQ ID NO: 777 - protein, 833 aa, Sorghum bicolor
MPCPWLAAAMATRGGGPAAAAVLLQLLGFLFLLRGVPSRAEDDTVAAGRPLSGGQSLVSKRGKFRLGFFQPDNSTQRWYLGIWYNQISVHTTVWVANRVTPISDPESSQLSISGDGNMVIVDHSSRSTVVWSTNVTATNSSTVGVILDNGNLVLADASNTSAVLWQSFDHLGDTWLPGGKLGRNKLTGEVTHLVAWKGYKDPTPSLFALELDPRGSSQYLLNWNGSEQYWSSGNWTGTAFAAVPEMTPTGASPVSEYTFGYVDGANESYFIYDVKDESVVTRFQVDVTGQIQFLTWVAAANEWVLFWSEPKRQCDVYSVCGPFGVCTENALPSCTCPRGFRQRDLAQWLQDDHTAGCARNTALQPCSAAAARDGQKKHSRRNDDRFYTMPNVRLPSNAQSTAAASAHDCELACLRNCSCTAYSYSGGGGCSLWYGDLINLQDTTSSGTTGGSSSSISIRLAASEFSSNGNTKKLIIGLVVGGFVTAVTAIVLATTFILRKRRIKSLRRVEGSLVAFTYRDLQLVTKNFSEKLGGGAFGSVFKGALPDGTLVAVKKLEGVRQGEKQFRAEVSTIGTIQHVNLIRLLGFCSEGSKRRLLVYEHMPNGSLDRHLFGASSQGQGVLSWDTRYQIALGVARGLDYLHEKCRDCIIHCDIKPENILLDDAFVPRVADFGLAKLMGRDFSRVLTTMRGTVGYLAPEWIAGTAVTAKADVFSYGMMLFEIVSGRRNVGQRADGTVDFFPSTAVSLLLDGDVRSAVDSQLGGSADVAQVERACKVACWCVQEDESLRPSMGMVVQILEGLVDVNVPPIPRSLKVLADPSKYAVEFFSGLPST

SEQ ID NO: 778 - protein, 483 aa, Sorghum bicolor
MGSTGREPEVTRADFPDGFVFGVATSAYQIEGARREGGKGDSIWDVFTDDKERVLDKSNAEIAVDHYHRYKEDIELMASLGFSAYRFSISWARIFPDGLGEKVNEQGVAFYNDLINFMISKGIEPYATLYHWDLPNNLQKTLGGWISDKIVEYFALYAEACFANFGDRVKRWITINEPLQTAINGYGIGIFAPGGCQGETARCYLAAHHQILAHAAAVDVYRRKFKAAQGGEVGFVVDCEWAEPFSEKAEDQIAAQRRIDFQLGWYLDPIYFGDYPESMRQRLGSDLPTFSEKDKEFIRNKIDFIGLNHYTSRLIAHHQNPDDVYFYQVQQMERIEKWNSGEKIGERAASEWLFIVPWGLRKVLNYIVKKYNNPVIYITENGMDDEDDQSATLDQVLNDTTRVGYFKGYLNSVAQAIKDGADIRGYFAWSFLDNFEWAMGYTKRFGIVYVDYKNGLSRHPKASALWFSRFLKGEAAENKPDTN

SEQ ID NO: 779 - protein, 1349 aa, Sorghum bicolor
MYPANHYMDPYHSHYRNHAPYPYYPPPRWEIPSGHPRAMDSSYYYRPPSCGTWPYNHDMHHSHPSELHCCCNQTYPPGYYSFRPPFPQELPPPHLYYHGPFPQHPNAWPSYFVPSHPYPVDHTPYGYDKFKGHCCGCPNHVCPGAEKSNVKIEEERPDVKLESEHKNADSGSIIQHPNSKYPFIWLPPGNMKGKENGEHYELSPQIFNEWAPLSSKRLGDVKQQEQDNQKGKQFQWPMVWMPAGYDAPKQKAKEMNDTEGTPKSPKISEESPQSPKIKIIPLSWFENGHHHDQKLAAKNDSGDHNKRSAVKNQPVLTNNEDEDSMTLEGNPKTTPAVPKSINDEKKPLRESCKTIPVVPEKEINEKKASTCRTIPVMKGSDEKKIGMKEKKEAKETNSVEKVEENRKTKHSDSSIAKHSKLPPVCLRVDPLPRKKPGNGSSRSPSPPTRKDADSAKDMKNPQNQNLEPKQSGTSNHIAVSEVKEKSPYEMKKEIGFRNETVQASAVEHSQDEEAPTSEDHQNVQAGSTMVGTQENTGTKSIQGGAVQENVGAGSLNGCDKSKNEDGTVIESEAAKDDKSKNEDGTVIESAKDDARTYRVNLSEPDAAVRIQSAYRGYDVRRWQPLDKLRKIRHVHEQMQGVKKQLQCLEDSCNKPTQKEQVAIGETIMNLLLKLDTIQGLHPNVREARKSVARELICLQEKLDTLCKAPFGDLDHTNSNDDGESERTKSIIQTAAPTVTTEASDRQERAVEMGKVEEPSSVSMEPCNTVPSEVSWEVRPDADFSERSEKQESCSPTVDEAHEEVASSMDMTSDEVFIEHPTDNQEHGIRESNVNSVEQVTEEEKPAAEDEVKESLTDNQEHGIGESNVNSVEQVTEECQQEKPAAADEVKESPLVNSMAPLYYAASLEDSSGLKQYTASTHQNLYAESPASTEDINISALTASVESEVATEKDGPVDSQVHETAALENVELKDDVSCAENEHNKSGSPVHLEDPLVPLKDVEKHDLTPAKDFVVSNTEDQQEARDIRLQVQDVDSMEDSGKVPDGTIEASTDDDLELGTADVEKHDQPNLLEPRLESVSAPELSVLDESDDKMQCGVSGKDEVPHVDEKTETTVDKVTGGSANCEDLLCESSRTEPDIQESHTSLGEEVDVTITTGGTVFPDSVSCDLSCPHDGGMTVYEGSETVSSENQTDAQKENIHSDVSQTDECTKTQKVPPVGTQGENSAEDSDVQVSEMDKCNEMPKEAPAHATGANPAEDEASLKEDITVQTDNKPSASPAPEDPKVSDKEKLAEENQKLKELLQKLLASGNDQMGVITDLSEKVKARKLARKKRPKVRVHRPSGHVTAKVH

SEQ ID NO: 780 - protein, 810 aa, Sorghum bicolor
MKMSPPALAAGTTSPLSPPTAAVSAHPFPPTNHKPHSARIRLSSAAAATSSSRWVNPRAPPPRRGAGRSGANQRLHHLVHLGDLDAALLLVESMRDPERPAAVPCTLLIKKLCAAGRLDDAERVLGASERAGTADAVTRNTLVAGYCRAGGRLADAERMLASLALSGSADVVTYNTLVAGYCREGRLNDARRLVADMPFAPNSYTNSTLLKGLCSNKEWDDAEELLSEMIRSGCPPNDLTFGMIIHSLCQNGLADRAMGVLDQMSKCRCTRGVIVYNEIISCLAELGRVEEALHLFDQMPCKPDIFSYNTVMKGLCRDGRWEDAGTLIAGMVRKDCPPDEVTFNTVISYLCHRGLVDCAMEVVEQMPKYGCKPDNFTYSALVNALSERGCVDDALELLRTIPWKPNTVCYRSVLKGLCRADRWDDVGKLVAEMIRNQLNLDEVTFGLIIDCLCQKGLVDYGAEVLREMTKFGCSPDIIIYNSLINGFSENGSVDDALELFKNMSCKRNVVTYNYMLKGLCRAEQWEDAGKLVAEMVKDECLPNEVTFSTLISYLCQKGFVECAIEVFEKMPKYNCMPNVIIYSTLINGLSDQECVDDALKLLNDMPCKPDTICYSAALKGLCRAERWEDAGELILEMIRKNCLPDEVTFSILINNLCHKGFLESATEVSELMLKYECMPNVFIYSSLINGFAEQYRAEDALQLLRNMPCEPDTICYSAALKGLCRAKRWEDARELIAEMFRKQCPLDEATFSMLIGSLCQNGLVDMATEVFEQMSVYGCSPNRKIHSSLVNGYSEQRRVDEGLKLLSSMP

SEQ ID NO: 781 - protein, 276 aa, Sorghum bicolor
MSDHQRIHPVDLEGGSNRPTAPLVPGGSSFRSDKGDPAAARSANHHHQQRAYVPGGPLPPPPRRVAPAAPLPPPPSRKRRGRGCCCRLLCCVVITAVVLAVLAAAAVGALYLALDPKAPRYSVDRLSVSAFQVDPSTVTARARFDVTVTAANPNSRIGIQYEPGSSLGVWYQSYRLARGALPAFYQGHRNTTVLPLALAGEVQLATAVVSGLQDAQRTGAVPLVFRADVPVRVEVGSFKLWKVTSRVRCDLVVDRLMDVSSPIKIKASNCKFSLKL

SEQ ID NO: 782 - protein, 384 aa, Sorghum bicolor
MDCGGALQLPPGFRFHPTDDELVMYYLLRKCGGLPLAAPVIAEVDLYKFDPWQLPEKAYGGEKEWYFFSPRDRKYPNGSRPNRAAGTGYWKATGADKPVGSPRPVAIKKALVFYAGKPPKGVKTNWIMHEYRLADVDRSAAARKKTNNALRLDDWVLCRIYNKKGVIERYDTVDDDADDAVAEDVKPAPASRNNPRGTASGRGGAAAAAAPMKVEFPEYGGYYDYEDLEATPSAGMLCFDRPSAAVPTAPASAPAPAPGPALSSPPPAADSDPERDDDSNNSVAWTMHHTHAHTDNYSSCGSEHVLSPSPDLPDRDHAESQSAGLWWPVGVGGDWAAAEDGFMVDVDVGDGSSLFGPPSPGLPFARVDAAAFGDMLASYLHKPF

SEQ ID NO: 783 - protein, 1715 aa, Sorghum bicolor
MSSSSAMPPPASPREHVERIRRERYYIGRGEQNPLAEDMHQAVNYLSQELYSKDVHFLMELVQNAEDNEYPSEVAPSLEFLITSKDITGCGASSTLLIFNNERGFSSTNIESICRVGKSTKKGNRHQGYIGEKGIGFKSVFLISSQPYIFSNGYQIKFNEKPCAECNIGYIVPQWVESTPSLSDIEAIYGCSKVLPTTTIILPLKSEKIDAVKSQLSSMHPEMLLFLTKIRKLSVREDKSDPNNTTVSEISISSEKNYQARKNMHAESYTLHLSSEETGKDEAECGYYMWRQKFPVKPENRVNKRAEIDEWVITLAFPHGERLSRGKQLSPGIYAFLPTEMVTSFPFIIQADFLPGSSREAILFDNPWNKGILDCVPSAFMNAFVTLVKSKADAPAMSLPSMFSFLPVNSSLIPLLEPVRSGIKYKVLTENIVPLESYASQKIFCKPSEVARLKPAFWAILGKAREFGVDLKSLSTHGTYILSSHFDKSRYNSVLEFLGIKSVSTEWYAKCIEGSNLVKEVDEQLYLEILHFVASNWENCFSGTNMMSVPLLKYVDRNGVLSFWSISRASQQKDRLCIASDMKYRSWLISWNKEFLSSNKFFLHPSTQAALDGFSQKMTVESWLRNHARVEVVSVYSYGSTVVDSLSNDQRSVLAFAHFLYHSFKMEHIESFWLSKLCCAMPIVDRYGNVVNKTENIIVPAKGSKWVGLLGTYPWRNQGYIELSADYKSVGHFAGNYTSEDQLLEFLKIHLHASDVPLIRPPNVRFHTVSSPLNVDNTFLLLEWIRNIRSNGVTLPDQFLACVEEGSWLKTSVGYKPPNESFLSSANWGSLLQSGPSFIDIPMIDQQFYQNKLHIYKQELKVIGVRFEFEEASSYIGSRLMSMAASNVLTRDCVYSLLRLIRFLREKVLSPSQLIDSVKDGCWMKSTVGYRRPSDCIIKDSEWAVASCISDQPFLDVEFYGEDILSYKSELELLGVIVGFKNNYHLVIDNFKFRSSAITSESTVLILKCIRYVGSCQDFIRKLRDLKWVKTNVGFCAPNVSFLVDSEWECLVKIFKGVPIIDLGFYGSVISSYKEELKKAGLITRFEEASMAIANVFKRMVSESSLTKANVLALLLAYRQLRTHSPLPVELFNCMRTEKWIHTSLGFQSPSNTILFDNAWQYLSPISILPFIDDGDTCNGLGMDIYGYKDELRELGVTVEVKFGARFALAGLSIPDDPSILSKATILSFLECIKNYFASATEPPKGFKDQICKKLLKTSLGYQYPDECILFDAKNCFLQMEDGPFIDEAFYGSDIASFKHPLAMIGVTVDVNSAQDLIARYLRNKKDIDTISRIYMYLKKCNWKPDKNNNNNRNWIWIPKETEGGDWVSSRSCVLYDKNNLFGLQLHVLDKYYDRKLLDFFSLAFSVRHGPCSEDYCKLWATWESSVHELPISDCLAFWKFIAKNWTKKTEELLSGCVKVPVCIDGKIILSNKENVFIPDDLLLADLFRKHPKQSLFIWYPSSALPSMSRARFNSIYGSIGVRTISEAVAKNDSFTSANSHFKTAVLSKVIKVGLLQIVLAFLSNPNFDIPAKDRHHLVSCLLNVTIEETDEPITMAYSVSLSSGEMVEVKARRMLRWERENSKLYMQRSDGASSYEDKIELATYFAHEISHGLLFQMPDQISSLTELIKIGSLVDFQQAAVAFLLKSKNLQLFPEDEDFLNSSVLGGSKKPVDN

SEQ ID NO: 784 - protein, 469 aa, Sorghum bicolor
MGGIGVSPCDLDREFAPQIAQLLATPPLQSAQEYYDELIRSKKLDGIRVSYSGKHGKGVCANRDFAEDDLVLKDQMLVGAQDSLNKIDCVVCSYCFRFIGSIEFQIGRRLYLQSLGGSVDGSTERHCHGSDAGPSTGCSGASSGNSNAVPQEVLMSLMDGNMSLPLTDQFCLPSVVACPGGCEGELYCSQSCADSDWDSYHSLLCAGSKTEPLRKSALQKFVGHANGTNDIFLIAAKAITFTLLRYRKLKRQHGSHESSSSLLMEAWKPLSMGFKKRWWECVALPEDVDSSEEELFRQQIRDLAFTSLQLLKDAIFDPECAPLFSLDIYGHIIGMFEMNNLDLVVASPVEDYFIHIDDLPESEKEEAEKVTGPFLDALGEDYSVPCEGTAFFPLQSCMNHSCCPNAKAFKRDEDKDGHAVIIALRPISKGEEITISYIDEDLPYEERQAQLADYGFTCTCLKCQEEQPV

SEQ ID NO: 785 - protein, 581 aa, Sorghum bicolor
MRWAAFLWEGASRASGGRRPGVSNLLLVVAAASSGGLVAYADSGSDAAVEKPQLPPRKKVVVLGTGWGGTTFLRNLDSRLYDVQVISPRNYFAFTPLLPSVTSGTVEPRSIVEPIRRILEKKGGEIKFWEAECFKIDPQSKKIHCRSNVGTNLEGNGEFLVDYDYLVVAVGARTNTFNTPGVVENCHFLKEVEDAQKIRRSVMDCFERASLPFLNEEERKKNLHFVVVGGGPTGVEFASSLHDFVTEDLSKLYPSVQHLVKISLIEAADHILTMFDKRITNFAEDKFGRDGIDVKTGYKVVKVSKDDITMQNPATGDISVPYGMAVWSTGIGTRPFVVEFMKQIGQANRRVLATDEWLRVRECDGVYAIGDCATINQRKVMEDISEIFRVADKDKSGTLTVKEIQDILDDIYVRYPQVQLYLKSKQMNGIADLVRSAKGDAEKESMELNIEEFKKALALVDSQVKFLPATAQVASQQGQYLARCFNKMKDAEENPEGPIRIRGEGRHRFRPFRYRHLGQFAPLGGEQTAAQLPGDWISIGHSTQWLWYSVYATKQISWRTRMLVVSDWTRRFIFGRDSSCI

SEQ ID NO: 786 - protein, 696 aa, Sorghum bicolor
MGARDNGEGRDEKKGIGSDYVPTRDSFSSQGESRVPRKLSKKETKDNNSPRTTKSSASRQAQTKLQHKGLNSVQNKSQKQKKTVSPAKAVEVRKPDITRIPSRPPSELSEETDDIISDAGTVDDKGTEEAKEIDVLDEAPHCDQSTGTDDEIPDIEDKVVDHGKSVVGQGNGELVLKIDKLEHELREVAALEVSLYSVVPEHGSSAHKLHTPARRLSRLYIHASKFWSEDKRASVAKSIASGLVLVAKSSSNDASRLTFWLSNTVVLREIIVQTFGISHQFTPSMTTMNMNGGAKKLDGKSMTMLWRNNSNGMQAKLAAMQMPDDWQETSTLLAALEKIESWIFSRIVETVWWQALTPHMQKRTVEGASTPKAGRVLGPALGDQQQGTFSVNLWKAAFHDAFNRMCPLRAGGHECGCLPVLAKLVMEQCVARLDVAMFNAILRESASEIPTDPISDPIVDPKVLPIPAGDLSFGSGAQLKNSIGNWSRWLTDKLGIDDDDSDEIGDVEDERRGRAETKSFQLLNELSDLLMLPKDMLLEKSIRKEVCPSIGLQLVTRILCNFTPDEFCPDAVPSTVLEELNSESLLERHTNKDVINVFPCIAAPIVYRAPSTLDAAEKVADIGVGAKLDRKASMVQRRGYTSDDDLDDLDSPLASLIDRSAPPSPSNGFTHFSSQRGVSMENTRYTLLREVWLEQR

SEQ ID NO: 787 - protein, 531 aa, Sorghum bicolor
MAKGDDALARKRNRVRRKRLRSSENAVSARVAAIIASKRRRKSGKRRGCEGMCFSLPTPDDPFNERHGKKRKVDDEPTEDTAAAKDGDDPKKKGANTKKEQPVAKAGAEAKAKAKAKAKSKAVRERATGADEGRVDLDRPSKFLVVCLNAIRDTLAPEDGGGSIHGAGDWGVELWRCCSAQAPSDVLDASGACATVDQTAWLVSTACDIVARKERLGMVVSCPFLLYLVPSQEKAAQVRSICKPLKPLGIHSVSLHPGASIEHQISGLKTCEPEFLIATPERLLELVSLKAIDISSVSMLVIDGLKCFVDHNASDKIFSIRDAISNNPQITIFTDPSDKKVAAMAKSLLRGRITKLSINDSVSSRSAFIAQHVHFCPSEELKTSKVKEILEGILQSHPKKTSKVLLVVANDQKARYMSSSLKLKNCTVIDDSHGSSFTICSSLGLMNVIVKDRENMAVTDAEEFETVLVVDLPPSVDEYVEILTGVALHVIGGEVHSIFCNADASIAKPLAELLADCRQVVPEFFKNLESS

SEQ ID NO: 788 - protein, 752 aa, Sorghum bicolor
MEQISLGNRYKECRPRRTSSCQTKILVGKDVLHELEQRRSSPSVIAKLMGIDVLPPNVVNSRHQEFKDVFEVSEEPPEAVTKERSHHFPKGLPSLKQSALRLKKLMPSKTLYRDDTHDCHVDSTDGLGRLNSVEINNPLFEKRPRDMNYSANYQYEKNTSSDCRTYPVGLANSSLSNFSLLSRGKNKDFNNIVLLEPPCLDKGHDPENVFSIPYLSPLNKNCRRGMKHKQSEFPVMENGRDWQHILSTEDNNVPRIRKERFLTSDPIDRLQIGQEASVHQFGNTDASCPGSSQRYFCGNDNFNQTNRSSSNSTLLKIRRHAESAVGSKTLAQMFALSDSERLKLNSNSRAPIRRNMIDRDNGHSKDGCFIVLPKHAPLQSIRSSMDRNSCSEGSSQGKKNSNISNIYNNGKCQFDYFRDKPRLLKQIGSGSEAHSAHLSNACCFQNLTADNFSSPDCLNEKVLFTTDEDLVLQPPEFLASGFNLQVSRKQRVTILPFRCHEDELISVSDHTDSTKSCKGSKEVEQPSPVSILEPPIDDDICFPGCLDYDDLQGMANVEKQRDGHQYHNESEVAMSSDDEDHSFYQSLEAFQVEENWDFSYLLDILICSGIIVADWQLICKSWYLPGCPVGPHVFDRLERKYNKIATWAKPERRLLFDLVNSILSEVLAPCVDVHPWVRPNRHCVALWGPEGPVEKVWQTIVRQREDCVTGQPDEMVLDTKWLEVGNDINMVGKQIAMMLHGDLLEEVIVDFL

SEQ ID NO: 789 - protein, 334 aa, Sorghum bicolor
MERKGGCCLAPRYGAAGPAAAQQQAGASWQMGRIMLKFRPIAPKPAAMAPVPAPTPVVAGPSVGAAGRGKRKAVCGAGGGRRGRKPKKAAAVVTAAPALAAAAAQDAGDCKKDCEKEKSSSSRSSSSSGMTSVDSSPPPPQHHLPTLLPLMPVTAVEDKGPAAGAATEELPAPVPSQVAAAATGSARPFAPRALRPGSAAWAASLVTVEEVTATWRDGEAPPSSAACVADDAPAFVSDQWGRVTWRNAAFVRAVPADDGGDEVETQTPVALSGALPAWGTCSGFTCRVRWHSSPRRVGSTSSVVAPCDVWRLDAGGSYLWRLDLQAALTLGGRL

SEQ ID NO: 790 - protein, 340 aa, Triticum aestivum
MHTQIMDMASPPSGASSEQDGIPVVDLAVLLNGDAGERSQAIRHLGRACQHWGFFMVTNHGVPEALQSAMMDACRELFGLPPEENAEFMDAGPMDPVRVGTGFNSAVDGARYWRDYVKMFAHPELHCPAKPDALRGVAAEYAARTRALLLDLTAAISESLGLHAGRVAERLDLGSCFQILVGNHYPPCAAGPGDDDDGAVGLPAHSDHGLLTLLCQNGVDGLQVKHDGRWLLAKPIPGAFFVIAGDQLEIVSNGRYKGVLHRALVDREQARMSCVSLIGPCLDAVVEPVPELAVPPLGLGLEFRGVKYRDYMEHQQSNKLNDKGALDLVRVQKRPAILYT

SEQ ID NO: 791 - protein, 1614 aa, Sorghum bicolor
MPKVFGTGVFEFRHPRAAEYPLPADAAPATAAAPDKVPASTGGGSITLLDIQRDRLTRVATEHWGTPAAASAFDADLVRKIYATELRVEGRGRKTVPLQRVMILEVSQYLENYLWPHFDPAHASFEHVMSIILMVNEKFRENVAAWTCFHDRKDAFKGFLWRVLKLKEEERALNMAEKTNYLLFMINSFQSLEDELVRETILQLVSLKLWNTLSFGRLQMELCLNPELIKKWTKIKRREAKEAKKADQPIDPSEMLENKFLRNLIEEFLEILDSKVILSNQDAGEESVLNESLSGQIDDSCVLYCERFMEFLIDMLSQLPTRRFLRPLVADVAVVAKCHLSALYTHEKGRLFAQLVDLLQFYEGFEINDHSGTQLGDDDVLQAHYSRFQAFQLLAFKQVPKLRDFALSSIGSLHKRADLAKKLLVLSDVELQDLVCNKLKLISAKDPCSGRRDFLIEVLVAFFEKRQSQKDAVNALPLYPNEQIMWDESLVPSINYSGEGCLALPKLNLQFLTLHDYLLRNFNLFRLESTYEIREDIQEAVPHLHAYINNEGETAFRGWSRMAVPIKEFKITEVKQPNIGEVKPSAVTADVTFSISSYRHQIKSEWDALKEHDVLFLLSIRPSFEPLSPEEAAKSTVPERLGLQYVRGCEVIEIRDEEGTLMNDFTGRIKREEWKPPKGEIRTVRVALDTAQYHIDVTETAEKGAENVYGTFNILMRRKPKENNFKAILESIRDLMNETCVVPEWLHNIFLGYGNPSAAQWMNMPDLLEVIDFKDTFLDASHVQQSFPDYQVTFINSDGTENLHPSPPFKIRLSKKMRESSHALPGNVNSNLTVKSNNIADGEPQKEKLIVESYIPADPGPYPQDKPKQNSVRFTPTQIGAIISGIQPGLTMVVGPPGTGKTDTAVQILNVLYHNCPSQRTLIITHSNQALNDLFEKIMQRDVPARYLLRLGQGEQELATDLDFSRQGRVNAMLVRRLELLGEVSKLARSLRLPEDVGYTCETAAYFWLLHVYARWEQFLAACAQNQDKPSFVKDRFPFSEFFSDTPQPIFTGESFEMDMHAAKGCFKHLSIIFQELEECRAFELLKSTVERANYLMTKQAKIVAMTCTHAALKRRDFLQLGFKFDNLLMEESAQILEIETFIPMLLQRQEDGHARLKRCILIGDHHQLPPVVKNMAFQKYSHMDQSLFTRFVRLGVPYIELNAQGRARPSIAELYNWRYRELGDLPYVREQAIFHKANAGFSFEYQLVDVPDYKGKGESAPSPWFYQNEGEAEYIVSVYIYMRLIGYPATKISILTTYNGQKLLIRDVINKRCKPWNIEPPNKVTTVDKFQGQQNDFILLSLVRTRFVGHLRDVRRLIVAMSRARLGLYVFCRRSLFEQCYELQPTFQLLLQRPDKLALNLEECTPFTERPLEETGNIHYITGTEDIDHLVKFRLEHLRQMQYMQYYAPPANELPQAVPENIADAIPSENGNAGSALNDANEHMAVEENGGATDTVIDNRMEEDGVEAKDDMTQEGNKGEGSGEGHMATEDTQGEVQASTNDKMEDADATSTDKMEEANAMPTDKMEEANATSTDKTEEANATSTDKTEEANATLTDKMEEENSDLKDKMDEE

SEQ ID NO: 792 - protein, 1613 aa, Sorghum bicolor
MAPARGVRSGGSAAAAALVSVLLVGCLVAGGEGAEIRRQKNVQTALRAKWAGTPLLLEASELLSKEWKDLFWDFIDHWKELEKGSECLTAKCCVQKIVEDARTLLNEPLSSIFEFSLTLRSASPRLVLYRQLAKESLSSFPIDDSPEQISGHGTGKTFDGAVDPNSSGGTCCWVDTGNVLLFNSADLHEWLGGLGKLAMDSTEQPELFDFDHIYPRTNITAPVAIFYGAVGTNCFKEMHVQLAEASKQGKVRYALRPVLPSGCGTTSTFCGSVGTVDAVTLSGYGVELALKNMEYKAMDDTAIKKSVPLEDPKTEDLSQEVRGFIFSKILERKPELNAEIMAFRDYLLSSTVSDTLEVWELKDLGHQTAQRIVQASDPLQSMQEINQNFPSIVSSLSRMKLDDSIKDEIIANQRMVPPGKSLMALNGALINIEDLDLYLLMDMVHGELSLADQFVRLKLPQSAAHKILSAPPPAESNSFRVDFRSSHVHCLNNLEEDDMYRRWRSNIQELLMPVFPGQMRYIRKNLFHSVYVLDPASACGAETIDMILSLYQDGVPIRFGIIMYSSRFINVIEESDGTPTNNGEDTSILITRLFLYIKETYSTQLAFQFLSNIHKSRNGEDDYNEELVEAHQVEGAFVESLLSNAKSHPQDVLLKLQKENVYKQEAEESSRFVHKLGLYKLQCCLLMNGFVHEASEEATMNAMNDELPRIQEQVYYGHIQSHTDVLEKFLSENSYKRYNPSITGNSAEKKFVSLFASYHQDSSVFNDMKYLQSPGTTDDAKPITHLLAIDLSSKVGTKLLSEAIRYLMDGSDRARVGLLLYVHTGGSSPILLLKDIFDRTIYSFSYKEKVLVFLHGLLKFYEAQPLPASSVADDWTRNMMEKVYTLAAETALPVDDYKAWFKSFSADTVLKGIDKLSDFLFGQLGLVFGSNAVITNGRVFIMNEGESFLANDLGLLESIEYDLRTKYIFEIIEEVEFAGVDPDDLTSQFYSDIAMLISSSMSVRERTSERARFEILHAEHSAIKLNNANSSIHIDAVIDPLSPIGQKLAPLLRILWKQIQPSMRIVLNPISSLADLPLKNFYRFVLPSMDDFSSTDHSVHGPKAFFANMPLSKTLTMNIDVPEPWLVEPVIAIHDLDNILLENLGDVRTLQAVFELEALLLTGHCIEKDRDPPRGLQFILGTKQRPHLVDTLVMANLGYWQMKVSPGVWYLQLAPGRSADLYELPPKLIAIDSLRGKLMHIEVQKKKGKEHEELLNAADDYHFQEKTDNKGWNNNLLKWASSLISGDASSKNKADKITDRKDARQGETINIFSVASGHLYERFLKIMILSVLKETQRPVKFWFIKNYLSPQFKDVIPHMAREYGFEYELITYKWPTWLHKQKEKQRIIWAYKILFLDVIFPLSLRKVIFVDADQIVRADMGELYDMNLKGRPLAYTPFCDNNKDMDGYRFWKQGFWKDHLRGRPYHISALYVVDLAKFRQTASGDTLRVFYEQLSKDPNSLSNLDQDLPNYAQHTVPIFSLPQEWLWCESWCGNATKARAKTIDLCNNPMTKEPKLQGARRIVPEWTGLDSEARQFTARILGDDVESAEATPPPSETPKPEDKDTDQEVKDEL

SEQ ID NO: 793 - DNA, 1568 bp, Arabidopsis lyrata
acaaagtctgcaacacctctcactggggattcaccatgttttctctcaaatcctcaatctcctcacctttcacacaatccaccactcatggattattcaccaacccgattacccgacccgttaatccattaccccgtaccgttactgcttccatgatacccaaaaaatcctctgctaacatgattcccagaaaccctccggcgcggcaacagctttaccaaccgttccggccaccgtcatctcctattccaaccaaattccgttcactcgactccgccggtaaaatcgaaatcctcgccggtcgaatggctctctggttcgaatacgcacctcttatctcttctctctacaccaatggtttcactcctcccaccatcgaagaactcaccggaatctcaagcatcgagcagaaccgtttaatcgtcggtgcacaagttcgtgactcaattcttcaatctatacatgaaccggagctcattgcggcgttcgacaccggtggtgcagagcttctctacgaaatccgtctccttagcaccacgcaacgcgttgcggctgccacattcatcattgatcgtaatattgattcgaaaggcgcacaagatttggcgcgagccatcaaggattatcctaaccggcgtggtgacgttggatggttggattttgattacaatttaccaggagattgtctttcgttcttgtattacaggcagagcagagagaacaagaatccatcggaacagagaacctccatgcttctacaagcattgggggttgtagaatcagaaaaggctaagaacaagttgaacaaagagctatacggggagaaggaagaagagaaggagaaggagaagaagaagaaggaagaggaagtcaaagctattcggattccggtggtgaggcttaagttcggagaagtagcaggagcgagctccgttgtggttttgccggtttgtaaagcagaggaaggggaaaagaagattcttgaagctccaatggagatcatagccggaggggatttcaaggtggttgaggcggagaaaggatggaagagatgggtagttcttccggggtggaacccagtggcggccattgggaaaggcggtgtggcggtttctttcagggatgatagaaaagtactgccttgcgacggaaaggaggagcctttactggtagtgaccgatagggtgaggaatttcgtggaggccgatgacgggtatttcctcgttgtggctgagaacggacttaagctagagaaaggatcagagttgaaggcgagagaggtgaaggagagtttagggatggttgttttggtggtgaggccgccaagagaagatgatgaagattggcagacaagtcatcaaaactgggactgatatagaatcaatacccatatcctgtaatagattactgagtcatgatcatgtaaaatttttggataaaggtggaaactttttgttctaagatacaatcagaaacagagcaagattttatctatatgctttctagttcctgtcttagtgaaaaaatcctaccaatcagactttttttggtaaatgttttattaaccg

SEQ ID NO: 794 - DNA, 1326 bp, Arabidopsis lyrata
acgccaccgattcccatcgccaaccctctcgtctctctctctctctaatcccttccttggccgcataaacgcaaccatcgtcgcccgagctttgatctttaccgactgaacaatatgtctgtttccgatgaggaagatgagtgtttcgctcgattcctcgaatcagaagtctcatcggtagaggataaagaagaaacgaaagaacctgaagcgaaacggcaacgtattgagaaagccgaaacaaaggctctagagaaggatgatgaagatcaaaaggaagatggtaacaaagatagaactggtgaaaagagaatagagagtggagttttcagtaatgttcctactgagctgtttcgtcatatcctcaagttcttatcttctgaggatcttgtatcatgctccttggtgtgtaaatttctcaattttgctgcggctgatgaatccttatggcgtcgcctctactgtatccggtggggtctaactcctccaactagaaagttacgtgaaagtgcttggaagaagctttatattgatcgtgacgagcaggacatgattgaacttgtcagaacctgtccttcggattttaaagagtattacatgcaaatgcaagcagcaaagagaagccaagcacctcttccgtcccagatggtggatgaccggataattcttgacaaaactgtacttgaacaagtatctctgtggaagaaaagcaaaggacttaccgataaggctgtcactggccatatttgtttgggaaccaaatgttcataccatcagattgacgacgtgttcatatgcaaagagacgggaaatgttcatgtatgcgatgataactgcaaggaagtaatactgagtccagaggaagacctcatggtgtgtactatctcaggactttgttctgatactttgctcgtacaaactgatccagacgcagatgggtgttatgaagaagaagctgaactagaagctgaagtattcatggataaaagtcgattggcacgagcttttgaacttggctacaactgcgatgatgagcaggaattggaacgtaccctgaggttctgctgagcaaaagtctcagccttttgtccaatttcataaggcctactttctgtaaggtcttatctctctctctctcacctgattctgcttgtgttctatggatggaattcaatgaatcaaatgtagctcttgtttttaatagtcagctttgtaacttatatacatattatcattgtctgtgatctatctactctattgtctttaaaaaagtgttacacctagtaattaagttccaactttatcagtaaaccctattgataacta

SEQ ID NO: 795 - DNA, 556 bp, Triticum aestivum
tgcagcacttgccactgcgagagcgagagtgagcaaggagtagaccaaacgtacgtacgacgacggccatgccgatgaggaaggaggtcctgctggtggccatgatgctggcgctggttgtggcggcgccgggcggggcgcgtgccgcgtgcgaggtggggcagctgacggtgtgcatgccggcgatcaccaccggcgccaagccgagcggcgcgtgctgcggcaacctgcgcgcgcagcaggcgtgcttctgccagtacgccaaggacccctccctcgctcgctacatcaccagcccccacgcccgcgagaccctcgtctcgtgcggcctcgccgtcccgcactgctaggctaggcgccagctcgcctagcgcgtatggctcagctataggtaggctacctccgtcgtccatgagagatgagagagactataatagcttagcctagctgagacctgagagagggcatgctgcgtccatgcacgcacgcatgtttctgtccgatccatgatgctgcaataaaatgttgggtgatgatcggtgcttgaataaaatga

SEQ ID NO: 796 - DNA, 555 bp, Triticum aestivum
acacctgccactgcgagagtgagcgaggagcagaccaacgtacgacgacggccatggcgatgaggaaggaggtcctgctggtggccatgatgctggcgctggttgtggcggcgccgggcggggcgcgtgccgcgtgcgaggtggggcagctgacggtgtgcatgccggcgatcaccaccggcgccaagccgagcggcgcgtgctgcggcaacctgcgcgcgcagcaggcgtgcttctgccagtacgccaaggacccctccctcgctcgctacatcaccagcccccacgcccgcgagaccctcgtctcgtgcggcctcgccgtcccgcactgctaggctaggcgccagctcgcctagcgcgtatggctcagctataggtaggctacctccgtcgtccatgagagatgagagagactataatagcttagcctagctgagacctgagagagggcatgctgcgtccatgcacgcacgcatgtttctgtccgatccatgatgctgcaataaaatgttgggtgatgatcggtgcttgaataaaatgagttttcctacctta

SEQ ID NO: 797 - DNA, 478 bp, Triticum aestivum
  misc_feature (463)..(463): n is a, c, g, or t
cactcaacacctgccactgcgagagtgagcgaggagcagaccaacgtacgacgacggccatggcgatgaggaaggaggtcctgctggtggccatgatgctggcgctggttgtggcggcgccaggcggggcgctcgcggcgtgcgaggtggggcagctgacggtgtgcatgcccgcgatcaccaccggcgcgaagccgagcgacgcgtgctgtggcaacctgcgcgcgcagcaggcgtgcttctgccagtacgccaaggacccctccctcgctcgctacatcaccagcccccacgcccgcgagaccctcgtctcgtgcggcctcgccgtcccgcactgctaggctaggcgccagctcgcctagcgcgtatggctcagctataggtaggctacctccctccatgagagatgatgagagactatagcttagcctagctgagacctgagagagtgcatgctgcgtcnatgcactcacgcatg

SEQ ID NO: 798 - DNA, 590 bp, Triticum aestivum
cacactcaacacctgccactgcgagagcgaggagtagaccagcgacgacggccatggcgatgaggaaggaggtcctcctggcggccatgatgctggcgctggtggtggcggcgccgggcggggcgcgtgccgcgtgcgaggtggggcagctgacggtgtgcatgccggcgatcaccaccggcgccaagccgagcggcgcgtgctgcgccaacctgcgcgcgcagcaggcgtgcttctgccagtacgccaaggacccctccctcggcgcctacatcaggagcccccacgcgagcgagaccctcgtctcctgcggcctcgccgtcccgcactgctagaccgagtatggctcagctataggtaggctacctccgtcgtccatgagagatgatgagagaatacatatagcttagcctagctgagacctgagagagtgcatgcgtccatgcacgcacgcatgttccctgttatgtgtggctccgtcgatgagatgctggaataaaatgttgggtgatgaataaaaaatgatctacggcggccaggctgcttgctattcctggctgctgctgctgctgctggtaaaaaaaaaaaaa

SEQ ID NO: 799 - DNA, 812 bp, Triticum aestivum
cttcgctcgagtccaacccccagctgccaccccgcccagttgctgttgcgcagcctccttcctctagtctcccctcctctcccccttttgccatctccaacctaatccttctcttctcgcctgtctgcctgacggattccaaagggctcgctcattcgggggaaaagctgttcgcagtgactcccaatctcatccatttcttgtctgttccaggcaatccagggtctggtcctgaactgtcggggctccatgtctaagtgggaacctgtcacatttgaggaatctcttagctttgttaagagggttaaggctcgtgactacttgttatacctgtcgctgctcaatgtgctcacccggagtgatcagatccctctggaagcttacaacgagcttttacttcttttccgggatcacggagatctgctagaggagctagggaagttcagacccctcccctctttcccaagcactgtgtacagccacaacacaatctggatgttcatattcctgatgccctttctgctcctgagccttctcctcgcgtttgagaagccgttggatagcttccttctccgataacctgttgcgagctaaagatcagcactacgatgaaaatgaccagacacggaatgcgtgcacggactgctgtcttgtgatatcccctcagagcccattgccttatcggtgcttttgtgatcatgttcatccttttgtgatccgcccgcataccggtgcgcggatagtatctctgaatctctcggaaggacaggctaaatcgatttttttggcttgttcaagacaaacttcagtgt

SEQ ID NO: 800 - DNA, 800 bp, Triticum aestivum
  misc_feature (524)..(524): n is a, c, g, or t
  misc_feature (755)..(755): n is a, c, g, or t
  misc_feature (757)..(757): n is a, c, g, or t
cttcctctatctcccctcctctcccccttttgccatctccaacctaatccttctcttctcgcctgtctgcctgacggattccaaagggctcgctcattcgggggaaaagctgttcgcagtgactcccaatctcatccatttcttgtctgttccaggcaatccagggtctggtcctgagctgtcggggctccatgtctaagtgggaacctgtcacatttgaggaatctcttagctttgttaagagggttaaggctcgtgactacttgttatacctgtcgctgctcaatgtgctcacccggagtgatcagatccctctggaagcttacaacgagcttttacttcttttccgggatcacggagatctgctagaggagctagggaagttcagacccctcccctctttcccaagcactgtgtacagctacaacacaatctggatgttcatattcctgatgccctttctgctcctgagccttctcctcgcgtttgagaagccgttggatagcttccttctccgataaccngttgcgagctaaagatcagcactacgatgaaagtgaccggacacggaatgcgtgcatgggctgctgtcttgtgatatcccctcagagcccattgccttattggtgcttttgtgatcatgttcatccttttgtgatccgcccgcataccggtgcgcggatagtatctctgaatctctcggaaggacaggctaaatcgatttttttggcttgttcaagacaaacttcagtgtncnattgacaaactaaatgaaagagtttagttttacaaaaaaaaaa

SEQ ID NO: 801 - DNA, 767 bp, Avena sativa
ggtccacctccctcgccagcgcccagttgcccggcctccttcctcttccctgttgccatctcgtccaacctaatctcttcttttcttcccggtcggtctgacgaacccgtaaaaggcgtgcttatttgggggaaagctgtttgttgcggccgcccattcgcccaattcatccatttcttgtttgttccaggaattttggaaatcatgtgtctttaaaaggaatccagggtctggttttgagctatccaagctccatgtctaagtgggaatctgtcacatttgaggagtctcttagatttgttaagagagttaaggctcgtgactacatgttatacttgtcactgctcaatgtgctcacccggaatgatcagatccctctggaagcttacgacgagctttcgactcttttccggcatcacgaagacctgctagaggagctagggaagttcagacccctccctgctccaagcattactgtgtacagccagagctcaatctggatgctcatattcctgatgccctttctgttcctgagccttctcctcgcgtttgagaagccattggatagcttccttcttcgaccaccgttcgcggcctgaagatctgtattgcggtgaaaacgacaccaaatgtgtaatatgagaattgactgctgtcttgtgatatcgctgctgaagccagtgatatgtttatctggaagaagctgataagacaaaattcggtgtacaatgatcaaactatacaggaaatataattttaagtccact

SEQ ID NO: 802 - DNA, 1682 bp, Triticum aestivum
ccaaccgcgcaccatgcgtcgtctcagccacttccccctcctcgccgccgtcctcctcgcggtggtcccgcacccggcccacccgctcaccgagctcgagacctcccaaatccggcgcttccaggactacctccgcatctgcaccgcccaccccgccccggactacgccggcgccgccgcgttcctcctcccctacgccgcgtcactcggcctcagcaccaagacgctccacttcagcccctgcaagtcaaagccgctcctcctcctcacctggccgggcacggacccgtcgctcccctccatcctcctcaactcccacctcgactccgtgcccgcggagcccgagcactggatccacccgccctacgccgcgcaccacgaccccgccacgggccgcgtctacgcccgcggcgcgcaggacgacaagtgcctccccatccagtacctcgaggccatccgcggcctccaggccgccggcttcgcgcccgcacgcaccgtccacgtctcgctcgtccccgacgaggagatcggcggcgaggacggccacgagaagttcgtccagtcggaggagttccgcgccctcaatgtcgggttcatgctcgacgaggggcaggcctcgctcacggatgtttacagggttttctacgcggataggctggtgtggaagctgatcgtgaaggccacgggggctcccgggcatgggtcgaagctgttcgatggggccgccgtggagaatctgatggattgcattgagaccgtggctggatacagggatgcacagttcgagaaggtgaagtcgggcaagtacggtcccggagaggtggtgtccgtgaatcctgtctacatgaatgccggcacgccaagccccactggctttgtgatgaatatgcaaccttcagaagcagaggtgggttttgatctccgccttcctccaaccgaagatattgaacagatcgaaagaagaatcaaagaagaatgggcaccagctcataaaaacttgacttaccagctgatgaagaaaggaccagtgagggatgtgacaggacgccccttacttacaccagccaatgagtcaaacccatggtggtctgtgtttgaacaggctattatctcttcaggtggaaaactagcaaagcctgagatcttatcttcaaccacggacgcccgattcgtgaggcagatgggtgttccagcccttggattttctccaatgataaatactccaattttacttcacgatcataatgagtttctggaggataaagtgttcctgaggggcatcgaagtgtaccaacatcttattagagcgctgagctccttcaaaggctgattcaaaataagcacataaattgtaccattattgtatttccatcccatgtaaattaattgtagcgaagataactcagatggccgtgatgccacaactgtcatgctccaaagccacagctaaactggttcgggctcaccagagtcagaataaacttttctgaaatattggaaatctgctgacagtgatctcagcaggttgattagtatgtaatgtacatacgaagttacaggccgcatataacaagatgatttgtaaaagtccacgggtgaactgatatatctcgattgtagtctactggtctcgtgtctgccgaggaaaagcagataaccagcaatgtaaattgttctgctgc

SEQ ID NO: 803 - DNA, 1681 bp, Triticum aestivum
  misc_feature (11)..(12): n is a, c, g, or t
  misc_feature (15)..(15): n is a, c, g, or t
  misc_feature (17)..(17): n is a, c, g, or t
  misc_feature (19)..(20): n is a, c, g, or t
  misc_feature (22)..(23): n is a, c, g, or t
  misc_feature (30)..(30): n is a, c, g, or t
  misc_feature (71)..(72): n is a, c, g, or t
  misc_feature (74)..(75): n is a, c, g, or t
  misc_feature (86)..(86): n is a, c, g, or t
  misc_feature (91)..(91): n is a, c, g, or t
  misc_feature (95)..(95): n is a, c, g, or t
  misc_feature (99)..(99): n is a, c, g, or t
  misc_feature (113)..(113): n is a, c, g, or t
  misc_feature (300)..(300): n is a, c, g, or t
cgcagcgtcannccncncnncnnccaaccncgcaccatgcgtcgtctcagccacttccccctcctcgccgnngnnctcctcgcggnggtcncgcncccngcccaccccctcancgagctcgagacctcccaaatccggcgcttccaggactacctccgcatctgcaccgcccaccccgccccggactacgccggcgccgccgcgttcctcctcccctacgccgcgtcactcggcctccgcaccgccacgctccacttcagcccctgcaagtcaaagcccctcctcctgctcacctggccnggcacggacccctcgctcccctccatcctcctcaactcccacctcgactccgtgcccgcggagcccgagcactggatccacccgccctacgccgcgcaccacgaccccgccaccggccgcgtctacgcccgcggcgcgcaggacgacaagtgcctccccgtccagtacctcgaggccatccgcggcctccaggccgccggcttcgcgcccgcccgcaccgtccacgtctcgctcgtccccgacgaggagatcggcggcgaggacggccacgagaagttcgtccagtcggaggagttccgcgccctcaatgtcgggttcatgctcgacgaggggcaggcctcgctcacggatgtttacagggttttctacgcggataggctggtgtggaagctgatcgtcaaggccacgggggctcccgggcatgggtcgaagctgtttgatggggccgccgtggagaatctgatggattgcattgagaccgtggctggatacagggatgcacagttcgagaaggtgaagtcgggcaagtacggtcccggagaggtggtgtccgtgaatcctgtctacatgaatgccggcacgccaagccccactggctttgtgatgaatatgcaaccttcagaagcagaggtgggttttgatctccgccttcctccaaccgaagatattgaacagatcgaaagaagaatcaaagaagaatgggcaccagctcataagaacttgacttaccagctgatgaagaaaggaccagtgagggatgttacaggacgtcccttacttacaccagccaatgagtcaaacccatggtggtctgtatttgaacaggctattatctcgtcaggtggaaaactagcaaagcctgagatcttatcttcaaccacggacgcccgattcgtgaggcagatgggtgttccagcccttggattttctccaatgataaatactccaattttacttcacgatcataatgagtttctggaggacaaagtgttcctgaggggcatcgaagtgtatgaacatcttattagggcgctaagctctttcaaaggctgattcaaaatagacacataaattctaccattgttgtactcccgtcacatgtaaattgaatgtagcaagagaactcggacgcccacaactatcatgctccaacctacagttagattggttcgggctcaaccacataatctgcggataatggaaatctgcggatgatgatctctgaaataatggaaatctgcagatgatgatctcggcgcaggttaaatttgtatgtaatgtaaatacagagttacgaactgtaacaaagtcgatgtgtaaggtatttctccatttatggtctgctggtagcctggtatcatgtctgccgagggaaagcaga

SEQ ID NO: 804 - DNA, 1358 bp, Triticum aestivum
cgcaccgccacgctccacttcagcccctgcaagtcaaagcccctcctcctgctcacctgtgccgggcacggacccctcgctccccttcattcttcttcaattcccacctcgactccgtgcccgcggagcccgagcactggatccacccgccctacgccgcgcaccgcgaccccgccaccggccgcgtctacgcccgtggcgcgcaggacgacaagtgcctccccgtccagtacctcgaggccatccgcggcctccaggccgccggcttcgcgcccgcccgcaccgtccacgtctcgctcgtccccgacgaggagatcggcggcgaggacggccacgagaagttcgtccagtcggaggagttccgcgccctcaatgtcggtttcatgctcgacgaggggcaggcgtcgctcacggatgtgtacagggtgttctacgcggataggctggtctggaagctgatcgtgaaggccacgggggctcccggacatgggtcgaagctgttcgatggggccgccgtggagaatctgatggattgcatcgagaccgtggctggatacagggaggcacagtttgagaaggtgaagtccggcaagtacggtcccggagaggtggtgtccgtgaatcctgtgtacatgaatgccggcacgccgagccccacgggctttgtgatgaatatgcaaccttcagaagcagaggtgggttttgatctccgccttcctccaaccgaagatattgaacagatcgaaagaagaatcaaggaagaatgggcaccagctcataaaaacttgacttaccagctgttgaagaaaggaccagtgagcgatgtgacaggacgccccttacttacaccagccaatgagtccaacccatggtgggctgtgtttgagcaggctattatctcttcaggtggaaaactagcaaagcccgagatcttatcttcaaccacggacgcccgattcgtgaggcagatgggtgttccagcccttggattttctccaatgataaatactccaattttacttcacgatcataatgagtttctggaggataaagtgttcctgaggggcatcgaagtgtaccaacatcttattagagcgctgagctccttcaaaggctgattgaaaataagcacataaactgtaccattattgtattcccatcccatgtaaattaattgcagcgaaggtaactcagaagcccgtgacgccacgactatggtgctctaggctacagctaaattggttcgggctcaaccattcagaataaacttttctgaaataaacgaatctgctgacggtgatctcagcgggttgatttgtatgtaatgtacaaacgaagttacaggacgtatataacaa

SEQ ID NO: 805 - DNA, 1141 bp, Triticum aestivum
  misc_feature (1130)..(1130): n is a, c, g, or t
tacctcgaggccatccgcggcctccaggccgccggcttcgcgcccgcccgcaccgtccacgtctcgctcgtccccgacgaggagatcggcggcgaggacggccacgagaagttcgtccagtcggaggagttccgcgccctcaatgtcggtttcatgctcgacgaggggcaggcgtcgctcacggatgtgtacagggttttctacgcggataggctggtctggaagctgatcgtgaaggctacgggggctcccgggcatgggtcgaagttgttcgatggggccgccgtggagaatctgatggattgcattgagaccgtggctggatacagggaggcacagtttgagaaggtgaagtccggcaagtacggtcccggagaggtggtgtccgtgaatcctgtgtacatgaatgccggcacgccgagccccacgggctttgtgatgaatatgcaaccttcagaagcagaggtgggttttgatctccgccttcctccaaccgaagatattgaacagatcgaaagaagaatcaaggaagaatgggcaccagctcataaaaacttgacttaccagctgttgaagaaaggaccagtgagcgatgtgacaggacgccccttacttacaccagccaatgagtccaacccatggtgggctgtgtttgagcaggctattatctcttcaggtggaaaactagcaaagcccgagatcttatcttcaaccacggacgcccgattcgtgaggcagatgggtgttccagcccttggattttctccaatgataaatactccaattttacttcacgatcataatgagtttctggaggataaagtgttcctgaggggcatcgaagtgtaccaacatcttattagagcgctgagctccttcaaaggctgattgaaaataagcacataaactgtaccattattgtattcccatcccatgtaaattaattgcagcgaaggtaactcagaagcccgtgacgccacgactatggtgctctaggctacagctaaattggttcgggctcaaccattcagaataaacttttctgaaataaacgaatctgctgacggtgatctcagcgggttgatttgtatgtaatgtacaaacgaagttacaggacgtatataacaaanatgatttgtaa

SEQ ID NO: 806 - DNA, 1627 bp, Avena sativa
gccagtgaccacagcgactttcagcatgcgtcgtctccaccacttcctcctcgtcgccgttctgctcgccgcggtgccgcgcccagcccaccccctcaccgagctcgagtcctcccaaatccggcgcttccaggactacctccgcatctgcaccgcgcaccccaccccggactacgccggcgccgccgccttcctcctcccctacgccgcgtctctgggcctcggcaccgccacgctccacttcagcgcctgcaagtcaaagcccctcctcctcctcacctggccaggcaccgacccctccctcccttccatcctcctcaactcccacatcgactccgtccccgcggagcccgagtactggatccaccctccctacgccgcccaccatgaccccgccaccggccgcgtctacgcccgcggcgcgcaggacgacaagtgcctccccatccagtacctcgaggccatccgcggcctccaggccgccggcttcgcccccacccgcaccgtccacatctcgctcgtccccgacgaggagatcggcgccgaggacggccacgagaagttcgtgcagtcggaggagttccgcgccctcaatgtaggcttcatgctcgacgaggggcaggcgtcgctgacggacgagtatagggttttctacgcggacaggctggtgtggaagctgatcgtgaaggctaccggggctccagggcatgggtccaagatgttcgacggtgctgctgtggagaatttgatggatatcatcgagactgtggctgggttcagggaggcccagttcgccaaggtgaaggctgggaagagcggtcccggagaagtggtgtctgtgaatcctgtctacatgaatgctggcacgcccagccccacgggctttgtgatgaatatgcaaccttcagaagcagaggtgggttttgatctccgccttcctccaaccgaagatattgagcagatcataagaagaatcaaagaagaatgggcaccagctcataaaaacttgacttaccagctgatgatgaaaggaccagtgagggatgtggcaggacgtccgttagttacactaacgaatgagtcaaacccgtggtggtctgtgtttgaacatgctattgtctcttcaggtggaaaactagccaagcccgagatcttatcttcaaccacggacgcccgattcgtgaggcagatgggtgttccagcccttgggttttccccaatgataaatactccaatattacttcacgatcataatgagtatctggaggataaagtgttcttgaggggcatcgaagtctatcagcatcttattaaagcgctaagctccttcaaaggctgattcaaaatacccacatgaagtgcacctctgttgtattcccataccgtgtcaattgaatgtactgtagttaagagaacctagatacacataactagtatcatgctccagcctacagctgaatcggttcgggctcaatcacatcagaataaacttgtttgaaataagggaaatctgctaaagaccgatgattatctcagcagattaatttgtatataatgtacagtacatacggagttatgggatgtaacaacatgatgtaaagtccacagttgaattgatacggagtta

SEQ ID NO: 807 - DNA, 1033 bp, Triticum aestivum
  misc_feature (210)..(210): n is a, c, g, or t
gtacagggttttctacgcggataggctggtgtggaagctgatcgtgaaggctacgggggctcccgggcatgggtcgaagttgttcgatggggccgccgtggagaatctgatggattgcattgagaccgtggctggatacagggatgcacagttcgagaaggtgaagtccggcaagtacggtcccggagaggtcgtgtccgtgaatcctgngtgtacatgaatgccggcacgccgagccccacgggctttgtgatgaatatgcaaccttcagaagcagaggtgggttttgatctccgccttcctccaaccgaagatatcgaacagatcgaaagaagaataagagaagaatgggcaccagctcataaaaacttgacttaccagctgatgaagaaaggaccagtgagcgatgtgacagggcgccccttacttacaccagccaacgagtcaaacccatggtggtctgtgtttgaacaggctattatctcttcaggtggaaagctagcaaagcccgagatcttatcttcaaccacggacgcccggttcgtgaggcagatgggtgttccagcccttggattttctccaatgataaatactccaattttgcttcacgatcataatgagtttctggaggataaagtgttcctgaggggcatcgaagtgtaccaacatcttattagagcgctgagctccttcaaaggctgattcgaaacaagcacataaattgtaccattattgtatttccatcccatgtaaattaattgtagcgaagataactcagatggccgtgatgccacaactgtcatgctccaaagccacagctaaactggttcgggctcaccagagtcagaataaacttttctgaaatattggaaatctgctgacagtgatctcagcaggttgattagtatgtaatgtacatacgaagttacaggccgcatataacaagatgatttgtaaaagtccacgggtgaactgatatatctcgattgtagtctactggtctcgtgtctgccgaggaaaagcagataaccag

SEQ ID NO: 808 - DNA, 619 bp, Festuca arundinacea
ggcacgaggcatgggtccaagatgttcgacggtgctgctgtggagaatttgatggatatcatcgagactgtggctgggttcagggaggcgcagttcgggaaggtgaaggctgggaagagcggccccggagaggtggtgtccgtgaatcctgtgtacatgaatgccggcacaccgagccccacgggctttgtgatgaatatgcaaccttctgaagcagaggtgggttttgatctccgccttcctccaaccgaagatattgaacagatcataagaagaataaaagaagaatgggcaccagctcataaaaacttgacttaccagctgatgatgaaaggaccagtgagggatgtggcgggacgtcccttagttacgttaaccaatgagtcaaacccatggtggtctgtgtttgagcatgctatcatctcttcaggtggaaaactagctaagcctgagatcttatcttccaccacggacgcccgattcgtgaggcagatgggcgttccagccctgggattttctccaatgataaatactccaatattacttcacgatcataacgagtttctggaggataaagtgttcctgaggggcatcgacgtttaccaacatcttattaaag

SEQ ID NO: 809 - DNA, 1909 bp, Oryza sativa
acacttttttcttaaaaaaagaaaaaaagaggaaaaatgaagctgaagccacactccaacctcacgatgcctcatctccggcggcgccaccgccgccgcctcctcgctgccgtcgtcttcctcctcctctctgccgtcgtcgcgcgaccagcagcaggcgccttcaccgagctcgagtccgcccagatcggccgcttccaggactacctccgcatccgcaccgcccacccgtccccggactacgccggcgccgccgccttcctcctcccctacgccgcctcgctcggcctccgcgccgccacgctccacttcaccccgtgcaagtccaagccgctcctcctcctcacgtggccgggcaccgacccctccctcccctccctcctcctcaactcccacctcgactccgtcccggcggagcccgagcagtggctccacccgcccttcgccgcccaccgcgacgccgccacgggccgcgtctacgcccgcggcgcgcaggacgacaagtgcctccccatccagtacctcgaggccatccgcggcctccgcgacgccgggttcgcccccacccgcaccctccacatctcgctcgtccccgacgaggagatcggcggcgccgacgggttcgagaagttcgcccagtcggaggagttccgggacctcaatgtcgggttcatgctcgacgaagggcaggcgtcgctgacggatgaatttagggttttctatggggacaggttggtgtggaggctgatcgtgaaggctaccggcgcacccggccatggctcgaagttgttcgacggcgccgcggtggagaatttgatggattgcgtggagaccattgccgggttcagggaggcgcaattcgggatggtgaaatccgggaagagaggtcccggggaggtggtgtctgtgaatcctgtgtacatgaaggctggcacgccgagccccacgggttttgtaatgaatatgcaaccctcagaagcagaagttggttttgattttcgacttcctccaactgaagacgtggaacatatcataagaagaatcaaagaggaatgggcaccagctcataaaaacttaacctacaagctgatgcagaaaggaccaacacgggatttggcaggacgccccatggtcacaccaaccaatgcatcaaatccttggtggtctgtatttgaacaggctatcatatctgcaggtggaaagctagctaagcctgagattttatcttcaaccacggattcacgcttcatcaggcagttgggcattccggcccttgggttttctccgatgacaaacactcctatattacttcatgacaataatgagtttctggaggataaagtattcctaaggggcatcaaagtgtatgaacatattattagagcactgagctccttcaaaggttgattcataataggaaactgctattgcataaagtgtaccattgatgtactttcacctcatgttggaagactggagttgcaggaaagaagccaccctcaaagatacagttttctcagaaatggttcaggcccaaccataccataataaacatgttgggaattgggaataatgcatatctgctgaacattgtatttttaatgattgtgtaagcagatcaatctgtacacatatacgaatttatgaactgcgacagtgtggtgttcaagtccacggctggattggtctacctgtagttctgctggttttatctgttttctttgggaaaccacatccgcgttttctcttggcattttttttcccttttgccaattgaactgtcatgtatcactacgaaccagtgatgaatatacaatgaataaaccagtacaatttaggaggtgtaaacacacgatgtaattataatatttggtgaacatgtctgatgttgaaactactgtgaactgtc

SEQ ID NO: 810 - DNA, 1836 bp, Sorghum bicolor
cgaacaaacagtgtgaacggggacacttcgctggaagctcagctcgcagtcgcagcgcatccaccacacccacacgatgccgccgcctctccgctgtctcctgctcgccttcgtcgtcctcctctccggcttcccccgtctcgcccaccccttcacggctctcgagtccgaccagatcgcccgcttccaggactacctccgcatccgaacggcgcacccgtcccccgactacgccggcgccgctgccttcctcctaccctacgccgcctcgctcggtctcgacaccaccacgctccacttcaccccgtgcaagaccaagccgctgctcctcctcacctggcggggctccgacccgtccctcccctccgtgctcctcaactcccacatcgactcggtccccgcggagcccgagcactgggcgcacccgccgttcgccgcgcaccgcgacgcggccacgggccgcgtctacgcgcgcggcgcgcaggacgacaagtgcctccccgtccagtacctcgaggcgatccggggcctccaggcggccgggttcgcgcccgcccgcaccgtccacatctcgctggtccccgacgaggagatcggcggcgcggatgggttcgacaagttcgcccagtcggaggagttccgcgccctcaacatcgggttcatgctcgacgaggggcaggcgtcgccgacggatgtgttcagggtcttttatgcggataggctggtgtggaggctcatcgtgaaggcggcgggggtgccggggcatgggtcgaggatgttcgacggcgccgccgtggacaatttgatggattgcgtggagaccatcgctgggttcagggatgcgcagttcaggatggtgaagtccggggagaggggtcccggcgaggtggtctcggtgaatcctgtgtacatgaaggccggcataccaagccccacgggttttgtgatgaatatgcaaccttcagaagcagaggttggctttgatctccgcctccctccaactgaagatattgaacagatcaaacgaagagtcaaagaggaatgggcaccagctcataaaaacttgacctaccagctaatgcagaaaggtccagtaacagatgtggctgggcgtcccatattcaccgcaacaaatgagtcgaacccatggtggtccatattcgagaaggccatcacctccgcgggaggaaagctatctaagcccgagatcttatcttcaaccacagattcacgctttgtgaggcagctgggcattcctgccctcgggttttctccgatgacaaatactccaatactactacatgaccataacgagtttctggaagataaggtgttcctgaggggcatcaaagtgtacgaacatgttattagagcactaagctcgttccaaggctgattcgtgaaaggaaagtgatgtttgcatgatttgtagcattgctggattcccgtctcatttactgaatgaaggtaagagcatcgaagctatggcctacaggtttctaataattggttcagtctcaaacatggcaaaggaaacattccgaaaccatcaggatatgtcaaatatagggatatgaatgataagcaaagaactgtaaatatgatttaggggttgtgaactgttgtaccacaatagcccaaaaaccactgtctctgttgatatattttctgatctggaggctgtatcggttttccccgtgtgctggagcaaaccgggtgttggaataatttctccccacgtggaacacttttttcctgtcaaaaaaatgcaagagaactgtgtctgctttttgttgctctctttccaatgccaaggcaccagcgcgaactgcgaag

SEQ ID NO: 811 - DNA, 1267 bp, Setaria italica
gggggcgcccgggcacgggtcgaggatgttcgacggcgccgccgtgggcaatttgatggattgcgtcgagaccgtggctgggttcagggaggcgcagttcgggaaggtgaaagccggagagaagggtccaggggaggtggtttcagtgaaccctgtgtacatgaaggccggcataccaagccccacgggtttcgtgatgaatatacaaccttcagaagcagaggttggctttgatcttcgcctccctccaactgaagacattgaacagataaaacgaagagtcaaagaggaatgggcaccagctcataaaaacttgacctatgagctgatgcagaaaggaccagtaatggatgtggcaggacgtcccatatttactgcaactaatgagtcgaacccatggtggtccgtatttgagcaggctatcacctctgcaggtggaaagctatccaagcctgagatcttatcttcaaccacagattcacgctttgtgaggcagctgggcattcccgcccttgggttttctccaatgacaaatactccgatactacttcatgacaataatgagtttctggaggataaagtattcctgaggggcatcaaagtgtatgaacatgtaattagagcattgagctcctttcaaggctgattcgggaactgaagctgctgttgcatatagtatagcattgttgaggccccatcccattcactgaagacaggagtcaaagttctgacctccaggtttctcatgattggttcagtgtcaaacataccaaaggaaacattctgaagcaatcaaagtctgcctaagatactgatttgaatgataacctgagcaaattaattcatgcatacatatggtatggagttgtgaactgcatgtaacacaaaaacatagaagccatgtctggattgatatttttcctattttgaaaccgtgtgccggagggaaccggtgctgtggaataatttctctccacttggacatttgaataagtaaagagagacaaggcctgcatagcaactgtagatggggagccctcagccctgaaattctgatcttagttggatgggttgagagggtatatgaaataaagaggcagatattgctaaaactgtatcgcatgtccaacatatattgcaaaaaaggagatggctgtcactgtcagaattatatctctgtttcatctgctttgatctgtgtggtcgatcttcccatgtcggcagcttactgttgaatgttgatgaatactagcaaccaattgttgtg

SEQ ID NO: 812 - DNA, 1964 bp, Pennisetum glaucum
gtgcacgcagcacagccacagccatcgcacgatggcggcgcctctccgccaccgccgcttcctgctcgccgtcgtcctcctctccggtctcctccgccccgcccaccccttcaccgagctcgagtccgaccagatcgcccgcttccaggagtacctccgcatccgcaccgcgcacccgtcgcccgactacgccggcgccgccgccttcctcctcccctacgccgcgtccctcggcctccgcaccgccacgctccacttcaccccgtgcaagaccaagcccctgctcctcctcacctggccgggcaccgacccgtccctcccctcggtcctcctcaactcccacatggactccgtccccgcggagcccgagcggtggtcgcacccgccattcgccgcgcaccgcgaccccgccacggggcgcatctacgcgcgcggcgcgcaggacgacaagtgcctccccgtccagtacctcgaggccatccggggcctccgcgccgccgggttcgcgcctgcccgcaccgtccacatctcgatcgttcccgacgaggagaccggcggcgtcgacggcttcgagaagttcgcgcggtcggaggagttccgcgccctcaacatcgggttcatgctcgacgaggggcaggcgtcgccgacggatgtgttcagggtcttctacgcggataggttggtgtggaggctcatcgtgaaggcggcggggccgcccgggcacgggtcgaggatgttcgacggcgccgccgtggacaatttgatggattgcgtcgagaccgtggctgggttcagggaggcgcagttcgggaaggtgaagacaggtgagaggggtcccggggaagtggtttcggtgaaccctgtgtacatgaaggccggcataccaagccccacgggttttgtgatgaatatgcaaccttcagaagcagaggttggctttgatcttcgccttcctccaaccgaagacattgaacagataaaacgaagagtcaaagaggaatgggcaccagctcataaaaacttgacgtacgagttgatgcagaaaggaccagtaacggatgtggcaggacgttccatatttacagcaaccaatgattcgaacccatggtggtctgtatttgagaaggctatcacgtctgcaggtggaaagctatccaagcctgagatcttatcttcaactacagattcccgctttgtgaggcagctgggcattcccgcccttgggttttctccgatgacaaatactccgatactacttcatgacaataatgagtttctggaggataaagtattcctgaggggcatcaaagtgtacgaacatgttattagagcattgagctcctttcaaggctgatttgggaaacgaagctgctgttgcatgtatatagcattgctgaggccccatcccattcactgaagacaggaatcgaagttctgaccccaggtttctcattatcagttcagtctcaaacataccaaaaggaaacattccgaagcaatcaaaatctgcctaagataccaattataatgacaacctgagcaatttaatccatgcatacatatggtatggggttgtgaactacttgtaacacgaaaatagtcatgtttggattgttattcgtatttggaaactcatgtgctggagggaaccggtgttgtggaataatttctctccacttggacatttgaataagtaacgagagacaaggttggatgggttgggagggcgtatgaaattctgtagatggagccctcagccctgaaattctgatcttagttggatgggttgggagggtgtatgaaataaagaggcgggtattgcccaaaactgtatcgcatggccaacatatattgcaacaaaggagatggctgtcactgtcctatttgcaacatgtatctcggtttcatctgctttgatctgtgtggttgatccgccagtgtcggcagcttactgttgtatgtgg

SEQ ID NO: 813 - DNA, 1059 bp, Saccharum officinarum
cacgaggataggctggtgtggaggctcatcgtgaaggcggcgggggcgccggggcatgggtcgaggatgttcgacggcgccgccgtggacaatttgatggattccgtggagaccatcgctgggttcagggatgcgcagttcaggatggtgaagtccggggagaggggtcctggggaggtggtctcggtgaatcctgtgtacatgaaggccggcataccaagccccacgggttttgtgatgaatatgcaaccttcagaagcagaggttgggtttgatctccgccttcctccaactgaagatattgaacaaatcaaacgaagagtcaaagaggaatgggcaccagctcataaaaacttgacttaccagctaacgcagaaaggtccagtaacagatgtggctgggcgtcccatatttacagcaacagatgagtcaaacccatggtggcccatatttgagaaggctatcacctcagcgggtggaaagctatctaagcccgagatcttatcttcaaccacagattcacgctttgtgaggcagctgggcattcctgcccttgggttttctccgatgacaaatactccaatactactacacgaccataatgagtttctggaagataaggtattcctgaggggcatcaaagtgtacgaacatgtcattagagcactaagctcgttccaaggctgattcgtaaaaggaaactgctgttgcaagatgtgtagcattgttggattcccacctcagttactggatgaaggtaagagcatcgaatacaggtttctaataattggttcagtcacaaacatgaggaaacattccgaagccatcagaatctgtcgaatatggtgatatgaatgataggcaaacaactgtatgtatactgtatggcgtaggggttgtgaaccgtaggggttgacgggttgtggtgtatgtctgtattccaaacctccagtctctgttgatattttcttatttggaggttctacaattcgtccgtgtgctggagcaaactgggtgttggaataatttctccccacatgggacacttttttcctctcc

SEQ ID NO: 814 - DNA, 1037 bp, Saccharum officinarum
ggctcatcgtgaaggcggcgggggcgccggggcatgggtcgaggatgttcgacggcgccgccgtggacaatttgatggattccgtggagaccatcgctgggttcagggatgcgcagttcaggatggtgaagtccggggagaggggtcctggggaggtggtctcggtgaatcctgtgtacatgaaggccggcataccaagccccacgggttttgtgatgaatatgcaaccttcagaagcagaggttgggtttgatctccgccttcctccaactgaagatattgaacaaatcaaacgaagagtcaaagaggaatgggcaccagctcataaaaacttgacttaccagctaacgcagaaaggtccagtaacagatgtggctgggcgtcccatatttacagcaacagatgagtcaaacccatggtggcccatatttgagaaggctatcacctcagcgggtggaaagctatctaagcccgagatcttatcttcaaccacagattcacgctttgtgaggcagctgggcattcctgcccttgggttttctccgatgacaaatactccaatactactacacgaccataatgagtttctggaagataaggtattcctgaggggcatcaaagtgtacgaacatgtcattagagcactaagctcgttccaaggctgattcgtaaaaggaaactgctgttgcaagatgtgtagcattgttggattcccacctcagttactggatgaaggtaagagcatcgaatacaggtttctaataattggttcagtcacaaacatgaggaaacattccgaagccatcagaatctgtcgaatatggtgatatgaatgataggcaaacaactgtatgtatactgtatggcgtaggggttgtgaaccgtaggggttgacgggttgtggtgtatgtctgtattccaaacctccagtctctgttgatattttcttatttggaggttctacaattcgtccgtgtgctggagcaaactgggtgttggaataatttctccccacatgggacacttttttcctctcc

SEQ ID NO: 815 - DNA, 1126 bp, Pennisetum glaucum
agggaagtggtttcggtgaaccctgtgtacatgaaggccggcataccaagccccacgggttttgtgatgaatatgcaaccttcagaagcagaggttggctttgatcttcgccttcctccaaccgaagacattgaacagataaaacgaagagtcaaagaggaatgggcaccagctcataaaaacttgacgtacgagttgatgcagaaaggaccagtaacggatgtggcaggacgttccatatttacagcaaccaatgattcgaacccatggtggtctgtatttgagaaggctatcacgtctgcaggtggaaagctatccaagcctgagatcttatcttcaactacagattcccgctttgtgaggcagctgggcattcccgcccttgggttttctccgatgacaaatactccgatactacttcatgacaataatgagtttctggaggataaagtattcctgaggggcatcaaagtgtacgaacatgttattagagcattgagctcctttcaaggctgatttgggaaacgaagctgctgttgcatgtatatagcattgctgaggccccatcccattcactgaagacaggaatcgaagttctgaccccaggtttctcattatcagttcagtctcaaacataccaaaaggaaacattccgaagcaatcaaaatctgcctaagataccaattataatgacaacctgagcaatttaatccatgcatacatatggtatggggttgtgaactacttgtaacacgaaaatagtcatgtttggattgttattcgtatttggaaactcatgtgctggagggaaccggtgttgtggaataatttctctccacttggacatttgaataagtaacgagagacaaggttggatgggttgggagggcgtatgaaattctgtagatggagccctcagccctgaaattctgatcttagttggatgggttgggagggtgtatgaaataaagaggcgggtattgcccaaaactgtatcgcatggccaacatatattgcaacaaaggagatggctgtcactgtcctatttgcaacatgtatctcggtttcatctgctttgatctgtgtggttgatccgccagtgtcggcagcttactgttgtatgtgg

SEQ ID NO: 816 - DNA, 792 bp, Triticum aestivum
gccgagggtctcggtgaatcctgtgtacatgaaggccggcataccaagccccacgggttttgtgatgaatatgcaaccttcagaagcagaggttggctttgatctccgcctccctccaactgaagatattgaacagatcaaacgaagagtcaaagaggaatgggcaccagctcataaaaacttgacctaccagctaatgcagaaaggtccagtaacagatgtggctgggcgtcccatattcaccgcaacaaatgagtcgaacccatggtggtccatattcgagaaggccatcacctccgcgggaggaaagctatctaagcccgagatcttatcttcaaccacagattcacgctttgtgaggcagctgggcattcctgccctcgggttttctccgatgacaaatactccaatactactacatgaccataacgagtttctggaagataaggtgttcctgaggggcatcaaagtgtacgaacatgttattagagcactaagctcgttccaaggctgattcgtgaaaggaaagtgatgtttgcatgatttgtagcattgctggattcccgtctcatttactgaatgaaggtaagagcatcgaagctatggcctacaggtttctaataattgggtcagtctcaaacatggcaaaggaaacattccgaaaccatcaggatatgtcaaatatagggatatgaatgataagcaaagaactgtaaatatgatttaggggttgtgaactgttgtaccacaatagcccaaaaccactgtctctgttgatatattttctgatct

SEQ ID NO: 817 - DNA, 1403 bp, Panicum virgatum
  misc_feature (1045)..(1045): n is a, c, g, or t
ccgggccgcggggttcgcgcccgcccgcaccgtccacatctcgctcgtccccgacgaggagatcggcggcgcggacgggttcgagaagttcgcggagtcggaggagttccgcgccctcaacgtcgggttcatgctcgacgaggggcaggcgtcgcccacggatgtattcagggtcttctacgcggacaggctggtgtggaggctcatcgtcaaggcggcgggggcgcccgggcacgggtcgaggatgttcgacggcgccgccgtggacaatttgatggattgcctggagaccgtggccgggttcagggaggcgcagttcgggatggtgaaggccggggagaggggtcccggggaggtggtttcagtgaaccctgtgtacatgaaggccggcataccaagccccacgggttttgtgatgaatatgcaaccttcaggagcagaggttggctttgatcttcgccttcccccaactgcagacattgaacagataaaacgaagagtcaaagaggaatgggcaccagctcataaaaacttaacatatgagctgatacggaaaggaccagtaacggatgtggcaggacgtcccatatttacagcaaccgatgagtcaaacccatggtggtctgtatttgagcaggctatcacctctgcaggtggaaagctatccaagcctgagatcttatcttcaaccacagattcacggtttgtgaggcagttgggcattcccgcccttgggttttctccgatgagcaatactccgatactacttcatgacaataatgagtttctggaggataaagtattcctgaggggcatcaaagtttatgaacatgttatcagagcactgagctccttccaaggctgattcagaaaaggatgatgttgtacatagagtatgcatcgttgagttcccatctcattcactgaagacaggagtcagagctctggcttccaggtttctcatgattggttcagtctcgaacataccaaaggaaacactctgaagcaatcaaatccgcctaagatgctgatttgaatgataatntaagcatattgattcatgcatgcatatggtatgaagttatgacatgaatgtaacacgatagcatagaagccatgtctcatgtctggatagatatttctcccatttggaggctccattggttgtacccgtgtgctagaggaaaccgggtgttgtagaataatttctctccacttgaacattttaatgagtagagagacaagccatgcatggatactgtagatggagccctgaaattctgatatttagttgtatcatgtatgggtagagaaggtatgaaataaaggggcagatatccccaaaactgtatcgcatgtccaaacatatattgcaataaaggagatggctgtcactgtcactc

SEQ ID NO: 818 - DNA, 792 bp, Triticum aestivum
  misc_feature (101)..(101): n is a, c, g, or t
  misc_feature (629)..(629): n is a, c, g, or t
gccgagggtctcggtgaatcctgtgtacatgaaggccggcataccaagccccacgggttttgtgatgaatatgcaaccttcagaagcagaggttggctttnatctccgcctccctccaactgaagatattgaacagatcaaacgaagagtcaaagaggaatgggcaccagctcataaaaacttgacctaccagctaatgcagaaaggtccagtaacagatgtggctgggcgtcccatattcaccgcaacaaatgagtcgaacccatggtggtccatattcgagaaggccatcacctccgcgggaggaaagctatctaagcccgagatcttatcttcaaccacagattcacgctttgtgaggcagctgggcattcctgccctcgggttttctccgatgacaaatactccaatactactacatgaccataacgagtttctggaagataaggtgttcctgaggggcatcaaagtgtacgaacatgttattagagcactaagctcgttccaaggctgattcgtgaaaggaaagtgatgtttgcatgatttgtagcattgctggattcccgtctcatttactgaatgaaggtaagagcatcgaagctatggcctacaggtttctaataattggntcagtctcaaacatggcaaaggaaacattccgaaaccatcaggatatgtcaaatatagggatatgaatgataagcaaagaactgtaaatatgatttaggggttgtgaactgttgtaccacaatagcccaaaaccactgtctctgttgatatattttctgatct

SEQ ID NO: 819 - DNA, 956 bp, Hordeum vulgare
acccgcaccgcacatcacagccgcccccaacaacagaggccaggccagaccagaccagaccggaccatggtttacggcggagaggaggcgctgatgcggcagtactccattggcgacgagatcgggcgcagccgcttcgggacggtccgccgctgccactccaacgccacgggggaggcgctggccctgaagaccacgcccaaggcgccgctgcgtgacccgctcgacttggcgctcgcggagcaggagcccaagctgcacctcctcgcctcctccccgccctgcagcccgcacctggtcgcgctccacgccgccttcgacgacgcgaacgccgtccacctcgtcgtcgacctctgcgccggcggggacctcctctcgctcgtctccgcccgcggcggccgcctccccgagcgcgaggccgtcgggctggccgcgcagctcgcgtccgcgctcgccgcctgccaccgccgcggggtcgcgcaccgcgacgtcaagcccgacaacctcctcttcgacgccgccacgagcgtgctcaagctcgccgactttggctccgcggagtggttcggggacgggcggcccatgtcgggcctcgtcggcacgccatactacgtggcgcccgaggtggtcgcctggagggagtacggggagaaggtggacgtgtggagcgccggggtggtgctttacatgatgctctcgggggccgtgcccttctacggcgccaccgcgcccgagatcttcgaggccgtgctccgcggcaacctgcgcttcccgccgcgcgccttcgccggcgtctcgcccgaggccaaggacctgatgcgccgcatgctctgcaaggacgtctcccgcaggttctccaccgaacaagtccttaaggcatcccgtgggatcgcgagcctgttgccggggaatgcggtcttgcggggcttgaagcagaatcgattggaaccaaacat

SEQ ID NO: 820 - DNA, 1578 bp, Triticum aestivum
ggcggcgatccgtcggtggcgaggtggacggcgaaaaggaggacgagcatggccgacgggaaggacctgggcgccgcggcggccgcggaacccgaccccgatgaagggcagccggatctggaagaggaaggtgagctcgaagccgccgccggcggcggcggcgaggaagaagaggacgtcgacgtcgacggcctcgctagcttcctcgaattcgagatcctctccggatccagcgaggaagatcctctcgaccagctggaggagggcgaggaggagaaggagacgagggtgaatgatgaagcgaagaacggtaagaggaagcaagattcgctgtcggacggagacggcagcggcagcgaggacgagcatcagaagagggcgaggaaggagaagggaaaaggaaaggttttggcagaggggccgcctcagattgacacgggcatgttcaccaacgtccccccggagctgttcctgcagatcttcaagttcctctcctcggaggacctcatctcgtgtgcccttgtgtgccgcttcatgaacgccgccgcatctgacgagaccctttggcgccgcttgtattgtatgaggtggggcctgtcctctaatgctacctctaacgcgaaactcagggagtgcgcttggaagagcctctacattcagcaagacagagaagatatggttgaattcgtgagatatacccctacagaattcaaagagtactatatccagatgcaggctgcaaaaaggagtcaggcaccccttccctcagaagttaacgacgacaagattgttcttgataagacagtagctgatcaggtgtctagttggaaaagccgcagaggccttaccgatgatgcagtcaaggggcattcttgttccggaagtacttgctactataagcagattggtgatgcttatatctgtgagaagactggtcgtgtacatgtctgcgatgatgcctgtcgtgaatttgtcttggaccaagctagcgggttacttgtctgtacgatatctgggcactgttttgagagatttttatgtcctgatgacgagtgggacacttgtgatgctgatcagcagcaaggtggcgtgactgatgaagcagagccattcatgggatctggacgatttgcacgagcttatcagttgggttacagctgtgccgacgagaaggaacttgagcacgctttgcggttctgctgatattctcccggggatttgatccttcagaccttcactcctcgtgctcgctacacgagagcaagtttttggttggcaagggaaataagctgcaggaagctctatactatacgctttacttgatctcgacctccggggatatgcctatgaatgcaaaatcagcagaaatgctggtatgcttttcgatcagtcgagggagctaatatgctgttgtatagtttcctaaattatgagcgatgtatcctagtaataaaataaatgcctgaccacttgtaatccccacaacagtgcctatttgtggcactgtaacctattcactgaagtggtcgaggcatgtatgaggttgctgtttttttatttagcatacaaatcagcaag

SEQ ID NO: 821 - DNA, 1538 bp, Triticum aestivum
ggcggcgatccgtcggtggcgaggtggacggcgaaaggaggacgagcatggccgacgggaaggacctgggcgccgcggcggccgcggaacccgaccacgatgaagggcagccggatctggaagaggaaggtgagctcgaagccgccgccgccggcggcggcgaggaagaagaggacgtcgacgtcgacggcctcgctagcttcctcgaattcgagatcctctccggatccagcgaggaagatcctctcgaccagctggaggagggcgaggaggagaaggagacgagggtgaatgatgaagcgaagaacggtaagaggaagcaagattcgctgtcggacggagacggcagcggcagcgaggacgagcatcagaagagggcgaggaaggagaagggaaaaggaaaggttttggcagaggggccgcctcagattgacacgggcatgttcaccaacgtccccccggagctgttcctgcagatcttcaagttcctctcctcggaggacctcatctcgtgtgcccttgtgtgccgcttcatgaacgccgccgcatctgacgagaccctttggcgccgcttgtattgtatgaggtggggcctgtcctctaatgctacctctaacgcgaaactcagggagtgcgcttggaagagcctctacattcagcaagacagagaagatatggttgaattcgtgagatatacccctacagaattcaaagagtactatatccagatgcaggctgcaaaaaggagtcaggcaccccttccctcagaagttaacgacgacaagattgttcttgataagacagtagctgatcaggtgtctagttggaaaagccgcagaggccttaccgatgatgcagtcaaggggcattcttgttccggaagtacttgctactataagcagattggtgatgcttatatctgtgagaagactggtcgtgtacatgtctgcgatgatgcctgtcgtgaatttgtcttggaccaagctagcgggttacttgtctgtacgatatctgggcactgttttgagcgatttttatgtcctgatgacgagtgggacacttgtgatgctgatcagcagcaaggtggcgtgactgatgaagcagagccattcatgggatctggacgatttgcacgagcttatcagttgggctacagctgtgccgacgagaaggaacttgagcacgctttgcggttctgctgatattctcccggggatttgatccttcagaccttcactcctcgtgctcgctacacgagagcaagtttttggttggcaagggaaataagctgcaggaagctctatactatacgctttacttgatctcgacctccgtggatatgcctatgaatgcaaaatcagcagaaatgctggtatgcttttcgatcagtcgagggagctaatatgctgttgtatagtttcctaaattatgagcgatgtatcctagtaataaaataaatgcctgaccacttgtaatccccacaacagtgcctatttgtggcactgtaacctattcactgaagtggtcgaggcatgtat

SEQ ID NO: 822 - DNA, 1575 bp, Brachypodium distachyon
aaccgcaccaatatctccagggtaagggaggagcggcgatccgtcggtggcgaggaggacgaccatggccgacgggcaggacctgggtgacgcggctgccgtggaacctgaccctctccctaatcctgaggaagggcgtacagatctggaagagggaggcgagggcgaagccgccgccggcggcggcggcgaggaagaagaggacgtcgacgtcgacggcctcgctagtttcctcgaatttgagatcctctccggatccggcgcggaggatcctcccgatcaggatgaggaagagaaggaggagccggtgaaagacgatgttaggaagggcaagaggaagcaagattcgcagtcggacggtgatggcagcggcagcgaggaggaacatcagaagagggcgaggagggagaagggaaaagggaaggctttgactcccgtgcagcctcggatcgacacggggacgttcagcaatgttcccccagagctgttcctgcagatcttcaagttcctctcgtccgaggacctcatctcctgtgccctggtgtgccgcttcatgaacgccgccgcatctgacgagactctttggcgccgcttgtattgtatgaggtggggcctgtcctctaatgctatctctcatgctaaactccgggagtgtgcttggaagaatctctatattcagcaagacagagaagatatggttgaattcgtgagatatacccctacagaattcaaagagtactatatccagatgcaggctgcaaaaagaagccaagccccccttccctcagaagtcaacgatgacaaggttattcttgataagacaatagctgatcaggtgtctagttggaaaagcagcagaggccttaccgaggatgcagtcaaggggcattcttgttctggaagtacttgcttatatacccagattggtgatgcttacatttgtgagaagactggtcgtgtgcatgtctgtgatgatgcctgtcgtgaatttgttttggaccaatctagtgggttacttgtctgtacgatatctgggcactgcttcgagagatttttatgtcctgatgacgaatgggacacttgtgatactgatcagcagcaaggtggtgtgactgatgaagcagagccattcctgggatctggacgctttgctcgtgcttatctgttgggctacaactgcgctgatgagaaggaacttgaatatgccttgcggttctgctgatacgctcatggggatttgatcctaaactcttgccggctaggtctggcaagatggaataagtggcaacaagctgtgttctttgttttgcttaatttcaacattccatgcatggagtacaaaatcagcagaaatactacacttcagagtgacattctgatctgttttgatcagttgagggagctgatatgttgttgtatagtttcgtgaattatgaagatgtagcaataagtcattgtaatcctcagcgtgcctatttgttttgttaaattatttctaaactactagctggtggtagccaacactagcagtagcggtgcaagtgcatttagcggtcgagatgcaattggtaatct

SEQ ID NO: 823 - DNA, 1606 bp, Avena sativa
agcggcgatccgtcggtggcgagtcggacggcgaagaggaagacgagcatgaccgacggacaggacccgggtgacgcagcggccgcagagcccgacccccttccagatcccgaagaaattcatacagatctggaagaagcaggcgagcccgaagccggcgccggcgccggcgacagcgaggaagaggaggacgtcgacgtcgacggcctcgccagcttcctcgaattcgagatcctctgcggatccagcaacgaagatcctctcgatcagcaggaggaaggcggggaggagaaggagaagccggtgatagatgctcttaacaagggtaagaggaagcaaagtcctcagtcagacggagatggcagcagcagcgaggatgagcatcagaagagggcgaggagggagaaggggaaagggaaggttctgactgcagagcatcctcagattgacacgggcatgttcacaaatatccccgtggaacttttcctgcagatcttcaagttcctctcttcagaggacctcatctcgtgtgccttggtgtgccgcttcatgaacgccgctgcatctgacgaaaccctttggcgccgtttgtattgcatgaggtggggcctgtcctctaatgctacctctaacgctaaacttagggactgcgcttggaagaacctctatattcagcaagatagagaagatatggttgaattcgtgaggtatacccctactgaattcaaagagtactacatccagatgcaggctgcaaaaaggagtcaagctcccattccctcagaagtcaacgacgacaaggttattcttgataagacagtagctgatcaggtgtctagttggaaaagcagaagaggccttactgatgattcagtcaaggggcattcttgttcaggaagtacttgcttgtacacccagattggtgatgcttatatctgtgagaagactggttgtgtgcatgtctgcgatgatgcctgccgagaatttgtcttggaccaatctagtgggctacttgtctgtacgatatctggccactgctttgagagatttttatgtcctgatgatgaatgggatacttgtgatactgatcagcagcaaggtggtgtgactgatgaagcagagccattcatgggatctggacgatttgctcgtgcttatcagttgggttacgactgtgccgatgagaaggaactcgaacacgccttgaggttctgctgatatgctcacggggatttgatccttcactcgtgctggctatgcgagaccaagttttttgcttggcaagggagacaagtggcagaaagctttggactactctttacttgtttctgaccactggggatgtacttaaaccagcagaaattctacactttgagcaaaaatgctgatctgtttcttggatcagtccttgtaggtgtagctgatatgttgttgtatagtagtatcctaaattatcaaagatgtattccctagcagtaataataaagtaaatgcttggccacttgtaatcctcacaacagtatcaccgatgtggttgaggcatgtaataacttgttgatatttttttttggcatagtagaaagcagcaagtgtttcactttctggt

SEQ ID NO: 824 - DNA, 977 bp, Triticum aestivum
ccacgcgtccggcaagaactggcaactgatcttgattttacccgtcaaggtcgtgaaaatgctatgctggttcggcgactagagctgcttggtgaagttgcaaaactggcaagatcccttcatcttcctgaagatgtgagctacacatgtgaaaatgctgcatatttttggttattacatgtttatgcccgctgggaacaattcttggccgcctgtgtgccaaataaggagaatccctcttttgttaaagaccgttttccattttctgagttctttttggataccccacagcctgtgtttactggtgagtcctttgagaaagatatgcatgcagccaaaggatgtttcaaacatctttctacgatattccaagagctggaagagtgcagggcttttgagttactgaagtcaacagctgagcgagcaaattatctaatgactaaacaagctaagattgttgccatgacttgtactcatgcagcattgaagagaagagactttcttcaattgggtttcaaatatgacaatttactgatggaagaaagtgcacagatattggagatagagacttttataccaactctcctgcaacggcaggaagatggctatgctcgtctcaaacgttgcattttaattggtgatcaccatcagttaccccctgtcgtgaagaacatggcttttcagaagtacagccacatggaccagagtctcttcacaaggtttgttcgccttggtgtcccttatattgaactcaatgctcagggtcgtgccagacctagtattgctcagctttataattggagatacagagaactgggagatctgccttatgtacatgaggaagctatattccataaagctaattctgggttctcttacgagtatcagctggttgatgttcctgattatcgtggcagccccgagtctgctccttctccttggttctaccagaatgaaggggaggctgagtatattcc

SEQ ID NO: 825 - DNA, 894 bp, Triticum aestivum
  misc_feature (618)..(618): n is a, c, g, or t
  misc_feature (624)..(624): n is a, c, g, or t
  misc_feature (630)..(630): n is a, c, g, or t
ccacgcgtccggcaagaactggcaactgatcttgattttacccgtcaaggtcgtgaaaatgctatgctggttcggcgactagagctgcttggtgaagttgcaaaactggcaagatcccttcatcttcctgaagatgtgagctacacatgtgaaaatgctgcatatttttggttattacatgtttatgcccgctgggaacaattcttggccgcctgtgtgccaaataaggagaatccctcttttgttaaagaccgttttccattttctgagttctttttggataccccacagcctgtgtttactggtgagtcctttgagaaagatatgcatgcagccaaaggatgtttcaaacatctttctacgatattccaagagctggaagagtgcagggcttttgagttactgaagtcaacagctgagcgagcaaattatctaatgactaaacaagctaagattgttgccatgacttgtactcatgcagcattgaagagaagagactttcttcaattgggtttcaaatatgacaatttactgatggaagaaagtgcacagatattggagatagagacttttataccaactctcctgcaacggcaggaagatggctatgctcgtctnaaacgntgcatnttaattggtgatcaccatcagttaccccctgtcgtgaagaacatggcttttcagaagtacagccacatggaccagagtctcttcacaaggtttgttcgccttggtgtcccttatattgaactcaatgctcagggtcgtgccagacctagtattgctcagctttataattggagatacagagaactgggagatctgccttatgtacatgaggaagctatattccataaagctaattctgggttctcttacgagtatcagctggtt

SEQ ID NO: 826 - DNA, 5294 bp, Brachypodium distachyon
aaaccctaaacctcgcggacaccagtcatgccgaaggtctacggcaccggtgtcttcgagtttcggcacccccgcgccgccgagtatccgctccccgccgacgtacccgccgcggcggcgcccgataaggtcccctcctccaccggcgcctccatcacgctcctcgacatccagcgcgaccgcctcacccgcgtcgccaccgagcactggggctcaccagcagccgccgccgccttcgatgccgaacttgtaaaggagatctacgccaccgagctccgcgtggagggccgcgggcgcaagaccgtcccgctccatcgtgtcatgatcctcgaggtcagccagtacctcgagaactacctctggccgcacttcgacccagacaaagcgtccttcgagcacgtcatgtccatgatcctcatggtcaacgagaagtttcgagagaatgtggcggcgtggacctgcttccatggtcggaaggactcgtttaaaggcttcctatggcgagttctcaagctaaaggaagaggataggcccgttagtatggcagagaaaaccaattacctcctgttcatgataaatgcgtttcagagtttggaggatgaacttgtccgggaaactatactccaggtagtaagcttaaaactgtggcatactctttcatccggacggcttcagatggaactttgtctgaaccctgagttggttaagaagtggaccaaaatcaaaagaaaagaagcaaaggaagcaaaaaaggcaggcctaccttgtaatccttcagacatgcttgagaataaattccttaggaacctaattgaagaattcctggagattcttgatttaaaggtgatgttatccagtcaagatggtggtgaagaatctgttcttaatgagtcacttagtgggcaggtcgatgattctagtgtcttgtattgtgaaaggttcatggaatttctgattgatatgttgagccagcttcctacaagaagatttcttaggccccttgttgctgatgttgctgtcattgcgaagtgccatttaagcactctctatactcatgaaaagggccgtctttttgcacagttagtggacttgctgcagttttacgaaggctttgagatcaatgatcagtctggaacacagcttagtgatgatgatgtcctgcaagctcactattcccgcttccaagcttttcagctgctagcattcaaacaaatacctaagttgcgagaccttgcgttgtgtaatattggttcaatccataagcgtgccgatttaacgaagaagctgcttgtcttgtcagatactgaactgcaagatctggtttgcaataaggtaaaatgttcacatggttacaatttctctgtgcttcttcttaaaataatttcagagaaggatccatacagtggaaggcgtgatttccttatcgaagtcctagttgctttttttgagaagcgacaatctcagaaagaagccgttaatgcacttccactgtatccaaatgaacagatcatgtgggatgagagccttgttcctagcataaactattctggagaaggctgtcttgccctcccaaaactcaatctccagtttctgacacttcatgattatttgttgaggaatttcaatctctttcgtcttgaatcaacatacgaaattcgtgaagatattcaagaagctgttcctcatctacattcttatatcaacaatgagggagacactgcctttcgtggatggtccaggatggctgttccaatcaaggaatttaggatcacacaagttaagcaaccaaacattggagaagttaagccttctgctgtaactgctgatgttacttttagcatatcaagctacagaccacagataaaatctgagtgggattctctgaaagagcatgatgttttatttttgttgtcaatccatccatcttttgaacctcttagccctgaggaggctgcaaaatcaactgtgcctgaaaggctaggattgcaatatgtacgtggatgcgaggtgatcgaaattcgtgacgaggaaggaggtctcatgaatgactatacaggaaggataaagagagatgagtggaaacctcccaagggtgagattcggactgttaaaattgccttagatacagcgcagtaccacattgatgttactgaattagcagagaagcacacagaaaatgtttatggaacatttaatattctaatgagaaggaaacccaaggagaataatttcaaagcaatcctggaatctatacgtgatttaatgaatgaaacatgtgtagttcctgaatggttgcataacatattcttgggttatggaaatccttctgccgcccagtggacaaacatgcctgatcttctggaaactatagactttaaggacacttttcttgatgctgaccatgttgtgcaaagctttccagcttttcaggtcacatttatcaatactgatggtacagaaaacatgcatccaagccctccatttaggattaagttgtccaagaaaatgagggaaatcagtcacgctctacctggcaatgtaaactcctctgatataacaagcaagaacaatatggctgatgatgaagggtctcagaaagaaaaactaagggttgagacttacattcctgctgatccagggccatatcctcaagataaacctaaacagaactcagtgaggtttacacccactcagatcggtgctataatatctggtattcaacctggattgacaatggttgttggtcctcctggtacgggaaaaacagacacagctgtgcagatattaaatgttctgtatcataactgtccttcacaaagaacgctgattataacccattccaatcaagctttgaatgacttgttcgagaagataatgcagagggatgtgcctgccaggtatcttctccgtcttggtcagggtgagcaagagctggcaactgatctcgattttagccgtcaaggtcgtgtcaatgctatgcttgttcgccgtctagagttgcttgctgaagttgcaaaactggcaagatccctccatcttcctgaagatgtgagctacacatgtgagaatgctgcatatttctggttattacatgtgtatgcccgttgggaacaattcttggctgcctgtgcgccaaataaagagaacccctcttttgttaaagaccgttttccattttccgagttcttttcggacaccccacagcctatattcactggcgaatcctttgagaaagatatgcacgcagccaaaggttgtttcaaacatctttctacgatattccaagagctggaagagtgtagggcttttgagttactgaagtcaacagcagagcgagcaaattatctaatgactaaacaagccaagattgttgccatgacctgtactcatgcagcgttgaagaggagagactttcttcaattgggtttcaaatatgacaatttgctgatggaagaaagtgcacagatattggagatagagacttttataccaaccctcctgcaacgccaggaagatggctatgctcgtctcaaacgttgcattttaattggtgatcaccaccagttaccccctgttgtgaagaacatggcttttcagaaatacagccacatggaccagagtctctttacaaggtttgttcgccttggtgtcccttatattgaactcaatgcccagggtcgagccaggcctagtattgccgaactttataactggagatacagagaactgggagatctgccttacgtacgtgaggaagcaatcttccataaggctaattctgggttctcttatgagtatcagcttgttgatgttcctgattaccgtggcagaggcgagtctgctccttctccttggttctaccagaacgaaggggaggctgagtatattgttagtgtctatatttacatgcgtctgatcggataccctgccaacaagatttcgatattaaccacttacaatggtcagaagcttcttattcgtgacgttatcagcagaaggtgcaagccatggaatattgagccaccttgcaaggtcaccacggtggacaaattccagggccaacaaaatgatttcattttattatctcttgtacggacccggtttgtgggccatctccgtgacgtcagaagacttattgtggcaatgtcccgtgctcgtctgggcttgtatgtgttctgccgccgttctctatttgaacagtgctatgaattgcagccaacattcaagcttctactccgaagacctgataagcttggcttgaatcttgaagagtgcactccatttacagagcggcctttgggagaagctggaaatattcattatattactggggttgaagatgttggacacctagtgaacttcagactggaacatcttcgtcagatacaatccatgcaatgttatacaacccctcctgagaatggaaatgctggtattgttctgcgtgatgcaaaggaggtcatggaggaagaaaatggcgaggcttttgatgcaatgaacagtaacaggatggatgaagatacagttgagacaaagggtgacatgatgcaggaagggaacaagatggatgcaggtaatggcgaggcaggtgacgtggctattgaggacaagatggtggaaggaagtacagatgaggccaaggacaatatggaggaagaaaatgctgatgaggccaaggacaaaatggaggaagaaaatgctgatgaggccaaggacaaaatggaggaagaaaaggccgagtcaaaaggcatggaggaagagtgatctgacctagttgttggttggttggaactgatgccaggcaccatcacttgactttggataactgttcaacgaattgaccttttcaacggctggtaatacaagtacctgagtcatacatggaagacggtgcaaaaatatgtaacaacctaaatgtatgtaacaacctatcggcctgtcatacaagaacatgcctgcaaaaactcttcgttggaacctctttgtcaggctatgcaggagacatgtacaaaagttcctcctaggacgactctccctcctgactgtttaacgtagctattccagagaacggcagggacattgttatgctattgttgtattactagattatgttctgtaatttgggcacggaagcattttaatctttttgggtagcttttttcttaatgtgttcaggtgtttgtttcttcagtctcgtcaggtaacgtcgtgtgctttgcagaggctttgaagctaacagaacacgttgtaatgtaagagtgtttatttcaatggaattttggaggattttattt

SEQ ID NO: 827 - DNA, 5328 bp, Oryza sativa
atgccgaaggtctacggcaccggcgtcttcgagttccgccacccgcgcgccgccgagtacccgctcccggccgacgtcccggcctccgccgcgtcggcgcccgacaaggccatccccaccgccgcggcctccaccatcacgctcctcgacatccagcgcgaccgcctcacccgcgtcgccgccgagcactggggcgcgcccaccgcgggggccgccttcgacgccgccctcgtcagggagatctacgcgaccgagctccgggtcgagggccgcggccgcaagaccgtcccgctccaccgcgtcatgatcctcgaggtcagccagtacctcgagaactacctctggccaaacttcgacccggccggcgcctccttcgagcacgtcatgtccatgatcctcatggtcaacgagaagttccgggagaatgtggcggcgtggacctgcttccatgaccggaaggatgctttcaagggatttttatggcgggttctcaagctaaaggaagaggatagggagcttaatatggccgagaaaacaaactacctgttgttcatgataaatgcgtttcagagtttggaggatgaactagttcgagaaaccatacttcagttagtaagcctaaagttgtggcatactctttcttttggacggcttcagatggagctttgccttaaccctgaattgattaagaagtggaccaaaatcaaaagaaaagaagctaaagaagcaaaaaaggcaggtcaaacctgtgatgcttcagaaatgctcgagaatagattccttaggaacttaatagaagaattcctggagattcttgattcgaaggtaatattgtccagtcaagatggtggggatgaatctgtgttgaatgtatcactcagtgggcaggttgatgattattgtgtcttgtactgtgagagattcatggagtttttgattgatatgttgagccagcttcctactagacgatttttaaggccccttgttgccgatgtagctgttgttgctaagtgtcacttaagtgcactgtatacccatgaaaaggggcgtctttttgcgcagttggttgatttgctgcagttttatgaaggctttgagattaatgatcattctggaacacagctcagtgatgatgatgtcttgcaagctcattattcccgtttccaagcctttcagctgctggccttcaaacaagtgcctaagttgagagatttttccttgtgtaatattggttcaatccataagcgtgcggacttagcaaagaagctgcttgtcttgacagatgtagaactgcaagatctggtttgtaataagtttttttatcagctgttattgttatttctcaagttaatttcagaggaggacccatgcagtggaagacgtgattttcttattgaggtcctggttgccttttttgagaagcgtcagtcacagaaagatgcagtaaatgcacttcctctttatccaaatgaacagatcatgtgggatgaaagccttgttcctagcattaattattctggagagggctgccttgctctcccaaaactcaatctccagtttttaacacttcatgattatttattgaggaatttcaatcttttccgccttgaatcaacatatgaaattcgtgaagacatccaggaagctgttcctcatctgcatgcctatattaacaatgagggagacactgcctttcgtggttggtccaggatggctgttccaatcaaggaatttaggattactgaagtgaagcagccaaacattggagaagttaagccatctgctgtaactgctgatgtcactttcagcatctcaagctacaagccacagatcaaatctgaatgggatgctttgaaggaacatgatgttttatttttgttgtcgatccgtccatcttttgaaccccttagccctgaggaggctgcaaaatcaactgtgccagaaaggcttggattacaatgtgtacgtggatgtgaggttattgaaattcgtgatgaggaaggatctcttatgaatgattttacagggaggataaagagagaggaatggaaacctcccaagggtgagattcgtactgttaaaattgctttggatacagctcagtatcatattgatgttactgaggtagcagagaagggtgcagagaatgtgtatgggacatttaacattctaatgagaaggaaacccaaggagaataatttcaaagcgatattggaatctatacgtgatctaatgaatgaaacatgtgtagttcctgaatggttgcataacatattcttgggttatgggaacccttctgccgcacagtggataaatatgcctgatcttctggaaaatatagattttaaggacacttttcttgatgcggaccatgttgtacaaagctttccagattaccaggtcacatttatcaattcagatggaacagaaaacctgaatccgagccctccttttaagattaagttgtccaagaaaatgagggaaagtagtcatgctctacctggcaatgtaaactctgttttgtcggctaagaacaatatggttgatgatgatgggccccagaaagaaaaaataatggttgagacttatattcctgctgatccagggccgtatcctcaagataaacctaaacagaactcagtgaggtttacacctactcagattggtgctataatatctggtattcaacctgggttgacaatggttgttggtcctcctggtacgggaaaaacagatacagctgtgcagatattgaatgttttatatcacaactgtccttcccaaagaactctaattataactcattccaatcaagctttgaatgatttgtttgagaagataatgcagagagatgtgcctgctaggtaccttcttcgtcttggtcagggtgaacaagagttggcaactgatctcgattttagccgtcaaggtcgtgtcaatgctatgctggttcggcgattagagctgctaggtgaagttgcaaaattggcaagttcccttcatcttcctgaagatgtgagctacacatgtgaaacggctgcatacttttggttattacatgtttatgctcgctgggaacaatttttagctgcctgtgcgcaaaaccaagacaagccctcatttgttaaagaccgcttccctttctcagagttcttctcagatactccacaacctaccttcactggtgagtcctttgagaaagatatgcatgcagccaaaggttgtttcaaacatcttttgacaatatttcaagagctggaagaatgtagggcttttgagctacttaagtcaacagcagagagggcaaattatctaatgaccaaacaagccaagattgttgccatgacttgtactcatgcggcattgaagaggagagactttcttcagttagggttcaaatacgataatttgctgatggaagaaagtgcacagatattagagatagagactttcataccgatgctgctgcaacggcaggaagatggctatgctcgtctgaaacgttgcattttaattggtgatcaccatcagttaccccctgtcgtgaagaacatggcttttcagaagtacagccacatggaccaaagtctctttacaagatttgttcgtcttggtgtcccttacattgagctcaatgctcaggggcgtgccagacctagcatcgccgaactatataactggagatacagagaacttggagatctaccttacgtccgtgaggaggctatcttccacaaagctaattctggcttctcttatgactatcagttggttgatgttcctgatttccgtggcagaggtgagtctgccccttctccttggttctaccagaatgaaggggaggctgagtttatagttagtgtctacatctacatgcgcctgattggataccctgccaataagatttcgatattgaccacttacaatggtcagaagcttcttattcgcgatgttattaacagaagatgcaagccatggaatatcgaaccacctagcaaggttaccacagtggacaagttccagggtcaacaaaatgatttcattttattatctcttgtccgcacccgttttgtggggcatcttcgtgatgtcagaagacttattgtggcaatgtcccgtgctcgtctgggcctgtatgtgttctgccgtcgttcactttttgaacagtgctacgaattgcagccaacattccagcttctcctccagaggcctgataagcttggcttgaatcttgaagagtgcacaccatttacagagcgacctttagaggaaactggaaatattcattatgttgctggtattgaagatattggtcatctagtgaatttcagattagaacatcttcgtcagatgcaatacatgcaatattatgcacctcatgcaaatgtaccaccttcagcagtaccagaaaacaatgctgatgcaactgaaaatggcaatgctggcaatggtatgcataaggcaaacgatgtcatggctgaagaaaatggtgatgcagtgatgagaaataagatggaggaagacactattgatacaatgcaggaagaaaacaagatggatggtaaaaatcctgaggcaaacgacatggctatggaggagaagaccgtcgacggagatgatgatccaaagaataagatggaggaaggaaatactgaggcaaagaataagatggaggaaggaaatactgaggcaaaggacaagatggaggaagaaaatgatgtggcaaagaacaatatggaagagtgagctaacatggctgttatctgattggactagaggctaacaaaggcttcatgttcgctagcttgatccaccacaattcttgatctggaataccaaatattgaagcacgcaacatcacatggaggggttcataacatggctcctgggatggtgtgcgtggaatggagcatgatatgcgaaggttaaagatatttttggagcttcttggccaaactatgctccttttatttccggccaattgtgtggtataccgtatacacatgtactgttatatggtttcacacatttggccgaaacacacgacggctattcagggggcattagcatgtacaaaagagatgagtttcttgttgtggtttcttcccttaactgtttaacatagctatgcgagtgcaagagggcagatgaaacattgatgttgtgatatttttgtatactcgattgttttgtaatatggttacgaggagcgttagagtttttttttttttaacactgcagcatgaggaggtagactactgtaactgctgtctgataacactgcagaaactggtggtagctgtaagaatggtgttccaagtttgaact

SEQ ID NO: 828 - DNA, 2542 bp, Pennisetum glaucum
ataatatccggtgttcaacctgggttgacaatggttgttggtcctcctggtacggggaaaacagatacagctgtgcagatattaaatgttctatatcataactgtcctcacaaaggacactgattataacccattcgaatcaggcttgaatgacttgttgagaagataatgcagagggatgtccctgctaggtaccttcttcgccttggtcagggtgagcaagagctagccactgatcttgatttagccgtcaaggtcgtgtcaatgctatgcttgtccgacggctagagctgctaggtgaagtttctaaattggcgagatctctccgtcttccagaagatgtgggttacacatgtgaaactgctgcatatttcggttattacatgtttatgctcgttgggaacaattcttagctgcctgtgcgcaaaatgaagataatcccacttttgtcaaagaccggttcccattttcagagtttttttcagatactccacagcctatttttaccggtgagtcttttgagaaagatatgcatgcagccaagggttgtttcaaacatctttcaacaatattccaagagctggaagagtgtcgggctttcgaactacttaagtcaacagtggagcgagcaaattatctaatgactaaacaggcgaagattgttgccatgacttgtactcatgcagcattaaagaggcgagactttcttcaattaggtttcaaatttgacaatttgctgatggaagaaagtgcacagatattggagatagaaacttttatccctatgctgctgcaacgacaggaagatggctatgctcgtcttaaacgctgcattttaattggtgatcaccatcaattaccccctgtggtgaagaacatggcttttcagaagtacagtcacatggaccagagtctgtttactaggtttgttcgtcttggtgtcccttatattgagctcaatgctcagggtcgtgcaagacctagtattgctaaactttataactggagatacagagagctgggagatctgccttatgtgcatgagcaagcgatcttccataaagctaatgctgggttctctttcgagtatcagttggttgatgttcctgattataatggcaaaggcgagtctgccccctctccttggttctatcagaatgaaggggaggctgagtatattgtcaatgtatatatctatatgcgtctgattggctaccctgccaataagatttcaatattaactacctacaatggtcagaagcttcttattcgtgatgtcataaacaaaagatgcaagccatggaatattgagccacctaacaaggttaccactgtggacaagttccagggtcagcaaaatgatttcattttactctctcttgtccggacccgttttgtgggccatctccgtgatgttaggagacttattgtggccatgtcccgtgctcgtctgggcttgtatgtgttctgccggcgttcactgtttgaacagtgttacgaattgcagccaacattccagcttctcctccaaagacccgataagcttgccttgaatcttgatgagtgcactccatttacagagcgacctttgggggaaactggaaatatctattatgttactggtattgaagacattgatcatctggttaagttcagactcgagcatcttcgtcagatgcaatatatgcagtattatgttcctccagcaaatgagctaccaccagcagcgccagaaaacattgctgatgtaatacctccagaaaacggcagtgttctgaatcagccaaaggaacacatggcaatggaagaaaatggtggcggaagtgacaccacagtcagtaacaggacggaggaagacgcagttgaggcaaaggatgaaacaatgcaggaaggaaacacgatgggtgaagggaatggtcacggtgatgttgctgcggataagggtgatgaacgtgctgatgcaaatgacaagatggaggaaggagatgccccgtcgaaggacaagatcgaggaagaaaattcagagccgtcgaaggacaagatcgaggaagaaaattcagagtcgaaggacaagatggatgaagagtgaggtatggtggtggccagtttggagattggcgaaggctgataacatgccccagccccctccccccggagacgtgggcagcaccaagattggcaaggtgacggacctatgttgctgcagttaatgatggtatgtcagcatgtgcagggaaatgttcaggcaacagtgtcttcatcatgtatcccacatgtgtttaaatggtgtaggagggttttggcagtttgtctgaatcactcggatatcagaggttcggagctacctttaattttttgcacaaaaaagtttcgtctaggagctctctccttgatatggctgctcgagcacacagccgtgacgtgattatgtaaccatgattgttgtaattttggcacgactagtgctgaatttttttttttgcagatttgatagccctactagactactgcggtcatgtgaaaggcatataaatgttgtgtt

SEQ ID NO: 829 - DNA, 2581 bp, Pennisetum glaucum
cagtgaggttcacacctacccagatcggtgctataatatccggtgttcaacctgggttgacaatggttgttggtcctcctggtacggggaaaacagatacagctgtgcagatattaaatgttctatatcataactgtccttcacaaaggacactgattataacccattcgaatcaggctttgaatgacttgtttgagaagataatgcagagggatgtccctgctaggtaccttcttcgccttggtcagggtgagcaagagctagccactgatcttgattttagccgtcaaggtcgtgtcaatgctatgcttgtccgacggctagagctgctaggtgaagtttctaaattggcgagatctctccgtcttccagaagatgtgggttacacatgtgaaactgctgcatatttttggttattacatgtttatgctcgttgggaacaattcttagctgcctgtgcgcaaaatgaagataatcccacttttgtcaaagaccggttcccattttcagagtttttttcagatactccacagcctatttttaccggtgagtcttttgagaaagatatgcatgcagccaagggttgtttcaaacatctttcaacaatattccaagagctggaagagtgtcgggctttcgaactacttaagtcaacagtggagcgagcaaattatctaatgactaaacaggcgaagattgttgccatgacttgtactcatgcagcattaaagaggcgagactttcttcaattaggtttcaaatttgacaatttgctgatggaagaaagtgcacagatattggagatagaaacttttatccctatgctgctgcaacgacaggaagatggctatgctcgtcttaaacgctgcattttaattggtgatcaccatcaattaccccctgtggtgaagaacatggcttttcagaagtacagtcacatggaccagagtctgtttactaggtttgttcgtcttggtgtcccttatattgagctcaatgctcagggtcgtgcaagacctagtattgctaaactttataactggagatacagagagctgggagatctgccttatgtgcatgagcaagcgatcttccataaagctaatgctgggttctctttcgagtatcagttggttgatgttcctgattataatggcaaaggcgagtctgccccctctccttggttctatcagaatgaaggggaggctgagtatattgtcaatgtatatatctatatgcgtctgattggctaccctgccaataagatttcaatattaactacctacaatggtcagaagcttcttattcgtgatgtcataaacaaaagatgcaagccatggaatattgagccacctaacaaggttaccactgtggacaagttccagggtcagcaaaatgatttcattttactctctcttgtccggacccgttttgtgggccatctccgtgatgttaggagacttattgtggccatgtcccgtgctcgtctgggcttgtatgtgttctgccggcgttcactgtttgaacagtgttacgaattgcagccaacattccagcttctcctccaaagacccgataagcttgccttgaatcttgatgagtgcactccatttacagagcgacctttgggggaaactggaaatatctattatgttactggtattgaagacattgatcatctggttaagttcagactcgagcatcttcgtcagatgcaatatatgcagtattatgttcctccagcaaatgagctaccaccagcagcgccagaaaacattgctgatgtaatacctccagaaaacggcagtgttctgaatcagccaaaggaacacatggcaatggaagaaaatggtggcggaagtgacaccacagtcagtaacaggacggaggaagacgcagttgaggcaaaggatgaaacaatgcaggaaggaaacacgatgggtgaagggaatggtcacggtgatgttgctgcggataagggtgatgaacgtgctgatgcaaatgacaagatggaggaaggagatgccccgtcgaaggacaagatcgaggaagaaaattcagagccgtcgaaggacaagatcgaggaagaaaattcagagtcgaaggacaagatggatgaagagtgaggtatggtggtggccagtttggagattggcgaaggctgataacatgccccagccccctccccccggagacgtgggcagcaccaagattggcaaggtgacggacctatgttgctgcagttaatgatggtatgtcagcatgtgcagggaaatgttcaggcaacagtgtcttcatcatgtatcccacatgtgtttaaatggtgtaggagggttttggcagtttgtctgaatcactcggatatcagaggttcggagctacctttaattttttgcacaaaaaagtttcgtctaggagctctctccttgatatggctgctcgagcacacagccgtgacgtgattatgtaaccatgattgttgtaattttggcacgactagtgctgaattttttttttgcagatttgatagccctactagactactgcggtcatgtgaaaggcatataaatgttgtgttaaa

SEQ ID NO: 830 - DNA, 2791 bp, Panicum virgatum
ttttaagatcaggttgtccaagaaaatgagggaaagcagtcatgccctacccggcaatgtgaactccagtttggctgttaagagcaacaataatatggctgatgacgagtctcagaaagagaaactaattgttgagacttacgttccagcagatcctgggccatatcctcaagataaacctaaacagaactcagttaggttcacacccacccagattggtgctataatatccggtgttcaacctggattgacaatggttgttggtccacctggtacggggaaaacagatacagctgtgcagatattaaatgttctatatcataactgtccttcacaaagaacactgattataacccattccaatcaagctttgaatgacttgtttgagaagataatgcagagggatgtgcctgctaggtaccttcttcgccttggtcagggtgagcaagagcttgccactgatcttgattttagccgtcaaggtcgtgtcaatgctatgcttgtccgacggctagagctgctaggtgaagtttctaaattggcgagatctcttcgtcttccagaagatgtgggttacacatgtgaaactgctgcttatttttggctattacatgtttatgcccgttgggaacaattcttagctgcctgtgcacagaatcaagataatccctcttttgtcaaagaccgcttcccattttcggagtttttttcagatactccacagcctatttttaccggtgagtcttttgataaagatatgcatgcagccaagggttgtttcaaacatctctctacgatattccaagagctggaagagtgcagagcatttgaactacttaagtcaacagtggaacgagcaaattatctaatgacaaaacaggcgaagattgtcgccatgacttgtactcatgcagcattaaagaggcgggactttcttcaattaggtttcaaatttgacaatttactgatggaagaaagtgcacagatattggagatagaaacttttatccctatgctgctgcaacgacaggaagatggctatgctcgccttaaacgttgcattttaattggtgatcatcatcagttaccccctgtggtgaagaacatggcttttcagaagtacagccacatggaccagagtctgtttacgaggttcgttcgtcttggtgttccttacattgagctcaatgctcagggtcgtgcaagacctagtatcgctaagctttataactggagatacagagagctgggagatctgccttatgtgcgtgagcaagcaatcttccataaagctaatgctgggttctcctttgagtatcagttggtcgatgttcctgattataaaggcaaaggcgagtctgccccctctccttggttctaccagaatgaaggggaggctgagtatattgtcaatgtatatatctacatgcgcctgattggctaccctgccaataagatttcaatattaacgacctacaatggtcagaagcttcttattcgtgatgttataaacaaaaaatgcaagccatataatattgagccacctaacaaggttaccactgtggacaagttccagggccagcaaaatgatttcattttactctctcttgtccggacccgttttgttggccatctccgtgatgttagaagacttattgtggctatgtctcgtactcgtctgggcttgtatgtgttctgccgccgatcgctgtttgaacagtgttacgaattgcaaccaacattccagcttctcctccaaagacctgatagacttgccttgaatcttgaggagtgcacaccatttacagagcgacctttgggggaaactggaaacatccattatgttactggtattgaagacattggtcatctggtgaagttcagactggaacatcttcgtcagatgcaatacatgcagtattatgctcctccggcaaatgagctacctccagcagtgccagataatattgctgctgtaatccctccagaaaatggcagtgttctgaatcagccaaatgagcacatggcagtggaagaaaatggtggtgcaaatgacaccacggtcggtaacaagatggaggaagatgctgttgaagcgaaggatgaaacaatgcaggaaggaaacaagatgtgtgaagggaatggtgatggtgacctggctgcgaaggataaggacgataaacatgctgatacaaatgacaagatggaggaaggagatgccatgtcgaaggacaagattgaggaaggaaattcagagccgaaggacaagatggatgaagagtgaggtatggtggcggccagtttagaaattgacgaaggctgataacatgcaccctggagacgtgggcagcaccaagatttgacaaggtgacatctatgttcccgtggttaatgatgatgaaggttgtttactaatggtcagcatgttcctgcggttcattaagggaaatgttcaagcaactgtgccttcatgtctataacatgtgtaggaggttttcggcagtttgtctgaatcactggaatatcagagctagccttagcgtgcacaaagaagtttcctcgtttagtgctctgtccttaacaaactgttcgagcacacagttgatttgtatacttgattgttgtaattttggcacgactagcgttagattttttttgcagataccgctgtcatgtgaaggcatataaattaagccaaatgtgaccgagaaaggttgttaattttttttaattacagtctgacaatttttttttgcttgaatctatgcgaatgcgcgactgttctcgcaac

SEQ ID NO: 831 - DNA, 5519 bp, Zea mays
ccccgccatgccgaaggtctttggcaccggcgtcttcgagttccggcacccccgagcggccgagtacccactacccgcggacgccgcccccgctacggctgcggcgcccgacaaagttcccgcatccaccggcggcggctccatcacgctcctcgacatccagcgggaccgcctcacccgcgtcgccaccgagcattggggcacggccgccgctgcggcggccttcgacgcggaccttgtcaggaagatctatggcactgagctccgcgtcgaggggaggggccggaaaactgtgccgctgcagcgtgttatgatcctcgaggtcagccagtaccttgagaactacctgtggccgcacttcgacccggttgacgcttccttcgagcacgtaatgtccatcatcctcatggtcaacgagaagtttcgggagaatgtggcggcttggacatgtttccatgaccggaaggatgcattcaaggggttcctgtggcgggttctcaagctcaaggaagagagcatggataaatctgggtgttgccaattctgtatgtatttcattttagacaaaacgaaagggctcttaatatggcagagaaaacaaattacctcctgtttatgataaattcatttcagagtttggaggacgagcttgtccgggaaacaatacttcagttagtaagcctaaagctgtggaataccctttcgtttggacgacttcagatggaactctgcctaaaccctgaattgattaagaagtggaccaaaatcagaagaagagaggcaaaggaagcgaaaaaggctgaccaacctatcaacccttctgaaatgctcgagaataagttccttaggaatttaattgaagaattcgtggagattctcaattcaaaggtcatactatccaatcaagatggtgctgaagaatctgtattgaatgagtctttcagtgggcaaattgacgattcttgcgttctatattgtgagagatttatggaatttttgattgacatgttaagccagcttcctactagacgatttttgaggcccctggttgctgatgttgctgttgttgccaagtgccacttaagtgcactctacactcatgaaaagggacggctttttgcacagttggtcgacttgctgcagttttatgaaggttttgagattaatgatcactctgggacacagctcggtgatgatgatgtcctgcaggcgcattattcccgtttccaagcttttcagttgctagcatttaaacaagtgcctaagctgcgagattttgccttgtccagtattggttcactccataagcgagctgacttaacaaaaaagttgcttgtcttgtcagatgtggagctgcaagatctggtttgtaacaagcttaagttaatctcagagaaagatccatgcagtgaaagacgcgattttcttattgaagtcctagttgctttttttgagaagcggcaatcccaaaaagatgcagtaaatgcacttcctttgtatccaaatgagcagatcatgtgggatgaaagccttgttcctagcattaattactctggagaaggctgtcttgccctcccaaaactcaatctccaattcctgacgcttcatgattatttgttaagaaatttcaatctgtttcgtcttgaatcaacctatgaaattcgtgaagacattcaggaagctgttcctcatctacatgcttatatcaataatgagggagagacagccttccgtggatggtcaagaatggctgttccgatcaagggatttaagattacagaagtgaagcagccaaacattggagaagttaagccttctgctgtaactgctgatgttactttcagcatatcaagctacaggtatcagataaaatctgaatgggatgctctgaaggagcatgatgttctatttttgctgtcaatccgcccttcatttgaacctcttagccctgaagaggctgaaaaatcaactgtgccagaaaggttaggattgcaatatgtacgtggatgtgaggttattgaaattcgtgatgaggaaggagcactcatgaatgatttcacaggaaggataaaacgagaagagtggaaaccacccaaaggtgaaattcgtactgtccgagttgccttagatacagcgcagtaccacattgatgttaccgagacagcagagaagggcacagaaaatgtgtatggaacatttaatattctaatgagaaggaaacccaaggagaataatttcaaagcaatcctggaatctatacgtgatctaatgaatgaaacatgtgtagttccagaatggttgcataacatattcttgggttatggaaatccttcggccgcacagtggatgaatatgcctgatcttctggaagttatagatttcaaggacacttttcttgatgccaaccatgttcagcaaagttttccagattaccaggttacatttatcaattctgatggtacaaaaaacctgcatccaagtcccccttttaaaatcaggctatccaagaaaatgagggaaagcagtcatgctttacctggcaacatgaactccaatttgactgttaagagcagaaataatatggctgatggggagcctcagaaagagaaactaattgttgaaacttacattccagctgatcctgggccgtatcctcaagataaacctaaacagaactcagtgaggttcacaccaactcagatcggtgctataatatctggtattcaacctgggttgacgatggttgttggtcctcctggtacgggaaaaacagatactgctgtgcagatattaaatgttctatatcacaactgtccttcacaaagaacactgattataacccactccaatcaggctttgaatgatttatttgagaagataatgcagagggatgtgcctgctaggtaccttctccgccttggtcagggtgagcaagaattggccactgatcttgattttagtcgtcaaggtcgtgtcaacgctatgctggtccggcggctagagctgctcggtgaagtttctaaattggcgagatctcttcgtcttccagaagatgtgggctacacatgtgaaactgctgcatatttttggctattacatgtttatgcccgttgggaacaattcttagctgcctgtgctcaaaatcaagacaaaccctcttttgtcaaagaccgcttccccttttcagagttcttttcagatactccgcagcctatttttaccggcgagtcatttgagatggatatgcatgcagcgaaaggttgtttcaaacatctttctacaatattccaagagttggaggagtgtagggcttttgagctacttaagtcaacagtggagcgagcaaactatctaatgactaaacaggccaagatagttgctatgacttgtactcatgcagcattgaagaggagggactttcttcaattaggtttcaaatttgacaatttgctgatggaagaaagtgcacaaatattggagatagaaacttttataccgatgctgctgcagcggcaggaagatggccatgctcgtcttaaacgttgcattttaattggtgaccaccatcagttaccccctgttgttaagaacatggcttttcagaagtatagccacatggaccagagtctctttacaaggtttgttcgacttggtgtcccttatattgagctcaatgcccagggtcgtgcaagacctagtattgctgaactttataactggagatacagggagctgggagatctgccttatgtccgtgagcaagcaatcttccataaagctaacgccggattctcttttgagtatcagttagttgatgttcctgattataagggaaaaggtgagtcagcgccttctccttggttttaccagaatgaaggggaggctgagtatattgttagtgtgtatatctatatgcgcctgattggctaccctgccaataagatttcaatattgaccacctacaatggtcagaagcttcttattcgtgatgttatcaacaaaagatgcaaaccatggaatattgagccccctaacaaggttaccactgtggacaagttccagggccagcaaaatgatttcattttactttctcttgtccgtacccgttttgtgggtcatcttcgtgatgtcagaagacttattgtagctatgtcccgtgctcgtctgggcttgtacgtgttctgccgtcgttcactgtttgaacaatgttacgaattgcaaccaacattccagctgctcctccaaagatctgataagcttgccttgaatcttgaggagtgcactccttttaccgagcgacctttggaggaaactggaaacatccattacattactggtattgaagacattaattcatctagtaaagttcaggctggaacatcttcgtcaagtgcaatacatgcagtattatgctcctccggcaaatgaactgcctcaagcagcaccagaaaatattgctgatgcaatcccttctgaaaatggcaatgctggaagggctctgaatgatggaaacgaggacatgacccgggaagaaaatggtggtgcaactgacacagtgatcagtaataggatagaggaagacagcgttgaggcaaaggatgacatgacacaggaaggggacaagggtgaagtgagtggcaagggtcacatggctacagaggataggaaaggggaagcacaaggtggcgcagatggcaagctggaggaagcaaatgtgatgtcggcggacaagatgatggaggaagcaaatgcgacgtcggcagacaagatggaggaagcaaatgccacgtcggcggataagatggaagaagcagatgccacgtcgtcggacaagatggaagaagcagatgccacattgccggacaagatggaagaagcagatgccacattgccggacaagatggaagaagcagatgccacattgccggacaagatggaggaagcaaatgccatgtcgccggacaggatggaggagaaaaattctgatccgaaggacaagatggatgaggagtgacgtggtggtgtaaccagttttgaaatagcggtagacttgttctgtcagccgcatatcttgatttggaacatcatgtattcacctgtgttaccgcagatgaagactgatacgtgctccccaagaggtgtagccttgtgggcagaatcaagatcgacatatgatgaccatgttcctgcggttaatggtggtgaaggctgttttccctaccatcttggccaggctatgctggaaaatgttccttctcttccagccaagggtatccatgtttccgcatgtgtttaatcgtgtaaactgtagaggattttttgggtagttttttctgaaacacccgttccatctatcgttgtctccgtaacataacacagctggaacgttgcttttgtatacttgactgactactataattttggcacaagcattagatttttgcagatttgataggccttatcggccattcaaaattttgatttgacagaccaactcacccagcctataaaagagaagc

SEQ ID NO: 832 - DNA, 5455 bp, Zea mays
atgccgaaggtctttggcaccggcgtcttcgagttccggcacccccgagcggccgagtacccactacccgcggacgccgcccccgctacggctgcggcgcccgacaaagttcccgcatccaccggcggcggctccatcacgctcctcgacatccagcgggaccgcctcacccgcgtcgccaccgagcattggggcacggccgccgctgcggcggccttcgacgcggaccttgtcaggaagatctatggcactgagctccgcgtcgaggggaggggccggaaaactgtgccgctgcagcgtgttatgatcctcgaggtcagccagtaccttgagaactacctgtggccgcacttcgacccggttgacgcttccttcgagcacgtaatgtccatcatcctcatggtcaacgagaagtttcgggagaatgtggcggcttggacatgtttccatgaccggaaggatgcattcaaggggttcctgtggcgggttctcaagctcaaggaagaggaaagggctcttaatatggcagagaaaacaaattacctcctgtttatgataaattcatttcagagtttggaggacgagcttgtccgggaaacaatacttcagttagtaagcctaaagctgtggaataccctttcgtttggacgacttcagatggaactctgcctaaaccctgaattgattaagaagtggaccaaaatcagaagaagagaggcaaaggaagcgaaaaaggctgaccaacctatcaacccttctgaaatgctcgagaataagttccttaggaatttaattgaagaattcgtggagattctcaattcaaaggtcatactatccaatcaagatggtgctgaagaatctgtattgaatgagtctttcagtgggcaaattgacgattcttgcgttctatattgtgagagatttatggaatttttgattgacatgttaagccagcttcctactagacgatttttgaggcccctggttgctgatgttgctgttgttgccaagtgccacttaagtgcactctacactcatgaaaagggacggctttttgcacagttggtcgacttgctgcagttttatgaaggttttgagattaatgatcactctgggacacagctcggtgatgatgatgtcctgcaggcgcattattcccgtttccaagcttttcagttgctagcatttaaacaagtgcctaagctgcgagattttgccttgtccagtattggttcactccataagcgagctgacttaacaaaaaagttgcttgtcttgtcagatgtggagctgcaagatctggtttgtaacaagcttaagttaatctcagagaaagatccatgcagtgaaagacgcgattttcttattgaagtcctagttgctttttttgagaagcggcaatcccaaaaagatgcagtaaatgcacttcctttgtatccaaatgagcagatcatgtgggatgaaagccttgttcctagcattaattactctggagaaggctgtcttgccctcccaaaactcaatctccaattcctgacgcttcatgattatttgttaagaaatttcaatctgtttcgtcttgaatcaacctatgaaattcgtgaagacattcaggaagctgttcctcatctacatgcttatatcaataatgagggagagacagccttccgtggatggtcaagaatggctgttccgatcaagggatttaagattacagaagtgaagcagccaaacattggagaagttaagccttctgctgtaactgctgatgttactttcagcatatcaagctacaggtatcagataaaatctgaatgggatgctctgaaggagcatgatgttctatttttgctgtcaatccgcccttcatttgaacctcttagccctgaagaggctgaaaaatcaactgtgccagaaaggttaggattgcaatatgtacgtggatgtgaggttattgaaattcgtgatgaggaaggagcactcatgaatgatttcacaggaaggataaaacgagaagagtggaaaccacccaaaggtgaaattcgtactgtccgagttgccttagatacagcgcagtaccacattgatgttaccgagacagcagagaagggcacagaaaatgtgtatggaacatttaatattctaatgagaaggaaacccaaggagaataatttcaaagcaatcctggaatctatacgtgatctaatgaatgaaacatgtgtagttccagaatggttgcataacatattcttgggttatggaaatccttcggccgcacagtggatgaatatgcctgatcttctggaagttatagatttcaaggacacttttcttgatgccaaccatgttcagcaaagttttccagattaccaggttacatttatcaattctgatggtacaaaaaacctgcatccaagtcccccttttaaaatcaggctatccaagaaaatgagggaaagcagtcatgctttacctggcaacatgaactccaatttgactgttaagagcagaaataatatggctgatggggagcctcagaaagagaaactaattgttgaaacttacattccagctgatcctgggccgtatcctcaagataaacctaaacagaactcagtgaggttcacaccaactcagatcggtgctataatatctggtattcaacctgggttgacgatggttgttggtcctcctggtacgggaaaaacagatactgctgtgcagatattaaatgttctatatcacaactgtccttcacaaagaacactgattataacccactccaatcaggctttgaatgatttatttgagaagataatgcagagggatgtgcctgctaggtaccttctccgccttggtcagggtgagcaagaattggccactgatcttgattttagtcgtcaaggtcgtgtcaacgctatgctggtccggcggctagagctgctcggtgaagtttctaaattggcgagatctcttcgtcttccagaagatgtgggctacacatgtgaaactgctgcatatttttggctattacatgtttatgcccgttgggaacaattcttagctgcctgtgctcaaaatcaagacaaaccctcttttgtcaaagaccgcttccccttttcagagttcttttcagatactccgcagcctatttttaccggcgagtcatttgagatggatatgcatgcagcgaaaggttgtttcaaacatctttctacaatattccaagagttggaggagtgtagggcttttgagctacttaagtcaacagtggagcgagcaaactatctaatgactaaacaggccaagatagttgctatgacttgtactcatgcagcattgaagaggagggactttcttcaattaggtttcaaatttgacaatttgctgatggaagaaagtgcacaaatattggagatagaaacttttataccgatgctgctgcagcggcaggaagatggccatgctcgtcttaaacgttgcattttaattggtgaccaccatcagttaccccctgttgttaagaacatggcttttcagaagtatagccacatggaccagagtctctttacaaggtttgttcgacttggtgtcccttatattgagctcaatgcccagggtcgtgcaagacctagtattgctgaactttataactggagatacagggagctgggagatctgccttatgtccgtgagcaagcaatcttccataaagctaacgccggattctcttttgagtatcagttagttgatgttcctgattataagggaaaaggtgagtcagcgccttctccttggttttaccagaatgaaggggaggctgagtatattgttagtgtgtatatctatatgcgcctgattggctaccctgccaataagatttcaatattgaccacctacaatggtcagaagcttcttattcgtgatgttatcaacaaaagatgcaaaccatggaatattgagccccctaacaaggttaccactgtggacaagttccagggccagcaaaatgatttcattttactttctcttgtccgtacccgttttgtgggtcatcttcgtgatgtcagaagacttattgtagctatgtcccgtgctcgtctgggcttgtacgtgttctgccgtcgttcactgtttgaacaatgttacgaattgcaaccaacattccagctgctcctccaaagatctgataagcttgccttgaatcttgaggagtgcactccttttaccgagcgacctttggaggaaactggaaacatccattacattactggtattgaagacattaatcatctagtaaagttcaggctggaacatcttcgtcaagtgcaatacatgcagtattatgctcctccggcaaatgaactgcctcaagcagcaccagaaaatattgctgatgcaatcccttctgaaaatggcaatgctggaagggctctgaatgatggaaacgaggacatgacccgggaagaaaatggtggtgcaactgacacagtgatcagtaataggatagaggaagacagcgttgaggcaaaggatgacatgacacaggaaggggacaagggtgaagtgagtggcaagggtcacatggctacagaggataggaaaggggaagcacaaggtggcgcagatggcaagctggaggaagcaaatgtgatgtcggcggacaagatgatggaggaagcaaatgcgacgtcggcagacaagatggaggaagcaaatgccacgtcggcggataagatggaagaagcagatgccacgtcgtcggacaagatggaagaagcagatgccacattgccggacaagatggaagaagcagatgccacattgccggacaagatggaagaaacaaatgtcacgttgccggacaagatggaggaagcaaatgccatgtcgccggacaggatggaggagaaaaattctgatccgaaggacaagatggatgaggagtgacgtggtggtgtaaccagttttgaaatagcggtagacttgttctgtcagccgcatatcttgatttggaacatcatgtattcacctgtgttaccgcagatgaagactgatacgtgctccccaagaggtgtagccttgtgggcagaatcaagatcgacatatgatgaccatgttcctgcggttaatggtggtgaaggttgttttcgctaccatcttggccaggctatgctggaaaatgttccttctcttccagccaagggtatccatgtttccgcatgtgtttaatcgtgtaaactgtagaggattttttgggtagttttttctgaaacacccgttccatctatcgttgtctccgtaacataacacagctggaacgttgcttttgtatacttgactgactactataattttggcacaagcattagatttttgcagatttgataggccttatcggccattcaaaattttgatttgacagaccaactcacccagcctataaaagagaagc

SEQ ID NO: 833 - DNA, 4663 bp, Prunus persica
cacattcgcaatgacgaaggtgtacggaacaggggcatacgatttcaagcgccaccatgtcgccgagtacccggtcgagcaaccccaccagcccggcgacaagccggttgaggccaaacccggttcagctctcccgagctctataaccttgtcggagattcagcgggaccgccttacgatgattgccgctgctaactggtccaaaaccggcgacacctcacaccccaagcaacccttggacccagagctggtgaaggagatctatcaaacggagttatcagttaaagagggtcagagaaagaccgtaccattacagagggtgatgattttggaggtcagtcagtacttggagaactatctatggcccaattttgacccggaaactgccacgttcgagcacgttatgtcgatgattctcatggtcaatgagaagtttcgagagaatgtggcagcttgggtatgcttttatgaccggaaagacgtgtttaagggattccttgagagggttcttcggcttaaatcgggaagagaattaagtatagcagagaagacaaattatctagttttcatgattaatgcctttcagagtttggaagatgaaattgtcagtgacactgtccttacgttagcaagtttggaatcatggcacagtttgtcatatggtcgttttcagatggagctttgttttaatccagatttgatcaagaaatggaaaaagatgataagaaaggaagccaaggaggctgcaaaacgaggagagccttttgacccctcaactacactcgaagttcagttcttgagaaacctaattgaagagttcctggagatacttgattccaaggttgtacccccagatcgtagtatcaatgaagatgatcaacttgttgaagctaatagactggagcatgttgatgatgcttgtgttttgtattgtgagaggtttatggaatttcttattgacctcttgagccaactaccaacaaggaggtacttgaggcctcttgttgctgatgttgctgttgttgccaaatgccacttgagtgctctgtatagacacgaaaaggggaaactctttgcacaattggtcgacttgctccagttttatgaagggtttgagattaatgatcatgatgggacacaactgacagatgatgaggtgcttcaatctcattatgatcgcgtccaatctttccagctacttgcctttaaaaaggttcctaagttgcgagagcttgcattggctaacattggttcaattgacaagcgcaatgatctctcaaagaaattgtctgtacttcctcctgaagaattgaaggatttggtttgttcaaagctgaaagtagtttcaaaggatgatccttggtcacagagggttgatttccttattgaagtcatggtttccttttttgagaagcagcagtctcaaaaagaaaaaataaatgctcttccactttacccaaatgagctgattatgtgggatgaaagccttgtgccaagcattaattactctggagaaggttgtctagcccttccaaaacttaatttacaattcttaacattacatgattatctcctcagaaatttcaatctctttcgtctcgaatcaacatatgagattcgtgaggatattcaggaagcggtgccgcatcttctttcctacattaataatgaaggagaaactgcttttcgtggttggtcaaggatggctgtgccgatcaaacagtttaggatcagtgaggtaaaacagccaaatattggtgaagtcaagccagctgctgtaacagcagaagttacttttagcgtttccagttataaagcacagataagatcagaatggaatgctcttaaagagcatgatgttctatttttactttctattcgcccttcctttgagcctctaagtgcagaggaggatgggagagccagtgtgcctcagaggcttggtcttcaatatgtacggggttgtgaaatcattgagattcgtgatgaggagggaactctaatgaatgattttactggaagaattaaacgggatgagtggaagcctccaaagggagaactgagaactgtgactgttgctttagatacagcacaataccacatggatgtcagcaacattgctgcaaaaggctcagaagatgtttatgggacattcaacatattgatgagaagaaagcccaaggagaataattttaaagcaattttagaatccattagagatcttatgaatgaatattgtattgttcctgactggttgcacaacatttttctgggatacggtaatccttctgctgcacaatggactaatatgccaggtcttttggccactgttgatttcaaagatactttccttgatgcagagcatttgaaggagtgttttccagatgatcaggtttcttttattagtccagatggtacagaaaacttgaatccaagccccccttttcgaataaggcttcccaagacgatcaaaagcagcactaatgctcttccagggaataagaaatctaccgattctatcagtgatggccctgtgaagaattctgatattgagaaagaaaaaattgttgttgaggcatacactcctcctgacccaggtccttatccccaagatcagccaaagaagaactcagttagattcacacccactcaggttggagcaatcatctcaggtattcagccaggactcacaatggttgtgggtccacctggtacgggaaagacagatacagctgtccaaattctgaatgttctttatcataattgtccatctcagagaacattgataatcactcattcgaaccaggctctcaatgacctttttgagaagataatgcagagggatgtgcctgcacgctatctgcttcgacttggtcaaggagaacaagagctagcaactgatcttgatttcagccgacaaggtcgtgtcaatgccatgcttgtgcggcgcttagagttgctaagtgaagtggagaggctggcaagatctctccagttgcccgaggatgtaggttatacttgtgaaactgctggttacttttggttgcttcatgtatactcgcgctgggagcaattccttgctgcttgtgtggacaataaagataaaccatcatttgttaaagatcgttttcccttcaaggagttcttctccaacacgccgaaaccagtctttacgggtgagtccttcgagaaagatatgcgggcagctaagggttgctttcgtcatcttaagactatgtttcaagagcttgaagagtgtagggcatttgaattactgaagtccactgctgatcgagcaaattacctgatgaccaagcaagcaaagatagttgccatgacgtgcactcatgcagctctaaagaggaaggatttccttcagttaggtttcaagtatgacaacttgctcatggaagaaagtgctcaaattttggagattgaaactttcattccaatgttgctccagaggcaggaagatggttatgcacggctgaaacgctgcatcttgattggtgatcatcaccagttgcctcctgttgtcaagaatatggcattccaaaagtacagccacatggaccagtctctctttacaaggtttgtccgtttgggcattccttatattgaacttaatgcccagggtagagccaggccaagtatagccaaactgtacaactggagatacagagatctgggagaccttccttatgtaaaggaggatgccattttccatagggcaaattctgggttctcctatgaatatcaattagtggatgtaccagattaccatgacagaggtgagtctgctccatcaccttggttctaccaaaacgagggggaagcagaatacgttgtcagtgtctatatctatatgcgtctacttgggtaccctgcaaataagatatccatattgaccacttacaatggccagaagcttttaatccgtgatgttatcaacagacgatgtgctccctatgacttcataggccctcccagcaaggttacaacagttgataaatttcaaggtcagcaaaatgatttcatattgctctctcttgtgcgtactcgctttgtgggtcaccttcgtgatgttagaagattgattgtagccatgtctcgtgcccgactgggtctctatgtgttctgccgccgttctttgtttgaacaatgctacgaacttcagcccacattccaacttctacttcagagacctgaccaccttgctcttaatttgaatgagatttcaccaaacacagaacgccacgttgaagacactggtcctatgcatcttgtcagcagtgttgatgagatgattggtatctaccaacagctttatgaggtaaagtttcatcagtacatggcttactcaggtcgagtagctccatccatagatgcatttgaggagaaaacaactcaggaaaatttgatatccgggcaacatcacatggatacagatatacctgtaacttccgatggggcaccagaggataatacccagcatggaagcaatttggaagaagacacaaaaatggatgcccttgcaaatggtcaaaatctggagtcatcactcgagaaccactcaaatggggggacagatgtggaagctggtggcggtgacagaaatgtgccacctgaaagcaattctgatgaaacaaatatggaagagtag

SEQ ID NO: 834 - DNA, 5080 bp, Fragaria vesca
agcagagtagtagtagtgatattaccgacgtcggaaaaaaaagaaaaagaatcggagaaccgactctgatgattacataaataccctccgagaccctttctctctcataaaccccaatcttcacaaaccctaaccctaacccaatctacagaaccctccccgcattcgtaaaaccctaattcggcaatgacgagggtctacggcaccggcgcgtacgatttcaagcgtcaccacgtcgccgagtacccggttggcgacaagccggtcgaggccaagcccggcgccgcgctcccgagctcgattaccttgtcggagattcagcgcgatcagctcaccgtgattgccgccgcgaactggtccagggtcggcgacgccaaggagaagaagccggcgtttgatccggagctggtgaagaggatttacgagacggagcttcgtgtgaaggagggggagaggaagacggtgccgttgcagagagtcatgattttggaggtcagccagtacttggagaactatctgttcccgaattttgatgccgaaacggccacgtttgagcatgttatgtctatgattcttatggtcaatgagaagtttcgagagaatgtggctgcttgggtgtgcttttatgaccggaaagatgcgtttaagggattccttggaagggttcttgggcttaaatcggaaagagaattaggtatagcagagaagacaaattatctagtattcatgataaatgccttccagagtttggaagatgagatagtcagtgagactgtccttagattggcaagtttccaatcctggcacagtttgtcgtatggtcgttttcagatggagcttggtttaaattcagatttgatcaagaaatggagaaggatggtaaagagggaagctgcaaaacatggagagtcttttaacccatcaactgcacttgaagtacagttcttaagaaatctcattgaagagttcctagagatacttgattccaaagtcttacggccaaatcatggtgtcaacggagaggatcaacttcttgatgttaatggaatggaacacgttgatgatgcttgtgttttgtactgtgagaggtttgtggaatttcttattgacctcttgagccagctaccaacaaggaggtacttgaggccacttgtagcggatgttgctgttgttcccaaatgccacttgagtgctttgtatagacatgaaaaggggaagctctttacccaacttgtcgacttgctacaattttatgaagggtttgagataaatgataatgttgggaaacaattgactgatgatgaagtgctccaatctcattatgatcgcgtacaatctttccagctgcttgcttttaaaaagattcctaagttgaaagagcttgcattggctaacattggttcaattgacaaccgaaatgatcttaccaagagattgtctgtactttctcctgaagaattgaaggatttggtttgctcaaagttgaagctgatttctaagaatgatccttggtcatccagggttgatttccttactgaagtgatggtttcctttttcaagaggcaacagtctcaaaaagagaaaataaatgctcttccactgtatccaaatgagctgatcatgtgggatgaaagccttgtgccaagcattaattactctggagaaggttgtctggctcttccaaaacttaatctacaattcttgacgctgcatgattatctcctgagaaattttgatctcttccgtcttgaatcaacatatgagattcgtgaggatattcaagaggctgtgccacatcttaatgcctgcattaataatgagggagaaactgttttccgtggttggtcaaggatggctgtgccgattaaagaatttaagatcagtgaggtaaaacagccaaatattggagaagttaagccagctgctgtgacagctgaaatcacttatagtatatccagttataaagcacaggtgcgatcagaatggaatgctcttaaagagcatgatgttctatttttactttctatacgcccttcctttgagcctctaagcgcagaagagggtgctaaggctagtgtgcctcagaagcttggtcttcaatatgtacggggttgtgaaatcattgaggttcgtgatgaggaaggaactctaatgaatgatttcactggaagaattaaacgggatgagtggaagcctccaaaaggagaattgagaactttgactgttgctttggatactgcacaatactacatggatgtcagcaacactgctgcaaagggtgcagaagatgtttatgggacattcaatattttgatgagaagaaagcccaaggaaaataatttcaaagcaattttagaatctattagagatcttatgaatgaatattgtattgttcctgactggttgcacaaaacatttctggggtatggtaatccttctgccgcacaatggactaatatgccagatctcttagaaacagtagattttaaggatactttccttgatgcggaccatctgagggagtgttttccagactatcaggtattctttgtgagtccagatggtacagaaaatatggatccaaggcctccttttcgagtaaggcttcccaagacgatcaaaagcagcactaatgctcttgcaggcaataagaaagcaaagatgagttctatgagtgatgtccccattgaggactctgataaggggaacgaaaaatttgttgttgaagcatacacccctcctgacccaggtccatatccccaagaccagccaaggcagaactcagttaggtttacacccactcaggttggagcaatcctctcaggtattcagccaggactaacaatggttgtgggtccacctggtacgggaaagactgatacagctgtgcaaattctgaatgttctgtatcataattgtccatctcagagaactttgataataactcactcgaaccaggctctgaatgacctttttgaaaagataatgcagagggatgtacctgcacgctatcttcttcgacttgggcaaggagaacaagagctagcaactgatcttgacttcagtcggcaaggccgtgtcaatgccatgcttgtgaggcggttggagttgcttagtgaagtggagaggctggcaagatctctccaattgcctgaggatgttggttatacatgtgaaactgctggatacttttggttgcttcatgtatactcgcgctgggagctattcctggctgcttgtaacgaaaataaaaataaacagtcatttgttaaagatcgatttcctttcaaggaattcttctccgactctccaaagccggtttttactggtgagtcattcgagaaagatatgcgagcagctaagggttgctttcgtcatctaaagactgtgtttcaggagcttgaagagtgtagggcttttgagttactgaagtctacagctgatcgagcaaactacttgatgactaagcaggcaaagatagtagccatgacatgcactcacgcagctctgaagaggaaggatttcctccagttaggtttcaagtatgataacttgctaatggaagaaagtgctcaaattttggagatcgaaacttttattccaatgttgctccagaggcaagaagatggttatgcacggcttaaacgttgcatcctgattggtgatcatcaccagttgcctcctgttgtcaagaatatggcctttcaaaagtatagccatatggaccagagtctctttacaaggtttgttcgtttgggcattccttacattgaacttaatgcccaaggtagggccaggccaagtatagccaaactttacaactggaggtatagagaattgggagaccttccctatgtaaagcaagatgccattttcaaaagagcaaattctggattctcctttgaatatcagttggtggatgtaccagattaccatgacagaggtgagtctgccccatcaccttggttctaccaaaatgagggagaagctgaatatgttgtcagtgtgtatatttacatgcgtctacttgggtatcctgcaaacaagatatcaatattgaccacttataatggccagaagcttttaatccgtgatgttattaacagacgatgtgctccgtacgacttcataggccctcccagcaaggtgaccacagttgacaaatttcagggtcagcagaatgattttatattgctctctctggtgcgtactcgctttgtgggtcaccttcgtgatgttcggagattgattgttgccatgtctcgtgcccgattgggtttgtatgtgttttgccgccgttctttgtttgagcaatgctatgaacttcagcctacattccaacatttacttcagagacctgattgccttgctcttaattttaatgagactacaccacacacagaacgccatgttgaagaaacggggcctgtccatcttgtaagcagtgttgatgagatgatcagtatctaccagcagctctatgcggtgaagtttcatcagtatgtggctccttcaattctgcaaacatctatgtctgggcaggatcctatggatgcagatatccctgtatctgctgatggggtgccagatgatacaccgcatgtaagcaattcggaactggaggacaacggccgaaaagtggattcgtcagttgagaatcattcaaatggggtgacagaaatggaaactagtctggatgatgctcatgtggttcccgaaagcaattcagaccaagtgagaatggaagagtagtctagcaaatggtagggaatttgtttttcttggttgctaaatctgctttagattttgagttcggttcctagagtgtacggcattggtagccagagatgaagtatatgaaggccaacatgccacacttcagttttgtcactgtttgtgggattgaaatcactaatttgagtgaacatgtattctgtacagagaatcttataaaatttcgtgtaccaaaagaattgatacttacggttcatcttttctgaggtaatgtactgaaatctcaacatgaattcttgtctcagttcctctcatcaaagaagaggacacatctgatgctcaggtt

SEQ ID NO: 835 - DNA, 5173 bp, Manihot esculenta
acgcccctcatttatccactaaacccccaaatctcaaaatcctaaacctaatttcaatctcaataacctgcagtctgtctattgtgccactccgaaattgcacatgagagaaccccgataattttcgattacagctatcacaatgaccaaggtgtatggtaccggcgcgtacgatttcaagcgccaccatgtggccgagtatccggtcgaggttcaaacccaccttggcgacaaacctgtcgagtccaaacccggttctacccttccgaactcgataacactctcggagattcaacgcgaccagttgacgaagattgcagctgcgaattggctgcagaccggtggtacggggtccgaggagaagaagaatgatttcgatcctgagcttgtgaagcagatatacgaaacggagttgaaggttaaggacggaaggaagcccgtgcctttgcagagagtgatgattttggaggtcagccagtatttagagaattatctgtggccgaattttgatccagaaaccgcgacatttgagcatgttatgtccatgattcttatgataaatgagaagtttcgagagaatgtggcagcttggttatgtttttatgatcggaaagatgtcttcaaggaatttctggagagggttattcgactgaaggaggggagagagttgagtatagcagagaagacaaattacctagtttttatgattaatgcttttcagagtttggaagatgagattgtcagcgagacagtcctgaaattaggaagtttacagtcatggtacagtttgtcatatggtcgatttcagatggagctttgtcttaatacggatttgatcaagaaatggaaaaggatgattaagagggaggctaaggaggcaatgaagcaaggagagctttttgacccctcaacttctcttgaagtgaagttcttgagaaatcttattgaagagtttcttgatgtgcttgacttccaagtttttccccatagtagctctcttagtgaagatggacttgatattggttttgagggagttgatgatgctgcagttttatattgtgagaggttcatggaatttcttattgatctgttgagccaactgccaacaaggaggtacctgaggccccttgttgctgatgtagctgttgttgcaaaatgtcatttaagtgctctttacagacatgaaaagggaaagctatttgcacagctagttgacttactgcaattctatgagcggtttgagatcaacgatcatgttgggacacaattgactgatgatgaggtgctccaatctcattatgatcgattccaagcttttcagcttcttgcctttaagaagattcctaagttgcgagaacttgcattgtctaatattggtgcaattcacaagcgagctgatctctccaagaagttgtctgtgctctctccagaagagttaaaggacttggtttgttataagctcaaattggtttctgacagagacccttggtctaaaagagttgattttcttattgaagtcatggtctccttctttgagaaacagcagtctcagaaagaagctattaatgctcttccgctctacccaaatgagcagatcatgtgggatgaaagtgtcgtaccaagcattaattactctggagaaggctgcctggcactcccaaaacttaatctgcaattcctaactctacatgattaccttctaagaaatttcaatctcttccggctcgagtctacatatgagatccgtgaggacattcaggaagctgttccacacctccttgcgtacatcaataatgaaggagaaactgcatttcgtggttggtcaagaatggctgtgccaataaaagaatttaagattactgaggtcaaacagccaaatattggtgaagtcaagccctcatctgttacagctgaagttacttttagcatttctagttacaaagcacaaataagatcagagtggaattccctgaaggagcatgatgttctatttttgctttcaattcgtccttcatttgagcctcttagtgctgaggaagctgggaaggctactgtgccacagcggcttggtctccagtatgtacggggatgtgaaattattgagattcgtgatgaggagggaacgctcatgaatgatttcactggaagaattaaaagggatgagtggaagccaccaaaaggtgaactcagaactgtgactcttgctttagatacagcacaataccacatggatgttactgatatagcagagaaaggtgcagaagatgtttataagacatttaatgtattgatgaggaggaaacctaaggaaaataacttcaaagcaattttagaatccataagagatctcatgaatgaatattgcattgttcctgactggttgcacaatgtatttctcggctatgggaatccttctgcagcacagtggaccaatatgcctgatcttcttgaaacagtagacttcaaggatactttccttgatgcagaccatttaaaggagagttttccagattaccaggtatgttttgtgaatccagacagtacagagagcttgaatccaaaacctccttttcgaattaggcttcctagaacaatgaaaggcaacactcatgcagtcccaggaaataagaaattaagtattgattcaatgaatgatgccaacatggaggatgccggaagtgagaaagaaaaacttattgttgaggcatatattcctcctgatccagggccatatccccaagatcagccaaaacagaattcagtcagatttacacccacacagattggagcgatcatatctggtatccagccgggactaactatggttgttggaccacctggtacgggaaagactgatacagctgtgcaaattttgaatgttctctatcacaattgcccttctcaaagaacattaataatcactcattcaaatcaggctctaaatgatctttttgagaagataatgcagagagatgtacctgcacgctatcttcttcgactgggtcagggtgaacaagaactagcaactgatcttgatttcagcaggcaaggtcgtgttaatgcaatgcttgttcgacggttagaactactaaatgaagtggagaggcttgcaagatcactccaacttcctgaggatgttggttatacttgtgaaactgctgggtacttttggttgcttcatgtatactcccgttgggaacaattccttgctgcttgtgaggataacaaagataaaccgacatttgttcaggatcgttttccctttaaggaattcttttccaacatgcctcagccagttcttacaggtcagtcatttgagaaagacatgcgggcagctatggggtgctttcgacatctcaagactatgttccaagaactagaagaatgtagggcctttgaactgcttaaatcaacagctgatcgagcaaattatcttatgaccaagcaagccaagatagtggcaatgacgtgcacccatgcagcactgaaaaggaaggactttcttcagttaggtttcaagtatgacaacttgttgatggaagaaagtgctcaaattttggagattgaaacctttatcccaatgttgctgcagaggcaggaggatggctatgcacggctaaagcgctgcatactgattggagatcatcatcagttacccccagttgtaaagaatatggcttttcaaaaatatagccatatggaccagagtttatttaccaggtttgtacgtctgggtattccttacattgaactcaatgcccagggtagagccaggccaagcatagccaaactttataattggaggtaccgggatttgggggaccttccttatgtgaaagagggggccatcttccataaagctaatgctggattctcctatgaatatcagttggtggatgtgcctgattaccatggcagaggtgagactgcgccttctccttggttctaccagaacgagggagaggctgaatatgttgtcagcgtctatgtctacatgcgtttattaggatatcctgcgaacaagatttcaatattgactacttacaatggccagaagcttcttattcgtgatgttattaatagacgatgtgttccatatgacttcattggaccacctagtaaggttacaacagttgataagtttcaagggcagcagaatgattttattttgctttctcttgtacgtactcgctttgtgggtcaccttcgtgatgttagaagattggttgttgccatgtctcgtgctcgacttggactttatgttttctgccgacgttctctatttgaacaatgctacgaattgcaacctacatttcaacttttgcttcagagaccagaccaccttgcactgaatttgaatgagaatttgtcacacacagaacgtcctgttgaagatgttggacaaccctatcttgtctctggcgttgaggaaatgggccacatcgtaattgataaaatcaatcaattgtatcaggcaaggatgatgaactatcagtttgagcagtattattcatctaatacgtctgcacctgcaaatggtgcctgggataatacgcagcatgaaagcaagtcagaggaagttgaagagatggaaggcattgaaagtggtcaaaatgaggatttgcctcttcagggcaaaccagatggggaaagggatgcagaaatgggtagaaatgatgaaaatggtgtaccatctgaaagcacaaatgaggaaacagacaaagtttagtatcttatggcctgagatgaattgctattctcacagttgcagccgttggtatattggttggtcaatctatcccagctggtgaacattgttcgacttcctcaagtcgttttacacgacttggggtgaactgaggcgaggtactagctttgctgcagcatcacatggtaaatgcagatttcatcaagtctaattgtgaagtgcggtaatcttggagaagtaaaaggcgttgtatctaagcaggaaacctggaagccaatgggcttaccattcaccaaacctgtaatgttacaccaatactaaatagaatagggaaacctttgaaagagagctggcagaagttagtggaaacttgtagaatagttgtcctgaaaaatagattcccatttatatgtgccttgtaggaaaactggtttttcttttaatttttttttaaagaattgaatt

SEQ ID NO: 836 - DNA, 5582 bp, Theobroma cacao
ggcaacaatatcacccccaaggtccttaaacatcaaaaaccttccgagtcttcgttcaaatcatgcattgcctcaaagcgaacgggtaatccattcatgctcgcccattcaaccttttctttttgtaacttccttctccattttcattagcaattttaaattatcaccaaaaccctaaccctatccctaaaactcaccaacttcacccaatgacaaaggtccacggaaccggcgtttacgacttcaagcgccaccatgtggccgagtacccagtcgagttcactgaccaactggactcaaaatccggccccggttcatcccttcccagctctattactttatctgaaatccagcgagaccagctgactaggatagccacggcaaattggctaaagagtggcggttcgaagcctaacaagcctttcgatcctcagctagttaaggagatttatgacacggagcttactgtgaagtcggaggggaagtcgcagaggaagacggtaccgttgcaaagggttatgatattggaagtcagccagtatttggaaaattacttgtggccgaattttgatgctgagacggcgtcctatgagcatgttatgtccatgattttgatggtcaatgagaagtttcgagagaatgtggctgcttggtcatgcttttatgatcagaaggatgtgttcacaggattccttgggagggtccttcggctgaaggagggaagagatttaaccattgcggagaaaacgaattatctagttttcatgatcaatgcttttcaggggcatgcaattgctggtgagcaacatcctgtccaccaccaactgcaccctatacctgcccattcaggaaacaggcaccaaatttatcagtgcatgagtttggaagatgaaattgttagggaaactgtccttagattggcaagtttgcgatcctggcacagtttgtcatatggtcgttttcagatggaactttgtcttaatcctgatttgatcaagaaatggaaacgaatgataaagaaagaagctgatgatgctaagaagcaaggcgtacatgttgaccccttatcttcattggaagtaaactttttgagaaatctgatagaagagtttcttgaggtgcttgatcacaaggtgttttccaggaagcattctgttaatgaagatgatgaacttgatgctagtagttttgagcaagttgatgatgcttctgtcttgtactgtgagaggtttatggaatttctcattgatctattgagtcaactgccaacaaggaggtacctgagacctcttgtggctgatgtagctgttgttgccaaatgccatttaagtgctctttatagacgtgacaaagggaaactctttgcgcaacttgtggacttgctacagttctatgaaaattttgagataaatgatcatgttggcactcagttgacagatgatgaggtgcttcaatctcattatgatcgtcttcaatccttgcagctgcttgcttttaagaaaattcctaagttgcaagaacttgcactggccaacattggtgcaacacacaagcgtgcagatctctcaaaaaaattatctgtactttctcctgaagaattaaaggacttggtttgctgtaagatttaccatttttcttttcagctcaaactggtctcgaagaatgatccttggtcagatagggttgattttctcattgaggtgatggtctccttttttgagaaacagcaatctcaaaaggaagccataaatgctcttcctctctacccaaatgagcagattatgtgggatgaaagtgttgtgccaagtattaattactctggtgaaggttgtctagctcttccaaagcttaacctacaattcttaacactccatgattatcttctaaggaatttcaatctcttccgtcttgaatctacatatgaaattcgcgaagacattcaagaagctgttccgcaccttcttgcctacatcaataatgagggagaaactgcttttcgcggctggtcaagaatggctgtgccaataaaagagttcaaaatcactgaagtaaagcagccaaatatcggcgaagtcaagccggcttctgtaactgcagaggttacctacagcatttctagttatagatcacaaataagatcagaatgggatgcccttaaggagcatgatgttttgtttttgctatctattagcccctcatttaagcctctaagtgcagaggaagatgctaaagctagtgtaccagagaagcttggccttcaatatgtacggggatgtgaaattattgagatccgtgatgaggagggaactctcatgaatgattttagtggaagaactaaacgtgaggagtggaagccaccaaaaggtgaactaagaactgtgactattgctttagatactgcacaatatcacatggatgtgactgacattgctgaaaaaggtgctgaagatgtttatgggacatttaatgtgttgatgaggaggaagcctaaggaaaataacttcaaagcaattttagagtctatcagagatcttatgaatgaatattgtattgttcctgattggttgcataaaatatttttgggctatgggcatccttctgctgcacagtggacaaatatgcctgatcttctagaaacagtggatttcaaagatacttttcttagtgcagaccatttgaaagagagttttccacattatcaggtctactttgttgattcagatggtagagaaaatttggatccaaggccaccttttcgtatcaagcttcctcagttgcttaaaagcgatactcatgctctgtcaggaaatggaatatctgatactggttcagtgaatgatgccaatacagtgcatgcttgtattgagaaagaaaaactaattgttgaagcatacatccctcctgacccaggtccttatcctcaagatcaaccaaaacagaactcagttagatttacacctacccagattggagcgatcatctcaggtattcagcctggattaactatggttgtgggtccaccaggaacgggtaaaactgatacggcagtgcaaatattgaatgttctctatcacaattgtccttctcagagaacattaataattactcattcaaatcaggctttgaatgacctttttgagaagataatggagagagatgtgcctgcacgctatcttcttcgtcttggtcaggaattgcttagtgaggtagagaggcttgcaagatccctacaacttcctgaagatgtaggatatacttgtgaaactgctggatatttttggttgcttcatgtgtattcacgctgggagcaattccttgccgcttgtgcgggtaatgaagataaaccagcattcgttcaagaccgctttcctttcaaggagtttttctccaacactcctcaggcagtctttactggccaatcatttgagaaagatatgcgagcggccaaggggtgctttcgtcatcttaagactatgttccaagagcttgaagagtgcagggcatttgaattgctcaaatcaacagctgatcgagcaaattacctgatgaccaagcaggcaaagattgtggctatgacatgtacgcatgctgccctaaagagaaaggatttccttcaacttggtttcaagtatgacaacctgttgatggaagaaagtgcccagattctggagattgaaacttttatcccaatgttgctccaaaggcaggaagatggctatgcacggcttaaacgttgcatattgattggtgatcatcaccagctgccccctgttgtgaaaaatatggctttccaaaagtacagccacatggatcagagtttgtttacaaggtttgttcggctgggtattccttacattgagcttaatgctcagggtagagccaggccaagtatagcccaactttacaactggaggtaccgggatttgggggaccttccttatgtgaaagaggaacctatcttccatagagcaaatgctggattttcctatgattaccaactagtggatgtgcctgattaccatgggagaggtgagactgccccctctccttggttttatcaaaatgaaggggaggctgaatatgttgtcagtgtctatatatacatgcgattactgggctaccctgcaaataaaatttccatcttgacaacttacaatggtcagaagcttctgattcgtgatgttatcaacagaaggtgtcttccatatgatttcattggtccacccagtaaggttaccacagttgataagtttcaaggccagcaaaatgattttattttgctttctcttgttcgtactcgctttgtcggtcaccttcgtgatgttcgaagattggtggttgccatgtcacgtgctcgccttggcctgtatgtcttttgtcgacgctctctgtttgaacagtgttatgaactccagcctactttccacctgctgcttcagagacctgatcatcttgctctaaatttgaatgagagcacgtcatttactgaacgacatgttgaagacattgggcatccatatcttgttggtggtgttgaggagatggcaaacgtagtttatgggaaaataaatcaattacaacaggcacgtgccatgtatcagtacatggcttattctggacaatacatgggaacatcagaggagcaaaatagtgagcacaattcaatatccccaaaccaggccatggacattgatacatcagtggctgaaaatggtagaattgatgacaatgtacatgaaaacaatggagaggaagctaaagatgtagatggtcttgcaaatggtccagatggggtgctacctccagagaacctgtcaaatgcagaaaaagatgctgaagtttgtgcaaatgatgaaaacagggtgccctagttaagaaagaaaatgatgcacttcagccttctttccttgagttgcacaggtagccaacaagcatcggtgaagacagtgctttttccttaatcagagagaactgctgctttcctccagatgtggcttagctatagatctacatagctgctgttcatatggaggtgttagagctataagctacttgctttccggaccttggggtgacatgttgaaaggtaaagtgttttggatccttctattcgtgcggtttaaagcttcttgctgacaaaggagtaaaaaagggtcatgaaagtgatgaaagggacattttgaagattcactaagtttcaattgcatcatgtgggagtaaaaaggtacaagaccagattttggggcttaatttttgtctaattgtttatctcctagtaaacgaaaatgattaaagtttggtgtatggtaacgggccatggtgaagcttttgtgtattgtattgtagtgatgaccttatttgcttaacttaatttagtgtagtcatcagataacagagactattgattctcattgccctcggagtgctttgacttaaattttaactagtgcctacatacaccttaaccagatccattttatcatacctctatagcaagtcaactgggcttatgttggtctgtctttgtagtgtacttgggtttgtctttgttaatggttttccaatcaaatttttaactatac

SEQ ID NO: 837 - DNA, 2469 bp, Quercus alba
tagtcagaactcagttagatttacactacacagattggagcaatcatctctggtattcagcctggactaactatggttgtgggtccacctgtacgggaaaaactgatacagctgtgcaaatcctgaatgtgctttatcacaattgtccttctcagcggacattgataatcacacattcaaatcaggctttgaatgacctttttgagaagataatgcagagggatgtacctgcacgttatctactccgtcttggtcaaggagaacaagaactagcgactgatctcgattttagtaggcaaggccgtgtgaatgcaatgcttgtccgacggttagaactgcttggtgaagtggagaggttggctagatctcttcaactgcctgaggatgtaggttatacatgcgaaactgctggatatttctggttgcttcatgtatactctcgctgggaacaattcttggcggcttgtgctgagaatgaagataaaccaacatttgttaaagaccgctttcccttcaaggaatttttctctgacactccgcatccaatttttatgggtgagtcttttgagaaagacatgagagcagctaaggggtgctttcgtcatcttaagaccatgtttcaagagcttgaagagtgtagggcatttgaattgctcaagtcaacggctgatcgagcaaattatctcatgaccaagcaggcaaagattgttgcaatgacttgcactcatgcagctctcaagaggaaggactttcttcagctaggtttcaagtatgacaacttgttgatggaagaaagtgcccaaatattggagattgagaccttcatcccaatgttgctccagaggcaagaagatggttatgcacggcttaagcgctgcatcctgattggtgatcatcatcagttgcctcctgttgtgaagaacatggctttccagaagtatagccacatggatcagagtctatttacaaggtttgttcgtctcggcattccttatattgagctcaatgcccagggtagagccaggccaagtatagccaaactgtacaactggaggtacagagatttgggtgaccttccttacgtaaaggaggatgctgtcttccatagagcaaatgctggattctcctatgagtatcagttagtggatgtgcccgattaccaaggtagaggtgaaagcgccccttccccttggttttatcaaaatgagggagaagctgaatatgttgtcagtgtctatatgtacctgcgtttacttgggtacccagcaaataagatatccatcttgacaacttacaatggccagaaacttttgatccgtgatgttatcaatagaagatgtgttccatatgacttcattggtccacccagcaaggttacaactgttgataagtttcaaggtcagcaaaatgattttatattgctgtctcttgtgcgtactcgctttgttggtcaccttcgtgatgttagaagattggttgttgccatgtctcgtgcccgacttggtttgtatgtgttttgtcgccgatctctgtttgaacaatgctatgaactgcagcctacatttcaacttctgcttcagagacctgatcgccttgccctcaatctaaatgagatcacatcatatacagaacgacatgttgaagacactggacctatccatcttgtcagtggtgttgaggagatgattagcatttttaactggaggtatcaggaacgatacatgagtcatcaatttgatcattatatgacctactcgggacaaaatgatcaacaaaattcaacaactttgttcaatgccatggacaccgatacaccttctgtgcaacatgaaagcagcatggaagaggatactaggatagatggggatgttctgcctgcaagtcattcaaatggggaagtagataaggaagctagtaaaaatgatgaaaatgataggcaacctgaaagcagcaattcaagtgaggaaaatatgacggagtagtgtagttaatagtgcttctcacaggagtcctcttcttttgctaattttaaatgatctggaggttcagttttatgtcaatcacaatcatggcaaccagccaatgcctttcctaaaactgaggtattaagataataactgcagaaactaggtctcaagtccttcattggtgtttaggtgaaaaacttggaactcaaaaataggcctggaagttgtgagactaaactactgaagagcaagcacgtcatgtggcagaaagaaaagatgcatgttgcatatcaaaatatgtttcagctgtacagtgccaaatttgttgaacatttttatatcctgagataggaaattatctgttcctgctgtctataccaaatactaattgtaagtaaagcatcatgcaattttgggcttagctaatgttgttgctaatttaatccaactatgactatgccttttttcttactaatggtggaaaatgttatcattgtacact

SEQ ID NO: 838 - DNA, 2811 bp, Cajanus cajan
tttaatgaatgaatattgtattgttcccaagtggttggaaaacatttttcttggttatggagatccttcagccgcacagtggactaatatgcctgaccttttggagacagtagatttcaaagatacttttgttgatgctgatcacttaaaaggaagttttgtggattatgaggtgtcttttattaatcctgatggcacagaaaatttgaatccaaggcctccttttaagatcaaacttccccgaacactgaaaccaagcaatggtgctcctactggtggaacaactggtatcaacacggttgatgctaattgtcagaaagaaacactgattattgagacatatactcctccagatcctggtccttatcctcaagatcagcctaaacaaaattcagttagatttacacccattcaggttgaggcaattatttctggcattcagcctggtctaactatggttgtagggccacctggtacaggaaagactgatacagccgtacaaattctgaatgttctttatcataattgtccttctcagagaaccttaataattactcattcaaatcaggctttgaatgatctgtttgagaagataatgcagagagatgttcctgcacgttatcttcttcgacttggtcaaggagaacaagagctagcaactgatcttgatttagtcggcaaggtcgtgttaattcaatgcttgtcaggcggttagaattgttgagtgaagtggagaggctagcaagatctcttcaattgccagaggatgttggttacacttgtgaaactgcaggatacttttggttgcttcatgtttattcacgctgggagcaatttcttgccgcttgtgctgagaataaagaaaagccaacatttgttcaagatcgttttcccttcaaagagttcttctctgatacaccacatcctgtatttacaggtgagtcttttgagaaagacatgcgggctgctatgggttgctttcgtcatcttaagaccatgtttcaagaacttgaagagtgccgggcattcgaattactcaagtcaacagctgacagggctaactacttaatgaccaagcaggctaagattgtggcaatgacttgcacccatgcagctctaaagaggaaagatttcctccagttaggttttaagtatgacaacttgttaatggaagaaagtgcccaaattttagaaattgagacttttattccaatgttactccagcgtcaggaggatggtcatgcacggcttaaacgctgcattctgattggtgatcatcaccagttgcctcctgttgtaaagaatatggcttttcagaagtacagccacatggatcagagtctatttactaggtttgtccgtttgggcattccttacattgagctaaatgctcagggaagagccaggccaagtatagctaaactttacaattggagatacagagatttgggagatcttccttctgtaaaggaggaaatcatattcaacagggcaaatgctggatttgcttatgattatcagttagtggatgttccagattaccttggtaagggggagacgactccatctccttggttttatcaaaatgagggagaagcagaatatgttgtcagtgtttatatatacttgcgtcttttagggtatcctgcaaataagatatcaattttgactacttacaatggtcagaaacttctcatccgtgatgttataaataggagatgcattccatatgacttcattggtcctccaagcaaggttactacagtggataagtttcaaggtcaacaaaatgattttatattgctgtctcttgtgcgtactcgatttgttggtcacctacgtgatgtaagaagattggtggttgcaatgtcacgtgctcggcttggtttatatgtcttttgccgtcgttccctttttgaacaatgctatgagctgcaacctacgtttcaactgcttcttaaaaggcctgaccaccttgcccttaatatgaatgagattacatcatatactgtgcgagatgttgaagatcctggaccaatacatcatatacatcttgtcagtggcattgaggagatggctagtatcatagatagtctgtatcaggaaaagttgagacaccagtttcatcaaaatgggccttattttagtcatttagaaccatcagaaaatacagatgaggtgcaaaatatgcagcagactgaagacactgatatgcgtgagcaaacagtggatacgcctcctgaaagcaagggaactacaactgttgataatcacgtggctggagatatgccacctgaaaacagcgtggaagatgttaccatggttgataatagtgctggtgttgcaaatgggagcccaacttcaaacgagggacaggtgtaggtgcttctaagtaagagttcatggcacatttatttgtttgtttttgcagagttaattatccgtaggtcgtggcatttctatgtttagataaatcaatgccaaattgacaatatgtagtaatagcaaattagattcttgatgttgaaaggtcaggcggaggaaatcacttttatgtaccagtggtaatcaatatatgggatgcttattggtgttcaggtgctagtgctagtgcatagagaagatatattttccccttgatttttttgtagactacgacgaatttactgtagattaactgttacctaattaagaattcaattttctgtataagattaagatgacgtttatttaggttttttcgtttttgtctctcccaaaaaattactcttctgggaggtttttattatgtgaaagaatacccaaattctt

SEQ ID NO: 839 - DNA, 1344 bp, Sequoia sempervirens
attccaatcaggctttaaatgatctttttgagaagattatgcagagggatgttccagctcggtaccttcttcgtctaggtcaaggtgagcaggaattagcaacagatcttgactttagccgacaaggtcgtgttaatgctatgctagcacgacggctggagttactagctgaagttgaacggcttgcaaaaacattggggctacccgaagatgttgcatatacatgtgaaactgcaggatatttctggttactgcatgttttctcacgttgggagctttttcttgctgcatgtgagggcaatcaagataagcctagttttgtgaaagatagatttccattcagtgagttcttttcagacacaccacaaccagttttcacaggccagtcatttgagcgagacatgcgtgcggcaaagggctgctttcgccatcttagtaccatgttccaagagcttgaagagtgcaaggcatttgaattacttaagtccacagctgaccgtgcaaattatctgatgactaagcaggctaaaattgtcgccatgacttgtacacatgcagcattgaaagaaaagatttcttcagctaggatttaagtatgacaacttgctcatggaagaaagtgcacagattttggagatagagacattcatacctatgctgttgcagaggcaggaagatggtcatgctaggctcaagcgttgtatattgattggtgatcatcatcaattaccacctgtagttaagaatatggctttccaaaagtatagccatatggaccagagtctgttcactaggtttgtgcgccttggaattccttatgtagaacttaacgcacaaggtagagcaaggccaagtattgcaaaactttataattggagatatagagaattgggtgatctgccatatgtgcaaagagagagagtttttcactgtgcaaatacaggttttcttatgaatatcaacttgtagatgttcctgatcacaatggtcagggtgaatctgcacctgttccttggttttatcagaatcttggtgaagcggagtatgtagttagtgtttatatgtacatgcgattactaggctaccctgctagtaaaatatcaatcttgacaacttacaaaggtcaaaagcacttgattcgggatgttgtcaggcaaagatgtgcctcgcatcccctcattgggtcacccaacaagatatcaactgttgataggttccaaggtcaacaaaatgattatatattgctgtctctagtccggacccgatttgtaggacaccttcgagatgttcgtagacttgttgttgccatgtcccgtgcacgtttggggttgtatgtgttttgcc

SEQ ID NO: 840 - DNA, 4878 bp, Medicago truncatula
tttcactgcaaaaccctaccatgacgaaggtttacggcaccggaacctacgatttccgtcgccacagagtcgcagagtatcccctcgccgaaccaaagccagtagaatggagtcaaaaatccggtggaggaggtttaccgaacaacatcacggtttccgagattcaacgcgatcgattgacgaagattgctgaatcgaattggttgaaaggtagtgagaagaagaaggagtttgatggtgagcttgttaagaagatttatgaaacggagttgttggtgaaagaaggacaagggaataataagcctgttccgcttcagagggttatgattttggaggtttcgcagtatttggagaattatctttgggttaattttgatcctgaaactgcgagttttgagcatgttatgtcgattattatcatggttaatgagaagttcagagagaatgttgctgcttgggtttgcttccatgataggaaagacgttttcaaagaatttctcgagagggttattcgcttaaaggagggaagggaactgaatattgcagagaagacaaattaccttgttttcatgataaatgcctttcagagtttagaagatgaggttgttaacgaggcagtgttaagactagcagatttgaagtcctggttcagtttgtcttatggtcgttttcagatggagctttgtcttaatccaggcttggtcaagaaatggaaaaatatgttaaagaaggaacctgtgaaagggggaaagcatttggatccttcaactacagttgaagtgacgtttttgagaaatcttatagaagaatttctggagatactggattcacaggtattttaccagagacagctgtctggcgaggatgatgaactaattaatgagactggttcgtggctaattaatgatgcttgtgtcctctattgtgagaggtttatggaatttcttattgacctcttgagtcaattggcaacaagaaggtatttgagacctctagtggctgatgtagctgttgttgccaaatgccatctgagtgcactctataggcatgaaaaggggaaactttttgcccagttggttgatttactacaattttatgaagggtttgagattaatgatcatactggggtacagttaacagatcatgaggttgttgaatcccattacagccgactgcagtcattccagctacttgcatttaaaaagatagacaagctgcgggagcttgctttgactaacattggttcaattcacacgcgggcaaatctatccaagaaattgtctgttctttctcctgaggagttaagggatctggtttgctgtaagctcaaactggtctctaaggatgatccctggtcagagagggtggattttcttattgaaataatggtgtcttattttgagaagcaacaatctcaaaaagaagctatcaatgctcttcctctttatccaaacgagcagattatgtgggatgaaagtgttgtaccaagcataaattattctggagaaggttgtttagcgttaccaaagctgaacttacaatttttaacattacatgactatcttcttcgaaattttaatctctttcgactcgaatcaacatatgagatacgcgaggacattcaggaagctgttccacatcttcttgcatatattaacattgatggagaaactgcttttcgcggttggtcaagaatgggtgtaccaatcaaagaattcaggatcgctgaagtaaaacaacccaacataggagaagtcaagccatcatctgtgactgcaaaagttacctatagcatttccagctatagatcccatattagatctgaatgggatgcactaaaagaacatgatgtattgtttttactaactattcgcccatcatttgagcctcttagtgcagaagaagaaaacaaagccagtgtgccacagaagcttggcctacagtatgtgcgggggtgtgaaattattgagattcatgatgaagaagggacccttatgaatgatttttctggtaaaattaagcgggaggattggaagccaccaaagggagaattgagaacagtaacagtggctttggatacagcacagtaccacatggatgtcaataacattgctgagaaagggggagaagatgtttatggtacatttaatgtgttaatgaggagaaagccaaaagaaaacaattttaaagcaattttagaatcaataagggacttgatgaatgaatactgtattgttcctaaatggttggagaatatttttcttggttatggggatccttcagatgctcagtggactagtgggtctaaactattacctgatctattagaaacagtagatttcaaagatacctttttagatgcggatcacttgaaaggaagttttggtgattatgaggttactttcgtaaatcatgatggcactgagaacttgaacccaagccctccttttaaaatcaagattcctcggacgctcaaaggaagcaatggtgcccttcctgggagggcagtgtctacttctggtgcagcaaatgatatcaatatggttgatactaatcatcagaaagaaacactggtaattgagacatatactcctcctgaccctggtccatatcctcaagatcagccaaagcagaattcagttagatttacagccacacaggttgaagcaattatatcaggtattcagcctggcctaactatggttgttgggccacctggtacaggaaagactgatacagctgtacaaattctaaatgttctttatcataactgtccttctcagagaaccttaataattactcattcaaatcaagctttgaatgacctatttgagaagataatgcagagagatgtacctgcccgttatcttctccgacttggtcagggagaacaagagcttgctactgatcttgattttagtcggcaaggtcgcgtcaatgctatgcttgttagacggttagaactgctaagtgaagtggagaggctagctagatctcttcagttgccagaggatgtgggttacacttgcgaaactgcagggtatttctggttgcttcatgtttattcacgctgggagcaatttcttgctgcttgcgccgagaataaagaaaagccaacatttgttcgagatcgttttcccttcaaagagttcttctgtgacacaccacatcctgtatttaccggtgagtcttttgagaaagacatgcgggctgctttggggtgctttcgtcatctgaagactatgtttcaagaacttgaagagtgccgggcttttgaattactgaagtcaacagcagacagagctaactacttaatgactaagcaggctaagattgtggcaatgacttgtacccatgccgctctaaagaggaaagatttccttcagctaggttttaagtatgataacttgttgatggaagaaagtgcccaaattttagaaattgagactttcattccaatgttactccagaggcaggaggatggccacgcacggcttaaacgctgcattctaattggtgatcatcaccaactgcctcctgttgtgaaaaatatggctttccaaaagtacagccacatggaccagagcttatttaccaggtttgtccgtctgggcattccttacattgaactaaatgctcaaggaagagccaggccaagtatagccaaactttacaactggagatacagagacttgggagaccttccttttctaaaggaggaagcaatattcaatagggcaaatgctggatttgcttatgattatcagttagtggatgttccagatcacaatggtaagggggagacaaccccatctccatggttttaccaaaacgagggagaagctgaatatattgtcagcgtttatatatacatgcgtttattggggtatcctgccaataagatatcaattttgaccacttacaatggccagaaacttctcatccgcgatgttataaacaggagatgtgttccatataacttcattggtgcaccaagcaaggttgctacagtggataagtttcaaggtcagcaaaatgattttatactgctgtctcttgtgcgcactcgatttgttggtcacctacgtgatgtaaggaggttggtggttgccatgtcacgtgctcggcttggtttatatgtcttttgccgccgttccctttttgaacagtgctatgagctgcagcctacatttcagcttcttctcaagagaccagaccatcttgcccttaatatgaatgagattacatcatatactgaacggaatgctgaagatcctgggcccaggcatcatgtacatctcgtcagtggcattgaagagatgagtagtatcatagacaggttgtatcaggtatgtctcacgtctcacgatactagacataatattcagatacatcatgacactcaaggatatgacaaaaattgaaagttatagaacatggcatggttataacagaacttatgctttttgtataaactgaatgaaaaaacagagatcaaatcaaaatagggaattaatgctttgaaaattatcttattactgtattgtttccatctttattatttatgaaggtttagaaagaaaaaaagtaaataagttatgaaatgcagccaggagtatctggcgtgttcccgttggtcgtgaatataatttgtgtggctattattctgaagtgtgtgtgcgtgttgtcggggactcgattcagattcatcaaccttagaaaatgattttcagtcattctgattcttatccgaatatcttttttataaaagaagaaatttatgaagacaagaaatccatttcgtcttaacataagaacagaacatgaaacaatgcaaactgctcaattctgcaacatattagggaaacatcacaggtg

SEQ ID NO: 841 - DNA, 4003 bp, Gossypium hirsutum
aggcctctcgtggctgatgtagctgtagttgccaaatgccatttaagtgctctttatagacatgacaaggaaactctttgcacaacttgtggacttgctacagttctatgaaaattttgagataaatgatcatgttggcactcagttgacggatgatgaggtgctccaatctcattatgatcgttttcaatccttccaactgcttgcttttaagaaagttcccaagttgaaagaacttgcactggccaatgttggtgcaatacacaagcgggtggatctctcaaagaaattgtctgtactttctcctggagaattaaaggacttggtttgctctaagctcaaactggtttcaaatgaagatccttggtcagacagggttgattttcttattgaggttatggtctcttttttgagaagcaccagtctcaaaaagaagccataaatgctcttcctctctacccaaatgagcagattatgtgggatgaaagtgttgtgccgagtattaattactctggtgaaagttgtctcgctcttcctaagctgaacctgcaattcttaacactccatgattatcttctaaggaatttcaatctcttccgtctggagtctacttatgaaattcgtgaggacatccaggaagccattcctcaccttctttcctatatcaataatgagggagaaactgctttccgtggctggtcaagaatggctgtgccaattagagaattcaagatcactgaggtaaagcagccaaatattggagaagtcaagcctgcttctgtaactgcagcgattacatacagcatttctagttataaatcacaaataagatcagaatgggatgcccttaaggagcatgatgttttatttttgctatctattagcccctcatttaaacctctaagtgcagaggaagaggctaaggctagtgtgccgcagaagcttggtctgcagtatgtacgaggatgtgaaattattgagattcgtgatgaggaggggactctcatgaatgatttcagtggaagaactaaacgtgaggaatggaagccaccaaaaggtgaactgagaactgtgactgttgctttagatgctgcacagtatcacatggatgtcactgacattgctgaaaaaggtactgaagatgtttatgggacgttcaatgtgttgatgaggaggaagcctaaggaaaataacttcaaagcaattttagagtctatcagagatcttatgaatgaatattgtattgttcctgattggttgcataaaatatttttgggctatgggcatccttctgctgcacagtggacaaacatgcctgatcttctggagacagtggatttcaaagatacttttcttaatgcagatcatctgaaagagagtttttcacattatcaggtttcctttgttgattcagatggtagggaaactttggatccacgaccaccattccgcatcaagcttcctcggtcatttaaaagtgatactcatgctccatcagaaaaatggaagacctgatactggtgtcagtgatgccaagatggtagatgcttgtgttgagaaagaaaactaattgttgaagcatatatccctcctgacccaggtccttatcctcaagatcaaccaaaacagaactctgttagatttacacctactcagattggagcaatcatatcaggtattcagcctggattaactatggttgtgggtccaccaggaacggggaaaactgatacggcagtgcaaatattgaatgttctctatcacaattgcccatcccagagaacattaataattactcattctaatcaagctttgaatgacctttttgagaagataatggagagagatgtgcctgctcgctatcttcttcgtcttggtcagggtgagcaagagctagcaactgacttggacttcagtaggcagggccgtgtgaatgcaatgcttgttcgacggctggaactgcttagtgaggtagagaggtttgcaaggtcactacaacttcccgaagatgtagggtatacttgtgaaactgctggatatttttggttgctccatgtatattcacgctgggagcaatttattgctgcgtgtgcgggtaatgaagataaaccggcatttgtccaagaccacttccctttcaaagagttcttctccaacacccctcaggcagtctttactggccaatcatttgagaaagacatgcgggcagccaagggttgcttccgtcatcttaagactatgttccaagagcttgaagagtgcagggcatttgaattgctcaaatcaacagctgatcgagccaattacctgatgaccaagcaggcaaagattgtggcaatgacatgtacccatgcagccctaaagagaaaagattttcttcaacttggtttcaaatatgacaacttgttgatggaagaaagtgctcaaattctcgagattgaaactttcatcccaatgttgcttcaaaggcaggaggatggttatgcacgacttaaacgctgcatattgattggtgatcatcaccagctgcctcctgttgtgaaaaatatggctttccaaaagtatagccatatggatcaaagtttgtttaccagatttgttcgactgggtattccttacattgagcttaatgcccagggtagagccaggccaagtatagcccaactttacaactggaggtaccgggatttgggggaccttccttcggtgaaagaggaagctatattctatagagcaaatgctggattttcctatgattaccaattagtggatgtacctgactaccatgggagaggtgagtctgctccctctccttggttctatcaaaatgaaggcgaagctgaatatgttgtcagtgtctatatatacatgcgattgcttggctaccctgcaaataaaatttccatcttgacaacttacaatggtcagaagcttctaattcgtgatgttatcaatagacgatgccttccatatgattttattggtccaccgtgtaaggttactacagttgataagtttcaagggcagcaaaatgatttcattttgctttctcttgttcgtactcgctttgttgggcaccttcgtgatgttagaagattggtggttgccatgtcacgtgctcgccttggcttgtatgtcttttgtcgccgttctctgtttgaacagtgttatgaactccaacctactttccagcggctgcttcaaagacctgatcatcttgctctaaatttgaatgagggcacatcatttactgaacgtcatgttgatgacattgggcatccatatcttgttagcagtgttgaggagatggctaacatagtttttgggagaatagatcaattacaacaggcacaagccatgtatcagtacatggcttattctgaacaattcactggaatatccgaggagcaaaacaatgaacaggattcaacgtccccaaaccaggcaatggaagttgatacctcagtggctgaaaacggtggaattaataacggtgtacatgaaaacaacggacaggaagctaaagaagatggagaggatcatgcaaatggtgaagacggggtgctaccttcagaggaccatcccaatacggaaaacgaaacccaagttagcacaaatgatgaaaacacggtgacctagttaatgatcccaaccactttccttgagtgacaaaggtagtagccagctcgcatcggcaatcaaactgcttccatcttaaaccatagagcactgctgactttcatgcaggtgccacttagcaacggtccctacgagcggggagctttatcaagctgcgaatatagttctgctttctcggaattagagggttacacgttgagaggtaaagggttctaaatcctttcgtattccatgtttgaaagcttgcaaatgggtttgttgagggttaaatatttagagttgttttatattattttacatcatttttactaaatatttttagtttatattctaaaagattatataactatacattttcgttcca

SEQ ID NO: 842 - DNA, 4792 bp, Ricinus communis
tttccacaatgaccaaagtttacggcaccggcgcatacgatttcaagcgccatagggtagccgagtacccggtcgagtcacaagccctatccagtgataacaaacccggttcaactcttccaaactcaataaccctatcggagatccaacgcgaccgattaacgaagattgcagccgccaattggctaaagacaggtggcagcggcacagagtctgaagggtttgatcctgatgtggttaagcagatatatgaaacggaattgaaagtgaaagaaggacgaaagccagtgcctttacagagagtaatgattttggaagttagccagtatttggagaattatctgtggcctaattttgatcctgaaacggcgtcatttgagcatgttatgtccatgattctcatgatcaatgaaaagtttcgagagaatgttgcagcttggttatgcttttatgataggaaagatgttttcagaggatttttggagagggttcttaaactcaaggaggggagagagttgagtatagcggagaagataaattacctagtgtttatgattaatgcctttcagagtttggaagatgaaattgtgagcgagacagtcctgaagttaggaggtttacagtcatggcacagtttgtcatatggtcgatttcagatggagctttgtcttaacccagatttggttaagaaatggaaaaggatgatcaagaaggaagctaaggaggcgatgaaacgaggagagccttttgaccctttaactgctcttgaagtgaaattcttgagaaatcttgttgaagagtttcttgatgtaattttttatctcagaactatgaaaaagttgcaaaattcggttgatggagatgatggattacatgttggttttgatgaagttgacgatgctgcaatcctgtactgtgagaggttcatggaatttcttattgatctgttgagccaactgccaactaggaggtacctaaggcctcttgtggctgatgtagctgttgttgcaaaatgccatttaagtgctctttacagacatgaaaaggggaagctatttgcgcaattggttgatttactgcagttttatgaaagatttgagattaatgatcatgtgggaacacaattgactgatgatgaggtcctccagtctcactatgatcgttttcaagctttccagcttcttgcatttaagacgatgcccaagttgcgagaacttgcattgtctaatattggtgcaattaacaagcgagctgatctgtccaagaaattgtctgtgctatctccagaagagttaaaggacttggtttgttgcaagctcaaattggtttccgcagaagatccttggtctgaaagagttgattttcttattgaagtaatggtctccttctttgaaaagcagcagtctcaaaaggaagctatcaatgctctaccactttatccaaatgagcagataatgtgggatgagagcctggtaccaagcattaattattccggtgaaggttgtctggcacttccgaaactcaatctgcaatttttaacactccatgattatcttctgagaaacttcaatctctttcggcttgaatcaatgtatgagatccgtgaggatattcaggaagctgttccgcaccttcttgcttatgttaataatgaaggagaaactgcttataaagcacaaataagatcagagtggaatgcccttaaggagcatgatgttttatttctactctcaattcgtccttcatttgagcctcttagtgccgaggaagcaggaaaggctactgtacctcagaggcttggtcttcagtacgtacggggatgtgaaattattgagattcgtgatgaggagggaacactcatgaatgatttcactggaagaattaaacgggacgagtggaaaccaccaaaaggagaactgagaacagtgactgttgctctggatacagcacagtaccatatggacataactggtatagcagagaaaggtgcagaagatgtttatgggacatttaatgtgctgatgaggaggaaacctaaggaaaataacttcaaagcgattttggaatctataagagatctcatgaatgaatactgtattgttcctgattggttgcacaacatatttttgggctatgggaatccttctgcagcacaatggattaatatgcctgatcttcttgaaactgtagatttcaaggatacattccttgatgctgatcatttgaaggagagttttctagattaccaggttcgtttcgtaaatccagatggtacggaatgcttacatccaaggcctccctttcgaattagccttcctaggacgctgaaaggcaacactcatgcacttccagggaataagaaagtagctactgattcactgaatgatgtcaacatggaggatgccaatagtgagaaagaaaaacttattgttgaggcatatattcctcctgacccaggtccatatccccaagatcagccaaaacagaactcagtcaaattcacacccactcagattggagcaatcatatctggtatccagccaggactaaccatggttgttggaccacctggtacgggaaagactgatacggctgtgcaagtcttgaatgttctctatcacaattgtacttcacagagaacactaataataacccattcaaatcaggctttaaatgacctttttgagaagataatgcagagagatgtgcctgcacgatatcttcttcgactgggtcaaggtgaacaagaactggcaactgatctcgacttcagcaggcaaggtcgtgtcaatgcaatgcttgttcggcggttggaattgctcggcgaagtggagaggcttgcaagatctctccagcttcctgaagatgtaggttatacttgtgaaactgctgggtacttttggttgcttcatgtatactcgcgctgggaacaatttcttgctgcttgtgcggataatgaagataaaccaacatttgttcaggaccgtttcccttttaaggagttcttttcgaactcacctaagccagtttttactggtcagtcatttgagaaagacatgcgggcagcgaaggggtgctttcgtcacctcaagactatgtttcaagaactagaagagtgtagggcatttgagttgctcaaatcaactgctgatcgagcaaattatctcatgaccaagcaagcaaagatagtagcaatgacttgcactcatgcagcactgaaaaggaaggactttcttcagttaggtttcaagtatgataacttgttgatggaagaaagtgcacaaattttggagattgaaactttcatcccaatgttgctacagagacaggaagatggctatgcgcggctaaaacgctgtatactgattggcgatcatcaccagttacctcctgttgtgaagaatatggcttttcagaaatacagccacatggatcagagcttgtttaccaggtttgttcgtctgggtattccttatattgagctgaatgcccaaggtagagccaggccaagcatagccaaactttataattggaggtaccgagatttgggagacctttcatatgtgaaggatggggccatcttccatagagcaaattctggattctcatatgaatatcagttagtggatgtgcctgactaccatggcagaggtgagtctgccccttctccttggttctaccagaatgagggagaggctgaatatgttgttagtgtctatatctatatgcggttattaggatatcctgcaaacaagatatctatcttgacaacttacaacggccagaagcttctgatccgcgatgttattaatagacgatgtgttccgtatgacttcattggtccacctagtaaggttgcaacagtggataagtttcaagggcagcagaatgattttattttgctttctcttgtgcgtactcgctttgtgggtcacctacgtgatgttagaagattggttgttgccatgtctcgtgcccgactggggctttatgtgttctgccgccgttctctttttgaacaatgctatgaattgcaacctacatttcaacttttgcttcagaggcctgaccaccttgcactgaatctgaacgaggttttgccgtacacagaacgtcctgtggaagatattggacacccttatcttgttagcagtgttgaggaaatgggccaaattgtgactgataaaatgaatcaaatgtatcaggcaaggttgaattatcagtttgagcagatggcttattcctccaatgtggttgcccctgcaaatggtgcagtggatgaaaaaccgcttgaaggtgaatcagaggaagctaaagagagcaagtcagaggaagctaaagagatggatggtattgaaattgatcaaaatggggatttgccttgtcagggccagcgaaatggggaaaaagatacagaaatctgtccaaatgataagaacagcaagccgtcagaaagcacaaatgaggaaacacggatgcaggaataatttaatctgttagtgcctgacaggtgaattggtcaagtgcagaaccctaattgtggagacttttctaacttgtaagcattgctgtgatcaggtagtaaaggagaacattggtagacaaaagtacaaagaactagctttgccgcagcatcttgtggtgcaagggagagatacttaagttagggcacatgttttcatatgtatagttctgaatttgttggtagagaaaaggaaaaaggaaaagaaaagatctagtatcagtagaggaagcgggtgatgttcagatgagcaaattgccttgccataca

SEQ ID NO: 843 - DNA, 2625 bp, Podocarpus macrophillus
gctttagatactgcacagtatcaaatggatgtcaatgctattgcagagaagggtgcagaggatgtctacagtacattcaatgtttgatgaggaggaaaccaaaggagaacaattttaaagctatccttgaatctataagggatctaatgaacgaagcttgcattgttccagactggttgcatgacatttttttagggtatgggaatccaagtgcggcacagtggtccaatatgcctgatacattggatgttgtagattttaaggacacatttcttgatgcagatcatctcagggaatgcttttcagattatgatgcgatcttcataaaaccgaatggtgaagaagacaagtctccaaagcctccttttcgcattacacttccaaagacaatgaagagtgatgtgaaccaggtcttgccagtagttacaaaaagaaccagcagagattgtgagaacgcagaaaatatgatggagatagatgtcaaaagagaaaaggtggttgttgaggcatttgtgcctccggatccaggtccttacccacaagaccagccaaagaaaaacagtgttagatttacatctgttcaggttggggctatcatctcaggtattcaaccaggattgacaatggttgtaggccctccaggaacagggaaaacagatactgctgtgcagattctgaatgtcttatatcataattgtccttcccagagaacactgatcatcactcattcaaatcaggctttgaatgatcttttgagaagataatgcagagggatgtccctgcacggtaccttctacgtcttggccaaggggaacaagaattagcaacagatcttgattttagtcggcaaggtcgtgtcaatgctatgctagcaaggcggttagagttgctagctgaagttgaacggcttgcaaaaacattgaagctaccagaagatgttgcctatacatgcgaaactgcaggatacttctggttactgcatgtttactcacgttgggagcagtttcttgctgcatgtgaggtaaatcaagataagccttgttttgtgaaagacagatttccgttcagtgaattcttttcagacacaccacagccagttttcacaggcctgtcatttgaacgagacatgcatgcagcaaagggttgcttccgccatcttagtactatgttccaagagcttgaggagtgtaaagcatttgaattactgaagtccacagctgaccgtgcaaattatctgatgactaagcaggccaaaattgtggccatgacttgtacacatgcagcattgaaaagaaaggattttcttcaattaggattcaagtatgacaatttgctcatggaagaaagtgcacagattttagagatagaaacattcatacctatgttgttgcaaagacaggaagatggtcattcaaggctgaagcgctgtatattgattggtgatcatcatcaattgccacctgtagttaagaacatggcttttcaaaaatatagccacatggatcagagtctgttcaccaggtttgttcgtcttggaataccttatgtggaacttaatgcgcaaggtagagcaaggccaagtatcgcaaagctttacaactggagatataggcaattgggtgatctaccatatgtgcaaaatgagagtgtttttcatcttgcaaatgcaggtttttgctatgattatcaacttgtagatgttcctgatcacaatggccagggtgaatctgcacctgttccatggttttatcagaaccttggtgaagcagagtatgtggttagtgtttacatgtacatgagattacttggctaccctgctagtaaaatatctatcttgacaacatataatggtcagaaacacttaatccgtgatgtggtcaggcaaagatgcgcttctcatccccttttaggatcacccaacaagattacaactgttgataggttccaaggtcaacaaaatgattatatattgctttctctagtccggacacgatttgttggtcaccttcgagatgttcgtaggctggttgttgcaatgtctcgtgcacgtttggggttgtatgtgttttgtcgtcgttcactctttgaacagtgctatgaactgcagcctacttttcagcttctactacgacgaccagataagcttgctcttaatttggatgaagcaacatcttccacagagcgtttagttggagaaactgggaggattcaccttgtgagtggactcgaggagatagaccacattgccttgagtaaatactatcagctttatcaggcaccattgatgtggcagcaaataccttcctctactactccaccaatatatggaaacaactctgggtcaatcatgccaacaagcggggattcttcattccaggagagattgtctgctgaacctgtcattgctccagatgtgtctactagaactgatgaaaatgttgaagctgcaacaaatgataagtcgggtgaggaaaatggtatgcaagaatgaagtattttcccctgatatctgtgttgaagatattaagttttacaaggaagaaatggaagcggttttattgtggtattgtgctactcaatgcaaaattcaacattttaatcatactgttttctgtttgtctattg

SEQ ID NO: 844 - DNA, 1284 bp, Vigna unguiculata
aaaccaagcaatggatctcttactgggaaggctatgtctactgctggtgctacaaatggtatcaatacggctgatactaattatcagaaagaaacactaattattgaggcatatactcctccagatcctggtccatatcctcaagaccagcctaaacaaaattcagttagatttactcctactcaggttgaagcaattatctccggcattcagcccggtttaacgatggttgtgggaccacctggtacaggaaagactgatacagctgtacaaattctgaatgttctttatcataattgtccttctcaaagaaccttgataattactcattcaaatcaggctttgaatgacctatttgagaagataatgcagagagatgttcctgcacggtatcttcttcgacttggtcaaggagaacaagagctagcaactgatcttgattttagtcggcagggtcgcgttaatgctatgcttgtgagacggttagaattgctgagtgaagtggagagactggcaagatctcttcaattaccagaggatgtgggttacacttgtgaaactgcaggatacttttggttacttcatgtttattcacgctgggagcaatttcttgctgcttgtgctgagaataaagaaaagtcaacatttgttcgagatcgtttccccttcaaagagttcttctctgatacaccacttcccgtatttacaggcgagtcttttgagaaagatatgcgagctgctatggggtgcttttgtcatcttaaaaccgtgtttcaagaacttgaagagtgccgggcattcgaattacttaagtcaactgctgatagggctaactatttaatgaccaagcaggctaagattgtggctatgacttgcacccatgcagcactaaagaggaaagatttcctccagttaggttttaagtatgacaacttgttaatggaagaaagtgcccaaattttagaaattgagactttcattccaatgttactccagcggcaagaggatggtcatgcacggcttaaacgctgtattctgattggtgatcatcaccagttacctcctgttgtgaagaatatggcttttcagaagtacagtcacatggatcagagtctatttaccaggtttgtccgattgggcattccttacattgagctaaatgctcaaggaagagccaggccaagtatagctaaactttacaattggagatacagagaattgggagaccttccttctgtaaaggaagaagtcatattcaaaagggcaaatgctggatttgcttat

SEQ ID NO: 845 - DNA, 4976 bp, Populus trichocarpa
gaaatgacgaaagtatacggcaccggcgcttacgatttcaagcgccaccacgtggccgagtacccactcgacctctctgcaacccgaaccgagaccaaatcagccgattccaaacctggttcaacaactctccccagctcaatcactctctccgagatccaacgcgacagattgaccaagattgcctccgcaaactggctcaaaacgaccccttctgctgtcgcggatggcggagacatgttggcggaagaggaggagaggagggggtttgatgcggaactggtgaagaagatatatgagacggagttgaaggtgaaagaagggagaaagactgtgcctttgcagagagtgatgattttggaagttagtcagtatttggagaattatttatggcccaattttgatcctgaaacggcaacgtttgagcatgttatgtctatgattcttatgattaatgagaagtttcgagaaaatgtggcagcttggtcatgcttttatgatcggaaggatgtcttcaaaagatttcttgatagagttcttcacctgaaggaggggagagagttgagtatagcagagaagacaaattacctagttttcatgattaatgcctttcagagtttggaagatgaaatggtgagtcagacggtcctcagaatagcaagttttgagtcatggcacagtttgtcatatggccgctttcagatggagctttgtcttaataataaattgattaagaaatggagaaagacaataagaaaagaggctgaagaggcaactaaacgaggagaagttttcaacccgtcaacctcgcttgaagtgaggtttttgaggaatttcactgaagagtttcttgatgtgcttgatttcaaagtttttccccagaaaagctctgcaaacgaagatgaaattgatgatgctgcagtcttgtattgtgagaggtttatggagtttctaattgatctgttaagtcaactgccaacaaggaggtatctgaggcctcttgtagctgatgttgctgttgttgcgaaatgtcatttaagtgctctctacagacatgaaaaagggaaactctttgctcaactggttgacttgctgcagttctatgagcggtttgagattaatgattattatggcacacaattaacagatgatgaagtggttcgatctcattatgagcgtttccaagccttccagctccttgcctttaagaaaattcccaagctgcgagaacttgcattgtctaacgttggtgcaattcacaagcgagctgatctctccaagaaattgtctgtgctctctcccgaagagttgaaggacttggtttgctgtaagctcaaactggtctccgcggaagatccctggtctgaaagagttgattttcttattgaagtcatggtctccttctttgagagacagcagtctcaaaaagaagcaataaatgctcttccactttatccaaatgaacagattatgtgggatgagagtgttgtgcccagcattaactattcaggagaaggttgtctggcacttcctaaacttaatctgcagtttttaacacttcatgattaccttttaagaaattttaatctcttccggcttgaatcaacatatgagattcgtgaagatattcaggaagccacaccacatctccttccatacattaataacgagggagaaactgcttttcgtggttggtcaagaatggctgtgccaataaaagaatttaagatcaccgaggtcaaacagccaaatattggtgaagtcaagccatcatctgtgacagcaaaaattacttttagcatttcgagttataaaacacaaataagatctgaatggaatgctctgaaggagcatgatgttttattcttactttcagttcgcccatcatttgagcctctaagtgccgaggaagctgagaaggccagtgttccagagaggcttggcctccaatatgtgcggggatgtgaaattattgagatccgtgatgaggagggaacactcatgaacgatttcacgggaaaaattaaaagggaggagtggaaaccaccaaaaggtgaacttagaactgtaaccgttgctttagatacagcccagtaccacatggatgtcactgatattgcagagagaggtgctgaagacatttatgggacattcaatgtgctgatgaggaggaaacctaaggaaaataacttcaaagcaatcttagaatctataagagatcttatgaatgaatattgtattgttcctgactggttgcacaacatttttctgggctatggggatccttctgcagcacaatggaccaaaatgcctgatcatcttcagaaagtagatttcaaagatactttcttggatgcagaccatttaaaggagagttttccagatcaccaggtttgttttgtaaatccagatggttcggctaacttgaatccaagacctccttttcgaattaggcttccagaaaaattgaagggctacactcatgcaattccagggaatgagaaatctactattgattccaaaaatggtgtcaatatggtggattctggtagggaaaaagaagaacttattgttgaggcgtacattcctcctgatccaggaccttatcctcaagatcagccaaaccagaactcagtcagatttacatcgacacagattggagcgatcatgtctggtatccagccaggactaaccatggttgtggggcctcctggtactggaaagactgatacagccgtgcaaatcatgaatgttctatatcataattgtccgtcccagagaacattaataatcacccattccaaccaggccttgaatgacctgtttgagaagataatgcagagagatgtgccagcacggtatcttcttcgacttggtcaaggtgaacaagaactagcaactgatcttgacttcagtaggcaagggcgtgtcaatgcaatgcttgttcgacggttggaattgcttagcgaagtggagaggcttgcaagatctctccaacttcctgaggatgtagcttatacttgtgaaactgctggatacttttggttactgcatgtatattcacgttgggagcaattccttgctacttgtgcggataacgaagataaaccaacacttgtccaggaccgttttccttttaaggagttcttctccaacacccctcagccagtttttactggtcaatcatttgagaaagacatgcgggcagcaaaagggtgctttcgtcatctcaagactatgttccaagaactagaagagtgtagggcttttgaattgctcaaatcaacagctgatcgagcaaattacctaatgacaaaacaggcaaagatagtggcaatgacctgcacacatgcagctctgaagagaaaggacttcctccagttgggttttaagtatgacaacttgctgatggaagaaagtgcccaaatattggagattgaaactttcataccaatgttacttcagaggcaggaggatggtcatgcacgtcttaaacgctgcatactgattggtgatcatcaccagttgcctcccgttgtgaaaaacatggcttttcagaagtatagccacatggatcagagcttattcactaggtttgttcggctgggtattccttatattgagctcaatgcccagggtagagccaggccaagcatagctaagctttacaattggagatacagagatttgggagaccttccttatgtaaaggagggggctatctttaagaatgcaaatgctgggttctcctatgattaccagttagtggacgtgcctgattatcatgggagaggcgagactgctccttctccctggttctatcaaaatgagggagaggctgaatacattgttagtgtttatatatacatgcgtttgcttggatatcctgcaaacaagatctccatattgaccacttacaatgggcaaaaacttcttattcgtgatgttatcaacagaagatgcgtcccttatgactttataggcccaccctgcaaggtcgccactgttgataagtttcaaggacagcaaaatgattttattttgctctctctagtgcgttctcgctttgtgggtcaccttcgtgatgttagaagattggttgttgccatgtcccgtgcccgacttggactttatgtattttgccgcagatctctgtttgaacaatgttatgaactgcagcctacatttcaacatttgcttcagagacctgatcgccttgcgctgaattttggtgaagtttcgacatatacagagcggcaagttgaagacattggacatccttattttgttagcagcgttgaggagatgggccacattgtagtggataaaatgaatcaattgcatcaggcacgtatgatgagctatcagcatgagcactacattgcgtatccatctgatggacctgctcctgcaaagggcgcaataatcaatgatacaccagacgaaaacgaggcagaggaatcgaaacagattgatgatattccaagtggtgaagacaaccaggcagaggaatcaaaagagatggatgctattccaagtggtgaagacggggatttgcaacctgataaccaattgaatggggaaaaggtgagcgaagcttgcccaaatgatgaagatggcatgccaccaagaagtggtgcaaacggggaaacaagcatggaggagtagcctttactttctccacctaatcgcacaagttgtaagcataacttgcagatagagacgagtaacgccaactggcaagtaactgtttagcttttctggcagtatctgtatctggtaggaagaagatgaagggcgctctcgtgtggagtcgtttatctgtactgtacagtgcaaaaaagagaaatcttgcttgcaaagggattttgttgtaatattcatatcaactagctaacctagtcacggaaaactcttctaagaattgaaatcactgccagtcatttgaagtcgttttgtggaacatcgttgatttt

SEQ ID NO: 846 - DNA, 4963 bp, Populus trichocarpa
gaaatgacgaaagtatacggcaccggcgcttacgatttcaagcgccaccacgtggccgagtacccactcgacctctctgcaacccgaaccgagaccaaatcagccgattccaaacctggttcaacaactctccccagctcaatcactctctccgagatccaacgcgacagattgaccaagattgcctccgcaaactggctcaaaacgaccccttctgctgtcgcggatggcggagacatgttggcggaagaggaggagaggagggggtttgatgcggaactggtgaagaagatatatgagacggagttgaaggtgaaagaagggagaaagactgtgcctttgcagagagtgatgattttggaagttagtcagtatttggagaattatttatggcccaattttgatcctgaaacggcaacgtttgagcatgttatgtctatgattcttatgattaatgagaagtttcgagaaaatgtggcagcttggtcatgcttttatgatcggaaggatgtcttcaaaagatttcttgatagagttcttcacctgaaggaggggagagagttgagtatagcagagaagacaaattacctagttttcatgattaatgcctttcagagtttggaagatgaaatggtgagtcagacggtcctcagaatagcaagttttgagtcatggcacagtttgtcatatggccgctttcagatggagctttgtcttaataataaattgattaagaaatggagaaagacaataagaaaagaggctgaagaggcaactaaacgaggagaagttttcaacccgtcaacctcgcttgaagtgaggtttttgaggaatttcactgaagagtttcttgatgtgcttgatttcaaagtttttccccagaaaagctctgcaaacgaagatgaaattgatgatgctgcagtcttgtattgtgagaggtttatggagtttctaattgatctgttaagtcaactgccaacaaggaggtatctgaggcctcttgtagctgatgttgctgttgttgcgaaatgtcatttaagtgctctctacagacatgaaaaagggaaactctttgctcaactggttgacttgctgcagttctatgagcggtttgagattaatgattattatggcacacaattaacagatgatgaagtggttcgatctcattatgagcgtttccaagccttccagctccttgcctttaagaaaattcccaagctgcgagaacttgcattgtctaacgttggtgcaattcacaagcgagctgatctctccaagaaattgtctgtgctctctcccgaagagttgaaggacttggtttgctgtaagctcaaactggtctccgcggaagatccctggtctgaaagagttgattttcttattgaagtcatggtctccttctttgagagacagcagtctcaaaaagaagcaataaatgctcttccactttatccaaatgaacagattatgtgggatgagagtgttgtgcctagcattaactattcaggagaaggttgtctggcacttcctaaacttaatctgcagtttttaacacttcatgattaccttttaagaaattttaatctcttccggcttgaatcaacatatgagattcgtgaagatattcaggaagccacaccacatctccttccatacattaataacgagggagaaactgcttttcgtggttggtcaagaatggctgtgccaataaaagaatttaagatcaccgaggtcaaacagccaaatattggtgaagtcaagccatcatctgtgacagcaaaaattacttttagcatttcgagttataaaacacaaataagatctgaatggaatgctctgaaggagcatgatgttttattcttactttcagttcgcccgtcatttgagcctctaagtgccgaggaagctgagaaggccagtgttccagagaggcttggcctccaatatgtgcggggatgtgaaattattgagatccgtgatgaggagggaacactcatgaacgatttcacgggaaaaattaaaagggaggagtggaaaccaccaaaaggtgaacttagaactgtaaccgttgctttagatacagcccagtaccacatggatgtcactgatattgcagagagaggtgctgaagacatttatgggacattcaatgtgctgatgaggaggaaacctaaggaaaataacttcaaagcaatcttagaatctataagagatcttatgaatgaatattgtattgttcctgactggttgcacaacatttttctgggctatggggatccttctgcagcacaatggaccaaaatgcctgatcatcttcagaaagtagatttcaaagatactttcttggatgcagaccatttaaaggagagttatccagatcaccaggtttgttttgtaaatccagatggttcggctaacttgaatccaagacctccttttcgaattaggcttccagaaaaattgaagggctacactcatgcaattccagggaatgagaaatctactattgattccaaaaatggtgtcaatatggtggattctggtagggaaaaagaagaacttattgttgaggcgtacattcctcctgatccaggaccttatcctcaagatcagccaaaccagaactcagtcagatttacatcgacacagattggagcgatcatgtctggtatccagccaggactaaccatggttgtggggcctcctggtactggaaagactgatacagccgtgcaaatcatgaatgttctatatcataattgtccgtcccagagaacattaataatcacccattccaaccaggccttgaatgacctgtttgagaagataatgcagagagatgtgccagcacggtatcttcttcgacttggtcaaggtgaacaagaactagcaactgatcttgacttcagtaggcaagggcgtgtcaatgcaatgcttgttcgacggttggaattgcttagcgaagtggagaggcttgcaagatctctccaacttcctgaggatgtagcttatacttgtgaaactgctggatacttttggttactgcatgtatattcacgttgggagcaattccttgctacttgtgcggataacgaagataaaccaacacttgtccaggaccgttttccttttaaggagttcttctccaacacccctcagccagtttttactggtcaatcatttgagaaagacatgcgggcagcaaaagggtgctttcgtcatctcaagactatgttccaagaactagaagagtgtagggcttttgaattgctcaaatcaacagctgatcgagcaaattacctaatgacaaaacaggcaaagatagtggcaatgacctgcacacatgcagctctgaagagaaaggacttcctccagttgggttttaagtatgacaacttgctgatggaagaaagtgcccaaatattggagattgaaactttcataccaatgttacttcagaggcaggaggatggtcatgcacgtcttaaacgctgcatactgattggtgatcatcaccagttgcctcccgttgtgaaaaacatggcttttcagaagtatagccacatggatcagagcttattcactaggtttgttcggctgggtattccttatattgagctcaatgcccagggtagagccaggccaagcatagctaagctttacaattggagatacagagatttgggagaccttccttatgtaaaggagggggctatctttaagaatgcaaatgctgggttctcctatgattaccagttagtggacgtgcctgattatcatgggagaggcgagactgctccttctccctggttctatcaaaatgagggagaggctgaatacattgttagtgtttatatatacatgcgtttgcttggatatcctgcaaacaagatctccatattgaccacttacaatgggcaaaaacttcttattcgtgatgttatcaacagaagatgcgtcccttatgactttataggcccaccctgcaaggtcgccactgttgataagtttcaaggacagcaaaatgattttattttgctctctctagtgcgttctcgctttgtgggtcaccttcgtgatgttagaagattggttgttgccatgtcccgtgcccgacttggactttatgtattttgccgcagatctctgtttgaacaatgttatgaactgcagcctacatttcaacatttgcttcagagacctgatcgccttgcgctgaattttggtgaagtttcgacatatacagagcggcaagttgaagacattggacatccttattttgttagcagcgttgaggagatgggccacattgtagtggataaaatgaatcaattgcatcaggcacgtatgatgagctatcagcatgagcactacattgcgtatccatctgatggacctgctcctgcaaagggcgcaataatcaatgatacaccagacgaaaacgaggcagaggaatcgaaacagattgatgatattccaagtggtgaagacaaccaggcagaggaatcaaaagagatggatgctattccaagtggtgaagacggggatttgcaacctgataaccaattgaatggggaaaaggtgagcgaagcttgcccaaatgatgaagatggcatgccaccaagaagtggtgcaaacggggaaacaagcatggaggagtagcctttactttctccacttaatcgcacaagttgtaagcataacttgcagatagagacgagtaacgccaactggcaagtaactgtttagcttttctggcagtatctgtatctgataggaagaagatgaagggcactcgtgtggagtcgtttatctgtactgtacagtgcaaaaaagagaaatcttgcttgcaaagggattttgttgtaatattcatatcaactagctaacctagtcacggaaaacttttttaagaattgaaatcactgccagtcatttgaagtcgttttgtgaaaca

SEQ ID NO: 847 - DNA, 4837 bp, Arabidopsis thaliana
actctaaatcccttctctgaacctcttcgtttgctgtatgtgttgatttcacttctctctgagcaagaagctttcgcgtgagagaatgacgaaggtctatggaactggcacgtacgacttcaagcgccacagagtggcggagtatccattggagttacctagccatcctgctgagaagcctctagagtcaaagcctggatctaatttgccgagctccatcactttatcggagattcagcaagataggttaacgaaaatcgctgaggagagctggattaagactggaggtaagctccctgagaaaccgttcgatccggaggttgtgaaggagatttatgtgacggagcttaaggtaactagtggtcgtaaacctgttccacttcagcgagttatgattctggaagtgagtcagtatttggagaactatctatggccgaattttgatcctgagactgctacgttcgagcatgttatgtctatgattcttatgattaacgagaagttccgggagaatgtggcagcttggatttgctttcatgatcgggatgatctattcaaaaagtttctacagaaggttcttcgccttaaagagggaagagacttgactattgctgagaagacaaactatttggtcttcatgattaatgctttccagagtttggaagacgcagtggttaatgagattgttctaagtctagcaggattacaatcttggcacagcttgtcttatggacgtttccagatggagctctgccttcaacctgatctaattaaaaagtggaagaggtcatcaaagaaatgggcagctgaggcaaagtcaaagggagagaaatttgatttatcctcatcccctgaagcaaattttgttcgaggcctaatagaagaattcgttgaggtgcttgatcatggggtttttgcggatgaggttgatgatactgctggatctcaattggtcgatgattcttctgtcttatattgtgagagattcatggaatttcttattgacatgctgaaccaacttccaacaagaagatacctaagacctcttgtggcggatatagcagttgttgccaaatgtcgactgagtgccctatacaaacatgaaaaagggaagcttttcgcccaactagttgacttgttacagttctacgaaaagtttgagataaaggatcatgatggaacacaattaactgatgatgaagcacttcaatttcattacgatcgttttatggcgtttcagctacttgcctttaagaaaatacctaagttgcaagatctgtctttggctaacattggttcgattcacaagagttctgatcttcggaggagattgtctgtgctttctcttgaagatttaagggatgttgtctgctcaaagctcaaactggtttcaagacatgatccttgggcagatagtaaagattttctgactgaagtcgttgtctcctcttttgagaagcaacagtctcagaaagaagcaataaacgctctgcctttgtacccaaatgagcaaatcatgtgggacgaaagtgttattccaagcattaattattctggggaaggttgccttgctcttccaaagcttaatcttcagtttctaacactccatgattatctccttagaaacttcaacctcttccgtctagaatccacctatgagattcgtgaagatatacaagaagctgtaccacatcttcttgcacatataaataacgagggagacactgcttttcgtggttggtcacgaatggcggttcctattaatgatttcaaaatcgctcaggtgaaacagcctaatattggagaagagaagccttcatctgtgacagcagaagttactttcagtatcaagagttacagaacgcagataagatctgaatggaattcccttaaagagcatgacgtgttgtttttgctttgtatacgcccttcatttgagccattaggtcctgaggaagctgataaagctacagttccacagaggctcgggcttcagtatgttcgtggttgtgaaatcatcgatatccgcgatgaggagggtaatctgatgaatgattttactggaagagttaaacgggatgaatggaagcccccaaaaggtgaaatgaggactgtgactgtcgctttagatgctgcacagtatcatatagatgttacagacatcgctgaaaaaggtgctgaggatgtgtatggcacatttaatgtgctaatgaggaggaaaccaaaagagaacaacttcaaggctattctggaatctatcagagatcttatgaacgaatattgtattgtgccggagtggttgcataatgtttttcttgggtatggcaacccttctgctgcacagtggcctaatatgccaaacctgttggaaatagtggacttcaaagacactttccttaatgcaaatcatctcagtgaaagtttttcagattatgaggtttctttcatcaatgctgaaggtgctgaagctctggatccaagtcctccgtttcgaatcactcttccaaagacactaaaaggaaatggtgctatttctggaaacaagatatctgaagtgaatccagcagataatgttaatatggtggatgcttccccgaaggagaaacttattgttgaggcatataccccacctgacccagggccttatcctcaggaccagccgaagcagaactcagttaaatttacacctacacaggttggagcaattatctctggtattcagcctgggctaactatggtggttggtccaccaggtaccggaaagactgatacagcagtgcaaattttgaatgttctataccacaactgtccttctcagaggacattgataatcactcattcaaatcaggctttgaatgatctttttgagaagataatggagagggatgtaccagcgcggtatctacttcgtttgggtcaaggtgaacaagagcttgccactgatcttgactttagcagacaaggccgtgtcaatgccatgcttgttcggcgtctggaactcctcagtgaggttgagagactagcaagatctcttcagcttccagaggatgtaggatatacttgtgaaacagctggatatttctggttgcttcatgtatactcgcgttgggagctgtttctcgcagcttgtgcaggaaatgaagacaatcaatcttttgtgcgagatcgcttcccgttcaaagatttcttctcagacacccctaaacctgtttttaatggggagtcatttgagaaagacatgagggcagctaaaggttgtttctctcatctcaagactgtgttccaagagctagaagagtgtagggcctttgaactactcaagtcaactgctgatagagcaaattatctgatgaccaaacaagcaaagattgtagcaatgacgtgtactcatgctgcattaaagaggagagattttcttcagttagggttcaaatatgataacttattgatggaagaaagtgctcagattttggaaattgagactttcataccaatgctgcttcagaggcaagaagatggtcatgcacgactcaagcgctgtatattgattggtgatcaccaccagctgcctcccgtggtgaagaatatggctttccagaaatatagtcacatggatcagagtttgtttacgaggtttgttcgtcttggtattccttatattgagctcaatgctcaaggaagagccaggccaagtttagccaaactctacaactggagatacagagatttaggagacctttccattgttaaggaagcacccatcttccaaagagcaaatgctggattctcatatgaatatcagttggtgaatgtgcctgattatgaggggagaggagaatcaacaccatctccttggttttatcaaaatcagggagaagctgaatatatcgtcagtgtctatatatacatgagattgttaggatatcctgcgaataagatatcaatattgacaacatataatggtcagaagctcttaatccgtgatgttatcaaccgacgatgtgttccgtatcctttcattggcccgccgagcaaggtgactacagtggacaagttccaaggacaacagaatgatttcatattgctctctcttgtacggacacgcttcgtaggtcatctacgtgatgtaagaaggttggtagttgcaatgtcacgtgctcggctcggtttgtatgtgttctgccgccgttcgctctttgaacaatgctatgagctgcaaccaacgtttcaacttcttcttcaaagacccgatcggctcggactcaattttaatgagaacacagcatatacagatcgtgtggtggaggaagttgaaaattcttatctcgttcatgatgttgaagagatggcacacatagttgacgacaggatgaacaagttctaccaggcacaaggagcttatgagcaataccaaaacaacatggcacagatggaagatggtaatcacgacatggagagtgattcagtagtagatggtgatgaatctgaaaaaaatatgcagcagctaaaccaatctccagacatagacggtgaattatcgaaggaggtggttggaatggaggtggacaataatggatttagcagtgagaatggaaaggctgatgagaagaattaggacaaaacaaactgggaatttcaaagttatcctttcgggagggtgataagtgagttgatgtttgaaacatggattttttttgctactgtaagataattttactgcatttgagtaaattctggtaagtgatacatgacatgaggaaaaaaatagcattgtctgaccttcctcaccgactttttgtaacttctagttgagtattcaagcttgtttatccttctt

SEQ ID NO: 848 - DNA, 4912 bp, Glycine max
ctaatttcacaactttccctatgacgaaagtttacggcacggggttatacgatttccggcgccaccgcgtcgccgagtatccggtggcggcggcaccagcagagtcgaaaacgttagttccaaagaccggcggcggcggcggcggcgttccgagcagcatcactctgtcggagattcagcgcgaccggctgacgaagattgcggaggcgaactggttgaaaagtggcgatgcggggaggcctaagaaggacttcgaccctgagcttgttcgcaagatctacgaaaccgaattgttggtgaaagagggttcgaaacccgttcccttgcaacgtgtcatgattctggaggttagccagtatctggagaattacctgtggccttatttcgaccctctcactgccaccttcgagcatgttatgtccatcatcatcatggtcaacgagaagttccgagaaaatgttgccgcttggacttgcttccatgagaggaaagacgctttcaaaggctttctcgagagtgttcttcgcttgaaggagggacgagaactaagtatagccgaaaagacgaattacctagtttttatgataaatgcctttcagagtttggaagatgaggttgttagcaggacaatcttgagactggcaaatttgaaatcttggtacagtttgtcttatggtcgatttcagatggagctttgtcttaatcctggcttgatcaagaaatggaaaaggatgataaagaaggaacctgtgaaaggagatggatcacatttagatccctcaactacagttgaagtgatgttcgtgagaaacctcatagaagaatttctggagatactggattcacaggtatttcccctgaaacaattatctggtgaggacgatgaacttattgatgctactggtttggggctagttaatgatgcctgtgtcctgtactgtgagaggtttatggaatttctaattgacctcttgagtcaattgccaacgaggaggtatttgaggcctcttgtggctgatgtagctgtagttgccaaatgccatttaagtgcactctataggcatgaaaaggggaaactttttgcgcagttggttgatttactgcaattctatgaagggtttgagattaatgatcatactggaacacagttaacagatcatgaggttcttgaatctcattacagccgaatgcagtcattccagctacttgcatttaaaaagatggaaaagctgcgggaacttgctttgactaacattggttcgattcacaagcgtgctaatctgtccaagaaattgtctgttctttctccggaggagttaagagattttgtttgctgtaagcttaaactggtctctaaggaagatccctggtcagagagggttgattttcttattgaagtaatggtgtcctattttgagaagcaacaatctcaaaaagaagctattaatgctcttcccctttatccaaatgagcagattatgtgggatgaaagtgttgtacccagcataaattactctggagaaggttgcttagcattacccaagctgaacttacagttcttaacacttcatgattatcttcttcgaaattttaatctttttcgacttgagtcaacatatgagatacgtgaggacattcaggaagctgttccacatcttcttgcatatattaataatgatggaggaactgcttttcgtggttggtcaagaatgggtgtgccaatcaaagaattcaaaatcactgaagttaaacaacctaacattggagaagtcaaaccatcatctgtgactgcagaggttacttatagcgtttccagttatagagcacatattagatcagaatgggatgcactcaaagagcatgatgtattgtttttactatctattcgcccatcatttgagcctcttagtacagaagaagaagacaaagctagtgtcccacaaaagcttggcctacaatttgtacgcggttgtgaagttattgagattcgtgatgaggaaggaaaccttatgaatgatttttctggaaagataaaacgtgatgagtggaagccaccaaagggggaactgagaacagtaactgtggctttggatacagctcaataccacatggatgtaagtaacattgccgaaaaaggggcagaagatgtttatggtacatttaatgtgttgatgaggaggaagccaaaagaaaacaattttaaagccatcctagaatcaataagggatttaatgaatgaatactgtattgttcccaagtggttggaaaacatttttcttggttatggggatccttcagctgcacagtggactaatatgcctgatctattggagacagtagatttcaaagacacttttgttgatgctgatcacttaaaagaaagttttttggattatgaggtgtcttttgttaatcctgatggctcaggaaatttgaatccaaggcctccttttaagatcaagcttccccgaacactcaaaccaaacaatggtgctcttactgggcatgcaatatctacttctggtgcaacaaatgaaatcaatgtggttgatgctaattatcagaaagaagcactaattattgagacatatactcctccagatcctggcccctatcctcaagatcagcctaaacaaaattcagttagatttacacccacccaggttgaagcaatcatctctggcattcagcctggtctaactatggttgtggggccacctggtacaggaaagactgatacagctgtacaaattctaaatgttctttatcataattgtccttctcagagaaccttaataattactcattcaaatcaggctttgaatgacctgttcgagaagataatgcagagagatgttcctgcacgttatcttcttcgacttggtcaaggagaacaagagctagcaactgatcttgattttagccggcaaggtcgtgttaatgcaatgcttgttagacggttagaattgctgagtgaagtggagaggctagcaagatctcttcaattgcccgaggatgtgggttacacttgtgaaactgcaggatacttttggttgcttcatgtttattcacgctgggagcaatttcttgctgcttgtgctgagaataaagaaaagtcaacatttgttcgagatcgttttcccttcaaagagttcttctgtgatacaccacatcctgtatttacaggtgagtcttttgagaaagacatgcgggctgcaatggggtgctttcgtcatcttaagaccatgtttcaagaacttgaagagtgtcgggcattcgaattacttaagtcaacagctgatagggctaactacttaatgaccaagcaggctaagattgtggcaatgacttgcacccatgcagctctaaagaggaaagatttcctccagttaggtttcaagtatgacaacttgctaatggaagaaagtgcccaaattttagaaattgagactttcattccaatgttactccagcggcaggaggatggtcatgcacggcttaaacgctgcattctgattggtgaccatcaccagttgcctcctgttgtgaagaatatggcttttcagaagtacagccacatggatcagagtctatttaccaggtttgtccgattgggcattccttacattgaactaaatgctcagggaagagccaggccaactatagctaaactttacaattggagatacagagatttgggagaccttccttctgtaaaggaggaagtcatattcaatagggcaaatgctggatttgcttatgattatcagttagtggatgttccagattaccttggtaagggggagacaactccatctccttggttttaccaaaatgagggagaagcagaatatgttgtcagtgtctatatatacatgcgtcttttagggtatcctgcaaataagatatcaattttgactacatacaatggtcagaaacttctcatccgtgatgttataaataggagatgcgttccatatgactttattggtcctcctagtaaggttactacagtggataagtttcaaggtcagcaaaatgattttatattgctatctcttgtgcgtactcgatttgttggtcacctacgtgatgtaagaagattggttgttgcaatgtcacgtgctcggcttggtttatatgtcttttgccgtcgttccctttttgaacaatgctatgagctgcaacctacatttcagctgcttcttaaaagacctgaccaccttgcccttaatgtgaatgagattacatcatatactgaacgaaatgttgaagatcctggaccggggcatcatttacatcttgtcagtggcattgaggagatgggtagtatcatagacagactgtatcaggaaaagttgagacatcagtttgatcaaaatggggcttattttagtcatttagaaccatcagcaaatacagattgggtgcaaagtgggcagcagactatggacactgatatgcctgaacaaacagaggaagctacaactgttgataaccatgtcgctgtagatatgccacctgaaaacagcatggaagatgttaccatggttgataatggtgatggtgttgcaaatgggaacccatcgccatagaagcccttcaaatgaggagactggtgtaggtgctgctaagcattccttgcacatttgtttttttttttttgttttccagttacatatccgtaggtcatggcatttctatgactagataaatcaatgccaaattgacaagatgtagctatatagcaattagcaaattagatttttcatgtggaaggccaggtggaggaattcatgttttgtatgtaacaattgtagtcggtatatgggatggcttattgatgtagctatagcaattgtagtcagtatattttttcgaatcaattaatcactagtccacttttactcgc

SEQ ID NO: 849 - DNA, 4892 bp, Glycine max
atgacgaaagtttacggcacggggttatacgatttccggcgccaccgcgtcgccgagtatccggtggcggcggcaccagcagagtcgaaaacgttagttccaaagaccggcggcggcggcggcggcgttccgagcagcatcactctgtcggagattcagcgcgaccggctgacgaagattgcggaggcgaactggttgaaaagtggcgatgcggggaggcctaagaaggacttcgaccctgagcttgttcgcaagatctacgaaaccgaattgttggtgaaagagggttcgaaacccgttcccttgcaacgtgtcatgattctggaggttagccagtatctggagaattacctgtggccttatttcgaccctctcactgccaccttcgagcatgttatgtccatcatcatcatggtcaacgagaagttccgagaaaatgttgccgcttggacttgcttccatgagaggaaagacgctttcaaaggctttctcgagagtgttcttcgcttgaaggagggacgagaactaagtatagccgaaaagacgaattacctagtttttatgataaatgcctttcagagtttggaagatgaggttgttagcaggacaatcttgagactggcaaatttgaaatcttggtacagtttgtcttatggtcgatttcagatggagctttgtcttaatcctggcttgatcaagaaatggaaaaggatgataaagaaggaacctgtgaaaggagatggatcacatttagatccctcaactacagttgaagtgatgttcgtgagaaacctcatagaagaatttctggagatactggattcacaggtatttcccctgaaacaattatctggtgaggacgatgaacttattgatgctactggtttggggctagttaatgatgcctgtgtcctgtactgtgagaggtttatggaatttctaattgacctcttgagtcaattgccaacgaggaggtatttgaggcctcttgtggctgatgtagctgtagttgccaaatgccatttaagtgcactctataggcatgaaaaggggaaactttttgcgcagttggttgatttactgcaattctatgaagggtttgagattaatgatcatactggaacacagttaacagatcatgaggttcttgaatctcattacagccgaatgcagtcattccagctacttgcatttaaaaagatggaaaagctgcgggaacttgctttgactaacattggttcgattcacaagcgtgctaatctgtccaagaaattgtctgttctttctccggaggagttaagagattttgtttgctgtaagcttaaactggtctctaaggaagatccctggtcagagagggttgattttcttattgaagtaatggtgtcctattttgagaagcaacaatctcaaaaagaagctattaatgctcttcccctttatccaaatgagcagattatgtgggatgaaagtgttgtacccagcataaattactctggagaaggttgcttagcattacccaagctgaacttacagttcttaacacttcatgattatcttcttcgaaattttaatctttttcgacttgagtcaacatatgagatacgtgaggacattcaggaagctgttccacatcttcttgcatatattaataatgatggaggaactgcttttcgtggttggtcaagaatgggtgtgccaatcaaagaattcaaaatcactgaagttaaacaacctaacattggagaagtcaaaccatcatctgtgactgcagaggttacttatagcgtttccagttatagagcacatattagatcagaatgggatgcactcaaagagcatgatgtattgtttttactatctattcgcccatcatttgagcctcttagtacagaagaagaagacaaagctagtgtcccacaaaagcttggcctacaatttgtacgcggttgtgaagttattgagattcgtgatgaggaaggaaaccttatgaatgatttttctggaaagataaaacgtgatgagtggaagccaccaaagggggaactgagaacagtaactgtggctttggatacagctcaataccacatggatgtaagtaacattgccgaaaaaggggcagaagatgtttatggtacatttaatgtgttgatgaggaggaagccaaaagaaaacaattttaaagccatcctagaatcaataagggatttaatgaatgaatactgtattgttcccaagtggttggaaaacatttttcttggttatggggatccttcagctgcacagtggactaatatgcctgatctattggagacagtagatttcaaagacacttttgttgatgctgatcacttaaaagaaagttttttggattatgaggtgtcttttgttaatcctgatggctcaggaaatttgaatccaaggcctccttttaagatcaagcttccccgaacactcaaaccaaacaatggtgctcttactgggcatgcaatatctacttctggtgcaacaaatgaaatcaatgtggttgatgctaattatcagaaagaagcactaattattgagacatatactcctccagatcctggcccctatcctcaagatcagcctaaacaaaattcagttagatttacacccacccaggttgaagcaatcatctctggcattcagcctggtctaactatggttgtggggccacctggtacaggaaagactgatacagctgtacaaattctaaatgttctttatcataattgtccttctcagagaaccttaataattactcattcaaatcaggctttgaatgacctgttcgagaagataatgcagagagatgttcctgcacgttatcttcttcgacttggtcaaggagaacaagagctagcaactgatcttgattttagccggcaaggtcgtgttaatgcaatgcttgttagacggttagaattgctgagtgaagtggagaggctagcaagatctcttcaattgcccgaggatgtgggttacacttgtgaaactgcaggatacttttggttgcttcatgtttattcacgctgggagcaatttcttgctgcttgtgctgagaataaagaaaagtcaacatttgttcgagatcgttttcccttcaaagagttcttctgtgatacaccacatcctgtatttacaggtgagtcttttgagaaagacatgcgggctgcaatggggtgctttcgtcatcttaagaccatgtttcaagaacttgaagagtgtcgggcattcgaattacttaagtcaacagctgatagggctaactacttaatgaccaagcaggctaagattgtggcaatgacttgcacccatgcagctctaaagaggaaagatttcctccagttaggtttcaagtatgacaacttgctaatggaagaaagtgcccaaattttagaaattgagactttcattccaatgttactccagcggcaggaggatggtcatgcacggcttaaacgctgcattctgattggtgaccatcaccagttgcctcctgttgtgaagaatatggcttttcagaagtacagccacatggatcagagtctatttaccaggtttgtccgattgggcattccttacattgaactaaatgctcagggaagagccaggccaactatagctaaactttacaattggagatacagagatttgggagaccttccttctgtaaaggaggaagtcatattcaatagggcaaatgctggatttgcttatgattatcagttagtggatgttccagattaccttggtaagggggagacaactccatctccttggttttaccaaaatgagggagaagcagaatatgttgtcagtgtctatatatacatgcgtcttttagggtatcctgcaaataagatatcaattttgactacatacaatggtcagaaacttctcatccgtgatgttataaataggagatgcgttccatatgactttattggtcctcctagtaaggttactacagtggataagtttcaaggtcagcaaaatgattttatattgctatctcttgtgcgtactcgatttgttggtcacctacgtgatgtaagaagattggttgttgcaatgtcacgtgctcggcttggtttatatgtcttttgccgtcgttccctttttgaacaatgctatgagctgcaacctacatttcagctgcttcttaaaagacctgaccaccttgcccttaatgtgaatgagattacatcatatactgaacgaaatgttgaagatcctggaccggggcatcatttacatcttgtcagtggcattgaggagatgggtagtatcatagacagactgtatcaggaaaagttgagacatcagtttgatcaaaatggggcttattttagtcatttagaaccatcagcaaatacagattgggtgcaaagtgggcagcagactatggacactgatatgcctgaacaaacagaggaagctacaactgttgataaccatgtcgctgtagatatgccacctgaaaacagcatggaagatgttaccatggttgataatggtgatggtgttgcaaatgggaacccatcgccatagaagcccttcaaatgaggagactggtgtaggtgctgctaagcattccttgcacatttgtttttttttttttgttttccagttacatatccgtaggtcatggcatttctatgactagataaatcaatgccaaattgacaagatgtagctatatagcaattagcaaattagatttttcatgtggaaggccaggtggaggaattcatgttttgtatgtaacaattgtagtcggtatatgggatggcttattgatgtagctatagcaattgtagtcagtatattttttcgaatcaattaatcactagtccacttttactcgc

SEQ ID NO: 850 - DNA, 4343 bp, Lotus japonicus
ttggcgatgacgaaagtgcacggcacgggaacatacgatttccgccgccatagagtggcggagtatccggtggcagcggagccgaaaccagtagagtggagtcaaaagagtggcggtgctcttcccagcacactcacagtatctgagattcaacgtgacaggttgaccaagattgcagaggagaattggtcgaagaagaagaaggagaaagcgtttgatgcggaggttgttgagaaaatctacgaaagtgagttgttggtgaaagagggtcagggtcacaaacccgttcctttgcagagggtcatgatccttgaggttagtcagtatctcgagaattacctctggccccatttcgaccctctcactgctaccttccagcatgttatgtccatcatccttatggtcaacgagaagttccgcgaaaatgtcgccgcttgggtttgcttccatgagaggaaagatgccttcaaagggtttcttgagagggttcttcgcgtaaaggagggaagagaactaagtatagcagagaagacaaattacctaattttcatgataaatgccttccagagtttggaagatgaggttgttagcgagacagtcttgaaactagcaagtttgaaatcctggtatagtttgtcttatggtcgttttcagatggagctttgtcttaatccaagtttgatcaagaaatggaaaaggatgataaaaaaggaatcagggaaaggaggacaccattctgatcagtcaactgcggttgaagttatgttcttgaggaacctcatagaagaatttctggagatattggattcacaagtgtttccccagaggcagttgtctggtgagaatgatgaacttattgatggtgctgattttggtgtagttaatgatgcttgtgtcctttattgtgagaggtttatggaatttcttattgacctattgagtcaattgccaacgagaaggtatttgaggcctctagtggctgatgtagctgtagttgccaaatgccacctgagtgcgctctataggcatgaaaagggaaaactttttgcccaattggttgatttattacaattctatgaagggtttgagattaacgatcatactggcacacagttaacagatcatgaggttctcgaatctcattacagccgactgcaagcattccagctacttgcatttaagaagatgagcaagctgcgggaactttctttgactaacattggttcaattcacaagcgcgctaatctctccaagaaactgtctgttctttctcctgaggagctaagggatttggtttgctgtaagctcaaactggtttctaaggaagatccctggtcagaaagggttgattttcttattgaagtaatggtgtcctttttcgagaagcagctgtctcaaaaagaagctatcaatgctcttcctctttacccaaatgaacagattatgtgggatgaaagtgttgtaccgagcataaattactctggagaaggttgtttagcgttaccaaagcttaacttacagttcttaacacttcatgactatcttcttcgaaattttaatctctttcgacttgaatcaacatatgagatacgtgaggatattcaggaagctgtaccacatcttcaagcatatatcaatagtgatggagaaactgctttccgcggttggtcaagaatggctgtgccaattaaagagttcaggatcactgaagtaaaacaacccaacataggagaagtcaagccatcatctgtgactgcaaaaattacttacagcatttccagttatagagcacacgttaggtcagaatgggatgcactaaaagaacatgatgtattgtttttactatctattcgcccatcattcgagcctcttagtgcagaagaagaagccagagctagtgtgccgcagaagcttggcctacaatttgtacggggatgtgaagttactgagattcgtgatgaagaagggatccttatgaatgatttttcaggaaggattaaacgggatgagtggaagccgccaaagggggagctgagaacagtaactgtggctttggatacagcacaataccatatggatgtcaataaaattgctgagaaaggggcagatgatgtttatggtacatttaatgtgttaatgaggaggaagccaaaagaaaacaattttaaagccatcttagaatcaataagggatttaatgaatgaatactgtattgttcccaagtggttagaaaacatttttcttggctatggggatccttctgcagcacaatggactaatatgcctgatctgttggaagcagtagatttcaaagatacttttgtagatgctgatcacttgagaaaaagttttgtgaattatgaggtttctttcgttaatcctgacggcactgaaaacttgaatccaaggcctccttttaaaatcaaacttccccggacgctcaaaggaagcattggttctcatcctgggggtgcagtgcctgctgttgatgcaacaaatgatatcaatgtagttgatgctaatcatcagaaagaaaaactaattattgagacatatactccacctgacccaggcccttatcctcaagatcagccaaaacaaaatacagttagatttacacccacacaggttgaagcaattatatctggcattcagcctggcctaactatggttgtggggccacctggtacgggaaagactgatacagctgtacaaattttgaatgttctttatcataattgtccttctcagagaaccttaataattactcattcaaatcaagctctgaatgacctgtttgagaagataatgcagagagatgtacctgcacgatatcttctccgacttggtcaaggagaacatgaactagaaactgatctagattttagtcgacaaggtcgtgttaatgcaatgcttgttagacgtctagaattgcttagtgaagtggagaggctagcaaggtctcttaatttgccagaggatgtgggttacacttgtgaaactgcaggatacttctggttgcttcatgtttattcacgctgggagcaatttcttgctgcttgttctgagaataacgaaaagccaacatttgttcgagatcgttttccctttaaagagttcttctttgacacaccacatcctgtatttaccggcgaatcttttgagaaagacatgcgggctgctatgggatgctttcgtcatctgaagactatgtttcaagaactcgaagagtgccgggcatttgaattacttaagtcaacagctgatagggctaactacttaatgaccaagcaggccaagattgtggcaatgacttgtactcatgcagctctgaagaggaaagatttccttcagttgggttttaagtatgacaatttgttgatggaagaaagtgctcagattttagaaattgagactttcataccaatgttactccagaggcaagaagatggtcatgctaggcttaaacgctgcattctgattggtgatcatcaccagttgcctccagttgtgaagaatatggctttccaaaagtacagccacatggatcagagtctgtttactaggtttgtccgtttgggcattccttacattgagctaaatgctcagggaagagccagaccaagtatagctaaactcttcaattggagatacagagatttgggagaccttcctattgtaaagaaggaagtcatattcaatagggcaaatgctgggtttgcttatgattatcagttagtggatgttccagattacatgggtaagggggagacaactccatctccatggttctaccaaaatgagggagaagcagagtatgttgtcagcgtctatatatacatgcgtctgttagggtatcctgctaataagatatcaattttgactacttacaatggccagaaacttttgatccgtgatgttataagccggagatgcactccatttgactacattggtgcaccaagcaaggttactacggtggataagtttcaaggtcagcaaaatgattttattttgctgtctcttgtgcgaactcgattcgttggtcacctacgtgatgtaagaagattggttgttgccatgtcacgagctcggctgggtttatatgttttttgccgccgttcccttttcgagcagtgctatgagctgcagcctacatttcagcttcttctgaagagacctgaccaccttgcccttaattttagtgagattacatcatgtactgaacgagatgttgaagatcctggacctcatatacatcttgtcagtggcattgaggagatgagtagtatcatagaaaggctgtgtcaggtatgtcacttcttgtgataatagaccttcat

SEQ ID NO: 851 - DNA, 4866 bp, Glycine max
ctaatttcacaactttcccgatgacgaaggtttacggcacggggttatacgatttccggcgccaccgcgtggcagagtaccccgtggcggcgccgccatcggagtcgaaagcggaagttccaaaggcaggcggcggcggcggctttccaagcagcatcactctgtcggagattcagcgcgaccggctgacgaagattgcggaggcgaactggttgaaaagcggcgatgcggctaggccgaagaaggacttcgaccctgagctagttcgcaagatctacgaaaccgaattgttagtgaaagagggttccaaacccgttcccttgcaacgtgtcatgattctggaggttagccagtatctggagaattacctgtggcctcatttcgaccctctcgctgccaccttcgagcatgttatgtccatcatcatcatggtcaacgagaagttccgagagaatgttgccgcttggacttgtttccatgagaggaaagacgctttcaaagtctttctcgagagggttcttcgcttaaaggagggacgagaactaagtatagcagagaagacgaattacctagtttttatgataaatgcctttcagagtttggaagatgaggttgttagcaggacaatcttgagactggcaaatttgaaatcttggtacagtttgtcttatggtcgttttcagatggagctttgtcttaatcctggcttggtcaagaaatggaaaaggatgataaagaaagaacctgtgaaagggggtggatcacatttagatcccttaactaaagttgaagtgatgttcgtgagaaacctcatagaagaatttatggaggtcgtatttccccagaaacaattatctggtgaggacaatgaacttattgatgctactggtttggggctacttaatgatgcctgtgtcctgtactgtgagaggtttatggaatttctaattgacctcttgagtcaattgccaacaaggaggtatttgaggcctcttgtggctgatgtagctgtagttgccaaatgccatttaagtgcactctataggcatgaaaaggggaaactttttgcccagctggttgatttactgcaattctatgaagggtttgagattaatgatcatactggaacacagttaacagatcacgaggttcttgaatctcattacagccgaatgcagtcattccaactacttgcatttaaaaagatggaaaagctgcgggaacttgctttgactaacattggttcgattcacaagcgtgctaatttgaccaagaaattgtctgttctttctccggaggagttgagaaattttgtttgctgtaagcttaaactggtctctaaggaagatccctggtcagagagggttgattttcttattgaagtaatgctgtcctattttgagaagcaacaatctcaaaaagaagctattaatgctcttcctctttatccaaatgagcagattatgtgggatgaaagtgttgtacccagcataaattactctggagaaggttgtttagcattgcccaagctgaacttacagttcttaacacttcatgattatcttcttcgaaattttaatctttttagacttgagtcaacatatgagatacgtgaggacattcaggaagctgttccacatcttcttgcatatattaataatgatggaggaactgcttttcgtggttggtcaagaatgggtgtgccaatcaaagaattcaaaatcactgaagttaaacaacctaacattggagaagtcaaaccatcatccgtgactgcagaagttacttatagtgtttccagttatagagcacatattagatcagaatgggatgcactcaaagagcatgatgtattgtttttactatctattcgcccattatttgagcctcttagtgccgaagaagaagacaaagctagtgttcctcagaagcttggcctacaatttgttcgaggttgtgaagttattgagattcgagatgaggaaggaaaccttatgaatgatttttctggaaagattaagcgtgatgagtggaagccaccaaagggggaactgagaacagtaactgtggctttggatacagcacaataccacatggatgtaagtaacattgctgaaaaaggggcagaagatgtttatggtacatttaatgtgttgatgaggaggaagccaaaagaaaacaattttaaagccatcttagaatcaataagggatttaatgaatgaatactgtattgttcccaagtggttggaaaacatttttcttggttatggggatccttcagctgcacagtggactaatatgcctgatgtattggagacagtagatttcaaagatacttttgttgatgctgatcacttaaaagaaagttttgtggattatgaggtgtcttttgttaattctgatggctcagaaaatttgaatccaaggcctccttttaagatcaagcttccccgaacactcaaacctaacaatggtactcttactgggcatgcaatgtctacttccggtgcaacaaatgatatcaatgtggttgatgcaaattatcagaaagaagcactagttattgagacatatactcctccagatcctggcccctatcctcaagatcagcccaaacaaaatttagttagattcacacccacacaggttgaagcaatcatctctggcattcagcctggtctaactatggttgtggggccacctggtacaggaaagactgatacagctgtacaaattctaaatgttctttaccataattgtccttctcagagaaccttaataattactcattcaaatcaggctttgaatgacctgtttgagaagataatgcagagagatgttcctgcacgttatcttcttcgacttggtcaaggagaacaagagctagcaactgatcttgattttagccggcaaggtcgtgttaatgcaatgcttgttagacggttagaattgctcagtgaagtggagaggctagcaagatctcttcaattgcccgaggatgtgggttacacttgtgaaactgcgggatacttttggttgcttcatgtttattcacgctgggagcagtttcttgctgcttgtgctgagaataaagagaagtcaacatttgttcgagatcgttttcccttcaaagagttcttctatgatacaccacatcctgtatttacaggtgagtcttttgagaaagacatgcaggctgctacggggtgctttcgtcatcttaagaacatgtttcaagaacttgaagagtgtcgggcattcgaattacttaagtcaacagctgatagggctaactacttaatgaccaagcaggctaagattgtggcaatgacttgcacccatgcagctctaaagaggaaagatttcctccagttaggtttcaagtatgacaacttgctaatggaagaaagtgcccaaattttagaaattgagactttcattccaatgttactccagcggcaggaggacggtcatgcacggcttaaacgctgcattctgattggtgatcatcaccagttgcctcctgttgtgaagaatatggcttttcagaagtacagccacatggatcaaagtctatttacaaggtttgtccgattgggcattccttacattgagctaaatgctcagggaagagccaggccaagtatagctaaactttacaattggagatacagagatttgggagaccttccttctgtaaaggaggaagtcgtattcaatagggcaaatgctggatttgcttatgattatcagttagtggatgttccagattaccttggtaagggggagacaactccatctccttggttttaccaaaatgagggagaagccgaatatgttgtcagtgtctatatatacatgcgtcttttagggtatcctgcaaataagatatcaattttgactacatacaatggtcagaaacttctcatccgtgatgttgtaaataggagatgcgttccatacgatttcattggtcctccaagcaaggttactacagtggataagtttcaaggtcagcaaaatgattttatattgctatctattgtgcgtactcgatttgttggtcacctacgtgatgtaagaagattggttgttgcaatgtcacgtgctcggcttggtttatatgttttttgccgtcgttccctttttgaacaatgctatgagctgcaacctacatttcagctgcttcttgaaagacctgaccaccttgcccttaatgtgaatgagattacatcatatactgaacgaaattttgaagatcctggacctggacatcatgtacatcttgtcagtggcattgaggagatgggtagtatcatagacagactgtatcaggaaaagttgagacatcaatttgatcaaaatgggccttatttgagtcatttagaaccatcagaaaatacagatgggatgcaaagtgggcagcagactatggacactgatatgcctgaacaaacagaggacgacatgccacataaaatcaaggaagctacaactgttgataatgtaactggatataacaacgtggaagatgttaccatggttgataatagtgatggtgttgcaaatgggaacccatcgccatagaagcccttcaaatgaggagactggtgtaggtgctgctaagcaagcattcattgcacatttgatttttgtttttgttttccagttagttacataactggtgtggtgggtcatggcgtttctatgactagattaatcaatgccaaattgacaagatgtagctatagcaaattagattttaaatgtaggtcaggtggaggaattcgtgttttgtatgtaccaattgtagtcagtatattttaccgaatcaattaatcactaatccactttcactcgcata

SEQ ID NO: 852 - DNA, 4856 bp, Glycine max
atgacgaaggtttacggcacggggttatacgatttccggcgccaccgcgtggcagagtaccccgtggcggcgccgccatcggagtcgaaagcggaagttccaaaggcaggcggcggcggcggctttccaagcagcatcactctgtcggagattcagcgcgaccggctgacgaagattgcggaggcgaactggttgaaaagcggcgatgcggctaggccgaagaaggacttcgaccctgagctagttcgcaagatctacgaaaccgaattgttagtgaaagagggttccaaacccgttcccttgcaacgtgtcatgattctggaggttagccagtatctggagaattacctgtggcctcatttcgaccctctcgctgccaccttcgagcatgttatgtccatcatcatcatggtcaacgagaagttccgagagaatgttgccgcttggacttgtttccatgagaggaaagacgctttcaaagtctttctcgagagggttcttcgcttaaaggagggacgagaactaagtatagcagagaagacgaattacctagtttttatgataaatgcctttcagagtttggaagatgaggttgttagcaggacaatcttgagactggcaaatttgaaatcttggtacagtttgtcttatggtcgttttcagatggagctttgtcttaatcctggcttggtcaagaaatggaaaaggatgataaagaaagaacctgtgaaagggggtggatcacatttagatcccttaactaaagttgaagtgatgttcgtgagaaacctcatagaagaatttatggagatactggattcacaggtatttccccagaaacaattatctggtgaggacaatgaacttattgatgctactggtttggggctacttaatgatgcctgtgtcctgtactgtgagaggtttatggaatttctaattgacctcttgagtcaattgccaacaaggaggtatttgaggcctcttgtggctgatgtagctgtagttgccaaatgccatttaagtgcactctataggcatgaaaaggggaaactttttgcccagctggttgatttactgcaattctatgaagggtttgagattaatgatcatactggaacacagttaacagatcacgaggttcttgaatctcattacagccgaatgcagtcattccaactacttgcatttaaaaagatggaaaagctgcgggaacttgctttgactaacattggttcgattcacaagcgtgctaatttgaccaagaaattgtctgttctttctccggaggagttgagaaattttgtttgctgtaagcttaaactggtctctaaggaagatccctggtcagagagggttgattttcttattgaagtaatgctgtcctattttgagaagcaacaatctcaaaaagaagctattaatgctcttcctctttatccaaatgagcagattatgtgggatgaaagtgttgtacccagcataaattactctggagaaggttgtttagcattgcccaagctgaacttacagttcttaacacttcatgattatcttcttcgaaattttaatctttttagacttgagtcaacatatgagatacgtgaggacattcaggaagctgttccacatcttcttgcatatattaataatgatggaggaactgcttttcgtggttggtcaagaatgggtgtgccaatcaaagaattcaaaatcactgaagttaaacaacctaacattggagaagtcaaaccatcatccgtgactgcagaagttacttatagtgtttccagttatagagcacatattagatcagaatgggatgcactcaaagagcatgatgtattgtttttactatctattcgcccattatttgagcctcttagtgccgaagaagaagacaaagctagtgttcctcagaagcttggcctacaatttgttcgaggttgtgaagttattgagattcgagatgaggaaggaaaccttatgaatgatttttctggaaagattaagcgtgatgagtggaagccaccaaagggggaactgagaacagtaactgtggctttggatacagcacaataccacatggatgtaagtaacattgctgaaaaaggggcagaagatgtttatggtacatttaatgtgttgatgaggaggaagccaaaagaaaacaattttaaagccatcttagaatcaataagggatttaatgaatgaatactgtattgttcccaagtggttggaaaacatttttcttggttatggggatccttcagctgcacagtggactaatatgcctgatgtattggagacagtagatttcaaagatacttttgttgatgctgatcacttaaaagaaagttttgtggattatgaggtgtcttttgttaattctgatggctcagaaaatttgaatccaaggcctccttttaagatcaagcttccccgaacactcaaacctaacaatggtactcttactgggcatgcaatgtctacttccggtgcaacaaatgatatcaatgtggttgatgcaaattatcagaaagaagcactagttattgagacatatactcctccagatcctggcccctatcctcaagatcagcccaaacaaaatttagttagattcacacccacacaggttgaagcaatcatctctggcattcagcctggtctaactatggttgtggggccacctggtacaggaaagactgatacagctgtacaaattctaaatgttctttaccataattgtccttctcagagaaccttaataattactcattcaaatcaggctttgaatgacctgtttgagaagataatgcagagagatgttcctgcacgttatcttcttcgacttggtcaaggagaacaagagctagcaactgatcttgattttagccggcaaggtcgtgttaatgcaatgcttgttagacggttagaattgctcagtgaagtggagaggctagcaagatctcttcaattgcccgaggatgtgggttacacttgtgaaactgcgggatacttttggttgcttcatgtttattcacgctgggagcagtttcttgctgcttgtgctgagaataaagagaagtcaacatttgttcgagatcgttttcccttcaaagagttcttctatgatacaccacatcctgtatttacaggtgagtcttttgagaaagacatgcaggctgctacggggtgctttcgtcatcttaagaacatgtttcaagaacttgaagagtgtcgggcattcgaattacttaagtcaacagctgatagggctaactacttaatgaccaagcaggctaagattgtggcaatgacttgcacccatgcagctctaaagaggaaagatttcctccagttaggtttcaagtatgacaacttgctaatggaagaaagtgcccaaattttagaaattgagactttcattccaatgttactccagcggcaggaggacggtcatgcacggcttaaacgctgcattctgattggtgatcatcaccagttgcctcctgttgtgaagaatatggcttttcagaagtacagccacatggatcaaagtctatttacaaggtttgtccgattgggcattccttacattgagctaaatgctcagggaagagccaggccaagtatagctaaactttacaattggagatacagagatttgggagaccttccttctgtaaaggaggaagtcgtattcaatagggcaaatgctggatttgcttatgattatcagttagtggatgttccagattaccttggtaagggggagacaactccatctccttggttttaccaaaatgagggagaagccgaatatgttgtcagtgtctatatatacatgcgtcttttagggtatcctgcaaataagatatcaattttgactacatacaatggtcagaaacttctcatccgtgatgttgtaaataggagatgcgttccatacgatttcattggtcctccaagcaaggttactacagtggataagtttcaaggtcagcaaaatgattttatattgctatctattgtgcgtactcgatttgttggtcacctacgtgatgtaagaagattggttgttgcaatgtcacgtgctcggcttggtttatatgttttttgccgtcgttccctttttgaacaatgctatgagctgcaacctacatttcagctgcttcttgaaagacctgaccaccttgcccttaatgtgaatgagattacatcatatactgaacgaaattttgaagatcctggacctggacatcatgtacatcttgtcagtggcattgaggagatgggtagtatcatagacagactgtatcaggaaaagttgagacatcaatttgatcaaaatgggccttatttgagtcatttagaaccatcagaaaatacagatgggatgcaaagtgggcagcagactatggacactgatatgcctgaacaaacagaggacgacatgccacataaaatcaaggaagctacaactgttgataatgtaactggatataacaacgtggaagatgttaccatggttgataatagtgatggtgttgcaaatgggaacccatcgccatagaagcccttcaaatgaggagactggtgtaggtgctgctaagcaagcattcattgcacatttgatttttgtttttgttttccagttagttacataactggtgtggtgggtcatggcgtttctatgactagattaatcaatgccaaattgacaagatgtagctatagcaaattagattttaaatgtaggtcaggtggaggaattcgtgttttgtatgtaccaattgtagtcagtatattttaccgaatcaattaatcactaatccactttcactcgca

SEQ ID NO: 853 - DNA, 4833 bp, Arabidopsis lyrata
tctctgaacctcttcttctctgtatgtcttgattctgacttctctctgaacaagaagctttcgcgtgagagaaatgacgaaggtctatggaaccggtacgtacgacttcaaacgccacagagtggcggagtatccattggagttacctagccatcctgctgagaagccactagaagcaaagcctggatccaatttaccgagctccatcactttatcggagattcagcaagataggttaacgaaaatcgctgaggagagctggattaagactggaggcaagctaccggagaaacctttcgatccggaggttgtgaaggagatttatgtgacggagcttaaggtaactagtggtcgtaaaccggttccacttcagcgagttatgattttggaagtgagtcagtatttggagaactatctatggccgaattttgaccctgagacggctacgtttgagcatgtcatgtctatgattcttatgattaacgagaagttccgggagaatgtggcagcttggatttgctttcatgatcgggacgatctattcaaaaagtttcttcagaaggttcttcgccttaaagtgggaagagacttgactattgctgagaagacaaattatttggtcttcatgattaatgctttccagagtttggaagacgcggtggttaatgagattgttctaagtctagcaggattacaatcttggcacagcttgtcttatggacgtttccagatggagctctgccttcaacctgatctaataaaaaaatggaagaggtcatcaaagaaatgggcagctgaggcgaagtcaaagggagagaaatttgatctatcctcatcacctgaagcaaattttgttcgaggcataatagaagaatttgtcgaggtgcttgatcatggggtttttgcggatgaggttgatgatactgctgggtctcaattggtcgatgattcttctgtcttatattgtgaaagattcatggaatttctcattgacatgctgaaccaacttccaaccagaagatacctaagacctcttgtggcggatatagcagttgttgccaaatgtcgactgagtgccctatacaaacatgaaaaggggaagcttttcgcccaactagttgacttgttacagttctacgaaaagtttgagataaaggatcatgatggaacacaattaactgatgatgaagcacttcaatttcattatgatcgttttatggcgtttcagctacttgcctttaagaaaatacctaagttgcaagatctgtctctggctaacattggttcggttcacaagagttctgatctccggaggagattgtcggtgctttctcttgaagatttaagggatgttgtctgctcaaagctcaaactggtttcaagacatgatccttgggcagatagtaaggattttctgactgaagtcgttgtctcctcttttgagaagcaacagtctcagaaagaagcaataaacgccctgcctttgtacccaaatgagcaaatcatgtgggacgaaagtgttattccaagcattaattattctggggaaggttgccttgctcttccaaagcttaatcttcagtttctaacactccatgattatctcctaagaaacttcaatctcttccgtctagaatccacctatgagattcgggaagatatacaagaagctgtaccacatcttcttgcacatataaataatgagggagacactgcttttcgtggttggtcacgaatggcggttcctattaatgatttcaaaatcgctcaggtgaaacagcctaatattggagaagagaaaccttcatctgtgactgcagaagttactttcagtattaaaagttacagaacgcagataagatctgaatggaattcccttaaagagcatgacgtattgtttttgctttgtatacgcccttcatttgagccattaggtcctgatgaagctgataaagctacagtaccacagaggctcgggcttcagtatgttcgtggctgtgaaatcatcaatatccgcgatgaggagggtaatctgatgaatgattttactggaagagttaaacgggatgaatggaagcccccaaaaggtgaaatgaggactgtgactgttgctttagatgctgcacagtatcatatagatgttacagacatggctgaaaaaggtgctgaggatgtgtatggcacatttaatgtgctaatgaggaggaaaccaaaggagaacaacttcaaggctattctggaatctatcagagatcttatgaatgaatattgcattgtgccggagtggctgcataatgtttttcttgggtatggcaacccttctgctgcacagtggcctaatatgccaaacctgttggaaacagtggacttcaaagatactttccttgatgcaaatcatctcagtgaaagttttccagattatgaggtatctttcatcaatgctgaaggtgctgaagctctggatccaagtcctccgtttcgaatcactcttccaaagacactaaaaggaaatgctgctatttctggaaacaagatatctgaagtcaatccagcagacaatgttaatatggtggatgcttccccgaaggagaaacttattgttgaggcatataccccacctgacccagggccttatcctcaggaccagccgaagcagaactctgtcaaatttacacctacacaggttggagcaattatctctggtattcagcctgggctaactatggtggttggcccaccaggtaccggaaagactgatacagcagtgcaaattttgaatgttctataccacaactgtccttctcagaggaccttgataatcactcattcaaatcaggctttgaatgatctttttgagaagataatggagagggatgtaccagcgcggtatctacttcgtttgggtcaaggtgaacaagagcttgccactgatcttgactttagcagacaaggccgtgtcaatgccatgcttgttcggcgtttggaactgcttaatgaggttgagagactaggaagatctcttcagcttccagaggatgtaggatatacttgtgaaacagctggatatttctggttgcttcatgtatactcgcgctgggagttgtttctcgctgcttgtgcaggtaatgaagacaatcaatcttttgttcgagatcgcttcccgttcaaagatttcttctcagacacccctaaacctgtatttagtggggagtcatttgagaaagacatgagggcagctaaaggttgtttctctcatctcaagactgtgttccaagagctagaagagtgtagggcctttgaactactcaagtcaactgctgatagagcaaattatctgatgaccaaacaagcaaagattgtagcaatgacgtgtactcatgcggcattaaagaggagagattttcttcagttagggttcaaatatgataacttattgatggaagaaagtgctcagattttggaaattgaaactttcataccaatgttgcttcagaggcaagaagatggtcatgcacgactcaagcgctgtatattgattggtgatcaccaccagctgcctcccgtggtgaagaatatggctttccagaaatatagtcacatggatcagagtttgtttacgaggtttgttcgtcttggtattccttatattgagctcaatgctcaaggaagagccaggccaaccttagccaaactttacaactggagatacagagatttaggagacctttccattgttaaggaagcacccatcttccaaagagcaaatgctggattctcatatgaatatcagttggtgaatgtgcctgattatgaggggaaaggagaatcgacaccatctccatggttttatcaaaatcagggagaagctgaatatatcgtcagtgtctatatatacatgagattgttaggatatcctgcgaataagatatcaatattgacaacatataatggtcagaagctcttaatccgtgatgttatcaaccgtcgatgtgttccatatccattcattggcccgccgagcaaggtgacgacagtggacaagttccaagggcaacagaatgattttatcttgctctctcttgtacggacacgctttgtaggtcatctacgtgatgtaagaaggttggtagttgcaatgtcacgtgctaggctcggtttgtatgtgttctgccgccgttctctctttgaacagtgctatgagctgcaaccaacttttcaacttcttcttcaaagacccgatcggctcggactcaatcttaatgagaacacaacgtatacagatcgtgctgttgaggaagttggaaatccgtatcttgttcatgatgttgaagaaatggcacacatagttcacgataggatgaaccagttctaccaggcacaaggagtgtatgagcaataccagaacaacatgccacagatggaagatggtaatcacgacatggagagtgattcagtagtaggagctgtagatggtgatgaatctgagaaaaatatgcagcagataaaacaagctccagacatagacggagaattatcgaaggaggtggttggaatggaggtggacaataatggatttagcagtgagaatggaaaggctgatgagaagaattaggacaaatcaaactgggaatatcaaatgtatccactcggatggtgacaaatgagttgatgtttgaaacatgagggaatttgttgctactgtaagaaatatttactgaatttgagtaaattctggtaagtgatatatgacacagaggaaaaagtagcattgtctgacaattctttcctcaccaactttttgtaacttctatttgagttttcaagctgtcttat

SEQ ID NO: 854 - DNA, 5107 bp, Aquilegia formosa
ccccaaatccccaatccaaaatgccaaaagtttatggaactggtgtttatgatttcaaacgacatagagttgcagaatacccaattcttcaacgaccaattcaagacccaaaaccagtgaattcgattacatcgaattcatcggcgttttcgattacattagatgaaattcaaacagatagattaacaaaaattgctgcagaaaattggtcgaaaacatcagtttctagttctattactaacccttttagtaatgagctagttaaagagatatatgaaactgagcttttagtgaaaagtggttgtaataaaccagtttatacacaaagagttactatgttggaaattagtcaatatttagaaaattatctttggccaaattttgattatgaaacgtcgagtttcgagcatgttatgtctatgattcttatggttaatgaaaagtttcgagaaaatgttgcggcgtggaagtgtttttatgatagaaaggatgtgttcagaggatttttagagagggttcttcgacttaaagagcagggaagagcactaagtatagcagagaagacgaattatttgctcttcatgattaatctatttcagagtttggaagatgagatagtcagtggaactgtgctgaagctagtaagtttgcagtcgtggcattctctttcatatggtcggtttcagatggagctgtgtcttaatccaaatttgatcaagaaatggaaaaaattgactaagaaagaaactaaggaagccaagaaacgaggagaaccttttgagccctcaagtatgcttgaagtaaaatttttgagaagtctgattgaagaatttttagagattctagatttggaggttttctcccacaaacagagtgaccatgaagataatgaagttgatgagtactacggatctaaacaagtcaatgatgcttgtgttctctattgtgaaaggtttatggaatttctcattgatttgttgagtcaactcccaactagaaggtttctgaggccaatcgttgccgacgttgctgttgtttccaaatgtcatttaagtacactttatactcatgaaaagggaaaacttttcgctcaactagtggacctgctacaattttatgaaggttttgagattgatgatcatgctgggactcagttgagtgatgataatgtgcttctcactcattattatcgccttcagacctttcagctattaatatttaaaaaaatccccaagctgcgagatctagcattagcaaatattggttcaataaacaagcgagctgatctcacaaagaaattatcttttctatctcccgaagagttgcaagatttggtgtgcaaaaagctcaaattagtatctgatggtgatccctgggctaaaagggttgattttctaattgaagtcatggtctcattttttgagaagcgtcagtcccaaaaggaagctataaatgcacttccactctacccaaatgaacagataatgtgggatgaaagcctcattccaagtattaattactctggggaaggatgcctggctcttccaaaacttaaccttcagtttttaacacttcacgattatctgttgagaaattttaatctgttccgcttggaatcaacttatgaaattcgcgaggatattcaagaggctgtaccacaccttcttgcctatattaataatgagggagaacctgctttccgtggttggtcaagaatggcagtgccaatcagcaggctcaggattagtgaggtaaaacagccgaatattggagaagtgaagccatcttctgttacagcgcaggttacattcagcatttcaagttataaggggcagatgagatctgaatggaactcactgaaagagcatgatgtcttatttttactcgctatttatcctttgtttgagcctctcagtgcagaggaagctgcaaaatcaagtgtacctgaaaagctcggcctgaaatacgtacgcggatgtgaagttattgagttacgagatgaagagggaactctaatgaatgactttacggggcgaattaagagggatgagtggaaacctcctaaaggtgatttaaggactgttactgttgcactagatacagctcaatactacatggatgtcagtgacattgcagagaaaggtgcagaagatgtttatggctcctttaatatactgatgagacggaaaccaaaagaaaacaactttaaagcaattctggagtccattagagatcttatgaatgaatcctgtattgttcctgattggttgcacaatatatttttgggctatggaaatccttctgcagcacaatggacaaacatgcctgatcttttggagacagtagatttcaaagatacctttctcgatgcagatcatttgaaagatagtttcccagattatcaggtttgctttgttagtcaagatggctcagagaacttgcatacggaacctcctttccgaattaaactcccaaaggctctcaaaggcaacactcatgcccttccaggaaataagaagtcaaccacaagtacaatgaatgatgtaaatatggtggatacaggtctagaacgtgaaaggcttattgttgaggcatatgtccctcccgatcctggtccttatccacaagatcagccaaagcaaaactctgttaggtttactcctacgcagatcggagcaataatatcgggtgttcagccggggctcacgatggttgtgggtccacctggtactggaaaaactgataccgctgtgcaaatcttgaatgttctataccacaattgccccactcagcggacattaattattactcattcgaatcaggctttgaatgatctttttgagaagataatgcagagagatgtcccagctcgctaccttcttcgtctgggtcaaggggaacaagaactagcaactgaccttgatttcagtcgtcaaggccgtgtaaatgctatgcttgtgcgaagattggagcttcttcaggaagttgagaggcttgcaagatctctccagctgccagaagatgtaggctacacttgtgaaactgctggatacttttggttgttgcatgtgtactctcggtgggaacaatttcttgctgcctgctctcagaatcaagataaaccatcatttgtgaaagatcgttttccctttactgagtttttttcggacacacctcaaccagtttttacaggccagtcctttgagaaagacatgcgttcagccaaagggtgctttcgtcatcttaaaataatgttccaagagctagaagagtgcagggcgtttgaattactaaagacaactgctgacagagcaaattatcttatgaccaagcaggcaaagattgtggcaatgacttgtactcatgctgctctaaaaagaaaggatttccttcatttgggatttaagtatgacaacttgttaatggaagaaagcgctcaaattttggagattgagacctttattcctatgttgctccagagacaggaagatggctatgcacgactaaaacgctgcatattgattggtgaccatcaccagttacccccagttgtgaagaacattgctttccagaaatatagccatatggatcagagcttgtttacaagatttattcgccttggtatcccttatattgagctcaatgctcagggtagagccaggccagatatagccaagctttacaactggagatacagagatctaggagatcttccgtatgtgcgggaacaggctatcttccacagagctaatcctggtttctgctatgagtatcagctggtggatgttcctgattatcgcgggagaggagaaattagtccttcttcttattttttccaaaatgaaggagaggcagaatatatcgtcagtgtctatatgtacatgcgtttgctaggttatcctgcaagtaagatttccatcttgaccacttacaatggccaaaagtttcttatccgcgatgtcattaatagacgctgtgcccaatacgacttcattggtccacctagcaaggttaccacagtagacaaatttcaaggtcagcaaaatgacttcattttattgtctcttgttcgtacccgtattgtgggtcatattcgcgatgtcagaagattgatagttgctatgtctcgagctcgacttgggctttatgtgtttggccgccgatcactgtttgaacaatgctatgaattacagcctacgtttcaacatttacttcagagacctgacttacttgctctaaactgtgatgaggaggtttatccttttactgaacgtcttgttggagacattgggaatcaattccgattcgtaagtggcgttgaggagatggctaatgttgttaatctaaagttgaattacatgtaccaggcaagagccatgagccatcattataatcagtatcctgctcatgctgggcaagtacctgcagccattgatgcacctgagggagtcgacaaccatattagtctcccctcatcccaccatgaagtcacatctgtaacctcccctgtaaatggggatatgttacttgaaaatggtggtgaggatgaaactcagaacagcagccctaaaactgtagttaatggagatacgcaagttgaaggcagttcaaatcttgactctcacatggaggatagggtaaagagtgaaagtgatgtaccaactgaagataattcaaaggatgaaagcaaaatggaggagtaaactaacaggtatcttgcgtgattatgttcagcaactgggaaatcctcagagttccccaggggttttgcttttgttgacagtggtcacagttaagttctgcaaccacactatgatactttcaactggcagctgactataacgacccggatgttttggctctcctatttccaactatttagggtcagactttaatttggtgtgcttgatgcttcactggtttttctgtagcaaacaagggaaatttcttatccctggatgaagggtggagcactgaacaggacatgttttgtatgtaaaattttgcgactgatgacaaacacgttaaaaaatgaggatttctgtattgacatcttagttagaatgttgtgttaaaagtaagaaaaacacattgttaagatttctgt

SEQ ID NO: 855 - DNA, 2248 bp, Brassica napus
ctgaaataaatccagcagacaaggctgatatggtggatgtatccccaaaggagaaacttattgttgaggcctataccccacctgacccagggccttatcctcaggaccagccgaagcagaactcagttaaatttacccctacgcaggttggagcgattatctctggaattcagcctgggctaactatggtggttggtccaccgggtaccggaaagactgatacagcagtgcaaatcttaaatgtgctatatcacaactgtccttctcaaagaaccttgattatcactcattcaaatcaggctctgaatgatctttttgagaagataatggagagggatgtgccagcgcggtatctacttcgtttgggtcaaggtgaacaagagcttgccactgatctcgactttagcagacaaggccgtgtcaatgccatgcttgttcgacgtttagaactgctcagcgaggttgagagactagcaagatctcttcaaattccagaggatgtaggttatacttgtgaaaccgctgggtatttctggttgcttcatgtctactcgcgttgggagctatttctggctgcttgtgctggaaatgaaaacaatccatcttttgttcaagatcgcttcccgttcaaagaattcttctcagacacgcctaagcctgttttcagtggggagtcatttgagaaagacatgagagcagctaaaggttgtttctctcatctcaagaccgtgttccaagagctagaagagtgtaggggctttgaactgctcaaatcaactgcggatagagcaattacctgatgaccaaacaagcaaagattgtagcaatgacgtgtactcatgcagcattaaagaggagagattttcttaagttggggttcaagtatgacaacttactgatggaagaaagtgctcagattctggaaattgagactttcataccaatgttgcttcagaggcaagaagatggccatgcacgactcaagcgctgtatactgattggtgatcaccaccagcttcctcccgtggtgaaaaatatggctttccagaaatacagtcacatggatcagagtctgtttacgaggtttgtgcgtcttggtattccgtatattgagcttaatgctcaagggagagccaggccaagcttagccaaactgtacaactggagatacagagacttgggagacctttccattgtcaaggaagcacccatctttcatagagcaaacgctggattctcatacgactatcagttgattaatgcgcctgattacgaaggaagaggagagtcaacaccatctccttggttttatcagaatcagggagaagctgaatacatcgtcagtgtctatatatacatgagattgctaggatatcctgctaacaagatatcaatattgacgacatataatggtcagaagctcttaatccgtgatgttatcaaccgtcgatgtgtgccctatgctttcatcggcccgcctagcaaggtgactacagtggacaagttccaaggacagcagaatgactttattttgctgtctcttgtacgaacacgctttgttggacatctacgtgatgtgagaaggttggtagttgcaatgtcgcgtgctaggctcggactgtatgtgttctgccgccgctccctctttgaacaatgctatgaactgcaaccaacgtttcaactacttctgaaaagacccgatcgtcttggactcaacctgagtgagaacacagcttatacagatcgtgctgtggaggaagttggaaatccttatcttgttcatgatgttgaagagatggcacacatagttcacgacaggatgaacgagttctacaaggcacaaggcgtgtacgagcaatgccagaataacatgccacaaatcgaagatggtaaccacatggagagtgattcagttgtaggtgaagatggtgaatctgagaagacggtgcagccagagttagatggcgtagttgatgaaacatcgaaggagatggaggtggataatggagttagcagtgagaatggaaaggctgatgagaactagaagagaggttcgaatggaataaaagagcgatccagatcatttgtttgcttaatgtaagatattttcttaaattgtactgagtaaattctggcgaagtagtaaaactaacatggattgcttccccaccgacagtctttgttataacacttttgtatttgagttttcatttcgttggtttctaaatcaaaatactcaacttctgag

SEQ ID NO: 856 - DNA, 4473 bp, Pinus taeda
acattccagtcttctagatcctcagctcattaaaaatggaaaatgatggtcaagaaagaagctaaggaagctagaagaactggaatgtcctctgacccccgtgataaacttgaagtgaaattttttgcctatgttgattcaagaatttttagagatactagattcaaaggttataaattctccaaagcacagcaatgaaagggaaagatcgattaatttgtaccaagatgatggagcattagtagatgaagcatgtctgttatattgtgagcgattcatggagttcttaattgatttattaagtcagctacccactcgaagattttttagggctgtcattgaagatgttgctgttgttgctaaatgccgtttgagtactctttatactcatcaaagggggaagctttttgcgcagctggtggacttgctgcggttttacgaggggtttgagatagatgaccatgttggcactcaacttagtgatgatgatgttttgctagctcattgctctcggctgcaagcttttcaacttttggcttttaaggaattcctaagctccgagatctagcattggccaatgtgggctccattgaaaaacgcaacgatctttgtaagaggctttctgttttgtctggagaagaacttaaggatgttgtctgtaataagcttaaattgcttgaagaaagtgacccatgtgttgaaagaatggatttccttactgaggtaatggtttctacttttgagaaacgacagtctcaaaaggaagcaataaatgctctccctctttatccaaatgaacaagtcatgtgggatgaaagtgttgtgcccagcattaattacactggtgaaggatgcttggctcttccaaaacttaatctacagtttctaactcttcatgactacctcctgaggaatttcaatcttttcggttggaatcgacatatgaaattcgagaagatatccaagatgtgttgcctcgactggcagcatatattaataatgagggagaaactcgctttcgaggatggtctaggatggctgttccaatcaaggagttcaaagtcactgaagtaagcagccaaacattggagaggtgaaaccatctgctgtcactgcagaggttacatacagtgtttcaagatacacatcacagataaggtctgaatggaatgggctcaaggaacatgatgttctctttttgttatctgtacgtccttttttagagccgcttagtggtgaggaagcatcgaacttaagtgtcccagaaaggtttgggctccagtatgtacgtggatgtgaagtcattgagattcgagatgaggatggcaaccttatgaatgattttacaggaagggtgaagagagaggagtggaaaccaccaaaaggtgagcttcggactgttgtgcttgccttagatactgcacagtatcagatggatgtcaatgctattgcagagaaggatgcagaagatatatacaagaccttcaatgttttgatgagaagaaaaccaaaggaaaacaattttaaagccatccttgagtcaattagggatctaatgaatgaagcctgtattgttccagaatggttgcatgacattttcttaggatatggaaatcccagtgctgcgcagtggaccaatatgcctgatactctggacattgtcgattttaaggacacatttcttgatgctgatcacctcagagaaagttttcctgattatgatgtttcttttttgcatccggatggagatgtagacaaattcccaaaacctccattccgcataacacttcccaggacactgaagagtgctgccaaccaagtcctgccaggagctaccaagagagggggtgtagatggagacattgtgaataaaatgatggagagcaatggtaaacgtgaacagatcattgtggagacatatgtacctccagatccaggtccttatccacaggatcagccaaagaaaaacaatgtcaggttcactccagttcagattggtgctatcatatctggcattcaaccaggattgacaatggtggtaggtcctcctgggacagggaaaacagatacagctgtgcagattctgaatgtgttgtatcacaattgtccttcccagagaacgttgataatcactcactctaatcaggctttgaatgatctctttgaaaagattatgcagagggatgttcctgctcgataccttctacgtctggggcagggtgagcaggaattggcaacagatgttgaatttagtcgacaaggtcgagttaatgctatgctagcacgacggttggagttgttggcagaagttgagaggcttgcaaaaacattgcatctaccagaagatgttggatatacatgtgaaactgcaggatacttctggcttttgcatgtttattctcggtgggaacaatttcttgctgcttgtgaaagtaatcaggataaagctagttttgtgaaagacagattcccatttaaggagttcttctcagacacacctcaaccagtattcacaggcttgtcctttgaacgagacatgcgtgcagcaaaaggttgcttccgccatcttactaccatgtttcaagaacttgaagagtgtaaggcatttgaattactgaaatcaactgctgaccgtgcaaattatctcatgaccaagcaagccaaagttgttgctatgacctgtacccatgctgcactgaagagaaaagattttcttcagttaggttttaagtatgacaatttgctaatggaggaaagtgcacagattttggagatagagacattcatacccatgttgttacaaagacaagaagatggacatgcaaggcttaagcgttgcatattgattggtgatcatcatcagttaccaccagtagttaagaacatggctttccagaagtacagccacatggaccagagtctgtttactaggtttgttcgcttaggaattccctatgttgaactcaatgcacaaggtagagcaaggccaagtatagcaaagctttacaactggagatacaggcagttaggtgatctatcatacgttcaaaaagagcatgtgtttcatcttgcaaatacaggtttctgctatgaatatcaacttgtagatgtccctgatcatcgtggcatgggtgaatctgcacctgttccttggttttatcaaaaccttggtgaagcagaatatgttgtgagtgtttatatgtacatgcgattgctaggctaccctgccagcaaaatatctatcttgactacttacaatggtcaaaagcacttgattcgtgatgtgatcagacaaagatgtgcctcacatcctcttattggatctccaagcaaggttacgactgttgacaggtttcaaggtcaacaaaatgactatattttgctttctctagtccgaaccagatttgtaggccaccttcgagatgttcgtagacttgttgttgccatgtcccgtgctcggttgggcttatatgtattctgccgtcgctctttgttcgaacaatgctatgaattacaacccacttttcaacttctactccaacgacatgatagacttgctttgaatttggatgaaacaacttgccccacagagcgttttgttggggacactggcagaattcatcttgtgagtggacttgaggagatggagcacattgccatgagcaaattttatcaactttatcagggacaaacaatagggcaacaggtcactatccattattctaatcagcaaatacatggatacaattcaggggcaactatgccaataaatactaattttccagctgagcagagatcgctggttgagcctggcttcattccttacaggtctcctgaaacagagaagaatgctgaagcccctgtggatgataaattggacaaaaacaatgatatgcaatagtgatgtctactttcgaccatccatgttttactcgatgttaagaggagaggctggacatagtgacatcgtgttgttcaaatgcttacacatggaaactttatgggaaggtgtacactcttgccacctgtgatttttgaagaagcttcaagaaggaattatggtgcctttttgctgggaaaaagatgcaggatggctatgatctgaaaatacattagggtcggatttcttcatccaacatggaattgttctattagggttcaaaatgattggcacctgcttctataagtggaaagaaaatttttaatgggatgaaattctattgtcagatgaaattgttagtaattctgctttttcttgctatcccaagaaggcttgctgccactatcagtgtgcagagatcagaaatttgaggatgtgataaacatgacttcacaagcatacatgtggtggttaatcaatagtaattgggtaattccttgattacaagttgaaatgtggcgataactgtgcaatactaaagctttgtatttaacatttcaactttaaatgaagtttgtgaagttaccgtataa

SEQ ID NO: 857 - DNA, 2177 bp, Brassica napus
  misc_feature (272)..(272): n is a, c, g, or t
  misc_feature (284)..(284): n is a, c, g, or t
  misc_feature (293)..(293): n is a, c, g, or t
  misc_feature (303)..(303): n is a, c, g, or t
  misc_feature (398)..(398): n is a, c, g, or t
  misc_feature (635)..(635): n is a, c, g, or t
  misc_feature (665)..(665): n is a, c, g, or t
  misc_feature (695)..(695): n is a, c, g, or t
  misc_feature (703)..(703): n is a, c, g, or t
  misc_feature (757)..(757): n is a, c, g, or t
  misc_feature (1303)..(1303): n is a, c, g, or t
  misc_feature (1315)..(1315): n is a, c, g, or t
  misc_feature (1456)..(1456): n is a, c, g, or t
  misc_feature (1477)..(1477): n is a, c, g, or t
  misc_feature (1610)..(1610): n is a, c, g, or t
  misc_feature (1612)..(1612): n is a, c, g, or t
  misc_feature (1618)..(1618): n is a, c, g, or t
  misc_feature (1660)..(1660): n is a, c, g, or t
ctgaaataaatccagcagacaaggctgatatggtggatgtatccccaaaggagaaacttattgttgaggcctataccccacctgacccagggccttatcctcaggaccagccgaagcagaactcagttaaatttacccctacgcaggttggagcgattatctctggaattcagcctgggctaactatggtggttggtccaccgggtaccggaaagactgatacagcagtgcaaatcttaaatgtgctatatcacaactgtccttctcaaagnaccttgattatnactcattcnaatcaggctntgaatgatctttttgagaagataatggagagggatgtgccagcgcggtatctacttcgtttgggtcaaggtgaacaagagcttgccactgatctngactttagcagacaaggccgtgtcaatgccatgcttgttcgacgtttagaactgctcagcgaggttgagagactagcaagatctcttcaaattccagaggatgtaggttatacttgtgaaaccgctgggtatttctggttgcttcatgtctactcgcgttgggagctatttctggctgcttgtgctggaaatgaaaacaatccatcttttgttcaagatcgcttcccgttcaaaganttcttctcagacacgcctaagcctgttttnagtggggagtcatttgagaaagacatgagngcagctanaggttgtttctctcatctcaagaccgtgttccaagagctagaagagtgtagggnctttgaactgctcaaatcaactgcggatagagcaattacctgatgaccaaacaagcaaagattgtagcaatgacgtgtactcatgcagcattaaagaggagagattttcttaagttggggttcaagtatgacaacttactgatggaagaaagtgctcagattctggaaattgagactttcataccaatgttgcttcagaggcaagaagatggccatgcacgactcaagcgctgtatactgattggtgatcaccaccagcttcctcccgtggtgaaaaatatggctttccagaaatacagtcacatggatcagagtctgtttacgaggtttgtgcgtcttggtattccgtatattgagcttaatgctcaagggagagccaggccaagcttagccaaactgtacaactggagatacagagacttgggagacctttccattgttaaggaagcacccgtctttcatagagcaaacgctggattctcatacgactatcagttgattaatgtgcctgattacgaaggaagaggagagtcaacaccatctccntggttttatcanaatcagggagaagctgaatacatcgtcagtgtctatatatacatgagattgctaggatatcctgctaacaagatatcaatattgacgacatataatggtcagaagctcttaatccgtgatgttatcaaccgtcgatgtgtnccctatgctttcatcggcccncctagcaaggtgactacagtggacaagttccaaggacaacagaatgactttattttgctgtctcttgtacggacacgctttgttggacatctacgtgatgtgagaaggttggtagttgcaatgtcacgtgctngnctcggnctgtatgtgttctgccgccgctccctctttgaacaatgctangaactgcaaccaacgtttcaacttcttctgaaaagacccgatcggctcggcctcaacctgagtgagaattcatcagcttatacggatcgtgcagtagaggaagttggaaatccatatcttgttcatgatgttgaagagatggcacacatagttcacgacaggatgaacgagttctacaaggcacaaggcgtgtacgagcaataccagaataacatgccacaaatcgaagacggtaaccaggacatggagagtgattcagttgtaggtgaagatggtgaatctgagaagacggtgcagccagagttagatggcgtagttgatgaaacatcgacggagatggaggtggacaatggagttagcagtgagaatggaaaggctgatgagaactagaagagaggttcgaatggaaaaaagaaggatcagatcatttgtttgcttaatgtaagatattttcttaaattgtaccgagtaaattctggtgaagtagtaaactagcatgaatggcttccccaccgac

SEQ ID NO: 858 - DNA, 4813 bp, Solanum phureja
accttactgcagggtagaagcttgacaattcctgagaaaattaattatctacttttcatgatcaatgctttccagagtttagaagacgagatagtgagtaaaaaggttttgaggttagccggtctacagtgttggcattgcttgtcatatggtcgatttcagatggagctctgtgttaaccctgatctaatcaagaaatggaagaaaattgcaaaacgagccaaggaggcagctaaaagaggcgaatcttttgatacctcaaccatgctagaagtgaatttcttgagacatctaattgaggagtttcttgaggttcttgattgcaaggtttttcctcagccagacagtgaggtcaataatgacttggatttcacaagtgattttgaaggtgttaacgatgcctctgtcctatattgtgaacggtttatggagtttctcattgatctattgagccaactgccaactagaagatatataaggcctgttgttgctgatgttgctgtggttgcaaaatgtcatttaagtgctctttatgggcatgaaaaaggaaagctttttgcccagctggttgacttacttcagttctatgaaggttttgaaattgatgaccatttagggagacaaatgactgatgatgaggtgattcaggctcattatgatcgtttccagtcattccagcttcttgcatttaagaagatacccaagctacgggaacttgcattggcaaatgttggtgcaatacacaggcgcgctgatctatctaagaaactttctgtgcttactcctgaggagctgagagatttagtatgccggaagctaaaactgatatcagttgatgatccatgctcaaatagagttgatttcttaattgaagtaatggtatctttctttgagagacaacagtcacagaaagaggccataaatgctcttcctctttaccctaacgagcaaataatgtgggatgaaagccttgtaccaagcatcaactacactggggaaggatgccttgcacttccaaagctcaacctacagtttttgacacttcacgactatcttcttagaaactttaacctctttcgccttgaatcgacttatgaaatccgtgaggacatccaagaggctgtgccacatctccttgcttatatcaataatgaaggagagccagcctttcgaggttggtcgagaatggctgtgccagttaaagaatttaagattacagaagttaaacaaccaaatataggcgaagtaaagccagctgctgtaacagcagaagttactttcagtatctccagctacaaatcacaaataaggtcagaatggaatgcacttaaagagcacgatgttctatttttactgtctattcgtccttcattcgagcctctcagtgctgaagaagctgctaatgcaaccgtaccacagaggcttggtctccagtgtgtacgcggctgtgaaataattgagatgcgtgatgaggagggaattctgatgaacgattttactgggagaatcaagcgggacgagtggaaaccccccaaaggagaccttagaactgttactgttgcgcttgacacagcacaataccatatggatgttggtgatatagcagagaaaggcgcagaagatatttatggtacatttaatatattaatgaggaggaaaccgaaggagaataatttcaaagccatcttagaatctataagggatctgatgaatgaaacatgcatagttcctgattggttgcatgatatatttttgggctatggaaatccttctgcagcacagtggactaatatgccagacctccttgaaacagtagattttaaagataccttcctagatgctgatcatgttagggagagttttcctgattatcaggtttgcttcgtcgaccaagatggcttagaaaacgtgcaaccatgccccccttttaagattaagcttcctaggaatctcaaagggaaagctcatgcccttcctggaagtgagaattctactactgcttcagttgatgctgcaggcatgccagaagttcattccgaaagagacaagcttattgtcgaagcatatatccctcctgatccaggtccatatcctcaggatcaaccaaagcggaactcggttaaatttaccgcgacacaggttggagcaatcatctcaggcgttcagccaggtttatccatggttgtgggaccccctggtacgggaaagactgataccgctgtgcaggttttgaatgttctctatcataattgcccttctcaacggaccctgataatcactcattcgaatcaagctttaaatgatctttttgagaagataatgcaaagagatgtgccagctcgctaccttctccggcttggtcagggagagcaagaattagcaactgatcttgacttcagtcgtcaggggagagtaaatgccatgcttgttcggcggctagaactgcttagtgaagtcgaacgccttgcaaggtcccttcaactgcctgaagatgttggttatacatgtgaaactgtgggatacttctggctgcttcatgtatactcacggtgggaacaatttttagctgcttgcgctgcagagaaagataacccaaccattgttcaggataagtttccctttaaggaatttttttctgatactccccagccagttttcacgggtcagtcttttggaaaggacatgcgttcagctaaggggtgctttcgtcatttgaaaacaatgtttcaagaacttgaagaatgtagggcatttgaattgctcaagtctactgttgatcgatctaattacctgatgaccaaacaggcaaaaattgtggcaatgacctgcactcatgcggcacttaaaaggaaggattttcttcaagtgggttttaagtatgacaacctgttgatggaagaaagtgcccaaattttggaaattgaaactttcatcccgatgttgcttcagaggcaggaagatggctatgctcggcttaaacgctgtatactgattggggaccatcatcaattgccccctgtcgtgaaaaatatggcttttcagaagtacagccacatggatcagagtctcttcacaagatttgtcagactagggataccatatattgagctcaatgcccagggtagggcacggccaagtttagctcggctttataattggagatacagagaactgggggatcttcctaatgtgaaggagaatgcggtctttcataaagcaaatgctggattctcatacgactatcagttggtagatgtgcccgattacaatggcagaggtgaaagtgccccttcaccctggttctatcaaaatgagggagaggctgaatacatagtcagtgtctatatgtatatgcgcttacttggatatcctgcgaataagatatcaatcttgactacttataatggtcagaaacttttgatccgcgatgttataaacagaagatgtgtcccttatgactttattggtcctccacacaaggttgcaactgttgataaatttcaaggtcagcagaatgattttatcttattgtctctagtccgtacgcgctttgttggccacctccgtgatgtcagaagattgattgttgcaatgtcccgtgctcgtctgggtctctacgttttttgtcgacgttctctttttgagcaatgttatgaacttcaaccaacgtttcgacttctcttagagagacctgattgcctcgccctaaatgttgaggaggccacatctttgacaaatcgtcctgttggagaaactggaccagtcagtgttgttagtggacctgaggaaatgcaggctattgtgaattttaagatgcatcaggtctatcaggcacggatgatgagccatattgagtatccagctcatccagaatctgtccccgagccaagtgttgagcagaatgtgatgtccctaccccatagtatggatactgataagaccgctatggaagatggcgatactgggccttcagagttaatggagtccacgaaggttcaacctgatgatggagagatgttagttgtgggccattcaaatggagaggttgatggcgaggatcaaagagttgttagtggtggactgggcacatcaactgggtccacagaggttccacatgatgatgcagagatgttagttgcgagccagtcaaatggagaggctgatgggaaggaccaaagagttgatagtgacggaacagacctcgagaactcttcgaatgtggaaagcaagatggaagagtaatatcaactgtactccaagtttgcttctctagaccaccatggaacttgattgcctgggaaatgtaaactatgatcttgattgttagcggccctaagatgtattgatctttaagaaggttgtgaggtcaaagaccagatgtggtggaacagctgcaaatgcaatgatatgttccctgccatcgacctccacaagcgacacgagtaatttgaatacacaggccgtgacttggttgaagaatatgtaaagcgaaattgtgctttcatgggtgtctagtagcccatatcatcggtaaatctgtaatcaattatttgtaacgattggaggtgggaatggggcataggccgcaccaactcaagacttattcgtcgttcctcggttgtctttttggtgaactcataacttattgtaaagtaaattgaaatgtacaattgtttgtatcgcttaaaactagattttaagggttacatattttgattttaaaagttttgttttacttgttagatctcttgcctctgtaattgtatttgtttctgaagtttttgttgaaaaattctggacacttccttttcaa

SEQ ID NO: 859 - DNA, 5496 bp, Solanum lycopersicum
gactgccaatatcttcaaaaccccaaaactctcttttaccataaaccctgttcttcgttctcctctacgagattctcaaatctcatagagaaacaagcacccttaactttttctcatcggaagtgtaattacagcaattatgaccaaggtatacggaactggcacctacgatttccggcgccaccgggtagctgagtacccggtggaagcattgccgcagacggcggaggctccacagaaaatgctgccttctatgactgagaagccgccggagtcgaagcccgggtcgaacatacctagctctataacccttgctgagatccaacgtgaccgcttgactaaaattgcagcttccaattgggcgaaaactggagagaagaaagcctttagttctgagcttgttaaagaaatttatgacacggagcttactgtaaaaggggggagaaagccggtgccattgcagagggtgatgatattggaggttagtcagtatttggagaattatctttggcccaattttgatccagaggcttcttccttcgagcatgtgatgtcaatgatactgatggtcaacgagaagtttcgggagaatgtggctgcatggatctgcttctatgatagaaaggatatgttcaaggcatttcttgatagggttcttcggctgaaagagggtagaagcttgacaattcctgagaaaattaattatctacttttcatgatcaatgctttccagagtttagaagacgagatagtgagtaaaaaggttttgaggttagccggtctgcagtgttggcattgcttgtcatatggtcgatttcagatggagctctgtgttaaccctgatcttatcaagaaatggaagaaaattgcaaaaagagccaaggaggcagctaagagaggtgaatcttttgatacctcaaccatgctagaagtgaatttcctgagacatttaattgaggagtttcttgaggttcttgattgcaaaatttttcctcagccagacgatgaggtcgatagtgacttaaatttcacaagtgattttgaaggtgtaaacgatgcctctgtcctatattgtgaacggtttatggagtttctcattgatctattgagccaactgccaactagaagatatataaggcctgttgttgctgatgttgctgtggttgcaaaatgtcatttaagtgctctttataggcatgaaaaaggaaagctttttgcccagctggttgacttacttcagttctatgaagggtttgaaattgatgaccatttagggagacaaatgactgatgatgaggtgattcaggctcattatgatcgtttccagtcattccaacttcttgcatttaagaagataccgaagctacgggaacttgcattggcaaatgttggggcaatacacaggcgcgctgatctatctaagaaactttctgggcttactcctgaggagctgagagatttagtgtgccggaagctaaaactgatatcagttgatgatccatgctcaaatagagttgatttcttaattgaagtaatggtatctttctttgagagacaacagtcacagaaagaggccataaatgctcttcctctttaccctaacgaacaaataatgtgggatgaaagccttgtaccgagcatcaactacactggggaaggatgcctggcacttccaaagctcaacctacagtttttgacacttcacgactatcttcttagaaactttaacctctttcgccttgaatcgacttatgaaatccgtgaggacatccaagaggctgtgccacatctccttgcttatatcaataatgaaggagagccagcctttcgaggttggtcgagaatggctgtgccagttaaagaatttaagattacagaagttaaacaaccaaatataggcgaagtaaagccagctgctgtaacagcagaagttactttcagtatctccagctacaaatcacaaataaggtcagaatggaatgcacttaaagagcacgatgttctctttttactgtctattcgtccttcattcgagcctctcagtgctgaagaagctgctaatgcaaccgtaccacagaggcttggtctccagtgtgttcgcggctgtgaaataattgagatgcgtgatgaggagggaatcctgatgaacgattttactgggagaatcaagcgggacgagtggaaaccccccaaaggagaccttagaactgttactgttgcgattgacacagcacaataccatatggatgttggtgatatagcagagaaaggcgcagaagatatttatggtacatttaatatattgatgaggaggaaaccgaaggagaataatttcaaagccatcttagaatctataagggatctgatgaatgaaacatgcatagttcctgattggttgcatgatatatttttgggctatggaaatccttctgcagcacagtggactaatatgccagacctccttgagacagtagattttaaagataccttcctagatgctgatcatgttagggagagttttcctgattatcaggtttgcttcgtcgaccaagatggcttagaaaacttgcaaccaagccccccttttaagataaagcttcctaggaatctcaaagggaaagctcatgccatccctggaagtgagaattctactactgcttcagttgatgctgcaggcatgccagaagttcattccgaaagagacaagctcattgtcgaagcatatatccctcctgatccaggtccatatcctcaggatcaaccaaagcggaactcggttagatttaccgcgacgcaggttggagcaatcatctcaggcgttcagccgggtttatccatggttgtgggaccccctggtacgggaaagactgataccgctgtgcaggttttgaatgttctctatcataattgcccttctcaacggaccctgataatcactcattcgaatcaagctttaaatgatctttttgagaagataatgcaaagagatgtgccagctcgctaccttctccggcttggtcagggagagcaagaactagcaactgatcttgacttcagtcgtcaggggagagtaaatgccatgcttgttcggcggctggaactgcttagtgaagtcgaacgccttgcaaggtcccttcaacttcctgaagatgttggttatacatgtgaaactgcgggatacttctggctgcttcatgtatactcacggtgggaacaatttttagctgcttgcgctgcagaacaagataacccaaccattgttcaggataagtttccctttaaggaatttttttctgatactccccagccagttttcacgggtcagtcttttggaaaggatatgcgttcagctgaggggtgctttcgtcatttgaaaacaatgtttcaagaactcgaagaatgtagggcatttgaattgctcaagtccactgttgatcgatctaattacctgatgaccaaacaggcaaaaattgtggcaatgacctgcactcacgcggcacttaaaaggaaggattttcttcaagtgggttttaagtatgacaacttgttgatggaagaaagtgcccaaattttggaaattgaaactttcatcccgatgttgcttcagaggcaggaagatggctatgctcggcttaaacgctgtatactgattggcgaccatcatcaattgccccctgtcgtgaaaaatatggcttttcagaagtacagccacatggatcagagtctcttcacaagatttgtcagactagggataccatatattgagctcaatgcccagggtagggcccggccaagtttagctcgcctttacaattggagatacagagaactgggggatcttccttatgtgaaggagaatgcggtctttcataaagcaaatgctggattctcatatgactatcagttggtagatgtgcctgattacaatggcagaggtgaaagtgccccttcaccctggttttatcaaaatgagggagaggctgagtacatagtcagtgtctatatgtatatgcgcttacttggatatcccgcgaataagatatcgatcttgactacttataatggtcagaaacttttgatccgcgatgttataaacagaagatgtgtcccttatgactttattggtcctccacacaaggttgcaactgtcgataaatttcaaggtcagcagaatgattttatcttattgtctctagtccgtacgcgctttgttggccacctccgtgatgtcagaagattgattgttgcaatgtcccgtgctcgtctgggtctctatgttttttgtcgacgttctctttttgagcaatgttatgaacttcaaccaacgtttcgacttcttttagagagacctgattgtcttgccctaaatgttgaggaggccacatctttgacaaatcgtcctgttggagaaactggaccagtcagtgttgttagtggacctgaggaaatgcaggctattgtgaattttaagatgcatcaggtctatcaggcacggatgatgagccatattgagtatccagctcatccagaatctgtccccgagccaagtgttgagcagaatgtgatgtccctatcccatagtatggattctgataagaccgctatggaagatggcacaaaagacactgggccttcagaatcaatggagtccacgaaggttccacctgatgctggagagatgttagttgtgggccattcaaatggagaggttgatggtgagaaccaaagagttgatagtggtgaactgggcacatcaactgggtccatagaggctccacatgatgatgcagagatgttagttgcgagccagtcaaatggagaggctgatgggaaggaccaaagagttgatagagatggaacggacctcgagaactcctcgaatgtggaaagcaagatggaagagtaatatgaactgcactccaagtttgcttctctagaccaccatggaacttggttgcctgggaaatgtaaaactatgatctttgatttgttagcggccctatgatgtattgatctttaggaaggttgcctggtcgaaaaccagatatggtggaacagctgcaaatgcaatgctatgttccctgccatcgacttccagaagcgacatggtttaaaatctacgagtaatttgaacacacaggctgtgacctagttgacgaatatgtgaagcgaaattgtgctgtcatgggtgtgtagtagcccatatcaccggtgaatctgtaatagattatttgtaacgattggaggttgtattgggcctaggctgcaccaactcaagacttgttcgtcattcctcggttgtctgtttggagaactcataatttgttgtaaagtaaattgaaatgtacaactgttcgaatcgcttgaaactagatttcaagggttacatattttgatgtttaagttttgttttacttgttagatctcttgcctctgtaactgtatttgtttctaaagtttttgttgaaaaactctggacacattcatttcaatcca

SEQ ID NO: 860 - DNA, 2579 bp, Cucumis sativus
ctgtgacggcagatgtcacttttagcatttctagctatagagcacaaataagatctgaatggaatgctcttaaggagcatgatgttttatttttactttctattagtccttcatttgagcctttaagttcagaggaagctgccaaagctagtgttcctcaacgtctaggtcttcaatgtgtacgtggatgtgaaattattgagattcgtgatgaagagggaagtctcatgaatgactttactggtagaattaaaccagatgagtggaagcctcctaaaggggagttgagaactgtaaccgtagctttagatacagcacagtatcatatggatgtcagtgctattgcagagaagggtacagaagatgtctatgggacgtttaatgtcttgatgaggaggaaacccaaggaaaataattttaaagctatactggaatccatcagagatcttatgaatgaatactgtatcgttcctgattggttgcataatatacttcttggttatgggaatccttctgctgcccaatggactaacatgccagatcttttggaagccgtagactttaaagatacatttcttgatgctgatcatttgaaagaatgttttccagattatcaggtctgttttacgaatccagatggtgaggaggttttgcacccaagtccccctttccggattaggattcctagagttcttaaaggtagcaatcatgctctcccggagaatatgaagtcttcaagtgtttcaaagaatgatgaaaacacgatggatgcctgtaccgagaaggagaaacttatagttgaggtgtatactcctcctgaccctggtccttatcctcaagatcagccaaaacagaactctgtcagatttactccaacacaggttggagcaatcatctctggtgttcaacccggattaaccatggttgttggtccacctggtacaggaaagactgatacagccgttcaagttctaaatgttctttatcacagttgcccttcacagagaaccttgatcatcactcattcaaatcaagcactgaatgatctattcgagaagataatggagagagatgttcctgctcgctatctacttcgccttggtcaaggtgaacaagaattagcaactgatcttgatttcagccggcaagggcgtgtcaattcaatgcttgtgcggaggttggaattgctgagcgaagtggagaggctggcaagatctctccaactccctgaagatgttggatatacttgtgaaactgctggatacttttggttactgcatgtgtactcacgctgggagcaatttatagctgcctgtgctggaaatgaggataaatctaattttgttcaagagagatttcccttcaaagaatttttctcaaatgcaccaaatccagtttttacaggggaatcttttgataaagatatgcgggcagctaaggggtgctttcgtcatctcaagataatgtttcaggagcttgaagagtgtagagcttttgaattactcaagtctacagctgatcgtgcaaactacttgatgactaagcaggcaaagattgttgcaatgacttgcactcatgctgccctaaagaggaaagattttcttcggcttggtttcaagtatgataatttgctaatggaagaaagtgcacagattttagaaattgaaacttttataccaatgttacttcagaggcaggaagatggttatgcacgtctcaaacgctgcattttgattggtgatcatcatcagttgcccccagttgtgaagaatatggcttttcaaaagtatagccatatggatcaaagtttatttacaaggtttgtcagattgggtattccttatattgaactcaatgctcaaggtcgtgccagaccaagtatagccaagctttacaactggagatatagagaattgggagatcttccctatgtaaaggaagcatccatttttcatagagcaaatgctggtttttcttatgattatcaactagtggatgtgccggactaccaagggaggggtgagaccgccccttctccttggttttatcagaacgagggggaagctgaatatattgttagtgtgtatatttatatgcgtttactagggtaccctgcaaataagatatccatcttgacaacttacaacggccagaagcttctaatccgagatgttattaatcgtagatgtgtgccatacaacttcattggtgcccctagcaaggtaacgacagttgataaatttcaaggtcaacagaacgattatatattactgtctctagttcgaacccgctttgtggggcaccttcgtgatgttagaagattgattgtggcgatgtctcgtgcccgacttggtttgtatgtattctgccgccggtctctgtttgaacaatgttatgaactgcagccaacatttcaacttttgcttcaaaggcctgaccaccttggactcaacttgaatgagataacgtcttatacagaacgtaatgttgcagatacgggtcctatctaccatgtgagtggtaccgaggagatggccagcattctggaacagctttatcaggtattatcagacttttcc

SEQ ID NO: 861 - DNA, 2361 bp, Citrus sinensis
  misc_feature (3)..(5): n is a, c, g, or t
  misc_feature (315)..(322): n is a, c, g, or t
  misc_feature (324)..(324): n is a, c, g, or t
  misc_feature (339)..(339): n is a, c, g, or t
  misc_feature (358)..(361): n is a, c, g, or t
  misc_feature (656)..(656): n is a, c, g, or t
  misc_feature (1253)..(1253): n is a, c, g, or t
  misc_feature (1373)..(1373): n is a, c, g, or t
  misc_feature (1384)..(1384): n is a, c, g, or t
  misc_feature (2234)..(2234): n is a, c, g, or t
  misc_feature (2247)..(2247): n is a, c, g, or t
  misc_feature (2259)..(2259): n is a, c, g, or t
  misc_feature (2265)..(2265): n is a, c, g, or t
  misc_feature (2277)..(2278): n is a, c, g, or t
  misc_feature (2289)..(2289): n is a, c, g, or t
cgnnngtcggaattccgggtcgaccccgcgtccgagagggatgtacctgctcgctatcttctgcgtttaggtcaaggtgaacaagagctagcaactgaccttgacttcagtaggcaaggccgagtcaacgcgatgcttgtcagacgcttagaattgcttagtgaggttgagaggcttgcaagatctcttcaactgcctgaagatgttgggtatacttgtgaaacagctggatatttttggttgcttcatgtatattcccggtgggagcaattccttgctgcttgtgcagataatgaaggtaaaccaacatttgtnnnnnnnngntttccctttaagganttcttctccacagccctcnnnnaatctttactggggattcatttgagaaggacatgcgggcagccaaggggtgttttcgccatctccagactttgttccaagagctggaagagtgcagggcatttgaattgctcaagtcaactgctgatcgagcaaattacctaatgacaaagcaggcaaaaattgtggcaatgacttgcacccatgcagcgctaaagaggaaggattttcttcaattaggttttaagtatgacaatctcttgatggaagaaagtgcccaaattttggagattgaaacttttattccgatgttgctncaacgacaggaggatggttatgcacgtctcaaacgctgtatactgattggtgatcatcatcagctccctcctgttgtgaagaatatggctttccaaaagtacagtcacatggatcagagcttatttacaaggtttgttcgtctgggtataccttatatagagcttaatgcccagggtagagccaggccgagcatagcccagctttacaactggaggtatagagatctgggagacctaccttttgtaaaggaggagccattcttccatagagctaatgcgggattctcctatgattatcagttagtggatgttcctgattataatgggagaggtgaaagtgccccttctccctggttctatcaaaatgagggagaggctgaatatgttgttagtgtctatatatacatgcgcctactaggttaccctgcaaataagatatcaatattgacaacttacaatgggcagaagcttttgattcgtgatgttatcaacaggcaatgtgttccatatccgtttattggtccacccagcaaggtcactacggttgataaatttcaaggtcagcaaaatgatttcattttgctgtctcttgtgcgnactcgatttgtgggtcaccttcgtgatgttagaagattggttgttgctatgtcccgtgctcggcttggtctgtatgtgttttgtcgacgttctttgtttgaacaatgctatgagctgcancctacttttcngcttctgcttcagagacctgataaacttgcacttaccatgaatgagaagacgtcttatacagatcgtcatgttgaagacattggagttccctatcttgttagtggcattgaggatatgcacgctattgtcaacagcttattatatcagaggcatttagcgatccaaagtcagtatgtggcttattcaggaaccacggatgcatatgcaatggagcaaattagccatcagaattcaattctcgagcacaatgccatggacactgatatgccagcagttgccaatggttctcttggggatacatcacatggaagccagtcggaggaagctactgaaatgaatggtcctgcaaatggggagatacctcttgagggccaattgaatggtgaatcagggtctgaacctcctacagacgacaagaatggcacaccacctgaaagcgattcaaatgaggcaacaaagatggagtagtctaaagtaacagcgcagcctatcaagatttttctttgagcagttgcggaaaccccatgtcctgcaggagaggcagctggcaaactaaactgggcaatataatccttaggtaagggccaccttatccaactttctggtattaatatatgtttcaattgtggatgattatcatcaaggcttcccatcataaggttgccgttagatttggtaaacgacgcaattgtgactgcaatctaacttagagccttcaaagttattatattaaaatctttctggagataactgtgcttcagctgcatcaagttgggagaaagatggaagttgttgacatagtttatagtctgttgatttttttttttttgccatcaaatccaaattaangagtggtaactanctgtacgactgntatatnaaggaatttcgnngtaaatttgcntcaatcaggtgacaaagcattgctggtaatgggactatggacacacaaacgacggagcacgggggagcccgc

SEQ ID NO: 862 - DNA, 977 bp, Setaria italica
ttaccggtgagtcttttgagaaagatatgcatgcagccaagggttgtttcaaacatctttcaacaatattccaagagctggaagagtgtcgggctttcgaactacttaagtcaacggtggagagagcaaattatctaatgacgaaacaggcgaagattgtcgccatgacttgtactcatgcagcattaaagaggcgagactttcttcaattaggtttcaaatttgacaatttactgatggaagaaagtgcacagatattggagatagaaacttttatccctatgctgctgcaacgacaggaagatggccatgctcgtcttaaacgttgcattttaattggcgatcaccatcagttaccccctgtggtgaagaacatggcttttcagaagtacagtcacatggaccagagtctgtttactaggtttgttcgtcttggtatcccttatattgagctcaatgctcagggtcgtgcaagacctagtatcgctaaactctataactggagatacagagagctgggagatctgccttatgtgcgtgagcaagcgatcttccataaagctaatgctgggttctcttttgagtatcagttggttgatgttcctgattataagggcaaaggcgagtctgccccctctccttggttctaccagaatgaaggggaggctgagtatattgtcaatatatatatctacatgcgcctgattggctaccctgccaataagatttcaatattaaccacctacaatggccagaagcttcttattcgtgatgtcataaacaaaagatgcaagccatggaatattgagccacctaacaaggtcaccactgtggacaagttccagggtcagcaaaatgatttcattttactctctcttgtccggacccgttttgtgggccatctccgtgatgttaggagacttattgtggctatgtcccgtgctcgtctgggcttgtatgtgttctgccggcgttca

SEQ ID NO: 863 - DNA, 4771 bp, Mimulus guttatus
atgacgaaaatctacggtaccggaatgtacgatttccggcggcaccgggtggctgagtacccggtggctgcggacgggcttcccctgccggaaaagcctccggagtccaaaccgggttccgatgtacccagctccatgactctaatcgagattcaaagagaccgtctcacgaaaattgcggctgaaaattgggcgaaaaccgcggattcgggcccgaagaagcccttcagcccggaccttgttaatgagatatactacactgagttaactgtaaaagcggggagaaagccagtgccattgcagagggtgatgatactagaagttagtcaatacttggagaattacctctggccaaactttagtccagagactgcgtcgtttgagcacgtgatgtcaatgatattgatggtcaacgagaagtttcgagagaatgtggctgcttggatatgcttttatgataagaaggatatgtttaaagcatttctggagagggtacttcgcctgaaagagggaagaagtttaactattgcagagaagacgaattatctactttttatgatcaatgcctttcagagcctggaggatgaaatagtaagtgaaatgattatgagattagcgagtctggagtgttggcatagcctatcatatggccgtttccagatggaactttgtcttaataaaaacctgatcagaagatggagaagaattgcaatgagagccaaggatgcaactaaacgaggggaaactttcgaccccacaaccattgtggaggccaacttcttgcgaaatctcattgaggagttcctggtggtgcttgattcagaggttttttgtaaacatgaggacgatgatttagttgatgtccatggttctgaagatgtcaatgattcctgtcttctgtattgtgaaaggtttatggagttccttattgatctcttgagccaactgccaacaaggaggttggttcggcctcttgttgctgatgttgctgttatctccaagtgtcatttaagtgctttgtataggcatgaaaaagggaaacttttcgcgcagttggttgatttgcttcagtactatgaaggttttgagattgatgatcataagggtgtacaaatggatgatgatgatgtgcttcgagctcattataagcgcctccaggcttttcagcttcttgcatttagaaagattccaaagctgcgagaacttgcattggctaatgtgggctcgatcaacaagcgtgctgacctggcaaagaagctttcagtactttctcctgaagagttgagagatttagtatgtgtgaagctcaagttggtgtcaaaggatgatccatggtctgaaagagttgacttcctgatagaagtcacagtctccttctttgagaaacaacaatctcagaaagaggcgatcaatgcgcttccactatatcctaatgagcaaataatgtgggatgaaagccttgtaccaagcattaactactccggtgaagggtgtcttgcacttccaaagcttaatttgcagtttttaacacttcatgattaccttcttagaaatttcaacctcttccgcctcgagtcaacgtatgaaatccgcgaggatattcaagaagctgttccacatcttcttgcttacgttaataatgaaggagaaactgcttttcgtggttggtccagaatggctgtaccgatcaaggaatttagaatcacggaagttaaacaaccaaatattggtgaagtaaagccatccgtggtgacggctaaagttacttttagcatttccagctataaagcacaaataagatctgaatggaatgccctcaaggagcatgatgttctatttttgttgtctattcgcccttcatttgagccacttagttcagaagaagcttcaaatgcaactgttccacagaaacttggtcttcaatatgtgcgtggatgtgagatagttgaagtacgcgatgaggacggaactcttatgaatgattttaccgggagaatcaaacgcgacgagtggaaacctcccaaaggagacttgagaactgttactattgcgttggatacagcacaatatcatatggatgtttccgacatcgcggagacgggcgcagatgacgtgtacggtacattcaacatattgatgaggcggaaacctaaggagaataacttcaaagcaattttggaatccataagggatctgatgaatgaaacatgtattgttcctaaatggttacatgatatattattgggttatggagatccttctgcagcacaatggaccaatatgccagatctcattaaaaaggttgattttaaagacactttcctcgatgctgctcatgtcatagagagcttcccaaactataaggttcggtttataaattcagatggaacagacaattcgaatccatgtcctccattccgtattaaatttccggagaatctcgaaagcatggtccatgctctgcctgggaatgtgatatctacacaaacttcaaatgacgccagctctatgcaagatgatcattctgacaaagtggagcttgtagttgaggcttatgtacctcctgatccagggccctatccccaggatcaaccaaagcagaactctgttagatttactcctactcaggtcggagttatcctgtccggagttcagcctggcttaaccatggtggttggtccacctggtactggaaagacggatacagctgtccaaatcttgaatgttctctaccataattgtccttctcagagaactttgataatcactcattcaaatcaggctctaaacgatcttttcgaaaagataatggagagggacgtgccagctcgatatctacttcgactcggtcaaggtgaacaagagttggccactgaacttgatttcagccgccaaggccgtgtaaatgccatgcttgttcgacgattggaactccttagtgaagtggagcggctcgcaagatctctacaactgcccgaggatgtaggttatacttgtgaaaccgctggctacttctggttgctccatgtttactcacgctgggagctttttctagctgcttgtgctcagaatcaagacaaaccgacgtttattcaggaccgcttcccttttaaggagttcttttccaataccgcgaagccgattttcgcagccgagtcctttgaaaaagacatgcacacagctaagggttgcttccggcaccttcaaactatgtttcaggagcttgaagagtgtagggcatttgagctgcttaagtcaacagtcgatagatcaaattatcttatgaccaagcaagcaaaaatagtagccatgacttgcacccatgcagctcttaaacggaaagattttctacacttgggctttaaatacgacaacttgttaatggaagaaagtgcccagattttggagattgaaactttcatccctatgttgctccaaaggcaggaagatgatcgtgctcgcctaaaacgatgtatattgattggtgaccaccaccaattgcctcccgttgtgaaaaatatggcttttcagaagtacagccatatggaccagagtctgttcacaaggtttgtgcgtctaggaattccctatattgagctcaatgcccaaggaagagctaggcctagtttagcaagactttacaattggagatataaagacctaggtgatctctcatacgtgaaggagaatgaaattttccaaagagcaaactctggattctcttacgactatcagttggtggatgttcctgattttcatgggagaggtgagagtgctccttcaccctggttctaccaaaacgaaggagaggctgagtatattgttagcgtctatatgtacatgcgtttgttgggatatccagccagcaaaatatccatactgacaacatacaatggtcagaaacttttgattcgtgatgttattaatcgacggtgtgtcccttatgacttcattggtccaccacacaagttgacaagtttcaagggcaacaaaatgacttcatcttgttatccctcgttcgttctcgctttgtgggtcaccttcgtgacgtaagaagattggttgtcgcaatgtctcgagctcgattggggctttatgttttctgtcggcgttctctgttcgaacagtgctatgaactacagcctacgtttcagcttcttcttcagaggcccgatcacctttctctcaatctgaacgaattcacaacaattaccgatcgtcatgtcgaagacacaggaccggtccagcttgttagtggaatcgaagagatggctaacatagttaattacaagatgcaccaggtttaccaggcacgggtaacgagctatcagtcaaatcaatattcagcatatccagggcagtccgctatggagattgatgcttctgaggaaaacggaacagaaaacgtagagccctctgtcggagagatggatctcgataacggtacagagaaggatacatcactactacctgatgctacctcgaatggttcagcacatttagatgcttccgtagaagagaatggtgatgcgtagtttctaaacggtattaatcattattagaaacttgtattgtaccggcatttaatggtaaaacgagcaggtacttaaactactaattattttactcactgaattttgaaggcggttgaggacattttaattgtgcttttttgttgtatagttaaagccatttcgtataaggttggcttcatgtagattttcacaaaattttatttgctggattatattttaatttctgattttgatca

SEQ ID NO: 864 - DNA, 3270 bp, Mimulus guttatus
ctgcgagaacttgcattggctaatgtgggctcgatcaacaagcgtgctgacctggcaaagaagctttcagtactttctcctgaagagttgagagatttagtatgtgtgaagctcaagttggtgtcaaaggatgatccatggtctgaaagagttgacttcctgatagaagtcacagtctccttctttgagaaacaacaatctcagaaagaggcgatcaatgcgcttccactatatcctaatgagcaaataatgtgggatgaaagccttgtaccaagcattaactactccggtgaagggtgtcttgcacttccaaagcttaatttgcagtttttaacacttcatgattaccttcttagaaatttcaacctcttccgcctcgagtcaacgtatgaaatccgcgaggatattcaagaagctgttccacatcttcttgcttacgttaataatgaaggagaaactgcttttcgtggttggtccagaatggctgtaccgatcaaggaatttagaatcacggaagttaaacaaccaaatattggtgaagttaagccatccgtggtgacggctaaagttacttttagcatttccagctataaagcacaaataagatctgaatggaatgccctcaaggagcatgatgttctatttttgttgtctattcgcccttcatttgagccacttagttcagaagaagcttcaaatgcaactgttccacagaaacttggtcttcaatatgtgcgtggatgtgagatagttgaagtacgcgatgaggacggaactcttatgaatgattttaccgggagaatcaagcgcgacgagtggaaacctcccaaaggagacttgagaactgttactattgctttggatacagcacaatatcatatggatgtttccgacatcgcggagacgggcgcagatgacgtgtacggtacattcaacatattgatgaggcggaaacctaaggagaataacttcaaagcaattttggaatccataagggatctgatgaatgaaacttgtattgttcctaaatggttacatgatatattattgggttatggagatccttctgcagcacaatggaccaatatgccagatctcattaaaaaggttgattttaaagacactttcctcgatgctgctcatgtcatagagagcttcccaaactataaggttcggtttataaattcagatggaacagacaattcgaatccatgtcctccattccgtattaaatttccggagaatctcgaaagcatggtccatgctctgcctgggaatgtgatatctacacaaacatcaaatgacgccagctctactgacaaagtggagcttgtagttgaggcttatgtacctcctgatccagggccctatccccaggatcaaccaaagcagaactctgttagatttactcctactcaggtgggggttatcctgtccggagttcagcctggcttaaccatggtggttggtccacctggtactggaaagacggatacagctgtccaaatcttgaatgttctctaccataattgtccttctcagagaactttgataatcactcattcaaatcaggctctaaacgatcttttcgaaaagataatggagagggacgtgccagcacgatatctacttcgactcggtcaaggtgaacaagagttggccactgaacttgatttcagccgccaaggccgtgtaaatgccatgcttgttcgacgattggaactccttagtgaagtggagcggctcgcaagatctctacaactgcccgaggatgtaggttatacttgtgaaaccgctggctacttctggttgctccatgtttactcacgctgggagctttttctagctgcctgtgctcagaatcaagacaaaccgacatttattcaggaccgcttcccttttaaggagttcttttccaataccgcgaagccgattttcgcagctgagtcctttgaaaaagacatgcacacagctaagggttgcttccggcaccttcaaactatgtttcaggagcttgaagagtgtagggcatttgagttgcttaagtcaacagtcgatagatcaaattatcttatgaccaagcaagcgaaaattgtagccatgacttgcacccatgcagctcttaaacggaaagattttctacacttgggctttaaatacgacaacttgttaatggaagaaagtgcccagattttggagattgaaactttcatccctatgttgcttcaaaggcaggaagatgatcgtgctcgcctaaaacgatgtatattgattggtgaccaccaccaattgcctcccgttgtgaaaaatatggcttttcagaagtacagccatatggaccagagtctgttcacaaggtttgtgcgtctaggaattccctatattgagctcaacgcccaaggaagagctaggcctagtttagcaagactttacaattggagatataaagacctaggtgatctctcgtatgtgaaggagaatgaaatttttcaaagagcaaactctggattctcttacgactatcagttggtggatgttcctgattttcatgggagaggtgagagtgctccttctccgtggttctaccaaaacgaaggagaggctgagtatatagttagcgtctatatgtacatgcgtttgttgggatatccagccagcaaaatatccatactgacaacatacaatggtcagaaacttttgattcgtgatgttattaatcgacggtgtgtcccttatgacttcattggtccaccacacaaggtagccacagttgacaagtttcaagggcaacaaaatgacttcatcttattatccctcgtgcggtctcgctttgtgggtcaccttcgtgatgtaagaagattggttgtcgcaatgtctcgagctcgattggggctttatgttttctgtcggcgctctctgttcgaacagtgctatgaactacagcctacgtttcagcttcttcttcagaggcccgatcacctttctctgaatctgaacgaattcacaacatttaccgatcgtcatgtcgaagacacaggaccggtccaacttgttagtggaatcgaagagatggctaacattgttaattacaagatgcaccaggtttaccagttggaacttttcgtaatttttatttatatggtctccggtgacttaatattctccttttcgccagttgctacttacattcctaattatattctaaaagtatccttgttcacgctgaatggtcctatttgtatctatccaagtcttgatgtccaattatag

SEQ ID NO: 865 - DNA, 2135 bp, Aristolochia fimbriata
tctaacgctccaaagccacgtttttctactggttgaatcttttgaaaaagacatgcgtgctgctaaagggtgttttcgccatcttaaaacaatgttccaagagctagaagagtgtagagcatttgaactcttgaagtcacaagctgatcgtgcaaattatcttatgaccaaacaagccaaaatagtagccatgacatgcactcatgcagctctgaaaaggaaagattttctgcaattgggattcaagtatgataacttgctcatggaagaaagtgcgcaaattctcgagatagagacatttatacccatgttgctacaaaggcaagaggatggttatgcacggcttaaacgctgcattctaattggtgatcatcatcagctgcccccagttgttaagaacatggctttccaaaaatacagtcacatggatcaaagtttgttcaccaggtttgttcgtctgggtatcccttatattgagctgaatgcccagggtcgagcaagaccaagtattgctaaactctacaattggaggtacagagatttgggtgaccttccatatgtatgtgagcagcctcttttccacagagctaatgctggattttcatttgattatcagctagtggatgttccagattaccatggaagaggtgaaactgctccttctccttggttttatcagaatgaaggagaagcagaatacatagttagtgtctacatatacatgaagttacttggatacagtgggagtaagatttccattttgactacttataatggccagaagcttctgatacgtgatgttgtcaataggcgctgtacgacctgtggcatcgaaccacctcataagatcacaactgtggacaaatatcaaggtcagcaaaacgatttcattttattatctttggtgcgtacccgttttgttggtcaccttcgtgatgttagaagattggtggtggcaatgtctcgagcacggcttgggttgtatattttctgtcgtcgttcactctttgagcaatgctatgagctacagcccacttttcagctactccttcaaagacctgatcgccttgctctaaatcttgatgaaatgatttcatccacagaacgtttagttggagatcctgggaaaatttacttgataggtggaattcaagagatggagaaccttattaacagtagaatctatcatcaactataccaggcacaattctatcattacagtcagcatatgcccaatgaggcagtaccaaatgctgaggatgcacaagagcagaatggtcatgaacaaatgccgactaagcctccccagaatgatgtggatatgccactgctcaatgatgagaatgagcaattgcctgctaaatctcccccgaatgatgttgatataccactgctcaatggtgagaatgagcaattgcctgctatatctccccagaatgatgttgatatgccaacgatcaccggcgagaatgagcaatcgcctgctaagcctgcaaaggataatgttgatgatggcccagctgtcagtggtgaagatgcactattgctttctgaggaaaagtcagaagaaaatacacaaaagactgtggaatgagtttgacaaaatttagcggttgacactattatgagattgagaaagttgctgaatctccctgttgcttatttacagttgactgacttgtatatgaaaatttaaatctctccgaagcctacctgtgacgttggacaagtcttttgtacaatatactaaagctgctaggtgaactgcagttgcacttcacatccctacatgagagaatgcagcctgttttattgcacaggaagcagcttctgtttagctagatgcatagtaaacatatgtaaggaggtgttttaacattttttgtgacgagaggtgtacaaccatgtaaagccggcaaacgtgccatcatgtggcctctatctaggatgcctcctttctgtatctgttgaagctgatgccattgtttcgtgcttgttctagcagcttttagtttcacattctactccagaaatttgttttcagtaggtcatgattattgctgtcgtcttttatattctcgtagctacagatggctttttggagtgcgggttattacttaatataatcacttcca

SEQ ID NO: 866 - DNA, 1916 bp, Aquilegia formosa
  misc_feature (425)..(425): n is a, c, g, or t
  misc_feature (611)..(611): n is a, c, g, or t
cggacacacctcaaccagtttttacaggccagtcctttgagaaagacatgcgttcagccaaagggtgctttcgtcatcttaaaataatgttccaagaactagaagagtgcagggcgtttgaattactaaagacaactgctgacagagcaaattatcttatgaccaagcaggcaaagattgtggcaatgacttgtactcatgctgctctaaaaagaaaggatttccttcatttgggatttaagtatgacaacttgttaatggaagaaagcgctcaaattttggagattgagacctttattcctatgttgctccagagacaggaagatggctatgcacgactaaaacgctgcatattgattggtgaccatcaccagttacccccagttgtgaagaacattgctttccagaaatatagccatatggancagagcttgtttacaagatttattcgccttggtatcccttatattgagctcaatgctcagggtagagccaggccagatatagccaagctttacaactggagatacagagatctaggagatcttccgtatgtgcgggaacaggctatcttccacagagctaatcctggtttctgctatgagtatcanctggtggatgttcctgattatcgcgggagaggagaaattagtccttcttcttatttttccaaaatgaaggagaggcagaatatatcgtcagtgtctatatgtacatgcgtttgctaggttatcctgcaagtaagatttccatcttgaccacttacaatggccaaaagtttcttatccgcgatgtcattaatagacgctgtgcccaatacgacttcattggtccacctagcaaggttaccacagtagacaaatttcaaggtcagcaaaatgacttcattttattgtctcttgttcgtacccgtattgtgggtcatattcgcgatgtcagaagattgatagttgctatgtctcgagctcgacttgggctttatgtgtttggccgccgatcactgtttgaacaatgctatgaattacagcctacgtttcaacatttacttcagagacctgacttacttgctctaaactgtgatgaggaggtttatccttttactgaacgtcttgttggagacattgggaatcaattccgattcgtaagtggcgttgaggagatggctaatgttgttaatctaaagttgaattacatgtaccaggcaagagccatgagccatcattataatcagtatcctgctcatgctgggcaagtacctgcagccattgatgcacctgagggagtcgacaaccatactagtctcccctcatcccaccatgaagtcacatctgtaacctcccctgtaaatggggatatgttacttgaaaatggtggtgaggatgaaactcagaacagcagccctaaaactgtagttaatggagatacgcaagttgaaggcagttcaaatcttgactctcacatggaggatagggtaaagagtgaaagtgaggtaccaactgaagataattcaaaggatgaaagcaaaatggaggagtaaactaacaggtatcttgcgtgattatgttcagcaactgggaaatcctccgagttccccaggggtttggcttttgtcgacagtggtcacagttaagttctgcaaccacactatgatactttcaactggcagctgactataacgacccggatgttttggctctcctatttccaactatttagggtcagactttaatttggtgtgcttgatgcttcactggtttttctgtagcaaacaagggaaatttcttatccctggatgaagggtggagcactgaacaggacatgttttgtatgtaaaattttgcgactgatgacaaacacgttaaaaaatgaggatttctgtattgacatcatagttagaatgttgtgttaaaagtaag

SEQ ID NO: 867 - DNA, 1400 bp, Triticum aestivum
tcggggttagttattaagacgccatttttaggcttttaacgcactcgctccaggctcagtcagggcttcctcatcctctcttatcctcctcttccgcggtcacacttcacatctccgtcttcttctacatcccgcctcgatctggatcgacaagagatcagccctgcaatggccagcgttggcggcgatgccaagaagagcctgacgcagtggctcggggagaaagggttcgacgaggaggccatcaggcgcatgtcgaagcggtgcaggaacctgccgaacctcgacgccggcgaggcctccggcgtctgggactacctcctcaacgacgtcaagatcgagcaccggaagctgcggtacgtggtgaccaagtgccccaaggtgctcaccatgtccgtcaacgacaagctcatccccacggtccagtgcctcaccacgctgcaggccaagcccggggagatcgcgcaggccatcgtcaagttcccgccgatactgttccacagcgtggaggagaagctctgccctctcctcgccttcttccagacgctggccatctccgagaagcagctcgccaagctgctcatggtcaacccgcgcctcatcagctacagcatccaggccaagttctcccagacggtcgacttcctcgtcggccttggcatcgacagggaggtcatgatcggcaagatcctgaccaaggagccatacatcatgggatacagcatcgataaaaggctgcgccctactgccgagttcctcaagtcggcagtcgggttgcaggggtcatatctccagagggtcatcatgaatttccctagcatactgtcacgagacgtcgacaagactctgcggcccaatttggtgttcctgcagagcgctggattcagcaaggatcagatcatgaaattggtggctggataccctcctgttctcatcaagagtatcaagcattgcttggagccaagggtgaagttcctggttgaagaaatggggcgggacaagggcgaggtggtagattacccccaattctttcaccatggtctcaagaggagcctggagtaccgtcacaagatactcaagcagatgaactcaaggtgcagtctcagtgagatgctcgactgtaatcagaagaagtttgccatgaaatttggtttgatcccagtagcttagggcctgatcttctgtctcttcagttcccatgtagcatgttttatattcaggtgaatgttttatttttgtaccattggccgtgttgtttcttgaacattttgggcattgagaatccaagcattttgctttaactggatgttttccgaatgttcagtgcaactgcctctttcaacaagtggcttgagtatgtatttttcatatttcttccaaggaaagcgtgtgaattttcc

SEQ ID NO: 868 - DNA, 1238 bp, Triticum aestivum
tcctctcttatcctcctcttccgcggtcacacttcacatctccgtcttcttctacatcccgcctcgatctggatcgacaagagattagccctgcaatggccagcgttggcggcgatgccaagaagagcctgacgcagtggctcagggagaaagggttcgatgaggaggccatcgggcgcatgtcgaagcggtgcaggaacctgccgaacctcgacgctggcgaggcctccggggtctgggactacctcctcaacgacgtcaagatcgagcagcggaagctgcggtacgtggtgaccaagtgccccaaggtgctcaccatgtccgtcaatgacaagctcgtccccacggtccagtgcctcaccacgctgcaggccaagcccggggagatcgcgcaggccatcgtcaagttcccgccgatactgttccacagcgtggaggagaagctctgccctctcctcgccttcttccagacgctggccatctccgagaagcagctcgccaagctgctcatggtcaacccgcgcctcatcagctacagcatccaggccaagttctcccagacggtcgacttcctcgtcggccttggcatcaacagggaggtcatgatcggcaagatcctgaccaaggagccatacatcatgggatacagcatcgataaaaggctgcgccctactgccgagttcctcaagtccgcagtcgggttgcaggggtcatatctccagagggtcatcatgaatttccctagcatactgtcacgagacgtcgacaagactctgcggcccaatttggtgttcctgcagagcgctggattcagcaaggatcagatcatgaaattggtggctggataccctcctgttctcatcaagagtatcaagcattgcttggagccaagggtgaagttcctggttgaagaaatggggcgggacaagggcgaggtggtagattacccccaattctttcaccatggtctcaagaggagcctggagtaccgtcacaagatactcaagcagatgaattcaaggtgcagtctcagtgagatgctcgactgtaatcagaagaagtttgccatgaaatttggtttgatcccagtagcttagggcctggtcttcttgtctcttcagttcccatgtagcatgttttatattcaggtgaatgttttatttttgtaccattggccgtgttgtttcttgaacattttgggcattgagaatccaagcattttgctttaactagatgtt

SEQ ID NO: 869 - DNA, 1391 bp, Brachypodium distachyon
gcccagcctcttatctccttgccgagcgacccagccctctcgctccgcggatcttcttcctcctcgcgcgagcgccgccactctcacgcttgccgagtgccgagcgcccgagccccctggctcgtcttcctcctcgctcgagcgcctccaccgcagttgtcgagcacaagacagcccagcaatggccggtgttggcagcggcgatgccaagagcctgacgcagtggctgagggagaaagggtttgacgaggagaccattgggcgcatgtcaaggcggtgcaggaacctgcccaagcttgacgccggcgaggcctctgccgtctgggactacctcttgtacgatgtcaacatcgagcggcggaagctgcggcacttggtcaccaagtgccccaaggtgctcacggtgtctgttggcgacaagctcgtccccacggtccagtgcctcaacacgctgcaggctaagcccggggaggtcgcgcaggccatcgtcaagttcccgccgatactgttccacagcgtggaggagaagctctgccctctccttgccttcttcgagacgctggccatctctgagaagcaactcgctaagctgctcatggtcaacccacgcctcatcagctacagcatcgaggccaagttctcccagacgattgacttctttgttggccttggaattgacaaggagggcatgatcggcaagatcctggcgaaggagccttacatcatgggttatagcgtcgacaaacgtctgcgtcctactgccgagttcctcaagtcggcagtcgggttgcaggggtcaaatctccagagggtcatcatgaatttccctggtatactgtcacgagacgtcgacaagactctgcagcccaatttggagttcctacagagctcaggattcagtaaggaccagataatggaattggtagctggataccctcctgttctcatcaagagtatcaagcactgcttggaacccagggtaaagttcctggttgaagaaatggggcgggacaagggcgaggtggtagattacccccagttttttcgtcatggtctcaagaggagcctcgagtaccgtcacaagattctcaagaagatgaactcgaggtgcagtcttagtgagatgctcgactgtaatcagaagaagtttgccatgaagtttggtttggtcgcagcagcagtttaggcactgatagtctcttcagttcccatgtagcatggttaatcttcaggtgaatgttttctttgtaccattggctgtgttgcttcttgaacattttggtcattgagaattcaaattattttgtgttaactgaatgtttttctggaacgttaagtggaatccctctttcaacatctgtctccagtatatattctcatattcctttcaa

SEQ ID NO: 870 - DNA, 1037 bp, Pseudoroegneria spicata
ctcgacgccggcgaggcctccggcgtctgggactacctcctcaacgacgtcaagatcgagcagcggaagctgcggtacgtggtgaccaagtgccccaaggtgctcaccatgtccgtcaacgagaagctcatccccacggtccagtgcctcaccacactgcaggccaagcctggggagatcgcgcaggccatcgtcaagttcccgccgatactgttccacagcgtggaggagaagctctgccctctcctcgccttcttccagacgctggccatctctgagaagcagctcgcgaagctgctcatggtcaacccgcgcctcatcagctacagcatccaggccaagttctcccagacgatcgacttcctcgtcggccttggcatcgacagggaggtcatgatcggcaagatcctgaccaaggagccatacatcatgggatacagcatcgacaaacggctgcgtcctactgccgagttcctcaggtcggcagtcgggttgcaggggtcatatctccagagggtcatcatgaatttccctagtatactgtcgcgagatgtcgacaagactctgcggcccaattttgtgttcctgcagagcgctggattcagcaaggaccagatcatgaaattggtggctggataccctcctgttctcatcaagagtatcaagcattgcttggagccaagggtgaagttcctagttgaagaaatggggcgggacaagggcgaggtggtagattacccgcaattctttcaccatggtctcaagaggagcctggagtaccgtcacaagatactcaagcagatgaattcaaggtgcagtctcagtgagatgctcgactgtaatcagaagaagtttgccatgaaatttggtttgattccagtagcttagggcctgatcttctgtctcttcagttcccatgtagcatgttttatattcaggtgaacgttttatttttgtaccattggccgtgttgtttcttgaacattttgggtattgagaatccaagcattttgctttaatggatgttttccgaatga

SEQ ID NO: 871 - DNA, 3467 bp, Oryza sativa
aagccgtttttagcgcactcgcttgctcaggttcctcctcatcttcttctctcctcttatccccttcgccttcctcctccccgcctacacgaccagttcctggtttctgctgccttccctcggtctggatcaacaagaggaggtcgtccaatggcgagtggtgggagcagcaatgccgggagcctgacgcagtggctgagggagaaggggttcgacgaggaggccatcgggcggatgtcgagacggtgcaagaaccttcacggccttgacgccggcgaggcctccggggtgtgggactacctcctgaacgtcgtcaagatcgagcggcggaagctccggtacgtggtcaccaagtgccccaaggtgctcaccctgtccgtcgacgacaagctcgtccccacggtgcagtgcctcaccacgctgcaggctaagcccggcgaggttgcgcaggccattgtcaagttcccccagatactgttccacagcgtggaggagaagctctgccctctcctcgccttcttccagacgcttggcatctctgagaagcagctcgccaagctgctcatggtcaacccgcgcctcatcagctacagcattgaggccaagttctcgcagaccgtcaacttcctcgttggccttggcattgacaaggagggtatgatcggcaagatcatggcaaaggagccctacatcatgggttacagtgttgacaagcgccttcgtcctactgccgagttcctcaagtcggcggtcgggcttgaggggtcaaatcttcagagggtgatcatgagttttcctgatattttgtcgcgagatgtcgataagattctgcggcccaatttggcgttcttacagagctgcggtttcagcaaggatcaggtcatggcattggtggctggataccctcctgttctcatcaagagtgtcaagcattgcctggagcctaggatgaagttccttgttgaagaaatggggcgggacatgggtgaggtggtggattacccccagttctttcgccatggtctcaagaggagcctggagtaccgccacaaggtgctcaagcagatgaattcaaggtgcagcctcagtgagatgcttgactgtaatcagaagaagtttgccatgaaatttggtttgcttgcagcagtttaggcatgcatcctctcttcagttcccatgtagcatgtttatttttcaggtgaaagtttttccttttgtactagcattttggacatcgagaattcaaagcattttgctttactgggtgttttctggaatgtcaagtgcaaatttgcctctttcagtgtcatgattaatgtataaccttgcatcaattcgcagaagagaaagcaatgcaaagcatatgaattttcttgtcggcatgctcttctcagttgaaatgcccaagtgagttgtaccactacagcagtaaggggaagacattactacagcattcctatccttggaagctatcacaatcacctatttacactacacatatacaccaatcatttgttatttgttcattacttacaagcacaattggggaaagtgggaaaacagtgcctactcagccaaactcctatgtatagtatatctgaaagatgatttgaaggggatccactcaacacacttgtctattcttctccgaagacattgtctgatttccttttgttgagcttcaggcatgatctcacatgccatctcaaccaagtcaggcaactcgagagcagcatccttcgcataatgatggagaactttaggtaggaagattgtctgctttctgactatgacactagcttgaatgaactcagtcctggcttgatccagttgatgattcactttcttggcagtgtacagcctcacctgcagaactttttacatggaaagagcaaaatgagcaagtggctctggaggatgaagagcatatggatgtatggagctccctgatgccgattttttcagtggagtaaatagagtccgtacccactgcatgtcaattattttgttagtttctttcctcaaatgtgtttgtctttgtattattggtggaaaatattgtgcaggtgtaaaccataccactgaagtgcgatgggattggcatccaataattgagttctggataatttgggcgtttactgaaagcccacccacattatatgcagcctgacaacagattgttcaaagcttgtgttgacattgtaatggcatcggggactccaactatcaacacggtgctttaaagaaaatgtacttgatgaagaggagaatgaaggagttgataaagtctcaaaatccgccaaattttgtgatggctggcttgcaagtttgcagtatactgcagaaatgcatcttacgatgtcctccgaaagtttgcaagagatctttggcacatattcagcgattgaagcactcaagaaatttgcaaggctagaatgtcctgaagatgatctcgacagcccctgtgaaaaacatgaaagatagattttctcagtttgagagattttgacagaaaaccatatgtttgtgcctgagctaaaacctgtactttgaagaggaaaaagatataactgaaactggcacaaactgtatagttctgaaaattgatccatccaaggtgcaaggcatgtacctgggtagaaacacgaggggatacacctaggtgttgatcaaatgctgccctgtagagggaaagcaaatgcagttccttgcgaacaacttcctcctcaagggctgctatctcccaaactaagtctgcaatagactgcaggaaccacaagataagaagatgaatggctagctcttggtgtttctgcacaacaaatggttgtttccatgaacacctctgatgctgcgtcttccatggattcctagaccttcagtcaccaagaacctaccaccaatcaagagcaagaaagtattgcaatcctattcagttctccataactagctgaagagaaggagaagaataatccaattaccgaaactaatgaacttaccaggctgatatatcatgagctgttgctatgcagtgtagctagcaatgagcagaacagaagaagaaggccatgattcagcttggtctggatgatgagaaatcttcactctctctcccaactccaatcccccagcttctacagaactcagcaaagggtctgaagaacagaaggaaatgcaaattctccttggtactagagtagagacaagaataatgaagaacagcagaaatgatgggcaggagatgtcctggactcctggttgccagtactacttctccaacctatgctgatagataataatggccaggaagctgatatttaagactggatgagaagagtaggattaatagcaagaagaggtggtgacccacaaggccaaagaagcaaaggaaagcaaatgaaacctgcatgaagatatggtcaggaaaaggatgaccaaagaaagcagagtttaaaaggaagcaaagc

SEQ ID NO: 872 - DNA, 3593 bp, Oryza sativa
gggagggacagagggacgacacacttgatgccattgatcgatttttcttttcttttttgctttgcttccttttaaactctgctttctttggtcatccttttcctgaccatatcttcatgcaggtttcatttgctttcctttgcttctttggccttgtgggtcaccacctcttcttgctattaatcctactcttctcatccagtcttaaatatcagcttcctggccattattatctatcagcataggttggagaagtagtactggcaaccaggagtccaggacatctcctgcccatcatttctgctgttcttcattattcttgtctctactctagtaccaaggagaatttgcatttccttctgttcttcagaccctttgctgagttctgtagaagctgggggattggagttgggagagagagtgaagatttctcatcatccagaccaagctgaatcatggccttcttcttctgttctgctcattgctagctacactgcatagcaacagctcatgatatatcagcctggttcttggtgactgaaggtctaggaatccatggaagacgcagcatcagaggtgttcatggaaacaaccatttgttgtgcagaaacaccaagagctagccattcatcttcttatctgcagcaatgtcactcgagaagcgttgtaagcacacatggaaatgtattggacatatcgcctcgactctcttatcacaaacctacaaccaacaaagataagatgctccgcagaagatattctcttaacctgccagagcatttgcctgagcatcacgtgattacaagtgcagaacaaagtgagaaaaccatatcaaagtctattgcagacttagtttgggagatagcagcccttgaggaggaagttgttcgcaaggaactgcatttgctttccctctacagggcagcatttgatcaacacctaggtgtatcccctcgtgtttctacccaggtggatcaagaaatacaccatcagaaaagcagaaagaaagctgatgaaggtgccctccgattgagaaatatcaaggagtcagcatcctacaacttgccaacagtatcaacagtttcagattctaaacatgggctgtcgagatcatcttcaggacattctagccttgcaaatttcttgagtgcttcaatcgctgaatatgtgccaaagatctcttgcaaactttcggaggacatcgtaagatgcatttctgcagtatactgcaaacttgcaagccagccatcacaaaatttggcggattttgagactttatcaactccttcattctcctcttcatcaagtacattttctttaaagcaccgtgttgatagttggagtccccgatgccattacaatgtcaacacaagctctgacaaatatgattcattgaatgagaaaagtgaacaatacaatgggatgataatatgcccaaggatatatatggatgcagaaaagtttgaatatgcctctaaaatgctagagactgtcagatcgctgataaaacgacttgagaaaattgacccaacaaaaatggcacatgaagagcagctctgtttttggatcaacatccacaacgctttggtgatgcatgcttttatggcttatggacttcaggagaaacgcatgaaaaacacagacatgattctgaaggctgcatataatgtgggtgggctttcagtaaacgcccaaattatccagaactcaattattggatgccaatcccatcgcacttcagtgtgggtacggactctatttactccactgaaaaaatcggcatcagggagctccatacatccatatgctcttcatcctccagagccacttgctcattttgctctttccactggagcaatttcagatccacctgtgaggctgtacactgccaagaaagtgaatcatcaactggatcaagccaggactgagttcattcaagctagtgtcatagtcagaaagcagacaatcttcctacctaaagttctccatcattatgcgaaggatgctgctctcgagttgcctgacttggttgagatggcatgtgagatcatgcctgaagctcaacaaaaggaaatcagacaatgtcttcggagaagaatagacaagtgtgttgagtggatccccttcaaatcatctttcagatatactatacataggagtttggctgagtaggcactgttttcccactttccccaattgtgcttgtaagtaatgaacaaataacaaatgattggtgtatatgtgtagtgtaaataggtgattgtgatagcttccaaggataggaatgctgtagtaatgtcttccccttactgctgtagtggtacaactcacttgggcatttcaactgagaagagcatgccgacaagaaaattcatatgctttgcattgctttctcttctgcgaattgatgcaaggttatacattaatcatgacactgaaagaggcaaatttgcacttgacattccagaaaacacccagtaaagcaaaatgctttgaattctcgatgtccaaaatgctagtacaaaaggaaaaactttcacctgaaaaataaacatgctacatgggaactgaagagaggatgcatgcctaaactgctgcaagcaaaccaaatttcatggcaaacttcttctgattacagtcaagcatctcactgaggctgcaccttgaattcatctgcttgagcaccttgtggcggtactccaggctcctcttgagaccatggcgaaagaactgggggtaatccaccacctcacccatgtcccgccccatttcttcaacaaggaacttcatcctaggctccaggcaatgcttgacactcttgatgagaacaggagggtatccagccaccaatgccatgacctgatccttgctgaaaccgcagctctgtaagaacgccaaattgggccgcagaatcttatcgacatctcgcgacaaaatatcaggaaaactcatgatcaccctctgaagatttgacccctcaagcccgaccgccgacttgaggaactcggcagtaggacgaaggcgcttgtcaacactgtaacccatgatgtagggctcctttgccatgatcttgccgatcataccctccttgtcaatgccaaggccaacgaggaagttgacggtctgcgagaacttggcctcaatgctgtagctgatgaggcgcgggttgaccatgagcagcttggcgagctgcttctcagagatgccaagcgtctggaagaaggcgaggagagggcagagcttctcctccacgctgtggaacagtatctgggggaacttgacaatggcctgcgcaacctcgccgggcttagcctgcagcgtggtgaggcactgcaccgtggggacgagcttgtcgtcgacggacagggtgagcaccttggggcacttggtgaccacgtaccggagcttccgccgctcgatcttgacgacgttcaggaggtagtcccacaccccggaggcctcgccggcgtcaaggccgtgaaggttcttgcaccgtctcgacatccgcccgatggcctcctcgtcgaaccccttctccctcagccactgcgtcaggctcccggcattgctgctcccaccactcgccattggac

SEQ ID NO: 873 - DNA, 1375 bp, Triticum aestivum
  misc_feature (1279)..(1279): n is a, c, g, or t
  misc_feature (1289)..(1289): n is a, c, g, or t
gacttctagcgcactcgctccagtccaggctcaggcagggcttcctcatcctctcttatcctcctcttccgcggtcacacttcacatctccgtcttcttctgcatcccgcctcgatctggatccacaagagatcagccctgcaatggccagcgttggcggcgatgccaagaagagcctgacgcagtggctcggggagaaagggttcgacgaggaggccatcaggcgcatgtcgaagcggtgcaggaacctgccgaacctcgacgccggcgaggcctccggcgtctgggactacctcctcaacgacgtcaagatcgagcaccggaagctgcggtacgtggtgaccaagtgccccaaggtgctcaccatgtccgtcaacgacaagctcatccccacggtccaatgcctcaccacgctgcaggccaagcccggggagatcgcgcaggccatcatcaagttcccgccgatactgttccacagcgtggaggagaagctctgccctctcctcgccttcttccagacgctggccatctccgagaagcagctcgccaagctgctcatggtcaacccgcgcctcatcagctacagcatccaggccaagttctcccagacggtcgacttcctcgtcggccttggcatcgacagggaggtcatgattggcaagatcctgaccaaggagccgtacatcatgggatacagcatcgacaagcggctacgtcctactgccgagttcctcaagtcggcagtcgggttgcaggggtcatatctccagagggtcatcatgaatttccctagcatactgtcgcgagatgtcgacaagactctgcggcccaatttggtgttcctgcagagcactggattcagcaaggatcagatcatgaaattggtggctggataccctcctgttctcatcaagagtatcaagcattgcttggagccaagggtgaagttcctggttgaagaaatggggcgggacaagggcgaggtggtggattacccccaattctttcaccatggtctcaagaggagcctggagtaccgccacaagatactcaagcagatgaactcaaggtgcagtctcagtgagatgcttgactgtaatcagaagaagtttgccatgaaatttggtttgatcccagtagcttagggtctgatcttctgtctcttcagttcccatgtagcatgttttatattcaggtgaacgttttatttttgtaccattggccgtgttgtttcttgaacattttgggcattgagaatccaagcattttgctttaactngatgttttcngaatgttcagtgcaactgcctctttcaacaagtggcttgagtatgtatttttcatatttcttccaaggaaagcgtgtgaattttcc

SEQ ID NO: 874 - DNA, 1268 bp, Panicum virgatum
  misc_feature (96)..(96): n is a, c, g, or t
  misc_feature (906)..(906): n is a, c, g, or t
ctcgttcttggtgacgcgaccgcatccaccgtagggaaaggaagaacaagggcaggtgccgatggcaagcagtgtcagaggttccaagagcctggngcagtggctgagggagaacgggttcgacgaggagaccgtcgcgcgcatgtcgaggaggtgcaagaacctgcacagcctcgacgccggcgaggcctcgggcgtctgggactacctcctcaccagcgtcaagatcgagcggcggaggctgcggcacgtggtggccaagtgccccaaggtgctcaccctgcccgtggacggcaagctcgtgcccacggtgcagtgcctcgccacgctgcaggccaagcccggggaggtggcgcaggccatcgccaagttcccgcagatactcttccacagcgtggaggagaagctctgcccgctcctcgccttcttccagacgctcggcgtctccgagaagcagctcgccaagctgctcatggtcaacccgcgccttatcagctacagcatcgaggccaagttctcgcagatggtggacttccttgtcggcttaggcattgacaaggaaggcatgatcggaaagatcctgaccaaggagccttacatcatggggtatagtgtcgacaaacggcttcgtcccactgccgagttcctcaagtcgggggtcgggttacaggggtcagatctcaaaagggtgatcatgagcttccctgatatattatcacgagatgtggataagattctgcggcccaatttagcgttcttgcagagctgcggtttcagcaagagtcaggttatggcattggtggctggataccctcctgttctcatcaagagcgtcaaacattgcttggagccaaggataaagttcctggtcgacgaaatgggacgggacatgggtgaggtggtagnttacccccaattctttcgacatggcctcaagaggagcctggagtaccgtcacaaggtgctcaagcagaataagtcaagttgcagcctcagcgagatgctagactgtaatcagaagaagtttgctatgaaatttggtttggttgcagcagtttaggtactcatcttgtctctagtttcaatgtagtatgttttatttttcaactgatgttttgatttgtacctttgggttgtattgttcttgaacatctggtattgagaatgcaaatctctcattcaagtttcaactattctcttgattagttgatcttgagaatatctatttatttgagagcaagagagggcacgtcatgtgggctttccca

SEQ ID NO: 875 - DNA, 723 bp, Secale cereale
cggcacgagggtaactagtggcaggtggtactgtaaaacatcacatcgtcgcacagtgacggtgtttggccgggctggtcgacgatcgacacggcggccagcatgaaggcgtcctgcttcctggtggtgcttctgctcgccgtggccacggggagcaggctctcgctcgccgcccgcgagggcggcaccctgggcgagctcatcgccaaggccggcagcttcctcacgtcggcgggccgcgcgggggcggacggctggcactccgccgcggccgcggaggtggacgcctcggcgaagaaggcgcacggccatccggcgggggcgaagaagcggctgaagaagtcgtcggtgaactgcatccccgccgacatgtgccggaggaagaaggtgctgtgcggcaagcggtgctacaagacgtcgcacgccgccgccggcctcagccacgtcccctccagccggtgcgtcgtgaggtgcaagaagtgcgtgcccacctgttagatcgatcgttggctgctccttcccttccctcttctgggttccgtgtcgtgtcgtgtcgtcgtgctcgatccatgcatgttagctacatttgcatcagttgaataagcaggcaggcttcccgccatcgtgcatgcagcataggtagtggatacgtacgggttctaaagaaatgtaccacggttgtgtgctaagtttgaacgtgatctcatctcatctcgtatcgtc

SEQ ID NO: 876 - DNA, 703 bp, Triticum aestivum
agtggcgagtgatactgtaacatcacatcacagggtgacggtgttcggccgagctggtcgatcgacacggcggccagcatgaaggcgtcctgcttcctggtggtgcttctgctcgccgtggccacggggagcaggctctcgctcgccgcccgcgagggcagcaccctgggcgagctcatcgccaaggccggcagcttcctcacgtcggcgggccgcgcgggggcggacggctggcggtccgccgccgccgcggaggtggacgcctcggcgaagaaggggcacggccatccggcgggggcgaagaagcggctgaagaagtcttccgtgaactgcatccccgccgacatgtgccggaggaagaaggtgctgtgcggcaagcggtgctacaagacgtcgcacgccgccgccgccgccggcctcagccacgtcccccccacccggtgcgtcgtcaggtgcaagaagtgcgtgcccacctgctagaccgttcgttggctgttccttcccttccctcttctgggttccgtgtcgtgtcgtgtcgtcgtggtcgatccatgcatgttagctacagtacatttgctttcccttccatagggttcatgcaccggttgaataagcaggcaagcttcccgccatcatggtcgcatgcagtgtaggtagtggatgggttctacgtactctaaaagaaatgtaccacggttgtgtg

SEQ ID NO: 877 - DNA, 743 bp, Triticum aestivum
ccacgcgtccggtaagtaacaagtggcgagtgatactgtaacatcacatcacagggtgacggtgttcggccgagctggtcgatcgacacggcggccagcatgaaggcgtcctgcttcctggtggtgcttctgctcgccgtggccacggggagcaggctctcgctcgccgcccgcgagggcagcaccctgggcgagctcatcgccaaggccggcagcttcctcacgtcggcgggccgcgcgggggcggacggctggcggtccgccgccgccgcggaggtggacgcctcggcgaagaaggggcacggccatccggcgggggcgaagaagcggctgaagaagtcttccgtgaactgcatccccgccgacatgtgccggaggaagaaggtgctgtgcggcaagcggtgctacaagacgtcgcacgccgccgccgccgccggcctcagccacgtcccccccacccggtgcgtcgtcaggtgcaagaagtgcgtgcccacctgctagaccgttcgttggctgttccttcccttccctcttctgggttccgtgtcgtgtcgtgtcgtcgtggtcgatccatgcatgttagctacagtacatttgctttcccttccatagggttcatgcaccggttgaataagcaggcaagcttcccgccatcatggtcgcatgcagtgtaggtagtggatgggttctacgtactctaaaagaaatgtaccacggttgtgtgccaagtttgaaaaaaaaaa

SEQ ID NO: 878 - DNA, 1454 bp, Triticum aestivum
agagttggactcttcatcatgtaccaactttttatatatttaaattgcaattatacctctcccccctgtgctcgtatgtgtgaacttgacttgctacagtgaagaaggaactcttcgacaccaagcatggctgaaagctcttcgacaccggggtcatgggatacagttcaatgtcgtcctaataaatgacaatgttgtgatcttttaaatcagtcaatcaagcaagcaatcaaatattttattttatcatcttcatagtttagtttccctcgagcttaagaggtccttgcaatcaaactacacagacacaatcagagcggcatcctgagacgccactgtcagtacacctgtcttttggtgccgtggaaggagagctactgctcatgcaagtgacctgatcattatcgtgtcattgtcgtgcccaactgaagcaccatcaggcatccatccccgaaattttgcaaggaaggatgccatctgaaacccacaaatcatggcaatggcacctcctttgctgtttcgtccacggcttctcacacgcacagtcacgcatcgcgccccgcccccttacgttcgtcgccatgttgacacgcatttgatgttcaccgcagttaggtagcccatgcagatggtttccgtttccatgtcatgccccatgcatcctttgctgatgatgacttgaccgcctatataagagaacagtgttaccgtgacctcacctgcaccggtaagtaactagtgggcaagtggtacgtactgtaaaacatcacatcgtcgcaccgtgacggtgttcggccgagctggtcgatcgacacggcagccagcatgaaggcgtcctgcttcctggtggtgcttctgctcgccgtcgccacggggagcaggctctcgctcgccgcccgcgagggcagcaccctgggcggcgagctcggcgagctcatcgccaaggcgggcagcttcctcacgtcggcgggccgcgcgggggcggacggctggcactccgccgcggccgcggaggtggacgcctcggcgaagaaggggcacggccatccggcggggccgaggaagcgtctgaagaagtcgtcggtgaactgcatccccgccgacatgtgccggaggaagaaggtgctgtgcggcaagcggtgctacaagacgtcgcacgccgccggcgccggcctcgaccacgtcccctccaaccggtgcgtcgtcaggtgcaagaagtgcgtgcccacctgctagatcgatcgtcggttgctcctacccttccctcttctgggttacgtgtcgtgtcgtgtcgtggtgctcgatccgtgcatgctagctacatttgcttttccttccatagggttcatgcatcagttgaataagcaggcgggcttcccgccatcatgatcgcatgcagtgtaggtagtggatgggttctacttactctaaaagaaatgtaccacggttgtgtg

SEQ ID NO: 879 - DNA, 585 bp, Triticum aestivum
taactagtgggcaagtggtacgtactgtaaaacatcacatcgtcgcaccgtgacggtgttcggccgagctggtcgatcgacacggcagccagcatgaaggcgtcctgcttcctggtcgtgcttctactcgccatcgccacggagagcaggctctcgctcgccgcccgcgagggcagcaccctgggcggcgagctcggcgagctcatcgccaaggcgggcagcttcctcacatcggctggccgcgcgggggcggacggctggcactccgccgcggccgcggaggtggacgcctcggcgaagaaggggcacggccatccggcggggccgagaaagcgtctgaagaagtcgtcggtgaactgcatccccgccgacatgtgccggaggaagaaggtgctgtgcggcaagcggtgctacaagacgtcgcacgccgccggcgccggcctcgaccacgtcccctccaaccggtgcgtcgtcaggtgcaagaagtgcgtgcccacctgctagatcgatcgttggttgctcctacccttccctcttctgggttacgtgtcgtgtcgtgtcgtggtgctcgatccgtgcatgcta

SEQ ID NO: 880 - DNA, 1732 bp, Leymus cinereus x Leymus triticoides
  misc_feature (1084)..(1084): n is a, c, g, or t
caccaccagctcgccatggctcatggcttgggcatcctcctcctcctcctggcctcctcgtttgccggctccgccttcgccgatgcgacggcgcttggccggaaggccggtgctggcgccattgccgaggagcccgagctgaaggcggcgccggggaagtacgcggtgatcttcgacgcgggcagcacgggcacgcgcgtccacgtcttccggttcgacaagaagatggagctcgtcgacgtcggcgacgacatcgaggtcttcgccaaggtggagccggggctgagctcgtacgccggacggccgcaggaggccgccaagtccatcgttcctctgctcgagaaggccaagagcgccgtgcctcgctggctcatgaagaaaacacccgttaaactaggggccacggctggactcagacttatcggagatgacaaggcagagcaaattcttgaagcagtgagggatgctgtccacagcaagagcaaattccagtacaatcctagttggatcaatgttctcaaggggtctcaggaaggatcttacctatgggttgctctgaattacctgctgggtaaactgggaggagactactccaagacggtggctgtgatcgaccttggaggtgggtccgtgcagatggcatatgccatctctgcggacgccgcggctgtcgctcccgtggtgcctcaaggggaggatccatacgtcaccaaagagtatatcaaaggaagagattacaacgtctatgttcacagctacttgcactacggcgcaatggcttctcgggtagagatcttcaaggcgaagaacggaccagtcagctactgcttgcttcgcggattcaatggcaaatacacctacaacggagagcaatacgacgccatagcgccactgcaaggagcggcatacgacaagtgcagagaggacgtcaccagggcgctgaaactgggcgcgccctgcgaggccaagaactgcaccttcaacggcgcgtggaacggcggcggcggccccggtcaggccgagctctacgtcacttccagcttctactacatggcagcagacgttggcttgatcgacagcgagncgagcagcgggaagaccaccccggcggcgttcaggaccgccgccgagaagatttgcccgatgagcttcgtggaagccaaggccgcataccccaaggtgcgatccgtcgacgcgccctacatctgcatggacctcatctaccagtactccctgctcgtggacgggttcggtttggagacgaccaaggaaatcacggtggcgcagaaggtgaagcacggggagtacttcatcgaagccgcgtggccgctcggagaggccatcgaggccgtgtcgccaaccaagcggctcaacgatgcatgattttatattgattgctagtccctatctcgcaataaggtgcatgcaggtgtatcttacgattgatcgcaattaataaagtgtatgcaggtgtgagttttgcttccgtacaccccttaaaagtttgcacgaatcttaaaattacttaaaaaaatgatattctcatacattcacgatcaacttctaatccctattctcttaatggatcaaacaaaagatcagaacaatctaatctttttgactgaaggggtgacttctaatcatcatttttaatctgtatagaaatccgtaaatttttctagaggggtgtactgatgcaacgttacatgaattaaaggattataaaggtgca

SEQ ID NO: 881 - DNA, 1579 bp, Triticum aestivum
cccacgcgtccgagccacccaccagcactccagcagcagctcgccatggctcaccatgcctcgggcgtcctcctcttcctcctcatggccttctcgttcgccggctccacctttgccgccgacgcggcggtgctcggccggaaggccggtattggcgccgttgccgaggaggagcccgagctgaagaaggcggcgcccgggaagtacgcggtgatcttcgacgcgggcagcacgggcacgcgcgtccacgtcttccggttcgacaagaagatggagctcatcgacattggcgacggcgacgacatcgaggtcttcgccaaggtggagccggggctgagcgcgtacgccggacggccgcaggaggcggccaagtccatcgtgcctctgctggagaaggccaagagcaccgtgcctcgctggctcatgaagaaaactcccgtcaaactaggggcgacggctgggctcaggctcatcggagacgagaaagcggagcaaattcttgaagcagtgagggatgctgtccacagcaagagcaaattccagtacaatcccagttggatcaatgttctcacggggtcccaggaaggatcttacctatgggttgctctgaattacctgctgggtaatctgggaggagactactccaagacggtgggtgtgatcgaccttggaggcggatccgtgcagatggcatatgccatctctgcggatgccgccgctgccgctcccgtggtgcctcaaggggacgatccatacgtcaccaaagagtatctcaaaggaagagattacaacgtctatgttcacagctacttgcactatggcgcaatggcttctcgggtagagatcttcaaggcgaagaatggaccagtgagctactgcatgctgcgcggatacaatggcaaatacacctacaacggagagcaatacgacgccgtagcgcctccgcaaggagcggcatacgacaagtgcagagaggacgtcaccaaggcgcttaagatcagcgcgccctgccaggccaagaactgcaccttcaacggcgcatggaatggcggcggcggccccggccaggccgacctctacgtcacctccagcttctactacatggcagcagacgttggcttgatcgacagtgaggccaccagcgggaagaccacccctgcggcgttcagggccgccgccgagaagatctgcccgatgggcttcgtggaagccaaggccgcgtaccccaaggtgcgatccgtcgacgcgcccttcatctgcatggacctcatctaccagtactccctgctcgtggacggttttggtctggagccgaccaaggaaatcacggtggcgcagaaggtgaagcatggggagtacttcattgaagccgcgtgggcgctcggagaagccatcgaggccgtctcacccaccaagcggctcaacgatgcatgattttagatataattgctagtccctcgcaataaggtgcaagcatgtgtatcgtacgattaattgcaataaggttcatatgcttggacgccatctccaattgtaatcctttttatcatctttgtggcgagaattgcctagtataatg

SEQ ID NO: 882 - DNA, 1567 bp, Triticum aestivum
agccacccaccagcactccagcagcagctcgccatggctcaccatgcctcgggcgtcctcctcttcctcctcatggccttctcgttcgccggctccacctttgccgccgacgcggcggtgctcggccggaaggccggtattggcgccgttgccgaggaggagcccgagctgaagaaggcggcgcccgggaagtacgcggtgatcttcgacgcgggcagcacgggcacgcgcgtccacgtcttccggttcgacaagaagatggagctcatcgacattggcgacggcgacgacatcgaggtcttcgccaaggtggagccggggctgagcgcgtacgccggacggccgcaggaggcggccaagtccatcgtgcctctgctggagaaggccaagagcaccgtgcctcgctggctcatgaagaaaactcccgtcaaactaggggcgacggctgggctcaggctcatcggagacgagaaagcggagcaaattcttgaagcagtgagggatgctgtccacagcaagagcaaattccagtacaatcccagttggatcaatgttctcacggggtcccaggaaggatcttacctatgggttgctctgaattacctgctgggtaatctgggaggagactactccaagacggtgggtgtgatcgaccttggaggcggatccgtgcagatggcatatgccatctctgcggatgccgccgctgccgctcccgtggtgcctcaaggggacgatccatacgtcaccaaagagtatctcaaaggaagagattacaacgtctatgttcacagctacttgcactatggcgcaatggcttctcgggtagagatcttcaaggcgaagaatggaccagtgagctactgcatgctgcgcggatacaatggcaaatacacctacaacggagagcaatacgacgccgtagcgcctccgcaaggagcggcatacgacaagtgcagagaggacgtcaccaaggcgcttaagatcagcgcgccctgccaggccaagaactgcaccttcaacggcgcatggaatggcggcggcggccccggccaggccgacctctacgtcacctccagcttctactacatggcagcagacgttggcttgatcgacagtgaggccaccagcgggaagaccacccctgcggcgttcagggccgccgccgagaagatctgcccgatgggcttcgtggaagccaaggccgcgtaccccaaggtgcgatccgtcgacgcgcccttcatctgcatggacctcatctaccagtactccctgctcgtggacggttttggtctggagccgaccaaggaaatcacggtggcgcagaaggtgaagcatggggagtacttcattgaagccgcgtgggcgctcggagaagccatcgaggccgtctcacccaccaagcggctcaacgatgcatgattttagatataattgctagtccctcgcaataaggtgcaagcatgtgtatcgtacgattaattgcaataaggttcatatgcttggacgccatctccaattgtaatcctttttatcatctttgtggcgagaattgcctagtataatg

SEQ ID NO: 883 - DNA, 1920 bp, Triticum aestivum
cgacccacgcgtccgaagccacccaccagcactccagcagcagctcgccatggctcgtcatgcctcgggcctcctcctcctcctcctcgtggccctctcgttcgccggctcggcctttgccgccgacgtggccgtgctcggccggaaggccggtattggggccgttgccgaggaggagcccgagctgaagaaggcggccgggaagtacgcggtgatcttcgacgcgggcagcacgggcacgcgcgtccacgtcttccggttcgacaagaagatggagctcatcgacattggcgacggcgacgacatcgaggtcttcgccaaggtggagccggggctgagcgcgtacgccggccggccgcaggaggcggccaagtccatcgtgcctctgctggagaaggccaagagcaccgtgccccgctcgctcatgaagaaaacgcccgttaaactaggggcgacggctgggctcaggctcatcggagacgagaaagcagagcaaattcttgaagcagtgagggatgctgtccacagccagagcaaattccagtacaaccctagttggatcaatgtcctcaaggggtctcaggaagggtcttacctgtgggttgctctgaattacctgctgggtaatttaggaggagactactccaagacggtgggtgtgatcgaccttggaggcgggtcagtgcagatggcatatgccatctccgcggatgccgccgctaccgctcccggggtgcctcaaggggacgatccatacgtcaccaaagagtatctcaaaggaagagattacaacgtctatgttcacagctacttgcactatggcgcaatggcttctcgggtagagatcttcaaggccaagaatggtccagtgagctactgcatgctgcggggatacaatggcaaatacacctataacggagagcaatatgacgccatagcgcctcctcaaggagcagcatacgacaagtgcagagaggatgtcaccaaggcgcttaagatcaacgcgccctgccaggccaagaactgcaccttcaacggcgcatggaatggtggtggcggccctggccaagccgacctctacgtcacctccagcttctactacatggcagcagacgttggcttgatcgacagtgaggccacaagcgggaagaccacccctgcggcgttcagggccgccgccgagaagatctgcccgatgggcttcatggaagccaaggccacgtaccccaaggtgcgatccgtcgacacgccctacatctgcatggacctcgtctaccagtactccctgctcgtggacggtttcggcctggagcccaccaaggaaatcacggtggcgcagaaggtgaagcatggggagtacttcatcgaagccgcatgggcgctcggagaagccatcgaggccgtctcacccaccaagcggctcaacgatgcatgattttagatataattgccaatccctcacaataaggtgcaagcatgtgtatcatacgattaattgcaataaggtgcatatgcttggacgccatctccaattgtaatccttttatcatctttgtggcgagaattgcctagtctaatgtgtaggagtacaacgacatatagatgtgcacgccacacgcgcacacacacagccagggctgggccggcaaaatttgaggccctgtgcgaaactaaaaaatagggccctatctcataaaaaaaactaacgagctattataatgtgtgtgtatatatatctctcgcagaaaaatattataatatttatgtaacataatatcttacataacagtcggacatattatttatctctgtctaaccatgtctagaatcattgtaaagaacaattgcaagtgcaaggatagagggatcaacagactgattaccagatgacaccttgtggtgcttcttttctaacaaatc

SEQ ID NO: 884 - DNA, 1934 bp, Triticum aestivum
  misc_feature (15)..(15): n is a, c, g, or t
  misc_feature (1784)..(1784): n is a, c, g, or t
ttccttgggttacgncgacccacgcgtccgagccacccaccagcactccagcagcagctcgccatggctcgtcatgcctcgggcctcctcctcctcctcctcgtggccctctcgttcgccggctcggcctttgccgccgacgtggccgtgctcggccggaaggccggtattggggccgttgccgaggaggagcccgagctgaagaaggcggccgggaagtacgcggtgatcttcgacgcgggcagcacgggcacgcgcgtccacgtcttccggttcgacaagaagatggagctcatcgacattggcgacggcgacgacatcgaggtcttcgccaaggtggagccggggctgagcgcgtacgccggccggccgcaggaggcggccaagtccatcgtgcctctgctggagaaggccaagagcaccgtgccccgctcgctcatgaagaaaacgcccgttaaactaggggcgacggctgggctcaggctcatcggagacgagaaagcagagcaaattcttgaagcagtgagggatgctgtccacagccagagcaaattccagtacaaccctagttggatcaatgtcctcaaggggtctcaggaagggtcttacctgtgggttgctctgaattacctgctgggtaatttaggaggagactactccaagacggtgggtgtgatcgaccttggaggcgggtcagtgcagatggcatatgccatctccgcggatgccgccgctaccgctcccggggtgcctcaaggggacgatccatacgtcaccaaagagtatctcaaaggaagagattacaacgtctatgttcacagctacttgcactatggcgcaatggcttctcgggtagagatcttcaaggccaagaatggtccagtgagctactgcatgctgcggggatacaatggcaaatacacctataacggagagcaatatgacgccatagcgcctcctcaaggagcagcatacgacaagtgcagagaggatgtcaccaaggcgcttaagatcaacgcgccctgccaggccaagaactgcaccttcaacggcgcatggaatggtggtggcggccctggccaagccgacctctacgtcacctccagcttctactacatggcagcagacgttggcttgatcgacagtgaggccacaagcgggaagaccacccctgcggcgttcagggccgccgccgagaagatctgcccgatgggcttcatggaagccaaggccacgtaccccaaggtgcgatccgtcgacacgccctacatctgcatggacctcgtctaccagtactccctgctcgtggacggtttcggcctggagcccaccaaggaaatcacggtggcgcagaaggtgaagcatggggagtacttcatcgaagccgcatgggcgctcggagaagccatcgaggccgtctcacccaccaagcggctcaacgatgcatgattttagatataattgccaatccctcacaataaggtgcaagcatgtgtatcatacgattaattgcaataaggtgcatatgcttggacgccatctccaattgtaatccctttatcatctttgtggcgagaattgcctagtctaatgtgtaggagtacaacgacatatagatgtgcacgccacacgcgcacacacacagccagggctgggccggcaaaatttgaggccctgtgcgaaactaaaaaatagggccctatctcataaaaaaaactaacgagctattataatgtgtgtgtatatatatctctcgcagaaaaatattataatatttatgtaanataatatcttacataacagtcggacatattatttatctctgtctaaccatgtctagaatcattgtaaagaacaattgcaagtgcaaggatagagggatcaacagactgattaccagatgacaccttgtggtgcttcttttctaacaaatc

SEQ ID NO: 885 - DNA, 1782 bp, Triticum aestivum
cccaccaccagcaggtcgccatggctcaggctcatcatgcctcgagcgtcctcctcctcctcctcgtggccttctcgttcgccggctccgcctttgccgccgacgtggcggtgctcggccggaaggccggtattggcgccgttgccgaggaggggcccgagctgaaggcggcgcccgggaagtacgcggtgatcttcgacgcgggcagcacgggcacgcgcgtgcacgtcttccggttcgacaagaagatggagctcatcgacatcggcgacggcgacgacatcgaggtcttcgccaaggtggagccggggctgagcgcgtacgccggacggccgcaggaggcggccaagtccatcgtgcctctgctggagaaggccaagagcaccgtgccccgctggctcatgaagaaaacgcccgttaaactaggggcgacggctgggctcaggctcatcggagacgagaaagcagagcaaattcttgaagcagtgagggatgctgtccacagccagagcaaattccagtacaaccctagttggatcaatgtcctcaaggggtctcaggaagggtcttacctgtgggttgccctgaattatctgctgggtaatctgggaggagactactccaagacggtgggtgtgatcgaccttggaggtgggtccgtgcagatggcatatgccatctctgcggatgccgccgccgccgctcccggggtgcctcaaggggacgatccatacgtcaccaaagagtatctcaaaggaagagattacaatgtctatgttcacagctacttgcactatggcgcaatggcttctcgggtagagatcttcaaggccaagaatggtccagtgagctactgcatgctgcgcggatacaatggcaaatacacctataatggagagcaatacgacgccatagcgcctccgcaaggagcggcatacgacaagtgcagagaggacgtcacaagggcgcttaagatcagtgcgccctgccaggccaagaactgcaccttcaacggcgcatggaacggtggcggtggccccggccaggccgacctctacgtcacctccagcttctactacatggcatcagatgttggcttgatcgacagtgaggccacaagtgggaagaccacccctgcggcgttcagggccgccgccgagaagatttgcccgatgggcttcgtggaagccaaggccgcgtaccccaaggtgcgatccgccgacgcgccctacatatgcatggatctcatctaccagtactccttgctcgcggacggtttcggtctggagcccaccaaggaaatcacggtggcgcagaaggtgaagcacggggagtacttcatcgaagccgcgtgggcgctcggagaagccattgaggccgtctcgccgaccaagcggctcaacgatgcatgattttagatataattgctagtccctcgcaataaggtgcaatcatgtgtatcatacgattaattgcaataaggtgcatatgcttggacgccatctccaattgtaatccttttatcatctttgtggcgagaattgcctagtctaatgtgtaggagtacaacgacatatagatgtgcacgccacacgcgcacacacacagccagggctgggccggcaaaatttgaggccctgtgcgaaactaaaaaatagggccctatctcataaaaaaaactaacgagctattataatgtgtgtgtatatatatctctcgcagaaaaatattataatatttatgtaatataatatcttacataacagtcggacatattattta

SEQ ID NO: 886 - DNA, 1516 bp, Triticum aestivum
ccacccaccaccagcaggtcgccatggctcaggctcatcatgcctcgagcgtcctcctcctcctcctcgtggccttctcgttcgccggctccgcctttgccgccgacgtggcggtgctcggccggaaggccggtattggcgccgttgccgaggaggggcccgagctgaaggcggcgcccgggaagtacgcggtgatcttcgacgcgggcagcacgggcacgcgcgtgcacgtcttccggttcgacaagaagatggagctcatcgacatcggcgacggcgacgacatcgaggtcttcgccaaggtggagccggggctgagcgcgtacgccggacggccgcaggaggcggccaagtccatcgtgcctctgctggagaaggccaagagcaccgtgccccgctggctcatgaagaaaacgcccgttaaactaggggcgacggctgggctcaggctcatcggagacgagaaagcagagcaaattcttgaagcagtgagggatgctgtccacagccagagcaaattccagtacaaccctagttggatcaatgtcctcaaggggtctcaggaagggtcttacctgtgggttgccctgaattatctgctgggtaatctgggaggagactactccaagacggtgggtgtgatcgaccttggaggtgggtccgtgcagatggcatatgccatctctgcggatgccgccgccgccgctcccggggtgcctcaaggggacgatccatacgtcaccaaagagtatctcaaaggaagagattacaatgtctatgttcacagctacttgcactatggcgcaatggcttctcgggtagagatcttcaaggccaagaatggtccagtgagctactgcatgctgcgcggatacaatggcaaatacacctataatggagagcaatacgacgccatagcgcctccgcaaggagcggcatacgacaagtgcagagaggacgtcacaagggcgcttaagatcagtgcgccctgccaggccaagaactgcaccttcaacggcgcatggaacggtggcggtggccccggccaggccgacctctacgtcacctccagcttctactacatggcatcagatgttggcttgatcgacagtgaggccacaagtgggaagaccacccctgcggcgttcagggccgccgccgagaagatttgcccgatgggcttcgtggaagccaaggccgcgtaccccaaggtgcgatccgccgacgcgccctacatatgcatggatctcatctaccagtactccttgctcgcggacggtttcggtctggagcccaccaaggaaatcacggtggcgcagaaggtgaagcacggggagtacttcatcgaagccgcgtgggcgctcggagaagccattgaggccgtctcgccgaccaagcggctcaacgatgcatgattttagatataattgctagtccctcgcaataaggtgcaatcatgtgtatcatacgattaattgcaataaggtgcatatgcttggacgccatctccaattgt

SEQ ID NO: 887 - DNA, 2262 bp, Avena sativa
ctcccggtctcccgccgcgccccgccgccctctgccgcgcacgtccccgcccgccggggcgcctcctcctccacggcctgccgctgcaccacggcccccgcctccgcctccgtctccgtctccgcctcagcggcggcgtccccctctacctgggactggagccgctggagccgccacttcgccgaggtcgaccaggccgagagctacgcctccgtcctcagcttccagctcgaggaggccgtcgagagcgaggacttcgccgaggccgccagcctcaagagggccatcctcgaggcctccgccgacgacgctgtcgcccacgtcatggccgagctcaagagcgctatagaggaacagcggtaccaggacgcgtccaggttgacgaagctcgccggaaccagcttggtaggttggtgggtgggatatgctaaggacactgatgactcgattgggagaattgtacggataagccctggtgttgggagatacgtggctaagagctacagcccaaggcaattggtcactgcatcttcagggtctccattatttgaaatattcctcgtcagagacgaagacgagacatatacaatgaaggtggtacacttgcgaccaacaaaaggaacttcaagtgcatcgcccatatcatcaacagctactgaaggcccagttaaggtggagagtggaagttcactggaaagtagtgctttatctgaaggtattacagaggaagcaaatacagatactacattaaaaggaactgaagatgtagaggagaaagtgcaagatgttggaagaaccaaggaaagtggcgttgaagggttgaaaagtgttctgaactttttcaagtctcggattcctgagttcaaagtgcaagtaataaatgttgatgtgcccgaggaaactgacttagtcacagattcatcagaagaactagtgcaagatgatgtgaagagcacatcagagagttcattggaagagcctagcactgaggaatttcaggaggaagatgtttctgatggagattcagactcgaatgatgacagtaagagtccagaagtgaagcttttcattagtggagtagttcacaataaagaggatgctggagcaaaatcctatgttcgagttcctgctgaaataaataacttggaaagggactcctttgaactgtacattcctggaaaaggttctgatcgagatctggctgaaacaaaggctgctaaacaaaaagttgcggatatggctgctaaattagcatcagagctaatgccctctgatgttgcaaaggcattatggggtaccaccaagagttcttcaaagataaataaagaagttcaggagcttttaaagcttacgttgagcaaggccagagtcaagctgactgaaaataccattttcaatcggatcactactgactcaaatggcgcagatccatttaatggtctctatgtaggagcatttagtccatatgggcctgaagttgtgcagctccgtcgaaagttcggtcactggaatagtactgatgaagtggggtttttcgagtatgttgaagcagttaagttgactggtgatcttagtgtccctgctggacagataacattccgggctaaggttgggaagggcacccgtcttgagaatcgtggtgcatatccagaagagtttggtgtgactgccagttataaaggccaggggagaatagcacaacctggattcaaaaacccgcgatgggtggacggtgagctattggtgctcaatggcaagagtgcaatcccgcaccttggtggtgcagagcttggtttcctgtacagcgtgcctgagcagagcttcttggttctctttgaccgccttacacttcctgagtgatgagattgtgccgaaatgaaccgtttctcacatgcggattgcatgaacacaaggcagagaggctcgcccgatttcgggcgatcaaatagacatgcggctttctccgtcatcataagcgctccctgggacggttggatcctcgtcctacctgacaggaaccaatcgatttgatattttcaaggttattatagagaaagctgacatgttcgttcctgggaatatgatgtattgagccgtcatgtgatatgcacacagccttaggattccaaatgatgtggtatagatacaactggcatggccttttcgttggtttgttcatttgaatgaaagcgtggaaaccaggttttggtattgtcttgatgctacaaaaataaataaagctcatatccgtcaaataattaa

SEQ ID NO: 888 - DNA, 2337 bp, Brachypodium distachyon
gccccacacatctctacccactcccgatgccggcctcgtgcgccacgccggcggcggcgctcccggtctcgcgccgcgcgcccccgccgccgccgccgcagttcgccgcgcacgtgcctgccgcccgccgcggctcctcctccgccacggcctgccgctgcaccacggcctctgcctcagcctcagcggcggccgcggctcctccatccgcctgggactggccccgctggacccggcacttcgcggaggtggaccaggccgagagctacgcgtccgtgctcgccttccggctcgaggaggccgtggagggcgaggacttcgccgaggccgccgccctcaagcgggccatccgcgacgccaccgcgcacgacgccgtcgcccacgtcatggcccagctcaagagcgctatagaggaacagcggtaccaggacgcgtccagattgaccaagctcgccggaaccagcttggtaggttggtgggtgggatacgctaaggacactgatgactcgatcgggaggattgtgcggataagccctggtgttgggagatacgtggccaagagctacagcccaaggcaattggtcactgcatcctcagggtctccattatttgagatattcctcgtcagagacgaagacgagacgtatacaatgaaggtggtacacttgcgaccaacaaaaggaacttcaagtgcatcgcccctatcaacaacaaccaccgaaggtcgagttaaggtagaaaatgatacttcatcagaaagtagtgctccatccgacggcgttaaagaggaagcaaatacagatagtcagttaaaaggaaatgaagatactgaggagaaaacacaagatgttggaaacaccaaggagagtagcgttgaagggttgaagagtgttttgaattttttcaagtcccggattcctgaattcaaagttcaagtgataaatgtagatgtgccggacgaaactgaattagtttcagattcaccggaagaattagtgcaagatgatgtgaagtccacatcagagaactcgttggaagagcccggcactgaggaattcgaggaggaagatgtttctgatggagaatcagactcgaatgaagacagtaaaagtccaggagtgaagcttttcattagtggagtggttcataataaagaggatatggctggagcaaaatcttatgttcgagttcctgctgaaataagtaacttggaaaaggactcctttgaactgtacattcctggaaaaggttctgatcgagatctgactgaaacaaaggccgcaaagcagaaagttgcggatatggctgctaaattagcatcagagctcatgccttctgatgttgcaaaggcattatggggcaccaccaagagttcttcaaagataaataaagaagtccaggagcttttaaaacttacactgagcaaggcccgagtcaagctgactgagaataccattttcaaccggatcattacggactctaatggctcagatccatttaatggtctctatgtgggagcatttagtccatatggaccagaagttgtgcagctccgtcgaaagttcggccattggaatagtactgacgaagttgagtttttcgagtatgttgaagcagtcaagttgactggtgatctgagtgtccctgctggacagataacgttccgtgctaaggttgggaagggcagtcgtcttgagaatcgtggtgcatatccagaagagtttggtgtgactgccagttataaaggccagggaagaatagcacaacctggattcaaaaaccctcggtgggtggacggtgagctattggtgctcaatggcaagagtacaattccacaccttggtggtgcagagctcggtttcttgtacagtgtgcctgagcagagcttcttggttctctttgaccggcttacacttcccgagtgaatgagacagcggcgaaaatagctgattctcacgtgcaaattgcgtgaacgcagaggctgacccgagacgctttgggcgatcaaataggttacatcatgcggcttttcccaccatcctcagagcttccctgagaaggttggctcctacttgacaggaaccaaccggtccaacatttttgaggttacagagaaagctgacatgttcgttcctgggaatgtcgtattaagctgtcatgtgacccaaaccttaggcttctaaacaatgcggtatagatatatccagaatgaccatttttgggcttcttgatttgttggtttgtatgaaagggttgtaactggtttcggtattgttttgatgctaccaacaaataaataaaaatcatactatctgtatcataaatctgtcatcatcc

SEQ ID NO: 889 - DNA, 2404 bp, Oryza sativa
ggggccccagttggcagccacttatctcatcgtagcccttatcttcctcacgggctcacgcgcggcggggagagagaggacgtcaccgatcggccatgtccgcagccaccgcgtgcgcctcgccggcggcggcgcgcccgcccctccacatccccctccgctcgcctccttccgccgcgcaccttccctccgccgccgcctcccgccgggcctcctccgccgcttgccgctgcaccgcctccgcctccgcctccgcctcgccctccacctgggattggacccgctggacccgccacttcgccgacgtcgaccaggccgagagctacgcctccctcctcaagttccagctcgaggaggccgtcgacaacgaggacttcgcggaagcctccaagctcaagaaggccatactcgaggccacgggcaacgacgccgtcgcccaagtcatgtctgaactcaagactgctatagaggaacagaggtatcaggacgcctcaaggttgacaaagcttgccagaaccaacttggtaggttggtgggtggggtacgctaaggataccgatgattcgatcgggagaatcgtacggataagccccggtgttgggagatatgtggctaagagcttcagcccaaggcaattggttactgcatcgtcaggaactccattatttgaaattttccttgtcagagatgacgatgagacatatacaatgaaggttgtacacatgcgaccaacaaaaggcacttcaagtgcatcatccgtatcatcagcaactgcagaaagtccagctaaggaagagaatgaaagctcattggaaagtagtgctatatctgagggcattaccgatgaagcgaatacagatactacattaaagggagatgaagatgttgaggataaagaacaagatgttggtaacgccaaggatagtagtgttgaagggttgaaaagcgttctgaatttcttcaagtctcggattcctgaattcaaagttcaagtaataaatgtagatgtgtctgaggaagctgaattagcttcagattcgtcagaagaattagtgcaagatgatgtgaagagcacgtcagagaactcattggaagattctaccactgaggagcttcagcaggatgatgttccagatggagattcagactcagctgaagatagtaaaagtccagaaatgaagctcttcattagtggagtggttcataacaaggaggatgctggagcaaaatcatatgttcgagttccagctgaaatcaataatttggaaaaggattccttcgaactttacattcctggaaaaggttctgatcgagatctggctgatacaaaggctgcaaaacagaaagttgctgatatggctgccaaattggcatcagaacttatgccttctgatgttgcgaaggcattatggggaacgaccaagagttcttcgaagataaataaagaagtacaagagctcttaaagcttaccctcagcaaggctcgagtcaagctgactgagaatacaattttcaataggatcattactgacagtaacggctcagatccatttagtggtctctatgtgggagcatttagtccatatggaccagaagttgtgcagctccgtcgaaagttcggccattggaacagcacagatgaagtggagtttttcgagtatgttgaagcagtaaagttgactggtgatctgagtgtccctgctggacagataacattccgtgctaagattgggaagggcaaacgtcttgagaaccgtggtgcataccctgaagaatttggtgtgattgctagctataaaggtcaagggagaattgcacagcctggcttcaaaaatccccggtgggtggatggtgagctattggtgctcaatggcaagagcacgatcccacaccttggaggtgcggagcttggtttcctgtacagcgtgcctgagcagagtttcttggtactctttgaccggcttaaacttccagagtgatgagattatgctgaatcgagctgttctcacatgcaaattgcatgagtacagagagaagctgacacagtttcaagagaaacgtatagatgtcccgtcatcttcctgaaatcctgagatgcctcagctcctttattagtcagctcctacttgacaggagctgacctgtttgagctttttcagggtataagagagctgactattctggtctaactgaatactgctattcttgtccaatggaaaactggagcttcatatgagatcatgctaggctcttagatgacgcggtatagatataatttgtgtgacagttttgcattcggttttgccttaataatgaaggatgggaaagttttgtattgtctggatgctacagataaataaagccttatctttcaatacagcatgcatggcttaattaatggtta

SEQ ID NO: 890 - DNA, 3590 bp, Triticum aestivum
gagcgtgctgcggctgccaccctctttgcctcccacgccttctccattcttcctcctcctcctcctcttctgcagttactccagtccagtccagtccagtccaaccacccgcaagaactccactccatccgcggaggtgaaaagatcttggttccggcgaggggaaccgccgaccctcccaccgagcaagggaggcggagggagggagggagatccctgccgccgccatggccgagaaggaggccggaaacctggaggccgtcctcaaggaggtcgtcgacctggagaacatccccctggaggaggtgttcgacaacctgagatgcagccgcgaggggctcaccgcggagcaggcgcggcagcggctccaaatcttcggcgccaacaagctggaggagaaggaggagagcaaggtgctcaagttcctgggcttcatgtggaacccgctctcctgggtcatggaggccgccgccatcatggccatcgcgctcgccaacggagggaataagccgccggactggcaggacttcatcggcatcatcaccctgctggttatcaattccaccatcagtttcatcgaggagaacaatgccggcaacgccgccgccgcgctcatggcccgtctcacccccaaagccaagattcttcgcgacggccggtggaccgaggaagacgccgccatcctcgtgccaggggacgtcatcagcatcaagctcggagacatcatacctgcagacgcacgcctcctggagggagaccctctcaagattgatcagtctgccctgaccggagaatcgttgccggccaccaaaggccccggtgatggcgtctactccggctcgacggtcaagcaaggagagatcgaagccgtcgtgatcgccaccggtgtccacaccttcttcggaaaggctgcacaccttgttgactccactaaccaagtgggccattttcagaaggttctgacggccattgggaacttctgcatttgttcgattggtgtgggaatgttcatcaagatcattgtaatgtatcctatccagcacagggggtaccgccctggaatcgacaacctcctggtccttctcattggaggcattccaatagccatgccaacggtcttatccgtgactatggctatcgggtcacatcgattatctcaacagggagctatcacaaagagaatgactgcaatcgaggagatggcgggcatggatgttctttgcagtgataaaactggaactttgaccctcaataagcttaccgtggacaagaaccttgttgaggttttcgaaagaggcatcactcaggaccaggtgattctcatggctgctagagcgtctcgaacagaaaaccaagatgctattgatacagcaattgttgggatgctagctgatccgaaagaggcacgtgctggtattcaagaagttcattttctgccattcaatcctactgacaagaggacggcgctgacatacattgacgctgatggcaaaatgcaccgtgttagtaagggcgcacccgagcagattcttcacctcgctcacaacacatcggagatagagcggagggtccatgctgtgattgacaaatttgcagagcgtggacttcggtcgcttgctgtagcgtatcaggaagtaccagatgggaggaaagaaagtcctggtggcccatggcactttgccggtctgatgccactttttgatcctccaagacatgacagtgctgaaacaattcggagggcacttaaccttggtgttaatgtcaagatgatcacaggtgatcagctcgccattggaaaggaaacagggcgtcgcctgggaatgggtacaaacatgtatccttcatctgctctgctggggcagaaaaattcagacgagtccatttctgctttaccagttgacgatctcattgagaaagctgatggctttgctggcgtcttccccgagcacaagtatgagattgtgaaacgcctgcaagcacgaaagcacatctgtggaatgacgggtgatggagtaaatgatgctccagccctaaagaaagcagatattggtattgcggttgctgacgcgactgatgcagccaggagtgcttcagatattgtcctcacagaaccaggcctcagtgtgatcatcagtgccgtgcttaccagccgtgcgattttccagcgtatgaagaactacactatctatgctgtctccatcacaattcgtattgtgcttggatttatgctacttgccctcatctggaaattcgacttcccaccgttcatggtcctgatcatagcgattctaaatgatggtaccatcatgactatatcaaaggatcgggtaaaaccatctccactacccgacagctggaagctggctgagatcttcacaactggagttatccttggtggatacttggcaataatgacggtcatcttcttctgggctgcgtacaagacaaactttttcccgaggttgtttcatgtcgaaagcctcgagaagacagctcaggacgatttccaaaagctcgcggctgccatttacctccaagtcagcaccatcagccaagccctcatctttgtcaccaggtcgcgcagctggtcatttgccgagcgtcctgggtttctactggtctttgcgttcttcgttgcacagctgattgctacgctgatcgcggtgtatgctgactggcggttcactcagatcaaaggcatcgggtggggctgggccggcgtcgtgtggctctacaatatcatcacatacctcccgctcgatatcatcaagttcctcatccgatacactctgagcggcaaagcgtgggacctcgtcatcgaccaaaggatcgcgttcacaaggaagaaagactttggcaaggaggagagggagctcaagtgggcacacgctcagaggaccctccatgggctgcagccaccggatgccaagatgttctcggagaaggggggctacaatgagctgaatcacatggctgaagaggccaagaggagggccgagattgcgaggttgagggagcttcatacgctcaaagggcacgtggagtccgtcgtcaagctgaagggtctcgacatcgagacgatccagcagtcctacacggtctgatgctctgagctgcccatgagcgaagagtggatcctcttctttgctatgaacttcactactgtaatcgaccgtgcgcgtggtactgagacataactactgtagttaaacgttgcccgctggtgacatagtttcgcgccacctaagtaatcgcgtcgccgttttttttgttcgtttttttacgttttcagacagtatgtatattatgttttttcccttcatttttagctcgttaccgacatgttgataaatcgggtatggtggtctgtttgtgggggcaaggtagggttggcatgtgaccttcattcagtgcatggcgatgaaatgcttccttcctggggtctggtttcagatccgtagctgtggtttggctcaaatatatttgcctgccatgcttttgtgtgtcggtgacagatgcagtcaaagtgcttcatgggcctcatggtagaaatcctttcgtgctgtagcactgtacaatgtttcctagtt

SEQ ID NO: 891 - DNA, 3554 bp, Triticum aestivum
  misc_feature (25)..(25): n is a, c, g, or t
  misc_feature (32)..(32): n is a, c, g, or t
  misc_feature (35)..(35): n is a, c, g, or t
  misc_feature (40)..(40): n is a, c, g, or t
  misc_feature (57)..(57): n is a, c, g, or t
  misc_feature (94)..(94): n is a, c, g, or t
  misc_feature (322)..(322): n is a, c, g, or t
  misc_feature (329)..(329): n is a, c, g, or t
  misc_feature (380)..(380): n is a, c, g, or t
  misc_feature (749)..(749): n is a, c, g, or t
  misc_feature (752)..(752): n is a, c, g, or t
  misc_feature (761)..(761): n is a, c, g, or t
  misc_feature (878)..(878): n is a, c, g, or t
  misc_feature (1673)..(1673): n is a, c, g, or t
  misc_feature (1697)..(1697): n is a, c, g, or t
  misc_feature (1764)..(1765): n is a, c, g, or t
  misc_feature (2114)..(2114): n is a, c, g, or t
  misc_feature (3518)..(3518): n is a, c, g, or t
  misc_feature (3533)..(3533): n is a, c, g, or t
  misc_feature (3540)..(3540): n is a, c, g, or t
  misc_feature (3548)..(3548): n is a, c, g, or t
gccttctcattcttcctcctcctcntcttctnctncactnactccagtccagtccanccatccccgccccacccacaagaactccattccatcngcggaggtgaaaagatcttggttccggcgaggggaaccgccgaccctcccaccgagcaagggaggcggagggagggagggagatccctgccgccgccatggccgagaaggaggccggaaacctggaggccgtcctcaaggaggtcgtcgacctggagaacatccccctggaggaggtgttcgacaacctgagatgcagccgcgaggggctcaccgcggagcaggcgcngcagcgnctccaaatcttcggcgccaacaagctggaggagaaggaggagagcaaggtnctcaagttcctgggcttcatgtggaacccgctctcctgggtcatggaggccgccgccatcatggccatcgcgctcgccaacggagggaataagccgccggactggcaggacttcatcggcatcatcaccctgctggttatcaattccaccatcagtttcatcgaggagaacaatgccggcaacgccgccgccgcgctcatggcccgtctcacccccaaagccaagattcttcgcgacggccggtggaccgaggaagacgccgccatcctcgtgccaggggacgtcatcagcatcaagctcggagacatcatacctgcagacgcacgcctcctggagggagaccctctcaagattgatcagtctgccctnacnggagaatcnttgccggccaccaaaggccccggtgatggcgtctactccggttcgacggtcaagcaaggtgagatcgaagccgtcgtgatcgccaccggtgtccacaccttcttcggaaaggctgcncaccttgttgactccactaaccaagtgggccattttcagaaggttctgacggccattgggaacttctgcatttgttcgattggtgtgggaatgttcatcgagatcattgtaatgtatcctatccagcacagggggtaccgccctggaatcgacaacctcctggtccttctcattggaggcattccaatagccatgccaacggtcttatccgtgactatggctatcgggtcacatcgattatctcaacagggagctatcacaaagagaatgactgcaatcgaggagatggcgggcatggatgttctttgcagtgataaaactggaactttgaccctcaataagcttaccgtggacaagaaccttgttgaggttttcgaaagaggcatcactcaggaccaggtgattctcatggctgctagagcgtctcgaacagaaaaccaagatgctattgatacagcaattgttgggatgctagctgatccgaaagaggcacgtgctggtattcaagaagttcattttctgccattcaatcctactgacaagaggacggcgctgacatacattgacgctgatggcaaaatgcaccgtgttagtaagggtgcacccgagcagattcttcacctcgctcacaacacatcggagatagagcggagggtccatgctgtgattgacaaatttgcagagcgtggacttcgatcgcttgctgtagcgtatcaggaagtaccagatgggaggaaagaaagccctggtggcccatggcactttgctggtctgatgccactttttgatcctccnagacatgacagtgctgaaacaatncggagggcacttaaccttggtgttaatgtcaagatgatcacaggtgatcagctcgccattggaaagnnaacagggcgtcgcctgggaatgggtacaaacatgtatccttcatctgctctgttggggcagaaaaattcagacgagtccatttctgctttaccagttgacgatctcattgagaaagctgatggttttgctggcgtcttccctgagcacaagtatgagattgtgaaacgcctgcaagcacgaaagcacatctgtggaatgacgggtgatggagtaaatgatgctccagctctaaagaaagcagatattggtattgctgttgctgatgcgactgatgcagccaggagtgcttcagatattgtcctcacagaaccaggcctcagcgtgatcatcagtgccgtgcttaccagncgtgcgattttccagcgtatgaagaactacactatctatgctgtctccatcacaattcgtattgtgcttggatttatgctacttgccctcatctggaaattcgacttcccaccgttcatggtcctgatcatagcgattctaaatgatggtaccatcatgactatatcaaaggatcgggtaaaaccatctccactacccgacagctggaagctggctgagatcttcacaactggagttatccttggtggatacttggcaataatgacggtcatcttcttctgggctgcgtacaagacaaactttttcccgaggttgtttcatgttgaaagcctcgagaagacagctcaggacgatttccaaaagctcgcggctgccatttacctccaagtcagcaccatcagccaagccctcatctttgtcaccaggtcgcgcagctggtcatttgccgagcgtcctgggtttctactggtctttgcgttcttcgttgcacagctgattgctacgctgatcgcggtgtatgctgactggcggttcactcagatcaaaggcatcgggtggggctgggccggcgtcgtgtggctctacaatatcatcacatacctcccgctcgatatcatcaagttcctcatccgatacactctgagcggcaaagcgtgggacctcgtcatcgaccaaaggatcgcgttcacaaggaagaaagactttggcaaggaggagagggagctcaagtgggcacacgctcagaggaccctccatgggctgcagccaccggatgccaagatgttctcggagaaggggggctacaatgagctgaatcacatggctgaagaggccaagaggagggccgagattgcgaggttgagggagcttcatacgctcaaagggcacgtggagtccgtcgtcaagctgaagggtctcgacatcgagacgatccagcagtcctacacggtctgatgctctgagctgcccatgagcgaagagtggatcctcttctttgctatgaacttcactactgtaatcgaccgtgcgcgtggtactgagacataactactgtagttaaacgttgcccgctggtgacatagtttcgcgccacctaagtaatcgcgtcgccgttttttttgttcgtttttttacgttttcagacagtatgtatattatgttttttcccttcatttttagctcgttaccgacatgttgataaatcgggtatggtggtctgtttgtgggggcaaggtagggttggcatgtgaccttcattcagtgcatggcgatgaaatgcttccttcctggggtctggtttcagatccgtagctgtggtttggctcaaatatatttgcctgccatgcttttgtgtgtcggtgacagatgcagtcaaagtgcttcatgggcctcatggtagaaatnctttcgtgctgtagnactgtanaatgtttnctagtt

SEQ ID NO: 892 - DNA, 3066 bp, Brachypodium distachyon
aaatccatcccgggagggaggaggggaaggggatccgtccgtgagtgactgagggcgccgccatggctgaggctgagaaggatgccggcaacctggaggccgtcctcaaggagtccgtcgacttggagaacatacccctggaggaggtgtttgagaacctgagatgcagccgccagggtctcagcgctcagcaggcgcagcagcgcctcgaaatcttcggtcccaacaagctcgaggaggaggaggagagcaagttcctcaaatttttgggcttcatgtggaatccactctcatgggtcatggaggctgccgctatcatggccattgcgctcgccaacggaggggggaagccaccggattggcaggattttgttggcatcataactctgcttgttatcaactccacaatcagtttcattgaggaaaacaatgccggcaatgctgctgctgcactcatggctcgtcttgcaccgaaagccaagattcttcgtgatggccgatggactgaggaagatgccgcgatccttgtaccaggggacgtcgtcagtattaaactcggagacattatacctgctgatgcacgcctcctcgagggagatcctttgaagattgatcagtctgccctgactggagaatcattgccggccaccaaaggtccgggtgatggtgtgtattcaggatcgacggtcaagcaaggtgagattgaagctgttgtgatcgcaactggtgtacatactttcttcgggaaggctgcacaccttgttgactccactaaccaagtgggccattttcagcaggtcttgacggctattgggaatttctgcatttgttcgattgctgtggggatgtttattgagatcattgtaatgtatcctatccagcacagggcataccgtcctggaatcgacaacctcttggtccttctcattggaggcattcctatagccatgccaacagtcttatctgtgaccatggctattgggtcacatcggttgtctcaacagggagcaatcacaaagagaatgactgctatcgaggagatggctggcatggatgttctttgcagtgataaaactggaactttgaccctgaataagcttaccgtggacaagaacctcgttgaggtttttgaaagaggaatcactcaggaccaagtgattctcatggctgctagagcatctcgaacagaaaaccaagatgccattgatactgcaattgttgggatgctagctgatccaaaagaggcacgtgctggcattcaagaagttcattttctaccattcaatcctacggacaaaagaacggcattgacatacactgatggtgatggcaaaatgcaccgtgttagtaagggcgcacctgagcagattcttcaccttgctcacaacacttcagagatagagcggagggtccattctgtgattgataaatttgcagagcgtggacttcgatcactcgctgtagcttatcaggaagtaccagatggaaagaaagaaagtcctggtggcccatggcactttgctggtcttatgccactttttgatcctccaagacatgacagtgccgaaacaattcggagggcacttaaccttggtgttaatgtcaagatgatcacaggtgatcagcttgcaattggaaaggaaacaggacgtcgcctgggaatgggtacaaacatgtatccttcatctgctttgttggggcaaaacacggatgagtctattgctgctttaccagttgatgatctcattgagaaagctgacggttttgctggtgtcttccctgaacataagtatgagattgtgaaacgtctgcaagcacggaagcatatctgtggaatgactggtgatggagtaaatgacgcgccagccctaaagaaagcagatattggtattgctgttgctgatgcaactgatgcggccaggagtgcttcagatattgtcctcacagaacctggccttagtgtgatcatcagtgctgtgcttacaagtcgtgcaattttccagcgtatgaagaactacactatctatgctgtctctatcacgattcgtattgtgcttggatttatgctactcgccctcatctggaaatttgatttcccaccgttcatggtcctaatcatagcaattctaaatgatggtaccatcatgacaatatcaaaggatcgggtaaaaccatctccactacccgatagctggaagctggctgagatcttcacaactggagttgtccttggtggatacttagcaataatgactgtcatcttcttctgggttgcatataagacgaactttttcccgaggttatttcatgtcgagagcctcgagaagacagctcaagatgatttccaaaagcttgcctctgctatttatctccaagtcagcaccatcagccaagctctcatctttgtcaccaggtcccgcagctggtcatttgttgagcggcctgggtttctactggtctttgctttcttcgttgcacagctgattgctacactgattgcggtgtatgctgactgggcattcacttcgatcaaaggcatcgggtggggctgggctggcatcgtgtggctttataacatcatcacatacttcccgcttgatatcatcaagttcctcatccgatacactctgagtggaaaagcatgggatcttgtcatcgatcaaaggatcgcgttcacaaggaagaaggacttcggtaaggaggagagggagctgaagtgggcacatgctcagaggaccctccatgggctgcagccaccagatgccaagatgttctcagagaaggctggctacaatgagctaaatcacatggctgaagaggccaagaggagggcagagattgcaaggctaagggagcttcacacgctgaagggccacgtggagtcggttgtgaagctcaaggggctcgacatcgagaccatccagcagtcttacactgtgtgatgatgaattgacctgtgttgtcccagaaaattggaacacaggaagaataccagatttgtcaccggcaattgtgaatttgatgttgtccatgtagtgcttataaaaacagaacattttccccctt

SEQ ID NO: 893 - DNA, 3459 bp, Sorghum bicolor
cttcttcctcgctcgctcgctcgcccgcccgcatccatcccatccccaccacctcatcccatctccatccgtctgtgcacggggtgaaaacacaacccacattcaccaccgagcaagctctccctcccctgctctcctccggcctccgccttgttcttcttgttgtttgcatataaatctggaactgcaagggggaaccaccaccaccaccacaccagcagcaggacagcgggagggagagggagatccgtgaggagcgaggtgccgcccccatggctgagaaggagggcaacctcgaggccgtcctcaaggaggccgtcgacctggagaacatccccctcgaggaggtgtttgagaatctgagatgcagccgcgagggtctctccactcagcaggcgcagcagcgcctcgaaatctttggcccgaacaagctcgaggagaaggaggagagcaaattcctcaagtttttgggctttatgtggaatccactctcctgggtcatggaggctgcagcaatcatggccattgcccttgccaatggaggggggaagccaccagattggcaggactttgttggtatcataactctgcttgtcatcaactcaacaatcagttttatcgaggaaaacaatgctggtaatgctgctgcagccctcatggctcgtctcgctcctaaagccaaggtgcttcgtgacggtcgatggaccgaggaagatgcagccattcttgtaccaggagacattgtcagtattaaactcggagacatcatacctgcagatgcacgcctccttgagggggatcctttgaagatcgaccagtctgccctgactggagagtcactgccggttaccaaaggtcccggtgatggtgtctattctggttcgacagtcaagcaaggtgaaatcgaagctgttgtgattgccactggtgttcatactttcttcggaaaggctgctcaccttgttgactccacaaaccaagttggccatttccagaaggtcttgacggctattgggaacttctgcatttgctcaattgctgttgggatgtttgttgagatcattgtcatgtatcctatccagcacagggcataccgccctgggattgacaacctcctcgtccttctcattggaggcatccccatagccatgccgacagtcctatctgtaactatggctattgggtcccatcgtttgtctcaacagggtgctatcacaaagagaatgactgcaatcgaggagatggctggcatggatgttctttgcagtgataaaacaggaactctgaccctgaacaagcttactgtggacaagaacctcgttgacgtttttgaaaggggcattactcaggaccaagtgattctcatggctgctagagcatcccgtacagaaaaccaagatgccattgatactgctattgttgggatgctagctgatcctaaagaggcacgcgctggcatccaagaagttcacttcctgccattcaatcctactgacaaaaggacagcattgacatatattgacggtgatgggaaaatgtatcgtgttagtaagggtgcacctgaacagattctccatttggctcacaacaagtcagagatagagaggagggtccatgctgtgattgataaatttgcagagcgtggacttagatcgcttgctgtagcatatcaggaagtacctgaggggaggaaagaaagtcctggtggtccatggcacttcgttggtctcatgccactttttgatcctccaagacatgacagtgctgaaacaattcggagggcactcaaccttggtgttaatgtcaagatgatcactggtgatcagttggcaatcggaaaagaaacaggacgccgtctaggaatgggtacaaatatgtatccttcttctgctttgttagggcagaacaaggatgagtctattgctgctttacctgttgacgatctcatcgagaaagctgatggttttgctggtgtattccctgaacataagtatgagatcgtgaaacgtctgcaagcacggaagcatatctgtggaatgactggtgatggagtaaatgatgctccagccctgaagaaagctgatatcggtattgctgttgctgatgcaactgatgcagccaggagtgcttcagatattgtcctcacagaaccaggacttagtgtgatcattagtgctgtgcttactagtcgcgctattttccagcgtatgaagaattacacgatctatgctgtctcgatcaccattcgtattgtgcttggatttatgctccttgccctgatttggaaatttgatttccccccattcatggtcctaatcattgcaattctaaatgatggtaccataatgactatatcaaaggatcgtgtaaaaccatccccactacccgacagctggaagctggctgaaattttcacaactggagttgtccttggtggatatcaggcaatgatgactgtcatcttcttttgggctgcatacaagacaaactttttcccaaaaatatttcatgtcgaaagccttgagaagacagctcaagatgatttccaaaagcttgcctctgctgtttacctgcaagtcagcaccatcagccaagcccttatctttgtgacaaggtcccggagctggtcatttgtcgagcgtccagggtttctgttggtctttgctttcttggtcgcgcagctgattgctacactgattgctgtgtacgccgactgggcattcacttcgatcaaaggcattgggtggggctgggctggtattgtgtggctttacaacatcatcttctacttcccgctcgatatcatcaagttcctcatcagatatgctcttagcgggaaagcatgggatcttgtcattgagcaaaggattgcgttcacaaggaagaaggactttggtagggaggagagggagcttaagtgggcacatgcacagaggaccctccatgggctacaggcacctgatgccaagatgttcccggagaaggctgggtacaatgagctgaaccagatggctgaagaggcgaagaggagggctgagattgcaaggctgcgggagcttcacacactcaagggacatgtggagtctgttgtgaagctgaaggggcttgacatcgagaccatccagcagtcctacacagtgtaaactttgcctgtccagaagaagttttttctttttctttttcttttttgcccaccgacgtgtgaatttgatggtggctggcttctctttgttttgtttatttaaccgaactgcaagcaccgacaagtacctgaaatgagacagatccctctctgtaatccccgatttctgtcttctcctcacatggtatgacaatcaatttatgaactttgctcggctatataaataagtgcttgaaggggagagcacagagtttttttggccactcatgggaatgggtgcatgcttgttttcagaaagagagattttgtgtttcttc

SEQ ID NO: 894 - DNA, 3856 bp, Oryza sativa
atgtttctctgttcctccacattcctctctacctcctcattcatttgtggagtggagtcccactcctaccactcctctccctgtgactctccacaaccatctcatctccttcaccttcaccttcagttacccccatccaattccatccagattgcaattgcacagggagccgaacaggtgggatacaggtagagagaggtgagaaggcagtggtgggagatccatctgcgaggtgcctccatggctgagaaggagggcaacctcgacgccgtcctcaaggaggccgtcgacttggagaatattcccctcgaggaagtgtttgagaacctgagatgcagccgcgagggtctcacaactcagcaggcgcagcagcgcctcgaaatctttggccccaacaagcttgaggagaaggaggagagcaagttcctcaagtttttggggttcatgtggaatccactctcatgggtcatggaagctgcagctatcatggccattgcgctggcgaatggaggggggaagccaccggattggcaggactttgttggtatcataactcttcttgttatcaactcgacaatcagtttcattgaggaaaacaatgctggcaatgctgctgctgcactcatggcccgtcttgcaccaaaggccaaggtgcttcgtgatggccgatggactgaggaagaggcggccatccttgtaccaggggatatcgtaagtattaaacttggagacattatacctgcagatgcgcgtctccttgagggagatcctttgaagatcgatcagtctgccctgactggagaatcattgcctgtcaccaaaggtcctggtgatggtgtctattctggttcgactgtcaagcaaggtgagatcgaagccatagtgattgctactggtgttcacactttcttcggaaaagcagcacaccttgttgactcaactaaccaagttggtcatttccagaaggtcctgacggctattgggaatttctgcatttgctcaattgctgtgggaatgtttgttgagatcattgtaatgtaccctatccagcacagggcataccgccccgggattgacaacctccttgtccttctcattggaggcattcccatagccatgccaacagtcttatctgtgactatggcaattgggtcacaccgcttgtctcaacagggagcgatcacaaagagaatgactgcaattgaggagatggcgggcatggatgttctttgcagtgataaaactggaactttgaccttgaataagctcaccgtggacaagaacctcattgatgtctttgaaagaggaatcactcaggaccaagtgattctcatggctgctagagcatcacgaacagaaaaccaggatgctattgatactgcaatagttgggatgctagctgatccaaaagaggcccgtgctggtattcaagaagttcatttcctgccattcaatcctactgacaaaagaacagcattgacatacattgatggtgatggcaaaatgtatcgtgttagtaagggtgcacctgagcagattctccaccttgctcataacaaaccggagatagagcggagggtccatgctgtgattgacaaatttgcagaacgtggacttagatcgcttgctgtagcataccaggaagtaccagaggggacgaaagaaagccctggtggcccatggcattttgttggtctcatgccactttttgatcctccaaggcacgacagtgctgaaacaattcggcgggcacttaatcttggtgtcaatgtcaagatgatcacaggtgatcagctggcaattggaaaagaaacagggcgtcgcctgggaatgggtacaaacatgtacccttcatccgctttgctgggacagaacaaggatgagtccattgccgctttaccagttgatgatctcattgagaaagctgatggctttgctggtgtattcccagagcacaagtatgagattgtgaaacgtctgcaagcaagaaagcacatatgtggaatgactggtgatggtgtcaatgatgctccagccctaaagaaagctgacattggtattgctgttgctgatgcaactgatgcagccaggagtgcttcagatattgtgctcacagaacctggtcttagtgtgatcatcagtgctgtgcttacaagtcgtgcaattttccagcgtatgaagaactacactatctatgctgtctcaatcaccattcgtatagtgcttggatttatgctacttgcgctcatctggaaattcgatttccccccttttatggtcctaatcatagcaattctaaatgatggtaccatcatgactatatcaaaggatcgggtaaaaccatctccactacctgacagctggaagctggctgagatttttacaactggagttgtcctcggtggatacttggcaatgatgacagtaatcttcttctgggctgcatataagacagactttttcccgagaatatttcatgttgaaagccttgagaagacagctcaagatgatttccaaaaacttgcctctgctgtttacctccaagttagcaccatcagccaagctctcatctttgtcacaaggtcccgcagctggtcatttgttgagcgccctggatttctgctggtctttgctttcttggttgcacagctgattgctacactgattgctgtgtatgctgactgggcgttcacctcaatcaaaggcattgggtggggttgggctggtattgtgtggctctacaatctaatcttctacttcccactcgacattatcaagttcctcatcagatatgctttgagtgggaaagcatgggatcttgtcattgagcaaaggatcgctttcacaaggaagaaggactttggtaaggaggagagggagctcaagtgggcacatgctcagaggaccctccatggactgcagccgcctgatgccaagatgttctcggagaaggctggctacaatgagctcaatcagatggctgaagaggcgaagaggagggcggagattgccaggcttagggagctccatacgctcaaggggcatgtagaatcggttgtgaagctcaaaggcctcgacattgagaccatccagcagtcttacaccgtgtgatccagcctgtccataaagaaagaaaaaagaggattattttttttccagattttcctgtttcgctttaacttgactgcaattctgcaatcacctacgtgtacttgaaccgaattgctgtaatctttgtccctcctgctccagctttctactacatggtagtgttatataatttttggtcacctgaaaatatataagtgtttgaggtgaagcacaatggcaatgccagagtttttttgctcggttactgagaagcatgttttcataatcaatcggtcaattgtatggacatattatagatgaatttggtaactgtttgtgtgggggcagctggcagtatgtaacatgtgggcttcaatgtatccaaccaagaggcaatgaatgaatgaatgaatagcggtgactctggtcctggactggaaacggatctgtttgttgttgggttccagccagatctgtagtgaggctctggctggctgatattgttgtctgccatgttgcctgtcaagtttgcaaaaactgtgggcacatcacatgagatgagttgagagcttttattttctaagctgcttgctgcgttgcatgcaggatctcgaatgatgcacgcttgcttgagctgtgcctgtaccaaatgtatgtagtactagattgtgtatgtactatgtattctccagctgccgtactgtgcacggataattggtttgtctcgtctggtctggtaaatagagaagtccaagtgttcaattca

SEQ ID NO: 895 - DNA, 3495 bp, Zea mays
cttccttctttatccgcttggttcgcttttcttcttttcctttggcattccatcgcatctcaatcctgttaccgttgtggactcccactcccctgtctgtctgtcgcggtgtcgcctgacaccttcttcttcctcactcccccctcaacctcatccccatcccgccctcgcacttcccacccaccccaatccatccatccatccacccgtctgaaaaccaaacccacattcaccagcgagcaagcttcccctgccctcctccggccgcctcattctcgtttccatataaatctgtaactgcaaggacaacccaccacaggacacacgaggtgaaaggagatccgtgaggaggcgcctcccccatggctgagaaggagggcaacctcgaggccgtcctcaaggaggccgtcgacctggagaacatccccctcgaggaagtgttcgagaatctgagatgcagccgcgagggtctctccaccgagcaggcgcagcagcgcctcgaaatctttggcccaaacaagctcgaggagaaggaggagagcaaattcctcaagtttctgggtttcatgtggaacccactgtcctgggtcatggaggctgcagcaatcatggccattgctcttgccaatggaggggggaagccaccagattggcaggactttgtcggtatcataactctgcttgtcatcaactcaacaatcagttttatcgaggaaaacaatgctggtaatgctgcagcagccctcatggctcgcctcgcacctaaagccaaggttcttcgtgatggccgatggaccgaggaagacgcagccattcttgtaccaggagacattgttagtattaaactcggagatattatacctgcagatgcacgcctccttgagggggatcctttgaagatcgatcagtctgctctgaccggagagtcactgccggtcactaaaggtcccggtgatggtgtctattctggttcgacggtcaagcaaggtgaaatcgaagctgttgtgattgccacaggtgtccacactttcttcggaaaggctgctcaccttgttgactccacaaaccaagttggccatttccagaaggtcctgacggctatcgggaacttctgtatttgctcaattgctgtggggatgtttgttgagatcattgtcatgtatcctatccagcacagggcttaccgccctgggatcgacaacctcctcgtccttctcattggaggcatccccatagccatgccgaccgtcttatctgtaactatggctattgggtcccatcgtttgtctcaacagggggctatcacaaaaagaatgactgcaatcgaggagatggctggcatggatgttctttgcagcgataaaacaggaaccttgaccctgaataagcttactgtggataggaaccttgttgaggtttttgaaaggggcactactcaggaccaagtgattctcatggctgccagagcgtctcgcacagaaaaccaagatgctattgatactgctatagttgggatgctagctgatcctaaagaggcacgcgctggaatccaagaagttcacttcctgccattcaatcctactgacaaaagaacagcactgacatacattgatggtgatgggaaaatgtatcgtgttagtaagggtgcacctgagcagattctccacttggctcacaataagtcagatatagagaggagagtacatgctatgattgataaatttgcagagcgtggacttagatcacttgctgtagcatatcaggaagtgcctgaggggaggaaagaaagtcctggtggtccatggcacttcgttggtctcatgccactttttgaccctccaagacatgacagtgctgaaacaattagaagggcactcaaccttggtgttaatgttaagatgatcacaggggatcagttggcaatcggaaaggaaacaggacgtcgtctaggaatgggtacaaatatgtacccctcttctgctttattaggacagaacaaggatgagtctattgctgctttaccagttgatgatctcattgagaaagccgatggttttgctggtgtattccctgaacataagtatgagatcgtgaaacgtctacaagcacggaagcatatctgtggaatgactggggatggagtaaatgatgctccagccctgaagaaagcggatatcggtattgctgttgccgatgcaactgatgcagccaggagtgcttcagatattgtcctcacagaacctggacttagtgtgatcattagtgctgtgcttactagtcgtgcaattttccagcgtatgaagaattacacgatctatgctgtctctatcaccattcgtattgtgcttggatttatgctccttgccctcatttggaaatttgatttccccccattcatggtcctaatcattgcaattctaaatgatggtaccataatgactatatccaaggatcgtgtaaagccatccccattacctgacagctggaagttggctgaaattttcacaactggagttgtccttggtggatatcaggcaatgatgactgtcatcttcttttgggctgcatacaagacaaactttttcccaaaaatatttcatgtggaaagccttgagaagacagctcaagatgatttccaaaagcttgcatctgctgtttacctgcaagttagcaccatcagccaggccctcatcttcgtgacaaggtcccggagctggtcatttgtcgagcgcccagggtttctattggtctttgctttcttggttgcgcagctgattgccacactgattgctgtgtacgccgactgggcgttcacttcgatcaaaggcattgggtggggctgggctggcattgtgtggctgtacaacatcatcttctacttccctctcgatatcatcaagttcctcatcagatatgctcttagtgggaaagcgtgggatcttgtcattgagcagaggattgcgttcacaaggaaaaaggactttggtagggaggagagggagctgaagtgggcacatgcacagaggaccctccatgggctacaggcacctgatgccaagatgttcccagagaaggctgggtacaatgagctgaaccagatggctgaagaggcgaagaggagggccgagattgcaaggctgcgggagcttcacacactcaaggggcatgtggagtctgttgtgaagctgaagggactcgacatcgagaccatccagcagtcctacacagtgtaactttgcctgcccttcccagaggaagtttcttgttctttttacccaccggcgtgtgaatttgatggtggctggcttctctttgttttatttatttatttaaccgagctgcaagcaccgacaagtagctgaaatgagacagacagacccctcgctgtaatccctgatttcttctgtcctctcctcacatggtatgccaaccagtttatgaactttgctcggctatataaataagtgcttgaagaggggagcagggttttgggcc

SEQ ID NO: 896 - DNA, 3137 bp, Brachypodium distachyon
acgtggaaaatcattccctcctacatccccaccacctctctatccactttcaggatccgatgattcatcagttgctcactgtctcgtctctctcccaaaaagaccacatatttcgcagagaagaattttgcttctataaatccgaatgagagcagaggaggatcgagagagaagggagtagctgggggagtgcagtgtcgccatggccgacaaggagggaaacctcgacgccgtcctcaaggaggtcgtcgacctggagaacatcccagttgatgaagtgttcgagaatctgcgatgcggacgtgaggggctcacttcccagcaggctcaacaacgcctgcaaatctttggtccgaacaagctcgaggagaaggaggagagcaagttcctgaagtttttggggttcatgtggaatccactgtcatgggtcatggaggctgctgctatcatggccattgcattggcaaacggtggggggaagccaccagattggcaagactttgttggtatcatcacacttctacttatcaactcaactatcagtttcatcgaggaaaacaatgctggcaatgctgctgctgcactgatggcccgtcttgcaccaaaagcaaaggttctccgtgatggccgttggaccgaggaggaggcagcagtccttgtccctggggacatcatcagtatcaaacttggagatatcattcctgcagatgcccgcctcctagacggagatcctttgaagattgatcagtctgccctgactggagaatcattgccagccaccaaaggtcctggtgatggtgtctactctggttcaacagtcaagcagggcgagatcaaggctgtagtcatagcaactggtgtgcacactttctttggaaaggctgcacatcttgttgactctaccaatcaagttggtcatttccaacaggtcttgacagccatcgggaacttttgtatttgctcaattgctgtgggaatgttcgttgagatcattgtcatgtaccctatccaacacagggcataccgcccggggatcgacaaccttttggtgcttctcattggaggcattcccatagcaatgcctacagtcttatctgtaaccatggcaattggatctcatcgcctgtctcaacagggagctataacaaagagaatgactgcaattgaagagatggctggcatggatgtcctttgcagtgataaaaccggaacactgactttaaataagctcagtgtggacaagaacctaatcgaggtgtttgaaagaggagtgactcaggaccaagtaattctgatggctgctagagcatcccggatagaaaatcaagatgctattgatacagcaatagttgggatgctagctgatccaaaagaggcgcgtgctggtattcaagaggttcatttcctaccattcaatcctaccgacaaaagaactgcattgacatacatagatggtgatggaaatatgtaccgtgttagtaagggtgcacctgagcagattctcaatctggcccacaacaagtcagagattgaacaaaaggtccatgctgttattgacaagtttgcagaacgtggactccgatcacttggtgtagcatatcaggatgtgccagatgggaggaaagagagtccaggtaggccatggcattttgtagctctcttaccactctttgatccaccaaggcatgatagcgcagaaacaattcaaagggcgcttaaccttggtgtgaatgtgaagatgatcacaggtgatcagctagccattgggaaggaaacggggcgtcgtctaggaatgggtacaaatatgtacccttcatctgctttgctggggcagaacaaggatgagtccattgcggatttaccagttgatgatctaattgagaaagctgatggttttgctggtgtatttccagagcacaaatatgaaattgtgaaacgcctgcaagcacggaagcacatttgtggaatgaccggtgatggtgtaaatgatgcaccagccctaaagaaagctgatattgggatagcagttgctgatgcgacagatgcggcaaggagtgcttctgatattgtactcacagaacctggcctcagtgtgatcattagtgctgtccttaccagtcgggcaattttccagcggatgaaaaactacactatctatgcggtctcaattacaatacgtattgtgcttgggtttatgctgcttgccctcatatgggagtttgatttcccgccatttatggtcttgatcatagcaattctgaatgatggtaccataatgactatatcgaaggatcgagtaaagccatctccactacctgacagctggaagttggctgaaattttcacaactggagtggtgcttgggggatacttggcaatgatgactgtcattttcttctgggctgcatataagactaactttttccctaggatctttcatgtcaaaagccttgagaagacagctcaagatgacttccaaatgcttgcctctgccgtgtatcttcaagtcagcaccatcagtcaagcacttatctttgtcacaaggtctcgaagctggtcatttgtcgagcgccctggctttctactggtctttgctttcttcgttgcacagctgatagctacattaatcgctgtatacgctgattggggattcacttcaatcaaaggaattgggtggggctgggctggtaccgtgtggctctacaaccttgttttttatttcccacttgatatcatcaagttcctcatccgatatgctctgagtgggaaagcatgggatcttgtcattgaccaaagagtcgcatttacaaggaagaagcactttggtaaggaagagagagaactcaagtgggcacatgcacagaggacgctccatgggctgcagccaccagatgccaagctgtttcctgagaaggcgggctacagcgagatgaatcagatggctgaagaggcaaaacggagggccgagattgcaaggctcagggagctccacactctgaaggggcatgtagagtcagttgtgaagctgaagggcctggacatcgacaccattcaacaatcttacactgtgtgacagttttagatatccttaaaagagagtacatatccttgctgcattgaataaaagtgacttttga

SEQ ID NO: 897 - DNA, 3328 bp, Oryza sativa
atttccatttcttgccgttttcttccacattcttctctgctgctggtgtctcttgtgggccgcgtggaaagccactctctcctcctctttgacctcgctatctatccatctactgcagtttgctcactggaaatgtttttcgcgtataaatagctgggaggagaggcaaggggaccggaaagagtgcgagaaagaaagaaaggcgagttctttttggcaagggagggagggggggcactcgttgagggtgggtttcagaggtgtgggaggtcgcctccatggcggaggacaagggaggcctcgatgccgtcctcaaggagtcggtcgacttggagaacatcccgatcgaagaagtattccagaatttgaaatgctgccgacaggggctcacttccgaagaggcgcagctgcgcctgcaactttttggtccgaacaagctcgaggagaaggaggagagcaaattcctcaagttcttggggttcatgtggaatccgctgtcatgggtcatggaggctgcagctatcatggccattgcattagccaatggtggggggaagccaccagattggcaggactttgttggtatcatcacactgctacttatcaactcaactatcagtttcattgaggaaaacaatgctggcaatgctgctgctgcgctcatggcgcgtcttgcgccaaaagccaaggtgctccgaaatggtagttggactgaggaagaggcagccatccttgtgcctggggacatcatcagtattaagctgggagatatcattcccgcagatgctcgcctcctggaaggagatcctttgaagattgatcagtctgcgctgactggagagtcattgccagccaccaaaggtcctggtgacggtgtttactctggttcaacggttaagcagggtgagattgaggctgttgtgattgcaactggtgtgcacactttctttggaaaggctgcacatcttgttgattccaccaatcaagttggccatttccaaaaggttttaacagctatcgggaatttttgcatttgctcaattgctgtggggatgtttgttgagatcattgtcatgtaccctatccagcacaggccataccgccctgggattgacaacctattggtgcttctcattggaggcattcctatagcaatgcccacagtcttatctgtaaccatggcaatagggtctcatcgcttgtctcagcagggagctataacaaagagaatgactgcaattgaagagatggctggcatggatgttctttgcagtgataaaacaggaactctgactttaaataagctcacagtggacaagaatctcattgagatttttgaaagaggagtcactcaggaccaagtaattctgatggctgctagagcatcccgaacagaaaatcaagatgctattgatactgcaatagtcgggatgctcgctgatccaaaagaggcacgtgctggtattcaagaggttcacttcctgccattcaatccgactgacaagagaactgcattgacatacattgatagtgatggaaagatgtaccgtgttagtaaaggcgcaccagagcagattctcaacctggcacacaacaagacacagatagaacgacgagtccatgctgtaattgataagtttgcagaacgtggacttcgatcacttgctgtagcatatcaggaagttccagatggaaggaaagagagtcctggtgggccatggcgctttgttgctctccttccactctttgatcctccaaggcatgatagtgcagaaacaattcgaagggcacttaaccttggtgtaaatgttaagatgatcacaggtgaccaactagcgattgggaaagaaacagggcgtcgtctaggaatgggtacaaacatgtacccttcatctgctttgttgggacagaacaaggatgagtctgttgctgctttaccagttgacgatctaatcgagaaagctgatggttttgctggtgtattcccagagcacaagtatgagattgtaaaacgtctgcaagcacggaagcacatctgtggaatgactggtgatggtgtaaacgatgctccagccctaaagaaagctgatattggtatagcagttgctgatgcgactgatgcagcaaggagtgcatctgatattgtactcacagaacctggcttgagtgtgatcattagtgctgttcttaccagtcgggcgattttccagcgaatgaagaactacactatatatgctgtctcgattacaatacgtattgtgtttgggtttatgctgcttgcccttatatgggagtttgatttcccgccatttatggttctgatcattgcaattctgaatgatggtaccataatgactatatctaaggatctagtaaagccttctccactacctgacagctggaagttggctgaaattttcacaactggagttgtgctgggtggatacttggcaatgatgactgttatattcttctgggctgcatacaagaccaactttttccctaggatctttcacgtcgaaagccttgagaagacagctcaagatgactaccaaaagcttgcatctgctgtatatcttcaagttagcaccatcagccaagctcttatctttgtcacaaggtctcgcagctggtcatttatcgaacgccctggctttctacttgtctttgctttcttcgttgcacagctgatagctacattgatagctgtttatgctaactgggcattcacttcaatcaaaggcattggatggggctgggccggtatcgtgtggctctacaatctcgttttctacttcccgctcgatatcatcaagttcctcatccgatatgctctgagtgggaaagcatgggatcttgtcattgagcagagaattgcgtttacaaggaagaaggattttggcaaggaagagagggaactcaagtgggcacatgcacataggacactccatggcctgcagccaccggatgcgaagcccttcccagagaagaccggctacagtgagctgaatcagatggcggaagaggcgaaacggagggccgagattgcaaggctcagggagcttcatacgctgaaggggcatgtggagtcagttgtgaagctgaagggcctggacattgataccattcaccagtcctacacagtgtgatagactcttatctaacaagagtaatatggttgctgcagaggaactgtttcgtttcatctaattagtagtttttatctcctctcagctaacataaatgtaatcaaccaacagttcatacaatctataaatcaaatcatcaaaggggattgttgagattatccgtttttgtcggtgttttc

SEQ ID NO: 898 - DNA, 4729 bp, Zea mays
atggccgacaatgaggggaccctggacgccgtcctcaaggaggccgtcgacttggagaacatcccacttgaggaagtttttgagaatctgagatgcagtcgtggggggctcacttccgagcaggcgcagcaacgcctgcaattatttggccccaacaagctcgaagagaaggaggagagcaaatttctcaagtttctgggattcatgtggaacccactgtcatgggtcatggaggctgcagctatcatggccatcgcactggccaatggtgggggaaagccaccagactggcaggatttcgttggtatcatcacactgctgcttatcaactcaactatcagtttcatagaggaaaataatgctgggaatgctgctgctgcgcttatggcccgccttgcgccgaaagccaaggtgcttcgtgatggccgttgggccgaggaagaggcagccgtccttgtgcctggggatgtaatcagcattaaacttggagatatcatccctgcagatgctcggctccttgatggagatcccttgaagatcgatcagtcttcgctaactggagaatcgttgccagtcaccaaaggtcctggtgatggtgcctactctggttcgactgtcaagcagggtgaaattgaggctgttgtgatagcaactggtgtccacactttctttgggaaggctgcgcatcttgttgactccacgaatcaagtattgacagccattgggaacttttgtatttgttcaattgctgtggggatgtttgttgagataattgtcatgtaccctatccagcatagggcgtatcgtcctgggattgacaatcttttggtgctacttattggaggcattcccatagcaatgcctacagttttgtctgtgaccatggcaattgggtcccatcgcttggctcaacagggagctataacaaaaagaatgactgcaattgaagagatggctggtatggatgtactttgtagtgacaaaactggaactctgactctgaataaactcacagtggacaagaacctcattgaggtttttgaaagggaagtgactcaagaccaagtaattctgatggctgctagagcctcccgaatagaaaatcaagatgctattgatactgctatagttggcatgctagctgatccaaaagaggcccgtgctggtattcaagaggttcatttccttccatttaatcctaccgacaaaagaactgccttgacatacattgatagtgatgggaagatgtaccgtgttagtaaaggtgcgccagagcagattctcaacctcgtctacaataagttggagatagaacgaagagttcatgctgtaattgacaagtttgctgagcgtggacttagatcacttgctgtagcgtatcaggtagtgccagatggaaggaaagagagtcccggtgggccatggcattttgttgctcttatgccactctttgatcctccaaggcatgacagtgcagaaacaatacgaagggcattgaaccttggtgttagtgtaaaaatgatcacaggtgatcagctagcaattgggaaggaaacaggacgtcgcttaggcatgggtactaacatgtacccttcctctgctttgctgggacagaataaggatgagtctattgctgctttacctgttgacgatttaattgagaaagcggatggttttgctggcgtattccctgagcacaaatatgagattgtaaaacgtttgcaagcacgaaaacacatttgtgggatgactggtgatggagtaaatgatgcccctgccctaaagaaagctgatattggtatagcagttgctgatgccactgatgcagccaggagtgcttctgacattgtcctgacagaacctggcttgagtgtgataattagtgccgttcttaccagccgggcgattttccagaggatgaagaactacactatctatgctgtttccattacaatacgtattgtgctaggatttatgctacttgccctcatatgggagttcgatttcccaccatttatggtacttattattgcaattctaaatgacggtaccataatgaccatatcgaaggatcgagtgaagccttcgcctctaccggacagctggaagctggccgagattttcacaactggaattgtgcttggtggatacctggcagtgatgactgtcatcttcttctgggctgcatataagacaaactttttccctaggatcttccacgttgaaagccttgagaagacagctcaagatgattaccagaaactcgcctctgccgtatatctccaagttagcaccatcagccaagctctcatcttcgtgacgaggtctcgcagctggtcattcgctgagcgcccgggctttctactagtgtttgccttcctggtcgcgcagctgatagctacactggtagctgtatacgcggactgggggttcacttcgatcgaaggcattggatggggctgggctggtgtggtgtggctctacaacctcgtcttctacttcccgctcgacctcctcaagttcctcatccgatatgctctgagtggcaaagcgtgggatcttgtcattgagcaaaggattgcatttacaaggaagaaggacttcgggaaggaggagagggcgctcaagtgggcacacgcgcagaggacgctccacgggctgcagccaccggatgccaagctgtttcctgacagggtgaacgagctgaatcagatggccgaagaggccaaacggagggccgagattgcaaggctgagggagcttcacacgctgaaggggcatgtggagtcggttgtgaagctcaagggcctagacatcgacaccatccagcagtcgtacacagtctgatgaccctggattaagtacatacatgtatatctagttctggcaggtggcagtcgcctgcttgtttgtatttgccatataccataacacatcatgagaactggtagttggtgccgtcggttgtcttcgcgtgctccttgcgatgttattgtgttacgccggtttcaagcaacataggtcacggatcataaatcagatatccgacggatatcaaatccgtgtgtcatctccccgcgtcctggttgccccgcgtcgggcgactcggacgctccccataatccctagtagccgccgccgccccttcgtgggcctctccctgccgcgccgctgcctgagctggccgccggaaggttcggctgcttgcggggagggcggcggcggggcatctccgtctccctctggtggatctgggcgggcacagccgccaaggtcaccgtgagttgctcgtcggcgtggtcggccccggcttcgccccctcgcgactcgggtggctgccaactcccctccctccccatctctttgccttgccgccgccggagctagctggtgggttgctcgcacggctaggggtgaaggcgtcgggcgggtgcttgctgccttgtcgtgcgtccaacccacggtggcggcgtccgcccactcaggcaacgggcctgtggctgggtgcgcgcccgcgaggctagcccggtggcggcgcctgcgtgccgcgacggcaatcgctgctgctcgggggttggaggtgtgcctggactgtgtgctcgcgtacctgatgcgcggagggctggatctggcgcccccagggggagcggcgttggcgcgcggaaggctggatctggcgcgcgaggttggcggcctccgcatgccatccgtcggaggcggcggcaggctggtcccgggctagcgcatgagccggggtggaggtcggcgttggtgcgccggcaggcctgcgcagtcggccggaattgcagtggcgggacctcctctcgtctggggcagcatcggctagtcgatcgggctagcgcagggtggtggtggcggcaggcccaaaatcttcatcatttgtgtggtacgtcggggtaccggcgacggcggaggcagcttgctgtgtctcgaggtttcggccagacgttgtgctgggggctcttgggcgaaagtctcggcgacggtgacgcccatgggcgtcgcttcccctgttaagggcgtcacaccccagtgctatcttccttgggtgaaagctcggtccatcacggacaggtgacggtggcgtcacagtgacgtcactcccttcctgaaggcgtcgcttctgaagttcgtctcggccaggactttgccttcggctgttgcttcgcttctcggtgcctggtatgcgagtggaggtgggggttttgcaacgtgaagtcggagctgctacatcagtggatgtggctcggcaacgataacacgaggcgaacctcccttcttcgtggtccagaatgtttcgaaggtcgggcaaaaaccggaggcagggcagagggtcaagattggaagtcgaagctgctttgtgcctgagcccggcaacgatgacttgttgagacctttcgcttcgggttgtctatctgctttttgtttggttcgcctgttggctgctttggaaagtcggagttgttggatgctctgcatctttgcttgataacgatgacctttagcagttttgtgctctcgtgtggggttgccgctgcctgtgttgtttgggcactctatgtcgacggtgagtgtggtgtcgtgttgatgtcctaatccaaccgacgagttgagttgtatggtgttggcgtgttgatgtctcaatccaaccgcatgttgtttgttgtttagtccggtccggaccacttcttaattaatataatcggca

SEQ ID NO: 899 - DNA, 5372 bp, Zea mays
atgggccttggttgtccaatatctcagatctggactcgtcatcgccaagataacttaagcatggcaggcgtcatcgtgtcctcctcggcggcacgtacagagaagagccaggagcaagaccgactcacccgtacccgcgtcgacgagcgtcagtcggctcgcggctgcgaccgcgggcgggggcagcaagttggggaggaagaatacggcgaaggtcgggaagacgaacgagacgtccgacgatggcgaaatcgatggtgcgtgcatgatgtgaaacgtcctcgtggacgtgcaatagccactgtgcgagtcggtccggggctggtgtcggacgaatacgggaagggggcacatgctcctacgccctctgccgagaatggggtcgtacggagttggaggcataagggaagagagaaaataagtagaatggcgaccgagatggtggcaactgaggcgaggaccatcattattgtgcggagggggactgggggagctaccgagcacagtgcagaggtcagaccgtcagagggagttgctggtgcagtggtgcgggggagatcatcagatcagaggggtgtctccatggccgacaatgaggggaccctggacgccgtcctcaaggaggccgtcgacttggagaacatcccacttgaggaagtttttgagaatctgagatgcagtcgtggggggctcacttccgagcaggcgcagcaacgcctgcaattatttggccccaacaagctcgaagagaaggagttaaactggccatggctgcaggagagcaaatttctcaagtttctgggattcatgtggaacccactgtcatgggtcatggaggctgcagctatcatggccatcgcactggccaatggtgggggaaagccaccagactggcaggatttcgttggtatcatcacactgctgcttatcaactcaactatcagtttcatagaggaaaataatgctgggaatgctgctgctgcgcttatggcccgccttgcgccgaaagccaaggtgcttcgtgatggccgttgggccgaggaagaggcagccgtccttgtgcctggggatgtaatcagcattaaacttggagatatcatccctgcagatgctcggctccttgatggagatcccttgaagatcgatcagtcttcgctaactggagaatcgttgccagtcaccaaaggtcctggtgatggtgcctactctggttcgactgtcaagcagggtgaaattgaggctgttgtgatagcaactggtgtccacactttctttgggaaggctgcgcatcttgttgactccacgaatcaagtattgacagccattgggaacttttgtatttgttcaattgctgtggggatgtttgttgagataattgtcatgtaccctatccagcatagggcgtatcgtcctgggattgacaatcttttggtgctacttattggaggcattcccatagcaatgcctacagttttgtctgtgaccatggcaattgggtcccatcgcttggctcaacagggagctataacaaaaagaatgactgcaattgaagagatggctggtatggatgtactttgtagtgacaaaactggaactctgactctgaataaactcacagtggacaagaacctcattgaggtttttgaaagggaagtgactcaagaccaagtaattctgatggctgctagagcctcccgaatagaaaatcaagatgctattgatactgctatagttggcatgctagctgatccaaaagaggcccgtgctggtattcaagaggttcatttccttccatttaatcctaccgacaaaagaactgccttgacatacattgatagtgatgggaagatgtaccgtgttagtaaaggtgcgccagagcagattctcaacctcgtctacaataagttggagatagaacgaagagttcatgctgtaattgacaagtttgctgagcgtggacttagatcacttgctgtagcgtatcaggtagtgccagatggaaggaaagagagtcccggtgggccatggcattttgttgctcttatgccactctttgatcctccaaggcatgacagtgcagaaacaatacgaagggcattgaaccttggtgttagtgtaaaaatgatcacaggtgatcagctagcaattgggaaggaaacaggacgtcgcttaggcatgggtactaacatgtacccttcctctgctttgctgggacagaataaggatgagtctattgctgctttacctgttgacgatttaattgagaaagcggatggttttgctggcgtattccctgagcacaaatatgagattgtaaaacgtttgcaagcacgaaaacacatttgtgggatgactggtgatggagtaaatgatgcccctgccctaaagaaagctgatattggtatagcagttgctgatgccactgatgcagccaggagtgcttctgacattgtcctgacagaacctggcttgagtgtgataattagtgccgttcttaccagccgggcgattttccagaggatgaagaactacactatctatgctgtttccattacaatacgtattgtgctaggatttatgctacttgccctcatatgggagttcgatttcccaccatttatggtacttattattgcaattctaaatgacggtaccataatgaccatatcgaaggatcgagtgaagccttcgcctctaccggacagctggaagctggccgagattttcacaactggaattgtgcttggtggatacctggcagtgatgactgtcatcttcttctgggctgcatataagacaaactttttccctaggatcttccacgttgaaagccttgagaagacagctcaagatgattaccagaaactcgcctctgccgtatatctccaagttagcaccatcagccaagctctcatcttcgtgacgaggtctcgcagctggtcattcgctgagcgcccgggctttctactagtgtttgccttcctggtcgcgcagctgatagctacactggtagctgtatacgcggactgggggttcacttcgatcgaaggcattggatggggctgggctggtgtggtgtggctctacaacctcgtcttctacttcccgctcgacctcctcaagttcctcatccgatacgctctgagtggcaaagcgtgggatcttgtcattgagcaaaggattgcgtttacaaggaagaaggacttcgggaaggaggagagggcgctcaagtgggcacacgcgcagaggacgctccacgggctgcagccaccggatgccaagctgttccctgacagggtgaacgagctgaatcagatggccgaagaggccaaacggagggccgagattgcaaggctgagggagcttcacacgctgaaggggcatgtggagtcggttgtgaagctcaagggcctagacatcgacaccatccagcagtcgtacacagtctgatgaccctggattaagtacatacatgtatatctagttctggcaggtggcagtcgcctgcttgtttgtatttgccatataccataacacatcatgagaactggtagttggtgccgtcggttgtcttcgcgtgctccttgcgatgttattgtgttacgccggtttcaagcaacataggtcacggatcataaatcagatatccgacggatatcaaatccgtgtgtcatctccccgcgtcctggttgccccgcgtcgggcgactcggacgctccccataatccctagtagccgccgccgccccttcgtgggcctctccctgccgcgccgctgcctgagctggccgccggaaggttcggctgcttgcggggagggcggcggcggggcatctccgtctccctctggtggatctgggcgggcacagccgccaaggtcaccgtgagttgctcgtcggcgtggtcggccccggcttcgccccctcgcgactcgggtggctgccaactcccctccctccccatctctttgccttgccgccgccggagctagctggtgggttgctcgcacggctaggggtgaaggcgtcgggcgggtgcttgctgccttgtcgtgcgtccaacccacggtggcggcgtccgcccactcaggcaacgggcctgtggctgggtgcgcgcccgcgaggctagcccggtggcggcgcctgcgtgccgcgacggcaatcgctgctgctcgggggttggaggtgtgcctggactgtgtgctcgcgtacctgatgcgcggagggctggatctggcgcccccagggggagcggcgttggcgcgcggaaggctggatctggcgcgcgaggttggcggcctccgcatgccatccgtcggaggcggcggcaggctggtcccgggctagcgcatgagccggggtggaggtcggcgttggtgcgccggcaggcctgcgcagtcggccggaattgcagtggcgggacctcctctcgtctggggcagcatcggctagtcgatcgggctagcgcagggtggtggtggcggcaggcccaaaatcttcatcatttgtgtggtacgtcggggtaccggcgacggcggaggcagcttgctgtgtctcgaggtttcggccagacgttgtgctgggggctcttgggcgaaagtctcggcgacggtgacgcccatgggcgtcgcttcccctgttaagggcgtcacaccccagtgctatcttccttgggtgaaagctcggtccatcacggacaggtgacggtggcgtcacagtgacgtcactcccttcctgaaggcgtcgcttctgaagttcgtctcggccaggactttgccttcggctgttgcttcgcttctcggtgcctggtatgcgagtggaggtgggggttttgcaacgtgaagtcggagctgctacatcagtggatgtggctcggcaacgataacacgaggcgaacctcccttcttcgtggtccagaatgtttcgaaggtcgggcaaaaaccggaggcagggcagagggtcaagattggaagtcgaagctgctttgtgcctgagcccggcaacgatgacttgttgagacctttcgcttcgggttgtctatctgctttttgtttggttcgcctgttggctgctttggaaagtcggagttgttggatgctctgcatctttgcttgataacgatgacctttagcagttttgtgctctcgtgtggggttgccgctgcctgtgttgtttgggcactctatgtcgacggtgagtgtggtgtcgtgttgatgtcctaatccaaccgacgagttgagttgtatggtgttggcgtgttgatgtctcaatccaaccgcatgttgtttgttgtttagtccggtccggaccacttcttaattaatataatcggcagctctcatgtctggttcgtttcaaaaaaaaaaagtgtgtc

SEQ ID NO: 900 - DNA, 3395 bp, Solanum phureja
actactagttttggtgaccctttgtctgtttataaaatcctacctgttttctcgataaacgaaatgttctcctcttttcttcttctgcttcacctaattttgttgcttcactgagttatatttatggtgtttttgatctgagacactgttgtcaaaagggggaaaaacaagtttaaagaagatggcggagaagcctgaagttctggatgctgtcttgaaggagactgttgatttggaaaatataccgattgaggaggtttttgagaatctgagatgtaccagagagggacttactactactgctgctcaagaaaggttgtccatttttgggtacaataagctcgaggagaagaaggagagcaaattcttgaaatttttgggatttatgtggaaccctctctcatgggttatggaggctgctgctatcatggcaattgctcttgcaaatggaggaggaaagccaccggactggcaggattttgtgggtatcatcacattgctcataatcaactcaacaatcagttttatcgaggagaacaatgctggcaatgcagcagctgcactaatggctcgacttgctccaaaagccaaggttcttcgagatggaaaatgggacgaggaagatgctgctgttcttgtgcctggggacataatcagtattaaactgggagatatcattccagctgatgctcgtcttctagagggtgatccactcaaaattgatcagtctgctttgaccggtgaatctcttcctgtaacaaaaggtcctggagatggtgtttactctggctccacgtgtaagcagggagagatagaagctgttgtgattgctacaggggttcataccttttttgggaaggcagctcaccttgttgacagtacaaaccaagtgggacactttcagaaggttttgactgctatagggaacttctgcatctgttcaattgcagtagggatgataatagagattattgtgatgtaccctatccaacatcgcaaataccgtcctgggatagacaatcttctggtgcttctcattggtgggattccaattgctatgccaactgttctctcggtcacgatggcaatcggttctcatcgtcttgctcaacagggggccattacgaaaagaatgacagctatagaggagatggctggcatggatgttttgtgcagcgacaagacgggaaccctaacattgaacaagctgactgttgataaagcccttattgaggtatttgccaaaggaattgatgcagacactgtagttctaatggcagctcgagcctctcgaattgagaaccaggatgcgattgatactgctattgttgggatgttggctgatccacaggaggcacgtgctggcattcgtgaaatacacttccttcctttcaatccaactgataaacgaacagcacttacttatcttgatggtgagggaaaaatgcatagggtcagcaaaggtgcaccggagcagattcttaatcttgcacacaacaagtcagacatagagcgtagagttcatacagtgattgataagtttgctgagcggggcttgcggtcgcttggtgtggcatatcaggaagttccggagggaagaaaggagagcgctggggggccatggcagttcattgctctcctccctttgtttgatccacctaggcacgacagtgctgagactataaggagggctttaaaccttggagtaaatgtcaaaatgatcacaggagatcaattggcaattggaaaagaaactgggcgccgcctgggaatgggtacaaatatgtatccttcatctgctctgttgggacagacgaaggatgaatcaatcgctgctttgccaattgatgaacttatagagaaggccgatggttttgctggtgttttccctgagcacaaatatgagatagtaaagcgcttgcaagctaggaaacatatctgtggtatgactggtgatggagtcaatgatgctcctgctctaaagaaagctgatattgggattgctgttgacgatgccactgatgcggctcgcagtgcttctgatattgtccttactgaacctggtcttagtgtcatcattagtgctgttttgaccagtcgagcaatctttcaaaggatgaaaaattacacgatatatgctgtttccatcacaatccgtattgtgcttggttttatgcttctggctctgatctggaagtttgactttccgcctttcatggtgcttatcattgcaattcttaatgatggtaccattatgacgatatcgaaggatagggtcaaaccatctcctttgcctgatagctggaaactggctgagatttttactactggagttattcttggtggctacttggcaatgatgacggtcattttcttttgggcggcatacaaaacaaatttcttcccgcgagtatttggggtatcaacacttgagaaaacagcaactgatgattttaggaagctcgcatctgcgatataccttcaagtaagcactatcagtcaggccctgatattcgttacaagatctcgaagttggtcgtttgtggagcgtcctgggttgttgctagtgtttgcctttttcgttgctcaactggttgccaccttgattgctgtttatgcaaattggagctttgctgcaattgaaggaattggctggggttgggctggagttatctggctttacaatattgttacctatatcccactagatttgatcaagttcctcatccgttatgctctcagtgggaaggcctgggatcttgttcttgagcaaaggattgctttcacccggaagaaggattttggaaaagaactgcgcgagcttcaatgggcacatgcacagagaacccttcatgggctccaagttccagaccccaaaatatttagcgaaactaccaatttcaatgagcttaaccagttggctgaggaagcgaagaggagagctgaaattgctaggctacgtgagttgcatacactgaaaggtcatgttgaatcagtggtgaagttgaagggtctcgacattgagacaattcagcagtcatacaccgtttaaagggaccgcgtgaagttgtaatcaaactgttggtgttgtgatgagagcgaagacatcaaaatgctatactgagtttacccttgaaacaacatcttcataggtagttagattaggggagtaatatttttgaagttgttattttgctgtttcctggagccttcatatcccatagctcttgtacatgttgtagtgactcagaatggtgaacatgaagttacgctagcactcgttttctatattcgtaaaaccttttttctcatctacattatgttgtactttcccccttcaatttcttcacttcatataatactactagtacgacaataagctcttccacacactt

SEQ ID NO: 901 - DNA, 3410 bp, Solanum lycopersicum
actactagttttggtgaccctttgtctgtttataaaatcctacacttgttttctcgataaacgaaatcttgtcctcttttcttcatctgcttcacctaattttgttgcttcactgagttatatttatggtgtttttgatctgagacactgttatcaaaagggggaaaaacaagttttaggaagatggcggaaaagcctgaagttctggatgctgtcttgaaggagactgttgatttggaaaacataccgattgaggaggtttttgagaatctgagatgtaccagagagggacttactgctactgctgctcaagaaaggttgtccatttttgggtacaataagctcgaggagaaaaaggagagcaaattcttgaaatttttgggatttatgtggaaccctctctcatgggttatggaggctgctgctatcatggcaattgctcttgctaatggaggaggaaagccaccggactggcaggattttgtgggtatcatcacattgctcataatcaactcaacaattagttttatcgaggagaacaatgctggcaatgcagcagctgcactgatggctcgacttgctccaaaagccaaggttcttcgagatggaaaatgggacgaggaagatgcttctgttcttgtgcctggggacataatcagtattaaactgggagatatcattccagctgatgctcgtcttctagagggtgatccactcaaaattgatcagtctgctttgaccggtgaatctcttcctgtaacaaaaggtcctggagatggtgtttactctggctccacgtgtaagcagggagagatagaagctgttgtgattgctacaggggttcataccttttttggaaaggcagctcaccttgttgacagtacaaaccaagtgggacactttcagaaggcaagttttgactgctatagggaacttctgcatctgttcaattgcagtagggatgataatagagattattgtgatgtaccctatccaacaccgcaaataccgtcctggcatagacaatcttctggtgcttctcattggtgggattccaattgctatgccaactgttctctcagtcacgatggcaataggttctcatcgtcttgctcaacagggggccattacgaaaagaatgacagctatagaggagatggctggcatggatgttttgtgcagcgacaagacgggaaccctaacattgaacaagctgactgttgataaagcccttattgaggtatttgcgaaaggaattgatgcagacactgtagttcttatggcagctcgagcctctcgaattgagaaccaggatgcgattgatactgctattgttgggatgttggctgatccgaaggaggcacgtgctggaattcgtgaaatacactttcttcctttcaatccaactgataaacgaacagcacttacttatcttgatggtgagggaaaaatgcatagggtcagcaaaggtgcaccggagcagattcttaatcttgcacacaacaagtctgacatagagcgtagagttcatacagtgattgataagtttgctgagcggggcttgcggtcgcttggtgtggcatatcaggaagttccggagggacggaaggagagcgctggggggccatggcagttcattgctctcctccctttgtttgatccacctaggcacgacagtgctgagactataaggagggctttaaaccttggagtaaatgtcaaaatgatcacaggagatcaattggcaattggaaaagaaactgggcgccgcctgggaatgggtacaaatatgtatccttcatctgctctgttgggacagacgaaggatgaatcaatcgctgctttgccaattgatgaacttatagaaaaggctgatgggtttgctggtgttttccctgagcacaaatatgagatagtaaagcgcttgcaagctaggaaacatatctgtggtatgactggtgatggagtcaatgatgctcctgctctaaagaaagctgatattggaattgctgttgacgatgcaactgatgcggctcgcagtgcttctgatattgtccttactgaacctggtcttagtgtcatcattagtgctgttttgaccagtcgagcaatctttcaaaggatgaaaaattacacgatatatgctgtttccatcacaatccgtattgtgcttggttttatgcttctggctctgatctggaagtttgactttccgcctttcatggtgcttatcattgcaattcttaatgatggtaccattatgacgatatcgaaggatagggtcaaaccatctcctctgcctgatagctggaaactggctgagatttttactactggagttgttcttggtggctacttggcaatgatgacggtcattttcttttgggccgcatacaaaacaaatttcttcccgcgaatatttggggtatcaacacttgagaaaacagcaactgatgattttaggaagctcgcctctgcgatataccttcaagtaagcactatcagtcaggccctgatattcgttacaagatctcgaagttggtcgtttgtggagcgtcctgggttgttgctagtgtttgcctttttcgttgctcaactggttgccaccttgattgctgtttatgcaaattggagctttgctgcaattgaaggaattggctggggttgggctggagttatctggctttacaatattgttacctatatcccactagatttgatcaagttcctcatccgttatgctctcagtgggaaggcctgggatcttgttcttgagcaaaggattgctttcacccggaagaaggattttggaaaagaactgcgcgagcttcaatgggcacatgcacagagaacccttcatgggctccaagttccagaccccaaaatatttagcgaaactaccaatttcaatgagcttaaccagttggctgaggaagcgaagaggagagctgaaattgctaggctacgtgagttgcatacactgaaaggtcatgttgaatcagttgtgaagttgaagggtctcgacattgagacaattcagcagtcatacaccgtttaaagggaccccctgaagttgtaatcaaactgttggtgtcgtgatgggagcgaagacatcaaaacgctagtaccgagtttacccattaaacaacatctacataggtagttagattaggggagtaatatttttgaagttgttattttgctgtttcctggagccttcatatcctatagctcctgtacatgttgtagtgacccagaaatggtgaacataaggttatatgctagtacccgttttctatattcgtaaaaccttttttctcatcttacattatgttgtactttcccctttcaatttctccacttcatataatactactagtatgacaaaaagctcttccccacactttttt

SEQ ID NO: 902 - DNA, 3579 bp, Zea mays
ggctgccactcggctggcgctcacaccggatccgggccccactacccacctcctgtccagcccggtctccacagcagtgcccaccaccgcctgcagtctgcagagatcccccactgattcgctcgccgtccctccgctgcgctgctatataggaccgtgccgccgcgtgcgctcgtggactgtggtgtgccttgtgcgacagtcgccagcctgccccgcctgccggcccggccgcccgcctgcccgcggcactgagaagacgaagctccgggctccgggacgccgagcagaggggaaaggatggaggacaaggcgtccaacctagacgccgtgctcaaggaggccgtcgatctcgagaacataccgatcgaggaggtgttcgagaacctccgatgcagcccgcagggtctcaccacggagcaggcggagcagcgcctcgccatcttcgggcccaacaagctggaggagaagcaggagagcaagttcctcaagttcttgggcttcatgtggaacccgctgtcctgggtcatggaggcggccgccatcatggccatcgcgctcgcgaatgggggaaacaagccgcccgactggcaggacttcgtggggatcatcactctgctcattatcaactccacaatcagcttcattgaggagaacaatgcgggcaatgccgctgctgctctcatggcacgcctcgcccccaaggccaaggttctcagaaatggccggtggaccgaggaggaatcggctatccttgtgccaggagacatcatcagtgtgaagcttggggacatcattccagctgatgctcgtctgcttgaaggggatccactgaaaatcgatcagtctgcactcaccggcgaatcccttccagtcaccaaaggccctggtgatggagtgtattctggctccacttgcaaacagggtgagattgaggccgttgtcattgccactggtgtgcacacattctttggcaaggccgcacatcttgtcgattcaacaaaccaagttggtcattttcagaaggttctcactgccatagggaacttttgcatctgttcaattgctgtgggaatgctcgtggagcttgtcgtcatgtacgctatccaacacagggcttaccgacccggaatcgacaatctattggtgcttctgattggaggaattccaatcgccatgcccactgtcctttctgtgaccatggcaataggggctcatcgcttggctcaacagggagcaatcactaagagaatgacagcaattgaagaaatggctggcatggatgttctttgtagtgacaagactgggacattaaccttaaacaagttgactgtggacaagagtcttgttgaggttttccaaagaggtgttgaccaagatacagtaattttgatggctgctagagcttctcgcacagaaaatcaggatgccatagatgccacaatagttggtatgctggctgatccaaaggaggctcgtgctggtgttcaagagatccattttcttccatttaacccaactgataaaagaactgctttaacctaccttgatggagaggggagaatgcatcgtgttagcaagggagcaccagagcagatccttcatcttgcccacaacaagtcggatattgaaagaagggtcagagctgtgatcgacaaatttgctgagcgtggtctgcgagcacttggtgtggcttaccaggaagtgccagatggtaggaaagagagtcctggaggaccatggcagttcattgggctcttgcctctttttgaccccccgcgccatgatagtgcagaaactatcagaagggcactcaatcttggtgtcaatgtcaagatgattacaggtgatcaacttgctattgggaaggaaactgcacgtcgtttgggaatgggtactaatatgtacccttcttctgctttactcggacagaataaggatgagtcaattgcttccttgccaattgatgatttgattgagaaggctgatggctttgctggtgtttttccagaacacaagtatgagatcgtgaaacgcttgcaagcaagaaaacatatatgtggcatgactggggatggtgtaaatgatgcaccagctttgaagaaggctgatattggtattgcagtagcagattctactgatgcagctcgtagtgcttctgacattgtcctaactgaacctggccttagtgtgattattagtgctgtgctgacgagtcgggcaattttccaaaggatgaagaattacacgatctatgctgtatcgattaccatccgtattgtgcttggttttatgcttcttgcgctgatatggaagtttgacttcccaccatttatggtcctgatcattgccatcctcaatgacggtaccattatgactatctcgaaggacagagtaaaaccatctccacaacccgacagttggaagttagctgagatttttgcaactggagtagttcttggtggttatttggccatgatgactgtcattttcttctgggctgcatacaagactgacttcttcccgcgactgttccacgtcgaaagcctcgagaagaccgcccaggatgactttcagaagctcgcctctgccgtgtaccttcaagtcagcacgatcagtcaggcccttatcttcgtgacgcggtcgcgcagctggtcgtttgtggagcgtcctgggttcttgctggtctttgctttcttggtggctcagctgattgccactctgatcgctgtatatgccaactgggcgttcgctgcgatcaagggcattggatggggttgggccggtgtcatctggctctacaacatcgtcttctacttcccgctggacatcatcaagttcctcatccgctatgcgctgagtgggagggcatggaacctcgtccttgagcagaggattgcgttcacgagcaagaagaattttggcacggaagaaagggagcgcaagtgggcgcatgcgcagaggactctccatgggctccagccgccagaggcatccatcttcgagaacaagacgacattcaatgagctgaaccagctcgcggaagaggcccgcaggagagccgagatggcgaggttgcgagaagtgagcaccctgaaggggaggatggagtcagtggtgaagcagaagggtctggacatcgagaccatccagcagtcctacaccgtgtgactggctgaccgacgacgacggggtttatagaggtttcttcttcttatactatacaatctgtactaggtagcaataaggatcaaggaaggaacccctatatattggctgtggttcgcgggaaatgaatgatggtcatatttatgatgtcggtgtggtgcttctgtcgccaactctcgaccatactaccctcaactcaccccttgtatgctgtggcattaaccacccccggcaccaccggcaggcattgatattgagagatgaggtatagtagtctgtagcctctagtagatgatgatgaattgatgatatagtacatttttgcttgcttgctttctttcttgtttgttgttttccttggttctgctctctgggtttttgatgcttgctggttttgtgctattcctgatt

SEQ ID NO: 903 - DNA, 3205 bp, Zea mays
atggaggacaaggcgtccaacctagacgccgtgctcaaggaggccgtcgatctcgagaacataccgatcgaggaggtgttcgagaacctccgatgcagcccgcagggtctcaccacggagcaggcggagcagcgcctcgccatcttcgggcccaacaagctggaggagaagcaggagagcaagttcctcaagttcttgggcttcatgtggaacccgctgtcctgggtcatggaggcggccgccatcatggccatcgcgctcgcgaatgggggaaacaagccgcccgactggcaggacttcgtggggatcatcactctgctcattatcaactccacaatcagcttcattgaggagaacaatgcgggcaatgccgctgctgctctcatggcacgcctcgcccccaaggccaaggttctcagaaatggccggtggaccgaggaggaatcggctatccttgtgccaggagacatcatcagtgtgaagcttggggacatcattccagctgatgctcgtctgcttgaaggggatccactgaaaatcgatcagtctgcactcaccggcgaatcccttccagtcaccaaaggccctggtgatggagtgtattctggctccacttgcaaacagggtgagattgaggccgttgtcattgccactggtgtgcacacattctttggcaaggccgcacatcttgtcgattcaacaaaccaagttggtcattttcagaaggttctcactgccatagggaacttttgcatctgttcaattgctgtgggaatgctcgtggagcttgtcgtcatgtacgctatccaacacagggcttaccgacccggaatcgacaatctattggtgcttctgattggaggaattccaatcgccatgcccactgtcctttctgtgaccatggcaataggggctcatcgcttggctcaacagggagcaatcactaagagaatgacagcaattgaagaaatggctggcatggatgttctttgtagtgacaagactgggacattaaccttaaacaagttgactgtggacaagagtcttgttgaggttttccaaagaggtgttgaccaagatacagtaattttgatggctgctagagcttctcgcacagaaaatcaggatgccatagatgccacaatagttggtatgctggctgatccaaaggaggctcgtgctggtgttcaagagatccattttcttccatttaacccaactgataaaagaactgctttaacctaccttgatggagaggggagaatgcatcgtgttagcaagggagcaccagagcagatccttcatcttgcccacaacaagtcggatattgaaagaagggtcagagctgtgatcgacaaatttgctgagcgtggtctgcgagcacttggtgtggcttaccaggaagtgccagatggtaggaaagagagtcctggaggaccatggcagttcattgggctcttgcctctttttgaccccccgcgccatgatagtgcagaaactatcagaagggcactcaatcttggtgtcaatgtcaagatgattacaggtgatcaacttgctattgggaaggaaactgcacgtcgtttgggaatgggtactaatatgtacccttcttctgctttactcggacagaataaggatgagtcaattgcttccttgccaattgatgatttgattgagaaggctgatggctttgctggtgtttttccagaacacaagtatgagatcgtgaaacgcttgcaagcaagaaaacatatatgtggcatgactggggatggtgtaaatgatgcaccagctttgaagaaggctgatattggtattgcagtagcagattctactgatgcagctcgtagtgcttctgacattgtcctaactgaacctggccttagtgtgattattagtgctgtgctgacgagtcgggcaattttccaaaggatgaagaattacacgatctatgctgtatcgattaccatccgtattgtgcttggttttatgcttcttgcgctgatatggaagtttgacttcccaccatttatggtcctgatcattgccatcctcaatgacggtaccattatgactatctcgaaggacagagtaaaaccatctccacaacccgacagttggaagttagctgagatttttgcaactggagtagttcttggtggttatttggccatgatgactgtcattttcttctgggctgcatacaagactgacttcttcccgcgactgttccacgtcgaaagcctcgagaagaccgcccaggatgactttcagaagctcgcctctgccgtgtaccttcaagtcagcacgatcagtcaggcccttatcttcgtgacgcggtcgcgcagctggtcgtttgtggagcgtcctgggttcttgctggtctttgctttcttggtggctcagctgattgccactctgatcgctgtatatgccaactgggcgttcgctgcgatcaagggcattggatggggttgggccggtgtcatctggctctacaacatcgtcttctacttcccgctggacatcatcaagttcctcatccgctatgcgctgagtgggagggcatggaacctcgtccttgagcagaggattgcgttcacgagcaagaagaatttcggcacggaagaaagggagcgcaagtgggcgcatgcccagaggactctccatgggctccagccgccagaggcatccatcttcgagaacaagacgacattcaatgagctgaaccagctcgcggaagaggcccgcaggagagccgagatggcgaggttgcgagaagtgagcaccctgaaggggaggatggagtcagtggtgaagcagaagggtctggacatcgagaccatccagcagtcctacaccgtgtgactggctgaccgacgacgacggggtttatagaggtttcttcttcttatactatacaatctgtactaggtagcaataaggatcaaggaaggaacccctatatattggctgtggttcgcgggaaatgaatgatggtcatatttatgatgtcggtgtggtgcttctgtcgccaactctcgaccatactaccctcaactcaccccttgtatgctgtggcattaaccacccccggcaccaccggcaggcattgatattgagagatgaggtatagtagtctgtagcctctagtagatgatgatgaattgatgatatagtacatttttgcttgcttgctttc

SEQ ID NO: 904 - DNA, 3345 bp, Glycine max
gcacacttttttttttctatttacttgtacttagtgccaactctttcggttggtgcacttcatccacgcacgctaactctctaatttctgaacggtttttgtagtgtgagagcaaagttggtagctctagagagacacagagaagaagaagatgggggacaagtcccaagttttggaggccgtgttgaaggaaactgttgatttggagaacatacccattgaggaggttcttgagaatctgagatgtggcagagaagggctcagcagtgaagctgctgaggagaggcttaccatttttggtcacaacaagcttgaagagaagaaagagagcaaatttttgaagttcttgggatttatgtggaatcctctgtcatgggttatggaggctgctgctataatggctattgcgcttgcaaatggaggggggaaggctcctgattggcaagactttgtgggtatcattaccttgcttctcatcaattcaactatcagtttcattgaggagaacaatgctggtaatgccgcagcagctctcatggctcggctcgctccaaaagcaaaggttcttcgagatggtaggtggaatgagcaagatgcggcgatcctggttcccggtgacataatcagcatcaaacttggagatattattcctgcagatgctcggcttcttgaaggggatcctttgaaaattgatcaatctgcccttaccggtgagtcactgccagtgacaaagggtcctggtgatggagtatattctggttctacctgcaaacaaggagagattgaagctgtggtcattgctactggtgttcataccttctttgggaaagctgctcatcttgtggatactaccaatcaagtgggacactttcaaaaggtcttgactgcaattgggaacttctgcatatgttcaattgcattagggatggttgttgaaattattgttatgtatcccatccaagatcggccctatcgtcctggaattgataacttgcttgtacttctcattggaggaattccaattgccatgcccacagttttgtctgtgaccatggccattggttctcacaggctatctcagcagggggctatcacaaagaggatgacagccattgaagagatggcaggcatggatgtgctttgcagtgataaaactgggactctgacattaaataagcttactgttgacaaaaatcttgttgaggtttttgcaaaaggagtggatccagatactgttattttgatggcggcccgagcttcaaggcttgagaatcaagatgcaattgatacagccatagttgggatgttggctgatccaaaggaggcacgtgctggcatacaagaagtgcattttcttcctttcaatcctactgataagcggacggcattgacttatcttgatcaagatggcaaaatgcatagagtaagcaaaggtgcaccagaacagatcctgaatcttgcacacaataaggcagacattgaacgtagagttcattcagtgatagacaagtttgcagagcgtggtttacgatctcttgctgtagcataccaagaagttccagatggaaggaaagagagtgctggaggcccgtggcaatttattggccttttgtctctctttgacccacctaggcatgatagtgcagaaacaatacggagggcactaaaccttggagtcaatgtcaaaatgattacaggggatcagctagctataggaaaggaaacaggtcgtcgcttgggaatgggtaccaacatgtatccttcatcagctttacttgggcaggacaaggatgaatccattgttgccttgccaattgatgaactaatagaaaaggctgatggatttgctggtgtatttcctgagcacaagtatgagatagtgaaacgcttgcaagctaggaaacatatttgtggaatgactggggatggagtgaacgatgcacctgccctcaagaaggcagacattggtatagctgttgctgatgctactgatgcagcccggagtgcatctgatattgttctaacagaacctggacttagtgttattattagtgctgttttgacaagccgagccatcttccagagaatgaaaaattatacaatttatgcagtatcaattacaattcgtattgtgcttggttttatgttgctggctctcatttggaagtttgactttccaccctttatggtgcttattatcgctatcctaaatgatggtactattatgacaatttcaaaagatcgtgtaaaaccatcacctctgccagatagctggaagctagcagagatatttactactggagttgtgcttggaagttacttggcaatgatgacagttatattcttttgggcggcatacaaaacaaactttttcccgcgagtgtttggagtcccaagtcttgaaaaaactgctcatgatgattaccggaaacttgcctctgcaatctatcttcaagtgagcactattagtcaggctcttatatttgtaactcgatctcgaggttggtcttatgttgagcgtcctggtttattgctggtgtttgcttttgttgttgctcaactgattgccactttgattgcagtatatgccaattggagctttgctgcaattgaaggaatcggttggggttgggctggtgttatatggttatataacatcatattctacatcccacttgatatcgttaaatttttaattcgctatgctcttagcggtagggcttgggaccttgtcattgagcaaaggattgcattcacaaggcaaaaggactttggaaaggaacaacgtgaacttcaatgggcacatgcacaaagaacattacatggattacaaccagctgacaccaagttcaatgagcgtacacatgtcagtgaactcaatcaaatggccgaagaagctaaaaggagagctgaaattgcaaggttgagagaacttcatacactaaaaggtcacgtagaatcagttgtgagattgaaggggcttgacatagacacaattcagcaagcatacacactctaaagatgcttaatatatttgcatacttatactgtaaagagttacattctaatgttgctgaagaaccatataatgtaatgatcacacacgttctgtcctttttactctgccgtctgtttcgagcacttaaaggagtgcttttttgaggtcaatttatgtcatcttgtttcttgttatcactctacctgtcacgcattctccacaatttcatgatgccatgaatgaagagaaattcacccttgtatcctacgcttctgaactcattttctatctatgtacctcctcaatttctttcatctttggaaattaattataaagttccatgtgaa

SEQ ID NO: 905 - DNA, 3110 bp, Glycine max
gcacacttttttttttctatttacttgtacttagtgccaactctttcggttggtgcacttcatccacgcacgctaactctctaatttctgaacggtttttgtagtgtgagagcaaagttggtagctctagagagacacagagaagaagaagatgggggacaagtcccaagttttggaggccgtgttgaaggaaactgttgatttggagaacatacccattgaggaggttcttgagaatctgagatgtggcagagaagggctcagcagtgaagctgctgaggagaggcttaccatttttggtcacaacaagcttgaagagaagaaagagagcaaatttttgaagttcttgggatttatgtggaatcctctgtcatgggttatggaggctgctgctataatggctattgcgcttgcaaatggaggggggaaggctcctgattggcaagactttgtgggtatcattaccttgcttctcatcaattcaactatcagtttcattgaggagaacaatgctggtaatgccgcagcagctctcatggctcggctcgctccaaaagcaaaggttcttcgagatggtaggtggaatgagcaagatgcggcgatcctggttcccggtgacataatcagcatcaaacttggagatattattcctgcagatgctcggcttcttgaaggggatcctttgaaaattgatcaatctgcccttaccggtgagtcactgccagtgacaaagggtcctggtgatggagtatattctggttctacctgcaaacaaggagagattgaagctgtggtcattgctactggtgttcataccttctttgggaaagctgctcatcttgtggatactaccaatcaagtgggacactttcaaaaggtcttgactgcaattgggaacttctgcatatgttcaattgcattagggatggttgttgaaattattgttatgtatcccatccaagatcggccctatcgtcctggaattgataacttgcttgtacttctcattggaggaattccaattgccatgcccacagttttgtctgtgaccatggccattggttctcacaggctatctcagcagggggctatcacaaagaggatgacagccattgaagagatggcaggcatggatgtgctttgcagtgataaaactgggactctgacattaaataagcttactgttgacaaaaatcttgttgaggtttttgcaaaaggagtggatccagatactgttattttgatggcggcccgagcttcaaggcttgagaatcaagatgcaattgatacagccatagttgggatgttggctgatccaaaggaggcacgtgctggcatacaagaagtgcattttcttcctttcaatcctactgataagcggacggcattgacttatcttgatcaagatggcaaaatgcatagagtaagcaaaggtgcaccagaacagatcctgaatcttgcacacaataaggcagacattgaacgtagagttcattcagtgatagacaagtttgcagagcgtggtttacgatctcttgctgtagcataccaagaagttccagatggaaggaaagagagtgctggaggcccgtggcaatttattggccttttgtctctctttgacccacctaggcatgatagtgcagaaacaatacggagggcactaaaccttggagtcaatgtcaaaatgattacaggggatcagctagctataggaaaggaaacaggtcgtcgcttgggaatgggtaccaacatgtatccttcatcagctttacttgggcaggacaaggatgaatccattgttgccttgccaattgatgaactaatagaaaaggctgatggatttgctggtgtatttcctgagcacaagtatgagatagtgaaacgcttgcaagctaggaaacatatttgtggaatgactggggatggagtgaacgatgcacctgccctcaagaaggcagacattggtatagctgttgctgatgctactgatgcagcccggagtgcatctgatattgttctaacagaacctggacttagtgttattattagtgctgttttgacaagccgagccatcttccagagaatgaaaaattatacaatttatgcagtatcaattacaattcgtattgtgcttggttttatgttgctggctctcatttggaagtttgactttccaccctttatggtgcttattatcgctatcctaaatgatggtactattatgacaatttcaaaagatcgtgtaaaaccatcacctctgccagatagctggaagctagcagagatatttactactggagttgtgcttggaagttacttggcaatgatgacagttatattcttttgggcggcatacaaaacaaactttttcccgcgagtgtttggagtcccaagtcttgaaaaaactgctcatgatgattaccggaaacttgcctctgcaatctatcttcaagtgagcactattagtcaggctcttatatttgtaactcgatctcgaggttggtcttatgttgagcgtcctggtttattgctggtgtttgcttttgttgttgctcaactgattgccactttgattgcagtatatgccaattggagctttgctgcaattgaaggaatcggttggggttgggctggtgttatatggttatataacatcatattctacatcccacttgatatcgttaaatttttaattcgctatgctcttagcggtagggcttgggaccttgtcattgagcaaaggattgcattcacaaggcaaaaggactttggaaaggaacaacgtgaacttcaatgggcacatgcacaaagaacattacatggattacaaccagctgacaccaagttcaatgagcgtacacatgtcagtgaactcaatcaaatggccgaagaagctaaaaggagagctgaaattgcaaggttgagagaacttcatacactaaaaggtcacgtagaatcagttgtgagattgaaggggcttgacatagacacaattcagcaagcatacacactctgaatatgcttatatatatttgcatagttatactgtaaagagttacattctaatgttgctgaagaagaatataatgtaatgattacacatgttc

SEQ ID NO: 906 - DNA, 3693 bp, Theobroma cacao
ctcatcacccataaaatatattataaaaaacaaatgttataaaagcagatgcactaaaatcaccaaccaatcctttgaaaatgcataaaaattcaaaaaaacccagggtacaagatcccaccagcattgcttatggtacaacctgtgagagcataagcatgggaggatggttttggattttaacaaaaaaaaaacattaaaaacagaagaaaggcaagtgtagaaataacaagggactgtcactggacatatatatcaacaacaacactgccactactcttttagcggttccacctttctgttctgcatttttttttttggggttgtttgttgtagatttcgagttgtgggttgttctcattttggttccttaacaaaaatctaagttcaagattaagtctttgaaactggagtttttttcttttgggagttttgagttttagaggaagagaagatgggggacaaaaatgaagtcttggatgctgtgttgaaggaaactgtggatttggaaaatatacccattgaggaagtttttgagaatctgagatgtagcagagaaggtcttactactgaggctgccgaggaaaggctggtcatttttggacacaacaagcttgaagagaaaaaggagagcaaattcttgaaatatctgggctttatgtggaatcctctctcctgggttatggaatctgctgctatcatggccattgctcttgcaaatggaggaggaaagcctccagattggcaagactttgttggtatcattactctgcttcttatcaactccaccatcagttttatcgaggaaaacaatgctggtaacgcagcagctgctctcatggctcgtcttgctcctaaagcaaaggttcttcgagatggaagatggagcgagcaagatgctgctattttggttcctggagacgtaataagtatcaaactaggtgatattatacctgctgatgcccggttacttgaaggtgatccgcttaaaattgatcagtctgcactaactggagagtctctccctgtaacaaaaggacctggtgatggtgtttactctggttctacttgcaaacaaggagagattgaagcagtggttattgcaaccggtgttcatactttctttgggaaagctgctcaccttgttgatactactaaccaagttggtcacttccaaaaggcaagtcttgacggcaataggaaatttctgcatatgctctattgcagtggggatgataatagagattattgtcatgtatcctattcaagaccggcagtaccgtcctggaatcgacaatcttcttgttctccttattggtggcatcccaattgccatgcctacagttttgtcagttactatggctattggttctcataggctatctcagcagggggctatcacaaagagaatgactgcaattgaggagatggcaggcatggatgttctttgcagtgataagacaggaactctgactctgaacaaacttacagttgacaaaaatcttgttgaggtctttgccaaaggagtagatgcagacactgtagttctgatggcagcccgagcctctagaacagagaaccaggatgcaatagattctgcaatagttgggatgctggctgatccaaaggaggcacgtgctggcattcgagaagtacacttccttcctttcaatccaacagataagagaacagctttaacctatatcgataatgatggtaaaatgcacagagtcagtaaaggtgcccctgaacagatcttaaaccttgcacataataagtcagatattgagcgaagagttcatgtggtcattgataagttcgcagagcgaggtttacgatctcttgcggtggcataccaggaagttccggaaggaaggaaggagagttctggtggcccatggcagttcattggtctcatgcctctctttgatccccctcggcatgatagtgcagaaacaattaggagggctttgaaccttggagtaaatgtcaaaatgattacaggagatcaactggcaataggaaaggagactgggcgccgtttgggcatgggaaccaacatgtatccatcatctgctttattgggtcaggacaaggatgaatctatagctgccttaccagttgatgaactaattgagaaagctgatggctttgctggtgttttcccagaacacaaatatgaaatagtaaaacgcttgcaagccaggaaacacatctgtggcatgactggtgatggagttaatgatgctcctgctcttaagaaagctgacattgggatagctgtggctgatgcaactgatgcagcacgtagtgcttctgacattgtccttactgaacctggacttagtgtcatcatcagcgctgtcttgaccagtcgtgccattttccagaggatgaaaaattacactatttatgcagtttccattacaatccgtattgtgttgggattcatgctgctagccctcatctgggaatttgactttccgccattcatggtgcttattattgcgatcctcaatgatggtaccattatgacaatatccaaggacagggtcaaaccatcacctctaccagacagctggaagctggcggaaatttttacaaccggaattgttcttggtagttacttggcagtgatgacagttatattcttttgggcagcatacaaaacagacttttttccgcgtatatttggggtgccgactcttgagaaaacagctcatgatgacttaagaaagcttgcctctgcagtgtatttgcaagtgagcattataagtcaggccctaatatttgtaacacgatcccgaagttggtcttatgttgagcgtccaggtttgctattagtggtggcgtttgtggtagctcagttgattgctacgctaattgctgtctatgcaaattggagctttgctgcaattgaagggattggatggggttgggctggtgtgatctggctctataacataatcttctacatcccacttgatttcatcaagttcttcattcgctatgctttgagtggcagggcctgggatcttgttattgagcagaggattgcattcacaaggcaaaaggattttggaaaagaacaacgtgagcttcaatgggcacatgcacagagaacattgcatggtttgcaggcacctgataccaagatgttcactgaacgaacccatttcacagagctcaatcagatggccgaggaagccaaaaggagggctgaaattgctaggttgagagaactccacacactgaaaggtcatgtcgaatcagtggtgagattgaagaaccttgacatagacacaattcagcaagcttacacagtctaggggaatcaatccaaagacatactcatatacgtaacagtagcatttacctgcggtgagaagacaaaatcagcatgtttttggttgcccatcattgagattaaaagatcctatttcgagcagataaaagagtgctgcagttagctttatctatgtattttttactgattcctctttcgttaccaaattatgccggcaataaggaacgcttattgtttatggcattttatgtttatattggtaagccttatggtttttcatctttggttttattgtattaaaaagaaactcgggtagtgggaagttattggggaataagaactcactaactcttggtatttaatcgaccaaaatgaaatgttggaca

SEQ ID NO: 907 - DNA, 3395 bp, Quercus alba
gccactactccatgctcttttagcggttcctcttcctgactcctctgcagaattggtattggtggggttgtcttcattttggtcctcaactcctattttgggttcaaaaccaggttttttaaactgggtgttgcttggttcttctataaagtctgagtttttctggcttttacatggtggctctttgatgggttttgatctgtgagtgcttctgtggtgatataaagttaaaaagagagtgttttttctagagaagaaggaagagatgggggacaagtctcaagtattggaggctgtgctgaaggaaactgtggatttggaaaacatacccattgaggaagtgttagagaatctgagatgtagcagagaggggcttacctctgtggctgctgaggagaggctggtccttttcggtcacaataagcttgaagagaaaagggagagcaaattcttgaagtttttggggttcatgtggaacccgttatcttgggtcatggaagctgctgctatcatggccattgcgcttgcaaatggaggagggaagcccccggactggcaagactttgtgggaattatagtcctgcttttcatcaactcgacaattagtttcattgaggagaacaatgcaggtaatgctgcagccgctctcatggctcgtctcgctccaaaagccaaggttcttcgagatggaaggtggaatgaacaagatgctgcgattctcgttcccggtgacattatcagtattaaattaggagatattataccagccgatgctcgtcttcttgagggagatccattgaaaattgaccagtctgcgcttactggtgagtcccttccggtcacaaaaggccctggagatggtatctactctggttcaacttgcaaacagggagaaattgaagcagtggtcattgccacaggtgtgcataccttctttgggaaggctgctcatcttgttgataccaccaaccaagtgggccacttccaaaaggtcttgactgccattgggaacttctgtatatgttcaattgctattgggatgattatagaaattattgttatgtatcccattcaagaccgcgagtaccgccctggaattgacaaccttcttgtgcttctcattggaggaattccgattgccatgcctacggttctatcagtgacaatggctattggttctcataggttagctcagcagggagctattactaagaggatgacagcaattgaagagatggcgggcatggacgttctttgcagtgacaagactggaactttgacattgaacaagcttagtgttgacaagaaccttattgaggtttttgcaaaaggagtagatggagatactgttgtcctaatggcagctcaagcctctagaacggagaatcaggatgcaatagattctgctatagttgggatgctggctgatccaaaggaggcacgtgctggcattcaagaagtgcacttccttccttttaaccctactgataagcgaacagctttgacttatattgaccgtaacggtaaaatgcatagagtcagcaaaggtgcaccagagcagattctaaatcttgcccacaataagtcggaaattgagcgtagagttcatgctgtgatcgataagtttgcagaacgaggtttaagatcgcttgcagtagcataccaggaagttccagaaggaaggaaggagagtgctggaagcccatggcagtttattggtctcatgcctctctttgacccacctaggcatgacagtgcagagacaataaggagggctttaaatcttggagtgaatgtgaaaatgattacaggggatcaacttgcaataggaaaggagactggacgccggttgggaatgggtaccaacatgtatccttcatctgctttgctaggacaggacaaggacgagtctattgtagctttaccaattgatgagctgatagagaaagctgatggctttgctggtgttttccctgagcacaaatatgagattgtaaagcgtttgcaagctaggaaacatatctgtggcatgactggtgacggagtcaatgatgctcctgccctaaaaaaggctgacattgggatagctgttgctgatgcaacagatgcagctcgtagtgcttctgacattgtccttacagaacctggtcttagtgttatcattagtgctgttttgaccagtagggcaatcttccagaggatgaaaaattatacaatttatgcagtttccattacaatccgtattgtgcttggttttatgttgcttgcactcatatggaagttcgactttccaccttttatggtgcttatcattgccatcctcaatgatggtactatcatgacaatatcaaaagatagggtgaaaccatctcctttaccagatagttggaagctagcagagattttcacaactggcattgttcttggtagttacttggcaatgatgacagtcatatttttctgggctgcgtacaagacagacttcttcccgcgcgtatttggggtgccaacccttgagaaaactgctcatgatgacttccgaaagcttgcttcagcaatatatctgcaagtgagcaccgttagtcaggccctcatatttgtaacacgatctagaagttggtccttcgttgagcgtcctgggatgttgcttgtagtagctttcattattgctcagctgattgccactgtaattgcggtctatgcaaattggagctttgctgcaattgaagggattgggtggggttgggctggcgtgatatggctttataacatcatcttctacatcccacttgatttaataaagttcttcatacgctatgctttgagtgggagagcttgggatcttgtcattgaacagaggattgcttttacaagacaaaaggactttgggaaggaacaacgtgagcttcaatgggcacatgcacagagaacattgcatgggttgcaacctcctgacacgaagatgtttactgaacgaacgcatttcacagaactcaatcaaatggctgaagaagccaaaagaagagcggaaattgcaaggttgagagaactccatacactgaaaggtcatgtagaatcagtggtgagactgaaaggtctggacatagacacaattcagcaagcatacacagtctaaggaagatcatttatgatatctcacctaatactgttaaagatgcttcaactagcactgagagtaaagacatgtaatgaacctcttgttgtgagttaaccttcaaacaacttttcttcatatttgatactataatatccattttcagcactcaagcagctcctatctgttctttctcttgattttttggacacctctcaaatgacctcttgtagtgccccatgatagaaaactgctaataatattaatggcatataatgtt

SEQ ID NO: 908 - DNA, 3305 bp, Fragaria vesca
agtggaaaagcttgtgactgttactgactgctttgccactctctgtgagcggttcatcatcctctttctgccattttggtgaagcagggtcgccctcatttcggtccctcaacccctaattcttatcaaaatccactctttacaaccggagctgtgacgagaggaaggagatggcggaggagaagcctgaagtgctggacgccgtgctgaaggagacggttgatttggaaaacatacccattgaggaggtgtttgagaatctgagatgtagcaaagagggtctcaccagtgaggctgctgaggaaagattaaccatttttgggcacaacaagcttgaggaaaagcaggagagcaaatttatcaagtttctgggctttatgtggaatcctctctcatgggttatggaagctgctgctataatggccattgctcttgcaaatggaggaggcaagcctccggactggcaagattttgtgggtatcattactctgctggttatcaactccaccattagtttcattgaggaaaataatgcgggtaatgctgcagcggctctcatggctcgtcttgcgcctaaagccaaggtgcttcgagatggaaggtggaacgagcaagatgccgctgtcctagtacctggagacataattagcatcaaacttggcgatatcgttccagctgatgcacggctgcttgaaggggatcccttaaaaattgatcagtctgcccttacaggcgagtctcttcccgtgacaaaaggccctggagatggtgtgtactctggttcaacttgcaaacaaggagagattgaagcagtggtcattgctacaggtgtgcatacattctttgggaaggctgctcatctcgttgatagcactaaccaagtgggccacttccaaaaggtcttaactgcaatagggaatttctgcatatgctctatcgctgtgggtatggtaatagagattattgtcatgtacccgattcaagaccgagattatcgccctggaattgacaatctacttgtgcttctcatcggtggaattccgattgcaatgcccacagttctgtctgtgactatggcaattggctctcatagattagcacagcagggagctatcacaaagagaatgacagcaattgaagagatggcgggcatggatgtgctttgtagtgataaaacaggaaccctaacactgaacaagcttacagttgataagaatcttattgaggtttttgcaaaaggagtggatccggatactgttgttctgatggcagctcgagcatcgaggacagagaatcaagatgcaatagatactgctatagttgggatgctggctgatcctaaggaggcacgtgctggcattcaagaaatacacttccttcctttcaatcctactgataagcgtactgctttgacttatattgaccgtgatggtaaaatgcatagagttagcaagggtgcaccagagcagattctacatctcgcccacaataagtcagacattgagcgcagagttcatgcagtgattgataagtttgctgagcgaggattacggtcccttgctgtagcataccaggaagttccagaaggaatcaaagagggtgctggaggcccatggcagttcattggtctaatgccactctttgacccacctaggcacgatagtgcagagacaatacggagggctttaaatcttggagtaaatgtgaaaatgattacaggtgatcaactggccataggaaaggaaacgggtcgtcgtttgggaatgggaaccaatatgtatccttcatcagctttactaggacagaacaaggatgagtcaattgcggctttacccattgatgatctgatagaaaaagccgatggctttgctggtgtattcccagagcacaaatacgagattgtaaaacgcttgcaagcaatgaaacatatctgtggaatgactggtgatggtgtaaatgatgctcctgccctcaagaaagccgatattggtattgctgttgctgatgcaacagatgcagcacgtagtgcttctgatattgtgctaactgaacctggactcagtgtaatcattagtgccgttttgaccagtcgagcaatcttccagaggatgaaaaattacacaatatatgctgtttccatcacaattcgtattgtgatgggtttcatgttgctggccctcatatggaagttcgactttccacctttcatggtgcttattattgcaatcctcaatgatggtactatcatgacgatatcaaaggatagggtcaaaccatctcctctgccagatagctggaagctggccgagatttttgctactggaattgtgctcggttcctacttggcaataatgactgtgatattcttttgggcagcatacaaaacagacttcttcccaaggacatttggggtgtcaactcttgagaaaacagctaatgatgacttccggaaacttgcctctgctatatatctacaagttagcatcattagccaggccctcatttttgtcacacgctctcgaggttggtcctttcttgagcggcctggaatgttactttttgtggctttcctgatagcccagctgattgccaccttgatagcagtgtatgctaactggagttttgctgcaatcgaagggattggatggggttgggctggggtgatctggctctataatatcgtattctatatcccactggatatcataaagttcatgatacgctatgctctcagtgggaaggcttgggatcttctcattgagcaaaggattgcttttacaaggcaaaaggactttggcaaggaacaacgtgagcttcaatgggcacatgcacaaagaacattgcatggtttgcaaccaccagataccaagatgtttactgaaagaacacatttcactgaactcaatcatatggctgaagaagccaaaagaagagctgaaatcgcaaggttgagagaactgcatacactgaaaggtcacgtagagtcagtggtgcgattgaagggtctcgacatcgacacaattcagcaagcttacacagtctagttcagggacagtttattttactatagcgtgacagaatcctagtattgctgagagtaaagacaggtactcggcatgttgtgagtaacctagtagagaaatccttttaaatttgctactctgctttcagtttattttttgcatgtaaaatgagtgctgcaatcagctgttttctggttccttttcctctacctccttatccccttttgtgatactgatacatgctcaattaatccaaaccattcacgacatgtttgcttcaca

SEQ ID NO: 909 - DNA, 2967 bp, Cucumis sativus
atgggggacaaagatgaagtcttggaagctgttgtgaaggaagctgttgatttggagaacgttccacttgaagaggtttttcaaacgttgagatgtaataaaaatggtttgacaacagaggctgctcatgagaggttggccatttttgggcataacaagcttgaagaaaagaaggagagtaagcttttgaagttcttgggatttatgtggaaccctctctcatgggtcatggaagctgcagctataatggctattgctttagctaatggaggagggaaacctccagattggcaggattttgttgggatcataactttgttacttatcaattcgactattagttttatagaggagaacaatgctggaaatgctgcagccgctctcatggctcaccttgctccgaaagctaaggttcttagagatgggaagtgggtagaggaggaagcatcagtccttgttcctggtgatataattagcgtcaaactcggtgacattattcctgctgatgctcgcctccttgaaggtgatcctttaaagatcgatcaatctgctctcacaggtgagtcgcttcctgtgactaaaggccctggcgacagtgtctattcaggttcaacatgcaagcagggagaaattgaagcagtggttattgctactggtgttcatacattctttggcaaagctgctcatcttgtagactccacgaatcaagtgggtcacttccaaaaggtcttgactgcgattggaaatttctgcatatgttccattgttgtgggtatggttgttgagattattgtcatgtacccaatccaacatcggccgtatcgaccaggaatcgacaatctcctagttctcctaattggaggaattcccattgcaatgccaactgttttgtcggtcacaatggcgattgggtcacaccgtctatctgaacagggagctatcactaaacgaatgactgcaatagaagaaatggctggaatggacgtgctctgtagtgacaaaacaggaacactgaccttaaataagcttactgttgacaagactctgatagaggtttttgccaagggagtggacgtggatactgtcgttctcatggcagctcgagcatctcgagttgaaaatcaagatgcaattgatgctgctatagtagggatgttaagtgatccaaaagaggcacgagcaggcattcaagaggttcatttccttccattcaacccaactgacaagcgaactgccctaacatacactgatactgatagtaaaatgcatcgagtcagcaaaggtgctccagagcagatcttgaatcttgcacacaacaaatcagagatagaaagaagagttcacgctgtgatcgataagtttgcagagcgaggattgcgctctcttgcagtggcataccaagaagtttcagatggaagaaaggagagtcatggtggcccatggcaattcattggtctaatgcctctgtttgatccccctagacatgatagtgcagagacaattaggagggctttgaatcttggtgtaaatgttaaaatgatcacaggtgatcaactggctataggaaaggaaacaggacgccggcttgggatgggaacgaatatgtacccttcatctgcattattaggacagaacaaagatgaatcaatttctggattgcctgttgatgagttaattgaaaaggctgatggatttgctggtgtatttcctgagcacaaatatgagattgtgaaacgtttacaagctcgaaaacatatatgtggaatgactggagatggtgttaatgatgcccctgctcttaagaaggccgatattggcatagcagttgcagatgcaactgatgcagctcgtagtgcttctgacattgttcttactgagcctggtcttagtgttattataagtgccgttctaaccagccgagccatcttccagaggatgaaaaattacacgatttatgctgtttccattacaattcgtatcgtgcttggattcatgctgctggcccttatatatcaatttgatttcccacctttcatggttctaatcattgctattctaaatgatggtaccataatgacaatatcgaaggatagagtgaaaccatctcctctgccagatagctggaaactggcagagatttttggcactggtattatacttggaggttatttggctatgatgaccgttattttcttctgggcagcttacaaaacggacttctttcctcgtacatttggggtttctagtcttcaaaagaaggacgaggatgatttccgaaagctggcttcagcaatatacctgcaagtgagtacaattagtcaggccctcatctttgtgacaagatctcgaagttggtcatttgtggagcgtcctggcttgttattggttgcagcttttattattgctcagctaattgctacactgattgctgtctatgcaaactggagttttgctgcaattgaaggaattggctggggttgggctggtgtggtttggctttacaacctcatcttttatttcccacttgacataatcaagtttgcaatcagatatgccattagtggtagggcatgggaccttgtcattgaacaaaggattgcctttacaaggaagaaagattttgggaaggaagagcgcgagctcaaatgggcacatgcacaaaggacacttcatggcctgcagccacctgaggctaagatgttctcggaccgcacaacttatacagaactcaatcaaatggcagaggaagcaaaacgccgagctgaaattgcaaggctgagagagctgcacacactgaaaggtcatgtcgaatcagtggtgaggctgaaaggtcttgatatcaacacgattcagcagtcatacacagtatagagaacagaggatttcaaatctgcatagctgcatagtatagtttacaaatcatagagagaagatccatccgtatttcttatttggtgtataaaagtc

SEQ ID NO: 910 - DNA, 2882 bp, Cucumis sativus
aaaagggagagaagcctgaggttttggaggctgtattgaaggaaactgtggacttggaaaacatacccatcgaggaggtttttgataatctgagatgtagcaaagagggtcttactacagcagctgctgaggaacggcttgtaatttttggtcacaacaagcttgaggagaagaaggaaagtaaagtactgaagtttttgggttttatgtggaaccccttatcatgggtaatggaggctgctgctattatggccattgcactcgcaaatggtggaggaaagcctcctgactggcaggattttgttggtattatcgccctgttgcttatcaactcaacaattagtttcattgaggaaaataatgccggaaacgctgcagctgcgctaatggccagtttagctccccaagccaagattcttcgagatggaaggtggagtgtacaagatgcgtcggttttagttcctggtgatattataagtatcaaacttggggatattattccagctgatgcacgtcttctggatggggatccgttgaaaattgaccagtctgcacttacaggcgagtctcttcctgttactaaaggtcccggcgatggcatatactctggttctacttgtaaacaaggagagattgaagcggtggtcattgccactggtgttcatactttctttggtaaggctgcccaccttgttgacaccactaaccaagtgggacacttccaaaaggtcttgactgcaattgggaacttctgcatatgttccattgctttgggcatgattacagaaattattgtcatgtaccccatccaagatcgtgactatcgtcctggaattgacaatcttcttgtgcttttgatcggaggaattccaattgccatgcccacagttctctctgtgacaatggctatcggctctcataggttatctcagcagggtgctatcacaaagaggatgactgcaattgaagaaatggcaggaatggatgtgctttgcagtgacaagacaggaacactgacactaaacaagctaactgtcgacaaaaatcttgttgaggtttttgctaaaggagtggatgtcgatacagtggttcttatggcagcccgggcatcaagaacagagaatcaagatgctattgatactgccattgttgggatgcttgctgacccaaaagaggctcgtgctggtattcaagaagtacacttccttccatttaaccctactgataagcggactgcattgacttacatagaccatgaaggtaaaatgcatagagtcagtaaaggggcacctgagcagattctgaaccttgcgcacaataagtcagagatcgagcgtaaagttcatgctgtgatagacaagtttgcagaacgaggtttacgctctcttgctgtggcataccaggaagttccagatggtcgaaaggagagtgctggaggtccatggcagtttgttggcctcctgccactgttcgacccaccaaggcatgacagtgcagagacaataaggagggcattaaatcttggagtgaatgtgaagatgattactggtgaccagctggccattggaaaggaaacaggacgtcgcttggggatgggaaccaacatgtatccctcatctgctttgttaggacaggacaaggacgagtctattgctgctttacctgtagatgaactgatagaaaaagctgatggctttgctggcgtttttcctgagcacaaatatgagattgtaaagcgcctgcaggcaaggaaacatatctgtggaatgactggcgatggagtaaatgatgctcctgcccttaaaaaagctgacatagggatagctgttgctgatgctactgatgctgctcgcagtgcttcagacatagtccttacagagcctggtttgagtgttatcattagtgctgttttgaccagccgtgctatctttcagaggatgaaaaattacactatatatgcagtttcaatcactattcgtatagtgcttggtttcatgttgctggctctcatatggaaatttgacttcccaccatttatggtgcttatcattgccattctcaatgatggtacaataatgacgatatcaaaggatagagtaaaaccgtctcctttgcctgatagctggaaactggctgaaattttcacaactggcattatacttggcggttacttggcaatgatgactgttatcttcttttgggtggcctataagacaaacttttttccacgaatctttggggtagcaactctcgagaaaactgctcatgatgacataaggaaattggcctcagcagtgtatcttcaagtaagcactataagtcaggctctcatatttgttactcgctctcgaagttggtctttcgtggaacgtcctgggttattactggttgcagcttttctggttgcacagctgattgctactttaattgcggtttatgcaaactggggctttgctgccattgaaggaattggatggggttgggccggtgttatctggctttacaacattatcttttacatcccacttgatctcattaagttctttatacgatatgctttgagtgggagggcttgggatcttgttattgaacagaggattgccttcacgagacaaaaggactttgggaaggaacaacgggagctacaatgggctcatgcgcaaagaacattacacggattgcaagcacccgatgccaaaatgttccacgaccgaactcatttcaccgagctcaatcagatggctgaagaagccaaaaggagagctgaaattgcaaggttgagggaactacacaccttgaaaggccatgttgaatcagtggtgaggctgaaaggacttgacattgacacaattcagcaagcttacacggtatgaagaagaaac

SEQ ID NO: 911 - DNA, 3203 bp, Glycine max
atgggggacaagtcccaagttttggaggctgttttgaaggaaactgttgatttggagaacatacccattgaggaggttcttgagaatctgagatgtggcagagaagggctcagcagtgaagctgctgaggagaggctcaccatttttggtcacaacaagctagaagagaagaaagagagcaaatttttgaagttcttgggatttatgtggaatcctctgtcatgggttatggaggctgctgctataatggctattgctcttgcaaatggaggggggaaggctcctgattggcaagactttgtgggtatcattaccttgcttctcatcaattcaactatcagtttcattgaggagaacaatgctggtaatgctgcagcagctctcatggctcggctcgctccgaaagcaaaggttcttcgagatggtaggtggaatgagcaagatgctgcggtcctggttcccggtgacataatcagcatcaaacttggagatattattcctgcagatgcccggcttcttgaaggggatcctttgaaaattgatcaatctgcacttaccggtgagtcactgccagtgacaaagggtcctggtgatggagtatattctggttctacatgcaaacaaggagagattgaagctgtggtcattgctactggtgttcatactttctttgggaaagctgctcatcttgtggatactaccaatcaagtcggtcactttcaaaaggtcttgactgcaattgggaacttctgcatatgttcaattgcattggggatggttattgaaattattgttatgtatcccatccaagatcggccatatcgttctggaattgataacctccttgtacttctcattggaggaattccaattgccatgcccacagttttgtctgtgaccatggccattggttctcacaggctagctcagcagggggccatcaccaagaggatgacagccattgaagagatggcaggcatggatgtgctttgcagtgataaaactgggactctgacattgaataagcttactgttgacaaaaatcttgttgaggtttttgcaaaaggagtggatccagatactgttattttgatggcggcccgagcttcaaggcttgagaatcaagatgcaattgatacagccatagttgggatgttggctgatccaaaggaggcacgtgctggcatacaagaagtacattttcttcctttcaatcctaccgataagcggacagcattgacttatcttgatcaagatggcaaaatgcatagagtaagcaaaggtgcaccagaacagatcctgaatcttgcacacaataaggcagacattgaacgtagagttcattcagtgatagacaagtttgcagagcgtggtttacgatctcttgctgtagcataccaagaagttcctgatggaaggaaagagagtgctggaggcccgtggcaatttattggccttttgtctctctttgacccacctaggcatgatagtgcagaaacaatacgaagggcactaaaccttggagtaaatgtcaaaatgattacaggggatcagcttgctataggaaaggaaacaggtcgtcgcttgggaatgggtaccaacatgtatccttcatcagctttacttgggcaggacaaggatgaatccattgttgccttgccaattgatgaactaatagaaaaggctgatggatttgctggtgtatttcctgagcacaagtatgagatcgtgaaacgcttgcaagctaggaaacatatttgtggaatgactggtgatggagtgaacgatgcacctgccctcaagaaagcagacattggtatagctgttgctgatgctactgatgcagctcgcagtgcatctgatattgttctaacagaacctggacttagtgttattattagtgctgttttgacaagccgagcaatcttccagagaatgaaaaattatacaatttatgcagtatcaattacaatacgtattgtgcttggtttcatgttgctggctctcatttggaagtttgactttccaccctttatggtgcttattatcgctatcctaaatgatggtactattatgacaatttcaaaagatcgtgtaaaaccatctcctctgccagatagctggaagctagcagagatatttactactggagttgtgcttggaagttacctggcaatgatgacagttatattcttttgggcggcatacaaaactaactttttcccgcgagtgtttggagtcccaactcttgaaaaaactgctcatgatgattaccggaaacttgcctctgcaatctatcttcaagtgagcactattagtcaggctcttatatttgtaactcgatctcgaggttggtcttatgttgagcgtcctggtttattgctggtgtttgcttttattgttgctcaactgattgccaccttgattgcagtatatggaaactggagcttttgctcaattgaaggaataggttggggttgggctggtgttatatggttatataacatcatattctacatcccacttgatatcattaaatttttaattcgctatgctctgagtggtagggcttgggaccttgtcattgagcaaaggattgcattcacaaggcaaaaggactttggaaaggaacaacgtgaactacaatgggcacatgcgcaaagaacattgcatggattacaaccagctgacaccaagttcaatgagcgtacacatgtcaatgaactcaatcaaatggccgaagaagctaaaaggagagctgaaattgcaaggttgagagaactgcatacactaaaaggtcacgtagaatcagttgtgagattgaaggggcttgacatagacacaattcagcaagcatacacagtctaaagatgcttatatatatttgcatacttatactgtaaagagttacattctgatgttgctgaagaaccatataatgtaatatgatcacacacttcaactttaatgtcctttttactctgccgtctgttttgagcacttaaaggagtgcttttgtgaggtcactttatgtcatcttgtttcttgttatcactctatctgtcacacattctccacaatttcatgatgccatgaacgaagagaaattcatattcacccttgtatcttatgcttctgatttcattttctatctatgtacctcaatttctttcatctttggaaattaattataaagtttgaag

SEQ ID NO: 912 - DNA, 3297 bp, Glycine max
tggtctatcatgggtgacaagtcccaagtattggaggctgtgttgaaggaagctgtagatttggagaacattcccattgaggaggtttttgagaatctgagatgtagcaaagaaggtctcagcagtgaggctgctgaggagaggttggtcatttttggccacaacaaacttgaagagaaaaaggagagcaaattcttgaagttcttggggtttatgtggaatcctctgtcttgggttatggaggctgctgctataatggcaattgcacttgccaatggaggggggaagccccctgattggcaagattttgttggtatcattaccttgcttatcatcaattcaactatcagtttcattgaggagaacaatgctggtaatgctgcggcggctctcatggctcggcttgctccgaaagcaaaggttcttcgtgatggtagatggaatgagcaagatgcctcggtcctggttcctggtgacatagttagcattaagcttggtgatattataccagctgatgctcgtcttcttgaaggggatcctttgaaaattgatcagtctgctcttactggtgagtcccttccggtgacgaagggccctggtgatggagtgtattctggttctacctgcaagcaaggagagattgaagccgtggtcattgccaccggcgttcataccttctttgggaaagctgctcaccttgttgataccactaatcaagttgggcactttcaaaaggtgttgactgcaattggaaacttctgcatatgttcaattgctgtggggatggttattgagattattgttatgtatcccattcaagatcgagaatatcgccctggaatcgataaccttcttgtgcttcttattggtggaattccaattgccatgcccactgtcctctcagtgactatggccattggttctcacaggctatcacagcagggggctatcacaaagagaatgacagctattgaagagatggcaggcatggatgtgctttgcagtgataagactgggaccctaacactaaataagcttactgttgacaaaaatcttatagaggtttttgcaaaaggagtggatgcggatactgttgttttgatggcagctcaagcttcaagacttgagaatcaagatgcaatagacactgccatagttggaatgttggctgatcccaaagaggctcggcttggtatccaagaagtacattttcttcctttcaatcccactgataagaggacggcattgacttatattgatcgtaatgggaaaatgcatagagtaagcaaaggtgctccagaacagattcttaatctcgcacacaataaatcagacattgagcgtagagttcatgcagttatagataagtttgcagagcgtggtttaagatcccttgcagtagcattccaggatgttcctgatggaagaaaagagagtccaggtggcccgtggcagtttattggtcttttgcctctgtttgacccacctaggcatgacagtgcagaaacaatacgcagggcactaaaccttggagtgaatgtcaaaatgattacaggggatcaactagctataggaaaggaaactggccgtcgcttgggaatgggtaccaatatgtatccctcatctgcattgctcgggcaggataaggatgaatctatatctgctttacccgttgatgaactaattgaaaaggctgatggatttgctggtgtttttcctgagcacaagtatgaaattgtgaaacgcctgcaagctaggaaacacatctgtggaatgactggtgatggagtgaatgatgcacctgcactcaagaaggccgacattggtatagctgttgctgatgcaactgatgcagctcggagtgcatctgatattgttttaacagaacctggtcttagtgttattattagtgcagtgttgacaagccgtgctatcttccagagaatgaaaaattatacaatttatgctgtctcaattacaattcgtatagtacttggctttatgttactggctctcatatggaagtttgattttccaccttttatggtgcttattatcgccattctaaatgatggtactatcatgactatttcaaaagatcgagtaaaaccatcacctctgccggatagctggaagctagctgagatatttacaactggcgttgtgcttggaagttacttggcaatgatgacagtcatattcttttgggcagcatacaaaaccaatttcttcccgcgagtatttggagtttctactcttgagaaaactgctcatcatgatttccgaaaacttgcctctgcaatctatcttcaagtgagcactattagtcaggccctaatatttgtgactcggtcacggggttggtcttatgttgaacgtcctggtattttgcttgtgacagctttcgtgattgctcagctaattgccactttgattgcggtatatgccaactggagctttgctgccatcgaaggcataggttggggatgggctggagtgatatggttatacaacataatattctatatcccacttgaccccatcaagtttttaattcgatatgctttgagtgggagggcttgggagcttgtcattgagcaaaggattgcattcacaaggcaaaaggactttggaaaggaacaaagggaacttcaatgggcacatgcacaaagaacattgcatggattacaaccacctgacaccaagatgttcaccgagcgcccacatttcaacgaactcaaccaaatggctgaagaagctaaaaggagagctgaaattgcacggctgcgagagctgcatacactgaagggtcatgtagaatcagttttgaaattgaagggtattgatgtagacacaattcagcaagcatacacagtctgaatatgcttttatatatatttgcatactgatacaatccaatggtgctaactatattgaagaggaatagaagaaatataatgttgtttactcactccagttgagttcaatgtcctctcaccgttttgagcacttaaaaggggagtgctttgtaaggtcgatgttactatagctgtcactttttttctctacagttccataatgcaacaacggggagagccgttcatcttctatgcttctaaacgcatttttccttgtacttcactctcaatcccttcagagttcaaactttcaagttatgaatataagaaaaacacgttattttatggtttgtttaggaacagaaatattcaggggatgcgtactttgttgttaagaattcagttttgattaaaaggtagtatgcctatactattatgc

SEQ ID NO: 913 - DNA, 3288 bp, Glycine max
atgggtgacaagtcccaagtattggaggctgtgttgaaggaagctgtagatttggagaacattcccattgaggaggtttttgagaatctgagatgtagcaaagaaggtctcagcagtgaggctgctgaggagaggttggtcatttttggccacaacaaacttgaagagaaaaaggagagcaaattcttgaagttcttggggtttatgtggaatcctctgtcttgggttatggaggctgctgctataatggcaattgcacttgccaatggaggggggaagccccctgattggcaagattttgttggtatcattaccttgcttatcatcaattcaactatcagtttcattgaggagaacaatgctggtaatgctgcggcggctctcatggctcggcttgctccgaaagcaaaggttcttcgtgatggtagatggaatgagcaagatgcctcggtcctggttcctggtgacatagttagcattaagcttggtgatattataccagctgatgctcgtcttcttgaaggggatcctttgaaaattgatcagtctgctcttactggtgagtcccttccggtgacgaagggccctggtgatggagtgtattctggttctacctgcaagcaaggagagattgaagccgtggtcattgccaccggcgttcataccttctttgggaaagctgctcaccttgttgataccactaatcaagttgggcactttcaaaaggtgttgactgcaattggaaacttctgcatatgttcaattgctgtggggatggttattgagattattgttatgtatcccattcaagatcgagaatatcgccctggaatcgataaccttcttgtgcttcttattggtggaattccaattgccatgcccactgtcctctcagtgactatggccattggttctcacaggctatcacagcagggggctatcacaaagagaatgacagctattgaagagatggcaggcatggatgtgctttgcagtgataagactgggaccctaacactaaataagcttactgttgacaaaaatcttatagaggtttttgcaaaaggagtggatgcggatactgttgttttgatggcagctcaagcttcaagacttgagaatcaagatgcaatagacactgccatagttggaatgttggctgatcccaaagaggctcggcttggtatccaagaagtacattttcttcctttcaatcccactgataagaggacggcattgacttatattgatcgtaatgggaaaatgcatagagtaagcaaaggtgctccagaacagattcttaatctcgcacacaataaatcagacattgagcgtagagttcatgcagttatagataagtttgcagagcgtggtttaagatcccttgcagtagcattccaggatgttcctgatggaagaaaagagagtccaggtggcccgtggcagtttattggtcttttgcctctgtttgacccacctaggcatgacagtgcagaaacaatacgcagggcactaaaccttggagtgaatgtcaaaatgattacaggggatcaactagctataggaaaggaaactggccgtcgcttgggaatgggtaccaatatgtatccctcatctgcattgctcgggcaggataaggatgaatctatatctgctttacccgttgatgaactaattgaaaaggctgatggatttgctggtgtttttcctgagcacaagtatgaaattgtgaaacgcctgcaagctaggaaacacatctgtggaatgactggtgatggagtgaatgatgcacctgcactcaagaaggccgacattggtatagctgttgctgatgcaactgatgcagctcggagtgcatctgatattgttttaacagaacctggtcttagtgttattattagtgcagtgttgacaagccgtgctatcttccagagaatgaaaaattatacaatttatgctgtctcaattacaattcgtatagtacttggctttatgttactggctctcatatggaagtttgattttccaccttttatggtgcttattatcgccattctaaatgatggtactatcatgactatttcaaaagatcgagtaaaaccatcacctctgccggatagctggaagctagctgagatatttacaactggcgttgtgcttggaagttacttggcaatgatgacagtcatattcttttgggcagcatacaaaaccaatttcttcccgcgagtatttggagtttctactcttgagaaaactgctcatcatgatttccgaaaacttgcctctgcaatctatcttcaagtgagcactattagtcaggccctaatatttgtgactcggtcacggggttggtcttatgttgaacgtcctggtattttgcttgtgacagctttcgtgattgctcagctaattgccactttgattgcggtatatgccaactggagctttgctgccatcgaaggcataggttggggatgggctggagtgatatggttatacaacataatattctatatcccacttgaccccatcaagtttttaattcgatatgctttgagtgggagggcttgggagcttgtcattgagcaaaggattgcattcacaaggcaaaaggactttggaaaggaacaaagggaacttcaatgggcacatgcacaaagaacattgcatggattacaaccacctgacaccaagatgttcaccgagcgcccacatttcaacgaactcaaccaaatggctgaagaagctaaaaggagagctgaaattgcacggctgcgagagctgcatacactgaagggtcatgtagaatcagttttgaaattgaagggtattgatgtagacacaattcagcaagcatacacagtctgaatatgcttttatatatatttgcatactgatacaatccaatggtgctaactatattgaagaggaatagaagaaatataatgttgtttactcactccagttgagttcaatgtcctctcaccgttttgagcacttaaaaggggagtgctttgtaaggtcgatgttactatagctgtcactttttttctctacagttccataatgcaacaacggggagagccgttcatcttctatgcttctaaacgcatttttccttgtacttcactctcaatcccttcagagttcaaactttcaagttatgaatataagaaaaacacgttattttatggtttgtttaggaacagaaatattcaggggatgcgtactttgttgttaagaattcagttttgattaaaaggtagtatgcctatactattatgc

SEQ ID NO: 914 - DNA, 3485 bp, Prunus persica
gaaaaataattttcagggctctttaagaatttgacattaaaaaagagagagtagaaaaggttgtgactgttactgactgccactcctatactctctttagcggttcatcttcttggttcctgcttgcgtgtttggtggccgacgagggtccttctcatttgggtttccctaccataattgctatcaaagtcgagtttttgcaactggagatatagcgaaaaaagtgaggccgtattagagaggaagagagatatggcggagaagcctgaagtattggacgctgtgttgaaggaaactgtggatttggaaaatatacccattgaagaggtctttgagaatctgagatgtagcaaagagggcctcagcagtgaggctgctgaggaaagactgaccatttttgggcacaacaagcttgaagaaaagcaggagagcaaatttttgaagtttttgggttttatgtggaaccctctctcgtgggttatggaagctgctgctataatggccattgctcttgcaaatggaggaggtaagcctcccgactggcaagattttgtgggtattattactctccttgtcatcaattccactattagtttcatcgaggaaaacaatgccggtaatgcagcagcagcactcatggctcgtcttgctccaaaagccaaggtccttcgagatggaaggtggaatgagcaagaggctggggttctagtacctggtgacataatcagtattaagcttggtgatattgttccagctgatgctcgtctacttgaaggggatcctctgaaaattgaccagtctgcacttacaggcgagtctcttccggtgacaaaaagcccaggggatggtgtgtactccggttcgacttgcaaacaaggagagattgaagcagtggtcattgccactggtgttcatacctttttcgggaaagctgctcaccttgttgatagcactaatcaagtgggccacttccaaaaggtcttgactgcaattgggaatttctgcatatgttccattgctgtggggatggtaatagagattattgtcatgtacccgatacaagaccgagactatcgtcctggaattgacaacttgctcgtgcttctcattggtggaattccaattgcaatgcccacagttctgtcagtgacaatggctattgggtctcatagattatcacagcagggagctattacaaagagaatgacagcaattgaagagatggcaggaatggatgtcctttgcagtgacaagactggaactctaacattaaataagcttactgttgacaaaaatcttattgaggtctttgcaaagggaatggatccagatactgttgtgctgatggcagctcgagcctccagagtggagaatcaagatgcaatagatactgctatagttgggatgctcgctgatcctaaggaggcacgtgctggtgttcaagaattacacttccttcctttcaaccctactgataaacgaactgcattaacgtatcttgaccgtgatggtaaaatgcatagagtaagcaaaggtgcaccagagcagattctaaaccttgcccacaataagtcagacattgagcgtagagttcatgctgttattgataagtttgctgagcgaggtttacgatctcttgcagtagcataccaggaagttccagaaggaaggaaagagagtgctggaggcccatggcagtttgttggcctaatgccactctttgacccacctaggcacgacagtgcagagacaataaggagggctttagatcttggtgtaaatgtgaagatgattacaggggatcaactggccataggaaaggaaactggacgtcgcttggggatgggaaccaacatgtatccttcatctgctttgctaggacaggacaaggatgagtcgattgttgctttaccgattgacgagctgatagaaaaagctgatggctttgctggtgttttcccagagcacaaatacgagattgtgaaacgcttgcaagctaggaaacatatctgcggaatgactggtgatggagttaatgatgctcctgccctaaaaaaagctgatattggtatagctgttgctgatgcaacagatgcagctcgcagtgcttctgatattgtgctaactgaacctggccttagtgtcatcattagtgctgttttgaccagtcgggcaatcttccagaggatgaaaaattacacaatatatgctgtttccatcacaattcgtattgtgcttggtttcatgttgctcgccctcatatggaagtttgattttccacctttcatggtgcttattattgccatcctcaatgatggcactatcatgacgatatcaaaggatagggttaaaccatctcctctgccagatagctggaagctggccgagatttttacaactggagttgtgcttggtagttacttggcaattatgactgtgatattcttttgggcagcatacaaaacagacttcttcccaagagtatttggggtgtcaacccttgagaaaacagctaatgatgacttccggaagcttgcctctgctatatatctacaagtgagcattatcagtcaggctctcatatttgttactcggtctcgaagttggtcgtttgttgagcgtcctggattgttgcttgtggtggcttttgtgatagctcagctgattgccaccttgattgcagtctatgcaaattggagttttgctgccattgaagggattggatggggttgggctggggtgatctggctttataacctcgtcttctatttccctctggatatcataaaattcatgatacgctatgcgctgagcgggaaggcttgggatcttctcattgagcaaaggattgctttcacaaggcaaaaggatttcggaaaggaacagcgtgagcttcaatgggcacatgcacaaagaacattgcatgggctgcaaccacctgataccaagatgtttacagaacgcacacatttcacagaactcaatcagatggctgaagaagccaaaagaagagctgagattgcaaggttgagggagctccacacactgaaaggtcacgtagaatcggtggtgagattgaagggacttgacatcgacacaattcagcaagcatacacagtttaagggagacataatttatttaccttgctatactgtataagatgatgatgatgattccccctagtgtgctgagagtaaagacgtgtactcagcatgttgtgagtaaccttcagtagacagtcattttaaatttgctactggtgctttcagtttttggcatgtaaaatgagtgctgcaatcagctgttttctactttttcctcccccgtctgcccccttccctcttgtgtcaagtctcacatgactaggggacacgtaaacggaaataaactgctcctcaagtgatccaaaccattcatgaaatgttttcacttacattaaatgggtttataaagaaggctaaaatgcatttctggaaaaaaaaaa

SEQ ID NO: 915 - DNA, 3173 bp, Juglans hindsii x Juglans regia
atggcggagaagcctgaagtattggatgctgttttgaaggaagttgtggatttggaaaacatacccattgaagaagtgtttgagaatctgagatgtagcaaggagggtctcaccacggtggctgccgaggagaggctggccattttcgggcacaacaagcttgaagagaaaaaagatagcaaattcctgaagtttttggggttcatgtggaaccctttgtcttgggtgatggaagctgctgctatcatggcgattgcgcttgcgaatggaggagggaagcccccagactggcaagattttgtgggtatcatagtcctactttttatcaattcaacaattagtttcattgaggaaaacaatgctggtaatgctgcggcggctctcatggctcgtctagctccaaaagcgaaggttcttcgagatggaaagtggagtgagtatgatgctgcggtactagttcctggtgacattgtcagtattaaactgggagatattataccggctgatgctcgacttcttgatggagatccattgaaaattgaccagtctgcacttactggtgagtcgcttcctgtgacgaaaggtcctggagatggtgtctactctggttcaacttgcaaacagggagaaattgaagctgtggtcattgccactggggtccatacattctttgggaaggctgctcaccttgttgacaccaccaaccaagtgggccacttccaaaaggtcttgactgcaattggcaatttctgtatatgttcaattgctgtgggtatgattatagagataattgtcatgtatcctattcaagaccggaagtatcgccctggaattgacaatcttctagttcttctcattggaggaattccgattgccatgcctacagttctctctgttacaatggctattggttctcataggttatctcagcagggagctatcacaaagaggatgacagcaattgaagagatggcaggcatggacgtactttgcagtgacaagactggaacattgacactgaacaagcttagtgttgacaaggctcttattgaggttttcaccaaaggagttgatgcggatgctgttgtcctgatggctgctcgagcctctagagtggagaatcaagatgcaattgattcggctatagttgggatgttggctgatccaaaggaggcacgtgctggaattcaagaagtgcatttcctcccttttaatcctactgataagcgaacagccttgacttatattgaccgtgatggtaaaatgcacagagtcagcaaaggtgcaccagaacagattctgaaccttgcacataataagtcagacattgagcgtagagttcatgctgtgatcgataagtttgcagagcgaggtttacgatctcttgctgtcgcataccaggaagttccggaaggaaggaaagagagtgctggaggaccgtggcagtttatcggtctaatgcctctctttgacccgcctagacatgacagtgctgagacaataaggagggctttaaaccttggagtgaatgtgaaaatgattacaggtgatcaacttgcaataggaaaggaaaccggacgtcggttgggaatgggtacaaacatgtatccttcatctgctttgctaggacagaacaaggatgagtctattgctgctttaccaattgatgagctgatagagaaagctgatggctttgctggggttttccctgagcacaaatacgagattgtgaagcgcttgcaagcaaggaaacatatatgtggcatgactggtgatggagtgaatgatgcacctgctctcaaaaaagctgacattgggatagctgttgctgatgcaacagatgcagctcgcagtgcttctgacattgtcctcacagaacctggtcttagtgttatcattagtgctgtcttgaccagtcgggcaatctttcagaggatgaaaaactacacaatttatgcggtttccattactatccgtattgtgcttggcttcatgttgctcgcactaatatgggagtttgactttccgccctttatggtgcttatcattgccatcctcaatgatggtaccatcatgaccatatcaaaagatagggtgaaaccatctcctttaccggatagttggaagctgtctgagatttttacgacaggcattattcttggtagttacctggcaatgatgacagttatatttttctgggctgcatacaagacagacttcttcccgcgcatatttggggtgccgacccttgagaaaacagctcatgatgatatccgaaagcttgcttcagctatatatctgcaagtgagcatcattagtcaggccctcatatttgtgacacgatctagaagttggtccttcattgaacgtccggggtttttgcttgtagtggcttttattattgctcaactgattgccactttgattgctgtctatgctagctggagctttgctgcgattgaagggattggatggggttgggctggcgtgatctggctttataacataatcttctatttccctctcgatttcatcaagttttttatacgctatgctctaagtgggagggcttgggatcttgtcattgaacagaggattgctttcacgagacaaaaggactttgggaaggaacaacgggagctccaatgggcacatgcgcagagaacattgcatgggttgcagccacctgactccaagatgtttaccgaacgaacacatttcacagaactcaatcaaatagccgaagaagctaaaagaagagctgaaattgcaaggctgagagaactcaatacactgaaagggcatgtggaatctgtggtgagactgaagggccttgacatagacacaattcagcaatcatacacagtctgagggggacctcatttatcatctttactcagtactgtgaaagatgcttcaactagtgctgaagagtaaaaagcttcgatcaacagccttgtgagtttacccccaaacaactttttgatattgtgatatgctaaaatgcccatttccagatcttatgtacttttgtgtttttggacccctttgtaatgcacaataatagtgagtgctttataatattgatgtggcatatgttctgttgttatgggtaaaactagtgaatttacccagaacttagacaaccagagtataagaacagcaattcagag

SEQ ID NO: 916 - DNA, 3251 bp, Glycine max
catgggtgacaagtctcaagtattggaggctgtgttgaaggaagctgtagatttggagaacattcccattgaggaggtttttgagaatctgagatgtagcaaagagggtctcagcagtgaggctgctgaggagaggctggtcatttttggccacaacaagcttgaagagaaaaaggagagcaagttcttgaagttcttggggtttatgtggaatcctctgtcttgggttatggaggctgctgctataatggcaattgcacttgccaatggaggggggaagccccctgattggcaagattttgttggtatcatcaccttgcttctcatcaattcaactatcagtttcattgaggagaacaatgcaggtaatgctgcggcggctctcatggctcggcttgctccgaaagcaaaggtcctccgcgatggtagatggaatgagcaagatgcctcggtcctggttcctggtgacatagttagcattaaacttggtgatattataccggctgatgctcgtcttcttgaaggggatcctttgaaaattgatcagtctgctcttactggtgagtcccttccggtgacaaagggccctggcgatggagtatattctggttctacctgcaagcaaggagagattgaagctgtggtcattgccaccggcgtccataccttctttgggaaagctgctcaccttgttgataccactaatcaagtggggcactttcaaaaggtgttgactgcaattgggaacttctgcatttgttcaattgctgtggggatggttattgagattatcgttatgtatcccatccaagatcgagaatatcgccctggaattgataaccttcttgtgcttcttattggtggaattccaattgccatgcccactgtcctctcagtgactatggccattggttctcataggctatcacagcagggggctatcacaaagagaatgacagctattgaagagatggcaggcatggatgtgctttgcagtgataagactgggaccctaacactaaataagcttactgttgacaaaaatcttattgaggtttttacaaaaggagtggatgcggatactgtggttttgatggcagctcaagcttcaagacttgagaatcaagatgcaatagacactgccatagttggaatgttggctgatccaaaagaggctcgtcttggtatccaagaagtacattttcttcctttcaatcccactgataagaggacagcattgacttatattgatcgtaatgggaaaatgcatagagtaagcaaaggtgctccagaacagatccttaatcttgcacacaataaatcggacattgaacgtagagttcatgcagttatagataagtttgcagagcgtggtttacgatcccttgcagtagcattccaggatgttcctgatggaaggaaagagagtacaggtggcccatggcagtttattggtcttttgcctctgttcgacccacctaggcatgacagtgcagaaacaatacgcagggcactaaaccttggagtgaatgtcaaaatgattacaggggatcagctagctataggaaaggaaaccggccgtcgcttgggaatgggtaccaatatgtatccttcatctgcattgcttgggcaggataaggatgaatccatatctgctttacccattgatgaactaattgaaaaggctgatggatttgctggtgtttttcctgaacacaagtatgagattgtgaaacgcctgcaagctaggaaacatatttgtggaatgaccggtgatggagtgaatgatgcgcctgcactcaagaaggcagacattggtatagctgttgctgatgcaactgatgcagctcggagtgcatctgatattgttttaacagaacctggtcttagtgttattattagtgcagtgttgacaagccgagctatcttccagagaatgaaaaattatacaatttatgctgtctcgattacaattcgtatagtacttggtttcatgttactggctctcatatggaagtttgattttccaccttttatggtgcttattatcgccattctaaatgacggtactatcatgactatttcaaaagatcgagtaaaaccatcacctctgccggatagctggaagctagctgagatatttacaactggtgttgtgcttggaagttacttggcaatgatgacagtcatattcttttgggcagcatacaaaaccaatttcttcccgcgagtatttggagtttctactcttgagaaaactgctcatgatgatttccgaaaactggcctctgcaatctatcttcaagtgagcactattagtcaggccctaatatttgtgactcggtcgcggggttggtcttatgttgaacgtcctggtattttgctagtgacagcttttgtgattgctcagctgattgccactttgattgcagtatatgccaattggagctttgctgcaattgaaggcataggttggggttgggctggtgtaatatggttatataacataatattctacattccacttgaccccatcaagtttttaattcgatatgctttgagcgggagggcttgggagcttgtcatcgagcaaaggattgcattcacaaggcaaaaggactttggaaaggaacaaagggaacttcaatgggcccatgcacaaagaacattgcatggacttcagccacctgacaccaagatgttcaccgagcgcacacatttcaatgaactcaatcaaatggctgaagaagctaaaaggagagccgaaattgcaaggctgcgagaactgcatacactaaaggggcacgtagaatcagttttgaaattgaaggggattgatgtagacacaattcagcaggcatacacagtctgaatatgttttttttttttttttttttttatatatatatttgcatactgatactgtaaagggtgggggcacaatccaatggtgctgacgacttctgagaggaatagaacctaatgatgtttacactcgagttgagttcaatgtcctctcaccgttttgagcacttaaaaggagtgctttgtaaggtctatttacatatgcttcttgtttcctgtggtcactatagctgtcacttttttttctaaagtttcattgtttatactgcaacggggagaggcgttcatcttctatgtttctaaacccattttcccttgtactttactctcaaaccctttagagttcaaactttgaagttctgaatataagaaaatcacgttatttt

SEQ ID NO: 917 - DNA, 3227 bp, Glycine max
atgggtgacaagtctcaagtattggaggctgtgttgaaggaagctgtagatttggagaacattcccattgaggaggtttttgagaatctgagatgtagcaaagagggtctcagcagtgaggctgctgaggagaggctggtcatttttggccacaacaagcttgaagagaaaaaggagagcaagttcttgaagttcttggggtttatgtggaatcctctgtcttgggttatggaggctgctgctataatggcaattgcacttgccaatggaggggggaagccccctgattggcaagattttgttggtatcatcaccttgcttctcatcaattcaactatcagtttcattgaggagaacaatgcaggtaatgctgcggcggctctcatggctcggcttgctccgaaagcaaaggtcctccgcgatggtagatggaatgagcaagatgcctcggtcctggttcctggtgacatagttagcattaaacttggtgatattataccggctgatgctcgtcttcttgaaggggatcctttgaaaattgatcagtctgctcttactggtgagtcccttccggtgacaaagggccctggcgatggagtatattctggttctacctgcaagcaaggagagattgaagctgtggtcattgccaccggcgtccataccttctttgggaaagctgctcaccttgttgataccactaatcaagtggggcactttcaaaaggtgttgactgcaattgggaacttctgcatttgttcaattgctgtggggatggttattgagattatcgttatgtatcccatccaagatcgagaatatcgccctggaattgataaccttcttgtgcttcttattggtggaattccaattgccatgcccactgtcctctcagtgactatggccattggttctcataggctatcacagcagggggctatcacaaagagaatgacagctattgaagagatggcaggcatggatgtgctttgcagtgataagactgggaccctaacactaaataagcttactgttgacaaaaatcttattgaggtttttacaaaaggagtggatgcggatactgtggttttgatggcagctcaagcttcaagacttgagaatcaagatgcaatagacactgccatagttggaatgttggctgatccaaaagaggctcgtcttggtatccaagaagtacattttcttcctttcaatcccactgataagaggacagcattgacttatattgatcgtaatgggaaaatgcatagagtaagcaaaggtgctccagaacagatccttaatcttgcacacaataaatcggacattgaacgtagagttcatgcagttatagataagtttgcagagcgtggtttacgatcccttgcagtagcattccaggatgttcctgatggaaggaaagagagtacaggtggcccatggcagtttattggtcttttgcctctgttcgacccacctaggcatgacagtgcagaaacaatacgcagggcactaaaccttggagtgaatgtcaaaatgattacaggggatcagctagctataggaaaggaaaccggccgtcgcttgggaatgggtaccaatatgtatccttcatctgcattgcttgggcaggataaggatgaatccatatctgctttacccattgatgaactaattgaaaaggctgatggatttgctggtgtttttcctgaacacaagtatgagattgtgaaacgcctgcaagctaggaaacatatttgtggaatgaccggtgatggagtgaatgatgcgcctgcactcaagaaggcagacattggtatagctgttgctgatgcaactgatgcagctcggagtgcatctgatattgttttaacagaacctggtcttagtgttattattagtgcagtgttgacaagccgagctatcttccagagaatgaaaaattatacaatttatgctgtctcgattacaattcgtatagtacttggtttcatgttactggctctcatatggaagtttgattttccaccttttatggtgcttattatcgccattctaaatgacggtactatcatgactatttcaaaagatcgagtaaaaccatcacctctgccggatagctggaagctagctgagatatttacaactggtgttgtgcttggaagttacttggcaatgatgacagtcatattcttttgggcagcatacaaaaccaatttcttcccgcgagtatttggagtttctactcttgagaaaactgctcatgatgatttccgaaaactggcctctgcaatctatcttcaagtgagcactattagtcaggccctaatatttgtgactcggtcgcggggttggtcttatgttgaacgtcctggtattttgctagtgacagcttttgtgattgctcagctgattgccactttgattgcagtatatgccaattggagctttgctgcaattgaaggcataggttggggttgggctggtgtaatatggttatataacataatattctacattccacttgaccccatcaagtttttaattcgatatgctttgagcgggagggcttgggagcttgtcatcgagcaaaggattgcattcacaaggcaaaaggactttggaaaggaacaaagggaacttcaatgggcccatgcacaaagaacattgcatggacttcagccacctgacaccaagatgttcaccgagcgcacacatttcaatgaactcaatcaaatggctgaagaagctaaaaggagagccgaaattgcaaggctgcgagaactgcatacactaaaggggcacgtagaatcagttttgaaattgaaggggattgatgtagacacaattcagcaggcatacacagtctgaatatgttttttttttttttttttttttatatatatatttgcatactgatactgtaaagggtgggggcacaatccaatggtgctgacgacttctgagaggaatagaacctaatgatgtttacactcgagttgagttcaatgtcctctcaccgttttgagcacttaaaaggagtgctttgtaaggtctatttacatatgcttcttgtttcctgtggtcactatagctgtcacttttttttctaaagtttcattgtttatactgcaacggggagaggcgttcatcttctatgtttctaaacccattttcccttgtactttactctcaaaccctttagagttcaaactttgaagttctga

SEQ ID NO: 918 - DNA, 3237 bp, Solanum lycopersicum
agtcttccacactctgttttggatttggtgggcgatttaccaatcttatttctggacccgagaaaaatcctatctttctttggaagagaggaaattgagcaagatgggggagaaacctgaggtgttagatgctgtattaaaggagactgtggatttggagaatatacccattgaagaagtttttgaaaatttgagatgtaccaaagagggtcttactggtacagctgcccaagaaaggttggcaatttttgggtacaacaaactagaggagaagaaggagagcaaattcttgaaatttctggggtttatgtggaaccccctctcatgggttatggaagctgctgctattatggcaattgctcttgcaaatggaggaggaaagcctccggattggcaagattttgtgggtattattaccttgctagtgattaactcaacaattagttttattgaggagaataatgctggcaatgcagcagctgctctcatggctcgtctcgctcctaaagccaaggttcttcgagatggaaaatggaatgaagaagatgctgctgttcttgttcctggggacattatcagtattaaactgggagatattattcctgcagatgctcgtcttcttgaaggtgatcccctgaaaattgaccagtctgctttgactggtgaatctcttcctgtaactaaaggtcctggagatggtgtctactctggttctacctgtaagcagggagagatagaagctgtcgtcatcgccactggggttcataccttttttgggaaggctgcacaccttgttgacagtacaaatcaagtgggacacttccaaaaggcaagttttgactgctattggaaacttctgcatctgttctattgcagtggggatgataatagagatcattgtgatgtaccctatccaacaccgcaaatatcgccctgggattgacaatcttcttgtccttctcattggtggaattccaattgccatgccaacggttctttcagtcacgatggcaattggatctcatcggctcgctcaacagggtgctattacgaaaagaatgacagctattgaggagatggctggtatggacgtgctttgtagtgacaagacagggacccttacactaaacaagcttactgttgacaaaaaccttgttgaggtttttgccaaaggtgttgacgcagatactgtcgttctgatggcagctcgagcgtctcgtacagagaaccaggatgccattgacactgctattgttgggatgttgtctgacccgaaggaggctcgtgctggcattcgtgaaatacactttcttcctttcaatccaactgacaagcgtacagcgcttacttatcttgatggtgaaggaaaaatgcacagggtcagcaaaggggcaccagagcagatcctaaatcttgcacacaacaagtcagacatagaacgtagagttcatgcggtgattgataagtttgctgagaggggtttgcgctcacttggtgtggcctaccaggaagttccagagggaaggaaggagagttccggaggaccatggcaattcattggtctcctgcctttgtttgatcctccaagacacgacagtgctgagactataaggagggctttgaatcttggagtgaatgttaaaatgatcacaggggatcaactggctataggaaaagaaacagggcgtcgtctgggaatgggaaccaacatgtatccttcatctgctctgttggggcagactaaggatgaatcaattgcttctttaccaattgatgaactgatagaaaaggctgatggttttgctggagtattccctgagcacaaatatgagattgtaaaacgcttgcaagctaggaagcatatctgtggaatgactggagatggagtcaatgacgctcctgctttaaagaaggctgatattgggatagctgttgatgatgccactgatgctgctcgtagtgcttctgacattgttcttactgaacctggtctcagtgtcatcattagtgctgttctgactagtcgagcaatctttcaaaggatgaaaaactatacgatatatgctgtttccatcacaatccgtattgtgcttggttttatgcttctggcccttatctggaagtttgactttccacctttcatggtgcttatcattgcaatcctcaatgacggtaccattatgacaatatcaaaggatagggtcaaaccatctcctctgcctgatagttggaagctggctgagattttcactactggggttgttcttggtggctacttggcaatgatgacagtcattttcttttgggcagcatatgagacagatttcttcccgcgtgtatttggggtatcaacacttcagaggacagcaactgatgacttcaggaaacttgcatcagcaatttaccttcaagtgagcactatcagtcaggccctgatatttgtcacaagatctcgaagttggtcgtttgttgagcgtcctggtttgttgcttgtggttgcttttctgattgctcaactggttgccaccttgattgctgtttatgcaagttggagctttgctgcaatcgaaggaattggctggggttgggcaggagtgatctggctctacaatttagtattctacttcccgcttgatatcatcaagttcttaatcagatatgctctcagtggaagggcctgggatcttgttcttgagcaaaggattgctttcaccaggaagaaggatttcggaaaagaacaacgtgagcttcaatgggcccacgcacagaggacccttcatgggctgcaagttcctgacaccaaattgtttagtgaagctaccaatttcaatgagcttaatcagttagctgaggaagcaaagaggagagctgaaatcgctaggcaacgtgagctgcacacacttaaaggtcacgtggaatcagtggtgaagttgaagggtcttgacatagagacaattcagcagtcatacactgtttgatgtgggagcaagtatgactagtgctacttaactggtgagtgggtgatagaatgaagacataatgagtgtgtgagttacctctggagcgacaagttcatagtagtaacatcttcagcgtttaaaagtgccttatatattttatacatttttttgctttgaattcttggttcatcttttcctgctttcatgtcttgactacattatatatgttacaattgaccaagaatgaatattaagctataacagcattcattatcta

SEQ ID NO: 919 - DNA, 2930 bp, Cucumis sativus
aataaatgggggaaaaaccagaagtgctggaggctgtgttgaaggaagctgtggatttggaaaatatacccattgatgaggtttttgaaaatctgagatgtagcaaagagggtcttactagtgagggtgctgaggaaaggctgaagatttttggccacaataagcttgaggaaaagaaggaaagcaaagttttgaagtttttgggtttcatgtggaatcctctatcatgggttatggaagctgctgcaattatggccattgcacttgcaaatggaggaggaaagcccccggattggcaagattttgttggtatcatcaccctgcttatcattaactctacaatcagttttattgaggaaaacaatgcaggaaatgctgcagctgctctcatggctcgtcttgctcccaaagccaaggttcttagagatggaaggtggagcgagcaagatgcttccattttagttcctggggacgtaatcagtgttaaacttggggacattattccagctgatgctcgtcttctggatggggatccactaaaaattgaccagtctgcgcttacaggcgaatctcttcctgtaacgaaaggacctggtgatggtgtgtactccggttctacttgcaagcaaggagagattgaagctgtggtcattgctactggtgtccacaccttttttggtaaagctgctcatcttgttgacaccaccaaccaagtgggacacttccaaaaggcaagaagatgtgtcttgacagccatagggaatttctgcatatgttccattgctttgggaatggtaatagagatcattgtaatgtacccaattcaggaccgagagtatcgtcctggaattgataacctccttgtgctattgattggaggaattcctatagccatgcctacagttctatctgtgacaatggctattggttctcataggttatcccaacagggtgccatcacgaagaggatgacggcaattgaagaaatggcaggcatggatgtcctttgcagtgataagacgggaaccctaactttgaacaagttaactgttgacaaaaatcttgttgaggttttcggtaaaggtatagatgcagacactattgttctaatggctgctcgagcatcaagaattgagaatcaagatgctattgatactgccattgttgggatgctagctgatccaaaggaggcacgtgctgggattcaggaagtacattttcttcctttcaatcctactgataagcgaacagctttgacttatattgaccacgagggcaagatgcacagagtcagtaaaggtgctccagaacagattctaaatcttgcatacaacaagtcagagattgagagaagagttcatgcagtgattgataaatttgctgaacgaggtttgcgttcgcttgctgtagcataccaggaagttccagaaggaagaaaagaaagtcctggaggtccctggcaattcatgggcctcttgcctttgtttgatccaccgagacatgatagtgcagagacaattaggagagctttaaatcttggagtaaacgtgaaaatgattaccggagatcagctggctataggcaaggaaacaggacgtcgattggggatgggaaccaacatgtatccatcatctgctttgctaggacaggaaaaggatgagtcaattgctgctttacctgttgacgatcttatcgagaaagcagatggttttgcgggtgtattccctgagcacaaatatgagattgtaaaacgcttgcaagctatgaaacatatctgtggtatgactggtgatggagtgaatgatgctcctgcacttaaaaaagcagacataggtatagctgttgcagatgcaactgatgctgctcggagtgcttctgatattgttcttaccgaacctggtctcagtgttatcatcagtgctgtcttgactagtagagcaatatttcagagaatgaagaattacacgatttatgcagtttccatcacaatacgtattgtgcttggtttcatgttgctggctctcatttggaaatttgattttccaccatttatggtgcttatcattgctatccttaatgatggtacaatcatgacaatatcgaaggatagggttaaaccgtctcctctgccagatagttggaagctggctgaaatttttactactggcgttgtacttggtagttacttggcaatgatgacggtcatatttttttgggcgtcgtataaaaccaactttttccctcgaatctttggagtatcaacccttgaaaaaacagctcatgatgatttccggaagctagcctcagctatatatctgcaagtgagcaccatcagccaggctctcatttttgttacgcgatctcgaagttggtcctacgttgagcgtcctgggttatttcttgtagtggcttttattcttgctcaactggttgctactctgattgctgtctatgctaattggagttttgctgccattgaaggaattggttggggttgggctggtgtaatttggctttataacatcatcttttatattcctcttgatcccataaagtttgctattcgatatgccttgagtgggaaggcttgggatctcatgcttgagcaaagggttgctttcacaagacaaaaggattttggtaaggaacaacgtgagctacaatgggctcacgcccaaagaaccctgcatggtttgcaaccgcctgatactaagatgttcaccgagagaactcatttcacagaactcaatcacatggctgaagaagccaaaaggagagctgaaattgctagattgagagaactccatacactgaaaggccatgtagagtcagtggtgagattgaagggtctcgatattgaaacgatccaacaagcatacaccgtgtaaggggatgttcaatactgtaatatactgtcttgtagttatatg

SEQ ID NO: 920 - DNA, 3434 bp, Oryza sativa
gccgtagtgtactcctcctatatagggcagcaaaggctgtggccgtccaagggcagcagcagcagcagcagcagcaaacgcagcaggcgaaggcgccggcttggagaggctggtggcttcgtggtctctctcttctctctccccctagcagcagcgcagaggcggaggaggggggagatggccgagaagggtgacaatctggaggccgtgctcaacgagtccgtcgatctcgagaacataccgttggaggaggtgttcgagcacctgcgatgcaaccgcgagggcctcacctccgccaatgccgagcagcgcctcaacctcttcggccccaacaggctcgaggagaagaaggagagcaagttcttgaagttcttggggttcatgtggaacccactgtcctgggtcatggaggccgccgcaatcatggccatcgctctcgccaatggaggagggaagccgccggactggcaggatttcgtgggcatcattacactgctcatcatcaactccacaatcagtttcattgaggagaacaatgccggcaatgccgccgccgctctcatggctcgcctcgcccccaaggccaaggttcttagaaatggaagatggagtgaagaggaagcagccatccttgtgccgggggacatcatcagcgtcaagcttggagatatcatccctgctgatgcccgtctccttgagggtgatccgttaaagattgatcagtctgcgcttaccggtgagtcccttccggtgaccaagggccctggagatggagtgtactctggctccacatgcaagcagggtgaaatcgaggctgttgtcattgcaaccggtgtgcacacgttcttcggcaaggccgcacatcttgtcgattcgacaaaccaagttggccatttccagaaggttctgactgccatcgggaacttctgcatctgttcaattgctattggaatggttgtagagattattgtcatgtaccccatccaacacagggattaccgaccagggattgacaatcttttggtgcttctgattggaggaattcccattgccatgcccactgttctttctgtgactatggcaatcgggtcacaccgcttggctcagcagggagcaattacaaagaggatgacagctattgaggaaatggctggtatggatgttctttgcagtgacaaaacaggaacactaaccttgaacaagttgactgtggataagagtcttattgaggttttccaaagaggtgttgaccaggatactgtcatactaatggctgccagagcttcacgtaccgaaaatcaggatgccatagatgccacaatagttggtatgcttgctgatccaaaagaggctcgtgctggtattcaagaggttcattttctgccattcaatccaactgacaaaaggactgctttaacctacattgatggtgaggggaaaatgcaccgtgtaagcaagggagcaccagaacagatccttaatcttgcacacaacaaaactgagattgaaagaagagtcagagctgtaattgacaaatttgctgagcgtggcttgcgatcacttggtgtggcataccagcaagtgccagatggtaggaaagaaagtcctggaggaccatggcaatttgttgggctcttgccactttttgaccctcctcgacacgatagtgcagaaacaatcaggagggcactcaaccttggtgtcaatgttaaaatgattacaggtgaccaacttgcaataggcaaggaaacagcacgccgcttgggaatgggtactaatatgtatccctcatctgctttactgggacaagataaggatgaatcaattgtggctttgccagttgatgaattaattgagaaagctgatggctttgctggagtctttcctgagcacaagtatgagattgtgaaacgcttgcaagcaagaaaacatatatgtggtatgactggagatggtgtgaatgatgctcccgctttgaagaaggctgatattggcattgctgtggacgactcgactgatgcagcccgtagtgcctccgatattgtcctaactgagccaggccttagtgtgattattagtgctgtgcttacaagtcgagcaattttccagaggatgaagaattacactatttatgctgtttcaattacaattcgtattgtgcttggttttatgcttcttgctctgatatggaagttcgatttcccaccatttatggtcctgatcattgccatcctcaatgacggtaccataatgaccatttcaaaggacagagtaaaaccatccccacaacctgatagctggaagttatctgagatttttgcaactggggtcgtccttggtagttacttggccatgatgacagtcattttcttctgggtagcatacaagactgatttcttcccgagagtgtttcacgttgaaagccttgaaaagactgctcaggatgactttcagaagcttgcatctgctgtctatcttcaagtcagcacaatcagccaggccctcatcttcgtaactcggtctcgcagctggtcatttgtggagcgcccaggattcttgttggtttttgctttctttgtagctcaactgattgctactctgattgctgtatatgccaactggggattcgcttcaatcaagggcattggatggggctgggctggtgtcatctggctctacaacatcgtcttttacttgccactggacatcatcaagttcctgatccgttatgcgttgagtgggagggcatgggatcttgttcttgagcaaaggattgctttcacaaggaagaaggatttcggcacacaagaaaaccagctcaagtgggcgactgctcagaggaccatccatgggctccagccagccgccaccgcggctgtcttccgcgacatgacaagctacaacgatctcaaccagcttgcagaagaggcccgtaggagagccgaaatcgcaaggttgagagagctgaccaccctgaaggggcggatggagtcggtggtgaagcagaagggcttggatcttgagaccatccagcagtcatacaccgtgtgattaacagagaatctccaatatatatatttattatatactatttataatgtgctaggccacaacaataatttacctggatgatgatgattgagcggatttccagtgtcggtgcggtgctaatcgctagagttcatcccccatctatcttgtgtccattaaccacccccggcagatgggcttgcattgagatactatatacaaactctttttactactagatgatataatagttcaattttgttttgtcagtctggttttgctgctgtttgtctctggttcttggccatctgaatcatgattaagggtatgtttggggagctttagattctgagaaaaaaatgtttggtagccagcttctgagaatctggaaaatctctgaaacc

SEQ ID NO: 921 - DNA, 3328 bp, Sorghum bicolor
gtgccgtgtgcgacagtcgccagcctgccctccccgcctgctgccggcccgcgcctgcccgaagccgagcgccgggacgccgaggagaggccagaggagaggccggaacgatggaggacaaggcgtccaacctggacgccgtgctcaaggaggccgtcgatctcgagaacataccgatcgaggaggtgttcgagaacctgcgatgcagcccgcagggtctctccacggagcaggccgagcagcgcctcgccatcttcgggcccaacaagctggaggagaagcaggagagcaagatcttcaagttcttgggattcatgtggaacccgctgtcctgggtcatggaggcggccgccatcatggccatcgcgctcgcgaacgggggaaacaagccgcccgactggcaggacttcgtggggatcattactctgctcatcatcaactccacaatcagcttcattgaggagaacaatgcgggcaatgctgccgccgctctcatggcgcgcctcgcccccaaggccaaggttctcagaaatggccggtggaccgaggaggaatcggcaatccttgtgccaggggacatcatcagtgtgaagcttggggatatcattccggctgacgctcgtctgcttgaaggggatccactgaaaattgatcagtctgcactcaccggcgagtcccttccggtgaccaaaggccctggtgatggagtgtactctggttccacttgcaaacagggtgagattgaggccgttgtcattgccactggtgtgcacacattctttggcaaggcagcacatcttgtcgattcaacaaaccaagttggtcatttccagaaggttctcactgccattgggaacttttgcatctgttcaattgctgtgggaatggtcgtggagcttatcgtcatgtaccctatccaacacaggggttacagaccaggaattgacaacctgttggtgcttctgattggaggaattccaattgccatgcccactgtcctttctgtgactatggcaattggggctcatcgcttggctcaacagggagcaattactaagagaatgacagcaattgaagaaatggctggcatggatgttctttgcagtgacaagactgggacattaaccttgaacaagttgactgtggacaagagtcttgtagaggttttccaaaaaggcattgaccaagatacagtaattctgatggctgccagagcttctcgtacagaaaaccaggatgccatagatgccacaatagttggtatgctggctgatccgaaggaggctcgtgctggtgttcgagagattcattttctgccatttaatccaactgacaaaagaactgctttaacctaccttgatggtgagggaagaatgcatcgtgttagcaagggagcaccagagcagatccttcatcttgcacacaacaagtcggatattgaaagaagggtcagagctgtgattgacaaatttgctgaacgtggtttgcgagcacttggtgtagcttaccaggaagtgccagatggtaggaaagagagtcctggaggaccatggcaattcattgggctcttgccacttttcgacccccctcgccatgatagtgcagaaactatcagaagggcactccatcttggtgttaatgtcaagatgattacaggtgatcagcttgctattgggaaggaaacagcacgtcgtttgggaatgggtactaatatgtacccttcatctgctttactcggacagaataaggatgagtcaattgcttctttaccaattgatgaattgatcgagaaggctgatggctttgctggagtctttccagaacacaagtatgagatcgtgaaacgcttgcaagcaagaaaacatatatgtggtatgactggggatggtgtaaatgatgccccagctttgaagaaggctgatatcggtattgcagtagcagactccaccgacgcagctcgtagtgcttctgacattgtcctaactgaaccaggccttagtgtgattattagtgctgtgctgacgagtcgggcaattttccaaaggatgaagaattacacaatctatgctgtatcaattaccatccgtattgtgcttggttttatgcttcttgctctgatatggaagtttgacttcccaccatttatggtcctgatcattgccatcctcaatgatggtaccattatgactatctcaaaggacagagtaaaaccatctccacaacctgatagttggaagttagctgagatttttgcaactggagttgtccttggtggttatttggccatgatgactgtcattttcttctgggcagcgtacaagactgacttcttcccgcgactgttccatgttgaaagccttgagaagactgcccaggatgattttcagaagcttgcgtccgctgtgtaccttcaagttagcacaatcagccaggcccttatctttgtgacacggtctcgcagctggtcatttgtggagcgccctgggttcttgcttgtctttgctttcttggtggcgcagctgattgctactctgatcgctgtatatgccaactgggcatttgcttcgatcaagggcattggatggggctgggccggtgtcatctggctctacaacctcgtcttctacttcccgctggatatcatcaagtttctcatccgttatgcgctgagtgggagagcatggaatctcgtccttgagcagaggattgcattcacaagcaagaagaatttcggtacggaagaaagggagcgcaagtgggcgcacgctcagaggactctccatggcctccagccacctgaggcatccatcttcgagaacaagacgaccttcaacgaactgaaccagctcgcggaagaggcccgtaggagagccgagatggcgaggttgcgagaagtgagcaccctgaaggggaagatggagtcggtggtgaagcagaagggtttggacattgagaccatccagcagtcctacaccgtgtgactgacggatcatacaggcacgattatagaggcggtttcttcttactatatatatatgtggttaggggagcaataataaggattaaggaaccaaccctacatatgactggttcgcgaggatgatgatgatatatttacgatgccggtgtggtgctctgtcgccaacacaccatagccgccctcactcacccctatatgctgtgcattattaaccacccccggcaggcattgagattgagatgagagatatatgctctgttgtagcccttagtagacgatgttgatgatacaatacatttttgcttgttattatatctattattagcctttgctccctggttctggttc

SEQ ID NO: 922 - DNA, 3306 bp, Solanum phureja
actgtgttttggatttggtaggcgacttaccaatcctatttcaggacccaaaaaaatcctatctttctttggaagagaggaaattgagaaagatgggggagaaacctgaggtgttagatgctgtattaaaggagactgtggatttggagaatatacccattgaagaagtttttgaaaatttgagatgtaccaaagagggtcttactggtacagctgcccaagaaaggttggcaatttttgggtacaacaaactagaggagaagaaggagagcaaattcttgaaatttctggggtttatgtggaatcctctctcatgggttatggaagctgctgctattatggcaattgctcttgcaaatggaggaggaaagcctccggattggcaagattttgtgggtattattaccttgcttgtgattaactcaacaattagttttattgaggagaacaatgctggcaatgcagcagctgctctcatggctcgtctcgctcctaaagccaaggttcttcgagatggaaaatggaatgaagaagatgctgctgttcttgttcctggggacataatcagtattaaactgggagatattgttcctgcagatgctcgtcttcttgaaggtgatccgctgaaaattgaccagtctgctttgactggtgaatctcttcctgtaacaaaaggtcctggagatggtgtctactctggttccacctgtaagcagggagagatagaagctgtcgtcatcgccactggggttcataccttttttgggaaggctgcacaccttgttgacagtacaaaccaagtgggacacttccaaaaggttttgactgctattggaaacttctgcatctgttctattgcagtggggatgataatagagatcattgtgatgtaccctatccaacaccgcaaatatcgccctgggattgacaatcttcttgtccttctcattggtggaattccaattgccatgccaacggttctttcagtcacaatggcaattggttctcatcggctcgctcagcagggtgctattacgaaaagaatgacagctattgaggagatggctggtatggacgtgctttgtagtgacaagacagggacccttacactaaacaagcttactgttgacaaaaaccttgttgaggtttttgccaaaggtgttgatgcagatactgtcgttctgatggcagctcgagcgtctcgtacagagaaccaggatgccattgatactgctattgttgggatgttgtctgacccgaaggaggctcgtgctggcattcgtgaaatacactttcttcctttcaatccaactgacaagcgaacagcacttacttatcttgatggtgaaggaaaaatgcacagggtcagcaaaggggcaccagagcagatcctaaatcttgcacacaacaagtcagacatagaacgtagagttcatgcagtgattgataagtttgctgagaggggcttgcgctcacttggtgtggcataccaggaagttccagagggaaggaaggagagttccggaggaccatggcaattcattggtctcctgcctttgtttgatcctccaagacatgacagtgctgagactataaggagggctttgaatcttggagtgaatgttaaaatgatcacaggggatcaactggctataggaaaagaaacagggcgtcgtctgggaatgggaaccaacatgtatccttcgtctgctctgttggggcagactaaggatgaatcaattgcttctttaccaattgatgaactgatagaaaaggctgatggttttgctggagtattccctgagcacaaatatgagatagtaaaacgattgcaagctaggaagcatatctgtggaatgactggagatggagtcaatgacgctcctgctttaaagaaggctgatattgggatagctgttgatgatgccactgatgctgctcgtagtgcttctgacattgttcttaccgaacctggtctcagtgtcatcattagtgctgttctgactagtcgagcaatctttcaaaggatgaaaaactacacgatatatgctgtttccatcacaatccgtattgtgcttggttttatgcttctggcccttatctggaagtttgactttccacctttcatggtgcttatcattgcaatcctcaatgatggtaccattatgacaatatcaaaggatagggtcaaaccatctcctctgcctgatagttggaagctggctgagattttcactactggggttgttcttggtggctacttggcaatgatgacagtcattttcttttgggcagcatatgagacagatttcttcccgcgtgtatttggggtatcaacacttcagaggacagcaactgatgacttcaggaaacttgcatcagcaatttaccttcaagtgagcactatcagtcaggccctgatatttgtcacaagatctcgaagttggtcgtttgttgagcgtcctggtttgttgcttgtggttgcttttctgattgctcaactggttgccaccttgattgctgtttatgcaagttggagctttgctgcaatcgaaggaattggctggggttgggcaggagtgatctggctctacaatttagtattctacttcccgcttgatatcatcaagttcttaatcagatatgctctcagtggaagggcctgggatcttgttcttgagcaaaggattgctttcaccaggaagaaggatttcggaaaagaacaacgtgagcttcaatgggcccacgcacagaggacccttcatgggctgcaagttcctgacaccaaattgtttagtgaatctaccaatttcaatgagcttaatcagttagctgaggaagcaaagaggagagctgaaatcgctaggcaacgtgagctgcacacacttaaaggtcacgtggaatcagtggtgaagttgaagggtcttgacatagagacaattcagcaatcatacactgtttgatgggagagcaagtttgactagtgctacttaaccggtgagtgggtgatagaatgaagacataatgagtgtgtgagttacctctggagcgacaagttcatagtagtaacgtcttcagcgtttaaaagtgccttatatattttatacatttttttgctttgaattcttggtttatcttttcctgctttcatgtcttgactgcattatatatgttacaattgaccaagaatgaatattaagctataacagcattcattatctataaggattttatttcatggtttagcagcatctgatttttttactgcttctctctattcattgattaaagaagttgggttttttg

SEQ ID NO: 923 - DNA, 3154 bp, Solanum tuberosum
ctttggaagagaggaaattgagaaagatgggggagaaacctgaggtgttagatgctgtattaaaggagactgtggatttggagaatatacccattgaagaagtttttgaaaatttgagatgtaccaaagagggtcttactggtacagctgcccaagaaaggttggcaatttttgggtacaacaaactagaggagaagaaggagagcaaattcttgaaatttctggggtttatgtggaatcctctctcatgggttatggaagctgctgctattatggcaattgctcttgcaaatggaggaggaaagcctccggattggcaagattttgtgggtattattaccttgcttgtgattaactcaacaattagttttattgaggagaacaatgctggcaatgcagcagctgctctcatggctcgtctcgctcctaaagccaaggttcttcgagatggaaaatggaatgaagaagatgctgctgttcttgttcctggggacataatcagtattaaactgggagatattgttcctgcagatcgtcgtcttcttgaaggtgatccgctgaaaattgaccagtctgctttgactggtgaatctcttcctgtaacaaaaggtcctggagatggtgtctactctggttccacctgtaagcagggagagatagaagctgtcgtcatcgccactggggttcataccttttttgggaaggctgcacaccttgttgacagtacaaaccaagtgggacacttccaaaaggttttgactgctattggaaacttctgcatctgttcaattgcagtggggatgataatagagattattgtgatgtaccctatccaacaccgcaaatatcgccctgggattgacaatcttcttgtccttctcattggtggaattccaattgccatgccaacggttctttcagtcacaatggcaattggttctcatcggctcgctcaacagggtgctattacgaaaagaatgacagctattgaggagatggctggtatggacgtgctttgtagtgacaagacagggacccttacactaaacaagcttactgttgataaaaaccttgttgaggtttttgccaaaggtgttgatgcagatactgtcgttctgatggcagctcgagcgtctcgtacagagaaccaggatgccattgatactgctattgttgggatgttgtctgacccgaaggaggctcgtgctggcattcgtgaaatacactttcttcctttcaatccaactgacaagcgaacagcacttacttatcttgatggtgaaggaaaaatgcacagggtcagcaaaggggcaccagagcagatcctaaatcttgcacacaacaagtcagacatagaacgtagagttcatgcagtgattgataagtttgctgagaggggcttgcgctcacttggtgtggcataccaggaagttccagagggaaggaaggagagttccggaggaccatggcaattcattggtctcctgcctttgtttgatcctccaagacatgacagtgctgagactataaggagggctttgaatcttggagtgaatgttaaaatgatcacaggggatcaactggctataggaaaagaaacagggcgtcgtctgggaatgggaaccaacatgtatccttcgtctgctctgttggggcagactaaggatgaatcaattgcttctttaccaattgatgaactgatagaaaaggctgatggttttgctggagtattccctgagcacaaatatgagatagtaaaacgattgcaagctaggaagcatatctgtggaatgactggagatggagtcaatgacgctcctgctttaaagaaggctgatattgggatagctgttgatgatgccactgatgctgctcgtagtgcttctgacattgttcttaccgaacctggtctcagtgtcatcattagtgctgttctgactagtcgagcaatctttcaaaggatgaaaaactacacgatatatgctgtttccatcacaatccgtattgtgcttggttttatgcttctggcccttatctggaagtttgactttccacctttcatggtgcttatcattgcaatcctcaatgatggtaccattatgacaatatcaaaggatagggtcaaaccatctcctctgcctgatagttggaagctggctgagattttcactactggggttgttcttggtggctacttggcaatgatgacagtcattttcttttgggcagcatatgagacagatttcttcccgcgggtatttggggtatcaacacttcagaggacagcaactgatgacttcaggaaacttgcatcagcaatttaccttcaagtgagcactatcagtcaggccctgatatttgtcacaagatctcgaagttggtcgtttgttgagcgtcctggtttgttgcttgtggttgcttttctgattgctcaactggttgccaccttgattgctgtttatgcaagttggagctttgctgcaatcgaaggaattggctggggttgggcaggagtgatctggctctacaatttagtattctacttcccgcttgatatcatcaagttcttaatcagatatgctctcagtggaagggcctgggatcttgttcttgagcaaaggattgctttcaccaggaagaaggatttcggaaaagaacaacgtgagcttcaatgggcccacgcacagaggacccttcatgggctgcaagttcctgacaccaaattgtttagtgaatctaccaatttcaatgagcttaatcagttagctgaggaagcaaagaggagagctgaaatcgctaggcaacgtgagctgcacacacttaaaggtcacgtggaatcagtggtgaagttgaagggtcttgacatagagacaattcagcaatcatacactgtttgatgggagagcaagtttgactagtgctacttaaccggtgagtgggtgatagaatgaagacataatgagtgtgtgagttacctctggagcgacaagttcatagtagtaacgtcttcagcgtttaaaagtgccttatatattttatacatttttttgctttgaattcttggtttatcttttcctgctttcatgtcttgactgcattatatatgttacaattgaccaagaatgaatattaagctatagcagcattcattatc

SEQ ID NO: 924 - DNA, 3169 bp, Solanum tuberosum
ctttggaagagaggaaattgagaaagatgggggagaaacctgaggtgttagatgctgtattaaaggagactgtggatttggagaatatacccattgaagaagtttttgaaaatttgagatgtaccaaagagggtcttactggtacagctgcccaagaaaggttggcaatttttgggtacaacaaactagaggagaagaaggagagcaaattcttgaaatttctggggtttatgtggaatcctctctcatgggttatggaagctgctgctattatggcaattgctcttgcaaatggaggaggaaagcctccggattggcaagattttgtgggtattattaccttgcttgtgattaactcaacaattagttttattgaggagaacaatgctggcaatgcagcagctgctctcatggctcgtctcgctcctaaagccaaggttcttcgagatggaaaatggaatgaagaagatgctgctgttcttgttcctggggacataatcagtattaaactgggagatattgttcctgcagatcgtcgtcttcttgaaggtgatccgctgaaaattgaccagtctgctttgactggtgaatctcttcctgtaacaaaaggtcctggagatggtgtctactctggttccacctgtaagcagggagagatagaagctgtcgtcatcgccactggggttcataccttttttgggaaggctgcacaccttgttgacagtacaaaccaagtgggacacttccaaaaggttttgactgctattggaaacttctgcatctgttcaattgcagtggggatgataatagagattattgtgatgtaccctatccaacaccgcaaatatcgccctgggattgacaatcttcttgtccttctcattggtggaattccaattgccatgccaacggttctttcagtcacaatggcaattggttctcatcggctcgctcaacagggtgctattacgaaaagaatgacagctattgaggagatggctggtatggacgtgctttgtagtgacaagacagggacccttacactaaacaagcttactgttgataaaaaccttgttgaggtttttgccaaaggtgttgatgcagatactgtcgttctgatggcagctcgagcgtctcgtacagagaaccaggatgccattgatactgctattgttgggatgttgtctgacccgaaggaggctcgtgctggcattcgtgaaatacactttcttcctttcaatccaactgacaagcgaacagcacttacttatcttgatggtgaaggaaaaatgcacagggtcagcaaaggggcaccagagcagatcctaaatcttgcacacaacaagtcagacatagaacgtagagttcatgcagtgattgataagtttgctgagaggggcttgcgctcacttggtgtggcataccaggaagttccagagggaaggaaggagagttccggaggaccatggcaattcattggtctcctgcctttgtttgatcctccaagacatgacagtgctgagactataaggagggctttgaatcttggagtgaatgttaaaatgatcacaggggatcaactggctataggaaaagaaacagggcgtcgtctgggaatgggaaccaacatgtatccttcgtctgctctgttggggcagactaaggatgaatcaattgcttctttaccaattgatgaactgatagaaaaggctgatggttttgctggagtattccctgagcacaaatatgagatagtaaaacgattgcaagctaggaagcatatctgtggaatgactggagatggagtcaatgacgctcctgctttaaagaaggctgatattgggatagctgttgatgatgccactgatgctgctcgtagtgcttctgacattgttcttaccgaacctggtctcagtgtcatcattagtgctgttctgactagtcgagcaatctttcaaaggatgaaaaactacacgatatatgctgtttccatcacaatccgtattgtgcttggttttatgcttctggcccttatctggaagtttgactttccacctttcatggtgcttatcattgcaatcctcaatgatggtaccattatgacaatatcaaaggatagggtcaaaccatctcctctgcctgatagttggaagctggctgagattttcactactggggttgttcttggtggctacttggcaatgatgacagtcattttcttttgggcagcatatgagacagatttcttcccgcgggtatttggggtatcaacacttcagaggacagcaactgatgacttcaggaaacttgcatcagcaatttaccttcaagtgagcactatcagtcaggccctgatatttgtcacaagatctcgaagttggtcgtttgttgagcgtcctggtttgttgcttgtggttgcttttctgattgctcaactggttgccaccttgattgctgtttatgcaagttggagctttgctgcaatcgaaggaattggctggggttgggcaggagtgatctggctctacaatttagtattctacttcccgcttgatatcatcaagttcttaatcagatatgctctcagtggaagggcctgggatcttgttcttgagcaaaggattgctttcaccaggaagaaggatttcggaaaagaacaacgtgagcttcaatgggcccacgcacagaggacccttcatgggctgcaagttcctgacaccaaattgtttagtgaatctaccaatttcaatgagcttaatcagttagctgaggaagcaaagaggagagctgaaatcgctaggcaacgtgagctgcacacacttaaaggtcacgtggaatcagtggtgaagttgaagggtcttgacatagagacaattcagcaatcatacactgtttgatgggagagcaagtttgactagtgctacttaaccggtgagtgggtgatagaatgaagacataatgagtgtgtgagttacctctggagcgacaagttcatagtagtaacgtcttcagcgtttaaaagtgccttatatattttatacatttttttgctttgaattcttggtttatcttttcctgctttcatgtcttgactgcattatatatgttacaattgaccaagaatgaatattaagctatagcagcattcattatctataaggattttatt

SEQ ID NO: 925 - DNA, 3275 bp, Aquilegia formosa
aaaatggctgataaggctgaagttcttgaagctgtgttgaaggaagctgtagatttggaaaacatacccattgaagaagtttttgagaatctgagatgtaatactgggggtttaacaagtgaagcagctcaagaaagattaaccatctttggttacaataaacttgaagaaaaaaaggagagtaaattcttgaagtttttggggtttatgtggaatcctttgtcatgggttatggaagctgcagctgtgatggctattgctttggctaatggaggaggaaaacctcctgactggcaagactttgttggtatcatcatcttgcttattatcaactcaacaatcagtttcatagaagagaacaacgctggaaatgctgctgcagctctcatggcacggttagccccaaaagccaaggtactgcgagatggaaggtggagtgaagaagatgcagctattcttgttccaggtgatatcatcagtataaagcttggagatatcgtacctgctgatgctcgtctcctctcgggagacccgttgaaaattgaccagtcttctctgacaggggagtctctgcctgtaacaaaaggccctggagatggtgtttattctgggtctacatgcaaacagggtgagattgaagcagttgtgattgccactggtgttcacaccttctttggcaaggctgctcatcttgtagatagcacaaatcaagttggccatttccaaaaggtcttgactgctattggaaacttctgtatatgttcgattgctgttggaatggttatcgagataattgtcatgtatccaatacaagaccgcgagtatcgtccaggaattgacaatctcttggttcttctcattggaggaatccccattgccatgcctacagttctgtcagttacaatggcaattggttcccatcgcctagctcaacagggagctatcacgaagagaatgacagcaatagaggaaatggctggtatggatgtgctttgcagtgataaaactggaacactgacactaaacaagctttctgtagacaaaaatcttattgaggtattcacaaaaggagtagacccagatactgttgttttgatggcagctcgagcctcccgtgtggaaaaccaagacgcaatagacactgctatagtgggaatgctggctgatccgaaggaggcacgagctggtattcaagagattcatttccttccatttaatccaactgacaagagaacagcattaacttatgttgacggagaaggaaaaatgcatcgagtcagcaagggagcgccagagcagatcctaaatcttgcacacaataaatcagacatagagcgcagagttcatactgtgattgataaatttgcagagagaggcttaaggtcccttggagtagcataccaggaagttccagaaggaaggaaagagagcacaggaggtccatggcagttcgttggtctgctccccctctttgacccacccagacatgacagtgctgaaacaattaggagggctctgaacctcggcgtaaatgtcaaaatgattacaggtgatcaattggctatagcaaaggaaacaggtcgccgtttaggaatggggacaaatatgtatccatcgtctgctcttctaggtcagaccaaggatgaatcaattgcagctttgcctattgatgagctgatagagaaagcggatggttttgctggcgtcttccctgaacataaatatgagattgttaagcgcttacaagctaggaagcatatttgtggaatgacgggtgatggtgtaaatgatgctcctgctctaaagaaggctgacatcggaatagcagttgatgattcaactgatgccgctcgtagtgcttctgacattgtcctgacagaacctggtcttagtgtcatcatcagtgctgtattaaccagtagagcaatctttcagaggatgaaaaactacacaatttatgcagtttccattacaatccgtattgtgcttggtttcatgctgcttgctcttttatggaggtttgattttccacctttcatggtgctcatcattgcaatcctgaacgatggaaccataatgacaatatcaaaagacagggtaaagccttctcccctgccagacagctggaagctggctgagatatttgctactggcattattcttggcggttacttggcaatgatgacagtcattttcttctgggcagcatacaaaacagatttcttcccgcgtcatttccacgtttcaagccttcagaaaaaagacgcagatgacttcaaaaagctcgcctcagccatatatctgcaagtgagcaccattagccaggccctcatatttgtaacacgatcaagaagttggtcatttgctgagcgcccaggctggtggcttataattgcttttgcagttgcacagctgattgctacgcttattgcagtctatgcaaattgggcctttgcagctattgaaggtattggatggcgttgggctggtgtaatctggctttataacatcgtcttctactttcctcttgatgtaatcaagttcataatccgatatgctctcagcggaagggcctgggatcttgttattgaacagaggattgcctttacgaggcagaaggatttcgggaaagaagcacgcgagcttaaatgggcgcatgctcagagaacacttcatgggctgcaggcgcctgatgccaaaatgtttcctgaccgtggaaatttcactgaacttaatcagatggcagaagaagccaaaaggcgggcggagattgcaaggctaagagaactccacactttgaagggacacgtcgagtccgtggtgcgactgaagggcctcgacatagacacaatccagcaagcatatactgtctgatgagttagtaccaagttctcccagttttcaatatactttctgttagttatgagagggagtaaagatcgacggtaaaggcttgcgattatccttttaccattgcgacaaactcagtaactcattacccttttaccattgcgacaaactcagtaactcagcattattcttagcattttgtagaaagttttaaagtagtgaccttttgagttgtgcattcaatagtagcaccatagctgctatgttactcttctatacttgatgattcttgagcaaccatagcagtgagcacatacccttgtggtatgtatctgaagtaattccttcgggatgtaattaaatcagcaagttgtacaaatttggttttactacgagtttaatggaatggttaaggttttcacatt

SEQ ID NO: 926 - DNA, 3106 bp, Helianthus annuus
aagcctgaagctcttgaagctgttttgaaggagactgtagatttggaaagtatacccattgaagaggtttttgagaatctgagatgtagcaaagatggtctcaccacttctgctgctgaacaaagattaatcatttttgggcataataaacttgaagaaaaaaaggagagcaaattcctgaagtttttagggtttatgtggaatccattatcatgggttatggaagctgctgctatcatggctatagcccttgctaatggaggaggaaagcctcctgattggcaagattttgtgggtattatcactttgctcataatcaactccaccattagtttcattgaagaaaacaatgctggtaatgcagtagctgctctcatggctagactggccccaaaagcaaagattttaagagatgggaaatggaatgaagaagatgcttccatgttagtccctggagatataattagtataaagttaggtgatattattccagccgatgctcgtttgctcgatggcgatccgttaaagattgaccagtcggctttaaccggtgagtctctcccggtcacaaaaggtcctggtgacggtgtctattccggttcgacatgcaaacagggtgaaatcgaggcggttgtgatagctaccggggtccacacgttcttcgggaaagctgctcatcttgttgatagcacaaaccaagttggtcattttcagaaagttttgactgcgatcgggaatttctgtatttgttctattgctgttggtatggtgattgagataattgtgatgttcccgattcaagataggcagtatcgccccgggatcgataatcttcttgttcttttgatcggaggaatcccgatcgctatgccgaccgttctttccgtaacgatggctatcgggtctcatcgattggcgcaacagggagcgattacgaaaagaatgacagcgatagaagaaatggcaggaatggacgttctttgcagtgacaaaaccggaacgttgactttgaacaaacttacagttgacaagaatcttatcgatgtatttgccaaaggagtagacgccgatactgtggttctgatggcggcccgagcctcgagaaccgaaaatcaagatgccattgatgctgcaatagtcggtatgctggctgatccaaaagaggcacgtgctgatattcaagagttgcattttctgccatttaatcctaccgataagcgtactgcattaacgtatttagacagtcagggtaaaatgcatagagtcagcaaaggcgcccccgagcagatcttgaatcttgcacacaacaaatcggacatagaacgccgagttcatgctgtcatcgacaagtttgcggaccgtgggttaagatcacttgctgttgcataccaggaagttccagagggacgaaaagagagtccaggaggaccatggcagttcattgggttaatgccgctctttgatccgccacgtcatgatagtgccgagacgatacggagggctttgaatcttggagtaaatgttaaaatgattacaggggatcaactggcaatcgggaaagaaaccggaagacgtcttggaatgggaaccaacatgtacccttcttcagctctgctcggtcaaaataaagacgagtcaattgctgctttacccatcgacgaactcatagaaaaagccgacggtttcgcgggtgttttccccgaacacaaatacgaaattgtaaaacgtttacaagctaggaaacacatatgtggaatgaccggagacggagtaaatgatgctcccgccctcaagaaagccgatatcgggattgcagtggctgatgcgaccgatgcagcccgtagcgcttctgacatcgtccttaccgagcccgggcttagtgtcatcatcagtgctgttttgaccagccgcgccatcttccaaaggatgaaaaattacacgatttatgcggtttcaatcaccattcgtattgttctcggtttcatgctgctggctttgatatggaagtttgacttcccgcctttcatggtgcttattatcgcaatccttaatgacggaactataatgaccatatcgaaggatagagtaaaaccgtctcctcttcccgatagctggaaactggcggagattttcaccaccggtgtcgttctcggtagttacttagcgatgatgacggttatatttttctgggcggcttataaaacagacttctttccacgtacatttggcgttccgacccttgagaagacggctcacgatgacttccggaagctcgcttcggcaatatatctccaagtcagcacaattagtcaagctctcattttcgtaacgagatctcgtagctggtcgtttgtggaacgcccgggttggctgcttgttattgcttttgctattgcgcaattggttgctacattgattgcggtttatgccaattggagctttgctgccgtagaaggaatcgggtggggatgggctggcgttatctggctctacaatatcgtcttctacttcccacttgatatcattaagttctttatccgatatgctcttagtgggcgggcctgggacctcgttatcgagaggaggattgctttcacaaggcaaaaggattttggtaaggaacaacgtgagctccaatgggcccatgcgcaacgaacccttcacgggcttgaagttcctgacaccaaaatgtttggtgatcgtaccaatgtcactgaactcaaccaaatggccgaagaagccaaacggagagctgaaatcgcaaggttgagagaattgcacacgttgaagggtcatgttgaatcggtggttagactcaagggtcttgacatagagacaattcaacaagcatacaccgtgtaagagacagttgccggttagttggtgagttacctttggaacagtcgtcttttattcggttaaattttcttttcttttcttttttttttgtttaatcttggctggttatatcccatgtgtactagtgaactgggaaagatagaaccttttatgctgtaatatgttgtgcatatgatgaaaagcttttcgcttcaaaaaaaaactcttgaatgatactaacatattaaatttacatcaaagtactctg

SEQ ID NO: 927 - DNA, 3195 bp, Pennisetum glaucum
cgggagaggagggggagatagagaggcgaggcggccgccggcggccggggaggcaggatggaggacaagacgtccaacctcgacgcggtcctcaaggaggccgtggatctcgagaacatcccgatcgaggaggtgttcgagaacctccgatgcagcccgcagggactctccaccgagcaggcggagcagcgcctcgccatcttcgggcccaacaagctggaggagaagcaggagagcaagttgctcaagttcctgggcttcatgtggaacccgctgtcctgggtcatggaggcagcagccatcatggccatcgcgctcgccaacggaggagggaagccaccggactggcaggactttgtggggatcatcactctgctcatcatcaactccacaatcagtttcatcgaggagaacaatgccggcaatgccgctgctgctctcatggcccgcctcgcccccaaggccaaggttctcagaaacgggcggtggaatgaggaggaatcggcgatccttgtcccaggagacatcatcagtgtgaagcttggggatatcattcctgctgatgctcgtctcctggagggtgaccctctgaagatcgatcagtctgcactcactggtgagtcccttccagtgaccaaaggccctggtgatggagtgtactctggttccacttgcaagcagggtgaaattgaggctgttgtcattgccactggtgtgcacacattctttggcaaggcagcacatcttgtggattcaacgaaccaagttggccatttccagaaggttctgactgccatcgggaacttctgcatctgttcaattgctgtgggaatggccgtggagcttgtcgtcatgtacgctatccaacacagggcttaccgaccgggaattgacaatctgttggtgcttctgattggaggaattccaatcgccatgcccactgtcctttctgtgactatggcaatcggagcgcatcgcttggctcaacagggagcaattactaaaagaatgacagcaattgaagaaatggctggcatggatgtcctttgcagcgacaagactgggacattgacattaaacaagttgactgtggacaagagcctcattgaggttttccaaagaggggttgatcaggatacggtaattctgatggctgccagagcttctcgtacggaaaatcaggatgccatagatgccacaatagttggtatgctggctgatccaaaggaggctcgtgctggtgttcaagagattcactttctgccatttaatccaactgacaaaagaactgctttaacctaccttgatggagagggaaaaatgcatcgtgttagcaagggagcaccagagcagatccttcatcttgcacacaacaagtcagatattgaaagaagggtcagagctgtgattgacaaatttgctgagcgtggcttgcgagcacttggtgtagcttaccaggaagtgccagatggtaggaaagagagtcctggaggaccatggcagttcatcgggctcttgcccctttttgacccccctcgtcatgatagtgcagaaacgatcagaagggcactcgatcttggtgtcaatgtcaagatgattacaggtgatcagctcgctattgggaaggaaacagcacgtcgtttgggcatgggtaccaatatgtacccttcatctgctttactcgggcaggataaggatgagtcgattatttctttgccagttgatgaattgatcgagcaggctgatggttttgctggagtctttccagaacacaagtatgagatcgtgaaacgcttgcaagcaaggaaacacatttgcggcatgactggggatggtgtaaatgatgccccagctttgaagaaggctgatatcggtattgcagtagcagactccaccgatgcagcacgtagtgcatcggacattgtcctgactgaaccaggccttagcgtgattattagtgctgtgctgacgagtcgggcaattttccaaaggatgaagaattatacgatatatgctgtgtcaattaccatccgtattgtgcttggctttatgcttcttgcgctgatatggaagtttgacttcccaccgtttatggtcctgataattgccatcctcaatgatggtaccattatgactatctcgaaggacagagtaaaaccatctccaatgcctgatagctggaagttagctgagatctttgcaactggagtagttcttggtggatatttggccatgatgacagtcattttcttctgggctgcatacaagactaacttcttcccgagagtgtttggtgtcgaaagccttgagaaaactgcccaggatgattttcagaagcttgcttctgccgtgtaccttcaagtcagcaccataagtcaagccctcatctttgtgacacggtctcgcagctggtcgtttatggagcgtcctggattcttgttggtctttgctttcttggtagcacagctgatcgctactctgattgctgtatatgccaactgggcgtttgccgcaatcaagggcatcggatggggctgggctggtgtcatctggctttacaatgttgtattctacttcccgctggatatcatcaagttcctcacccgttacgctctgagcgggagggcatgggatctcgtacttgagcagaggatcgcattcacaaggaagaaggattttggaagggaagagagggagctcaagtgggcacatgctcagaggacgctccacgggctccaggcaccagagccatccatcttcgagaacaagacgaccttcaatgaactgaaccagctcgcggaggaggcacgcaggagagccgagatggcgaggttgcgagaagtgaacaccctcaaggggaagatggagtcggtggtgaggcagaaggggttggacatggagaccatccagcagtcctacaccgtgtgattgatcgattgatctgggatatggattgattatagaggcggcttcttactactactactatatatatatactgtactaggcagcaataaggaaacccgtggttggtccttgataacgatgatgatatgtttctaacagtcggtgcggtgcttatcgctctagtctctcacccctatatgctgtttgtccattaaccacccccggcagaccatttaccgcattgagatgagacatactcatgtagagtccttattagcagatgatggt

SEQ ID NO: 928 - DNA, 3732 bp, Pinus taeda
ggggctggacaggccaagcaagcagactagcatacttcatgtaatgcccaggtttgtagcgagtccttggtgaaaagggagagtgagaataaaagcaaatacagtgaattttggacacctggaaactcatcctatattatatatcggattccacatctcacattctttctttctatcaactgaaatctcatctttctactggtttttttaagcccaacactgtttttcacgtccacagttcgaatctcctcagctcaagtgtttagtgattggcatatcgaagcaaatagagctcggtgatgcattgatcgctggattgcatgtgtgtatcttgtgggcggcggggcggtgagtaaacccgatttgcggaaatgggtgacaaggctgcgactctggaagccattaacaaagaagctgtggatttggaacatattcccatcgaggaggtttttgagaatctaagatgcagcagggagggtttgagcagccaagctgcgcaggagaggctcactatattcggatacaacaagctcgaagagaaaaaggaaagcaaatttctcaagtttttgggttttatgtggaaccccttatcatgggttatggaagccgcagctgtgatggccattgctatggcgaatggagggggaaaacctcctgactggcaagattttgttggtattataacattgcttgttataaactctaccataagtttcatagaggaaaacaatgctggcaatgctgctgcggcactgatggctcggctggctccaaagagcaaggttctcagagatggacaatggaatgaagaagatgcagcagtgcttgttcctggtgacataatcagcatcaaacttggagatattgttcctgcggatgcgcgtcttcttgaaggagatcctttaaagattgatcagtctgccctcactggggagtcattaccagtaacaaagggtcctggcgatggggtttattctggttctacttgcaaacagggtgaacttgaatgtgttgtcattgctactggggtccataccttttttggtaaagcagcacatcttgtggacagtacaaaccaagttggccacttccaaaaggttttgacggcaattgggaatttctgcatttgctcaattgcgattggcatgatagttgagatcattgttatgtatccaattcaagaccgtaaatatcgtcctggaatagataaccttctagttctcctcattggtgggattccgatagcaatgcctactgtcctttctgtgacaatggctattggatcccaccgtctgtctcaacagggtgccatcacaaaacggatgacagccattgaagaaatggctggaatggatgtgctttgcagcgataaaactgggacattaacactgaataagcttactgtggacaagaatattattgaggtttttacgaaaggatatgacaaggatgctgttgtcctgatggctgcaagagcatccagaacagagaatcaagatgccattgatgcggcaattgttgggatgcttgcggatcctaaggaggcgcgggcaggcattcaagaggtccattttcttccttttaatccaactgacaagaggacagctctcacttatattgacaatgaagggaaaatgcatcgcgttagtaaaggtgctccagagcagattcttaacctcgcacataataagccagaaattgagcggcgagttcatacagttattgacaagtttgctgaacgaggacttcgctctcttgcagttgcatatcaggaagttccagagggcaggaaggagagtccaggagggccctggcattttattggattgatgcctctttttgatcccccacgtcatgacagtgctgaaacaatcagaagggctcttaatcttggtgtgaatgtcaaaatgatcacaggagatcaattagctattgccaaggagacaggtcgccgactgggcatgggtacaaacatgtatccatcatcctctttactaggtcaggacaaagatgagtcaattgcagctttgccagttgatgaactgatagagaaggctgacggttttgctggtgttttccctgagcataagtacgagattgttaagcgattgcaggctagaaagcacatatgtggaatgactggcgatggtgttaatgatgcgcctgcgctaaagaaggcggacataggaattgctgttgctgatgcaactgatgcagcaagaagtgcttctgacatagttttgacagagccaggtctcagtgttattatcagtgcagtgttgacaagtcgtgcaattttccagcgaatgaagaattacactatatatgcagtgtcaattacaatacgtattgtgctaggttttatgcttttagcgttgatatggaagtttgacttcccaccgttcatggtacttataattgccatattaaatgatggtactataatgaccatttctaaggacagggtgaaaccatcacctttaccagatagctggaaactagcagagatttttgccactggggttattattggcagttacctagcattgatgactgttatatttttctgggctgcttacaagacagatttcttcccgagaacatttggtgttgcaagtcttcagaaaaaagaccaagatgatataagaaaactgagtgctgcagtttacctgcaagttagtaccgttagtcaggcacttatatttgtgactcgttcccgaagctggtcttttatggagcggcctggtctcttgcttgtatttgctttttgtgttgcacaactgattgcgacactaattgcagtttatgcaaactggggatttgctgcaatagagggcatgggctggggctgggctggtgtagtgtggctttataatatcatattttacttccctcttgatataataaaattcctcattcgatatgctctgagtgggaaggcttgggatcttgttattgagcaaaggacggcatttacaaggcaaaaggactttgggaaagaggcccgtgaacttaaatgggcacatgctcaaaggacacttcatggtttgcatacagcagacacaaaaatgttcagtgaaaggggcaacattactgacctcaatcaaatggcggaggaggctaagagacgtgctgagattgcaaggttgagagagctacatactttgaaaggacacgtagagtctgttgtaaggctgaagggcttggatatagacacaattcagcaggcctacactgtttgaatcaatgcgagctttttctgccggggtgctatggggggggctcacttgaaaacaattgtaactttttgacgtgtaatttgatgaagatattggtgttctacagaagttttagtaacgtttcttgtaaaagagttgaaaggatgttaatttcaagcacgctgttcaactttgccaaatctctggtattcaggtgggcagagtgttgtgttcaacatctttgattttatgtggtgttttggcagaaattaagcagtaagatctcaggtggttttgtgggtttgacaactagtttggtttcatgttcttgttgatctaaatctcgtttttcttagtcagatggaactgcactcaacagtgtcagactatatgaattaacatattggctagtattacctggaagaagttgaccatcattttgtctttaaattgtctcttatttggacgtaatgctatgttgaaagaatctaataaaatgtatttagcttttacg

SEQ ID NO: 929 - DNA, 3839 bp, Taxus baccata
gaggaggggggttagggacacctgtgagctactctgtcgagcaataataaaaataataatacttaatccgtagtagggaattggaatgcacaactcgagcacttcctataacgtgttcaggtgtacccacgtcccgggttcgaatcccccgagcaccagatagtatttagagcagtggtggagctagtagatcgaaggcataataagggaggcactgcgggagcgaatcgtggaatgatttgatgcgtggtttagtgaaactctagtggaaaatatggacgacaaggcagccactctggaggccattaacaaagaagctgtagatttggagaatattcctatcgaggaggtttttgagaatctaagatgtggcagggagggtttgagcaacgatgctgctcaggagaggctcggtttatttggacacaacaagctcgaagaaaaaaaggaaagcaaattcctcaagttcttggggtttatgtggaaccctttatcatgggtcatggaagcagcagcaatcatggccattgcgttggcaaatggaggaggcaagcctcctgattggcaggattttgtaggtatcataacattgcttgttattaactccacaataagttttattgaagaaaacaatgctggtaatgctgctgcagcgctgatggctcggttggctccaaaggccaaagtcctacgagatggacagtggggtgaagaggatgcagccatacttgttcctggtgacataattagcattaaacttggggacattgttcctgcagatgctcgtcttctggagggagacccattaaaaattgatcagtctgctcttactggcgagtctttgccggtaaccaagggtcctggtgacggggtttattctggatctacttgcaagcaaggcgaaattgaagctgttgtcattgccacgggagttcataccttttttggaaaagcagcccatcttgtggactctacaaaccaagttggtcatttccaaaaggttttgacagcaattgggaatttttgcatttgctcaattgccattggcatgctaattgaagttgttgttatgtatcctattcaagaccgtaaatatcgtcctggaattgataatcttctggtgctcctgattggtgggattccaatagcaatgcctactgttctttcagtgacaatggctattggatcacatcgtctatctcaacagggtgcaatcacaaaacggatgacagctattgaagaaatggcaggaatggatgtgctgtgcagtgacaagactgggacattaactttaaacaagcttactgtggacaaaaaccttattgaggtgtttgccaaaggagttgacaaggatacagttgtcttgatggctgcgagagcatccagaacagaaaaccaagatgccattgattctgcaattgttgggatgcttgctgatcctaaggaggctcgggcaaacattcaagaaattcatttccttccttttaatcccactgacaagagaaccgctctgacctatattgaccgtgatggaaaaatgcatcgtgttagtaaaggtgctccagagcagattctcaaccttgcacataataagtcagaaattgagcgccgagttcatacagttatcgacaagtttgctgaacgtgggcttagatctcttgcagtttcctatcaggaagttccagaggccaagaaggatagtgctggagggccctggcagttcattggactgatgcctctttttgatcctccacgtcatgacagtgctgaaacaattcgaagggctcttaatcttggcgtgaatgtgaaaatgattacgggcgatcaattggctattggaaaagagacaggccggcggctggggatgggtacaaacatgtatccatcgtcatctttgctggggcagaataaggatgaatcaattgtagctttgccagttgatgatttgatagaaaaagcagatggctttgctggtgttttcccagagcataagtatgaaattgtgaagcgattgcaggctagaaagcatatatgtggaatgactggtgatggtgttaatgatgcacccgcattaaaaaaggcagatatagggattgctgttgcagatgcaactgatgcagcaagaagtgcttctgacatagttcttacagagccaggtctcagtgtcattatcagtgcagtgttgacaagtcgtgcaatctttcaaagaatgaaaaattacactatatatgcagtgtcgatcacaatacgtattgtgttgggctttatgcttttggctttaatctggcagtttgacttcccaccgttcatggtactcataattgccatattgaatgatggtactataatgacaatttccaaagatagggttaaaccatcacctctaccagacagctggaagcttgcagagatttttgcaactggggttatcattggcagttaccttgcattgatgactgtaatatttttctgggccgcttacaagacagatttcttcccgcgaacatttggtgttgaaagtcttcattctaaagatcaagaagacacgaaaaaactaagtgcagcagtttacttgcaagttagtaccatcagtcaggcactaatatttgtgactcgttcgcgaagttggtcttttgtggagcggcctggtctattgcttgtatttgcattttgcgttgcccaactgattgcaacaataattgcagtttatgcaaactggggattcgctgcaataaaaggcatgggctggggctgggctggtgttgtgtggctttacaatataatcttttactttccccttgatgttataaaattctttatacgatatgcattgagtggaaaggcctgggatcttgttattgagcaaaggacggcatttacaaggcaaaaggactttggaaaagaggcgcgtgaacttaaatgggcacatgctcagaggacattgcatggtttgcatcctccagatacaagaatgttcagcgagagaagcaacgttactgatcttaatcaaatggcggaggaggctaaaaggcgtgctgaaattgcaaggctgagagagctacatactttgaaaggacatgtagaatctgttgtgaggctgaagggcttggatatagatacaattcagcaggcatacactgtttgaatcgatgcattttcttgctgctaacttgctattgggattcagatgaaaatattctatatttcaacatgttctgtaatttgattaatattggtggtgtacagcagttagtgacgcttcttgttaaagggttcagagggctgttaattttaacatttgccctgggaccagaagattttctgtttttctggagatactaaatagccatttgtctgaattatcaaacttttagagttcagttaggtttccaagaggtggaaaatatggcttttagtatcctttggttttaggtgccaactatttgtagaacaagttaggaagcagtataatgtgtttatgattttgtggttcaagtcgtaacagctacacgggttccatgatgttgatggctcaatccttttatgtctggtgcctaagaagctgtacttaattgagtactatgcttgcaagacttcaatacctttaatgtattggctagtatcctttgtttttaggtgccagctttgtgtaaaacaagttagaaagctgcagtacttgtgtattattttgttggttcaagtctggacagccatgtgggttccctgatgttgatggcccaacccttgtatgtctgatgggcaagaagccgtacttagatgagtatcatgcaaaagacaaaaacttttaacatattggctagtatgagtctcaaatgagc

SEQ ID NO: 930 - DNA, 3284 bp, Arabidopsis thaliana
gagagagaggtcggagtgtgttagcttcccatactgccactaacctttagcggttttctcatcttctctactcttctttctcttttctgagaaacccaaaagacaaaaacgaagaagaagattaggaaatcatcttgagaaacaggaggtagcaggagaatatgggggacaaggaagaagtccttgaggctgttttgaaagaaactgtggatctggagaatgtacctattgaagaagtttttgagagtctgagatgtagcagagaaggtctcactacagaagctgctgatgaaaggctggctctttttgggcataacaagctcgaagagaagaaggaaagcaaattcctgaaatttcttggtttcatgtggaaccctctttcttgggttatggaagctgctgctatcatggctattgctcttgctaatggaggagggaagccacctgattggcaagactttgttggtattattactctgcttgtgattaactccactatcagtttcatagaggagaacaatgccgggaatgctgctgctgcactcatggcacgtcttgccccaaaagcaaaggttcttcgagatggaagatggggtgagcaggatgctgcaattcttgttccgggtgatataatcagcataaagctcggggatattgttccagctgatgctcgccttctcgagggtgatccccttaaaatcgatcagtcttctcttaccggtgaatctctcccagtaaccaaaggtccaggggatggtgtgtattctggctccacttgcaaacagggagagcttgaagcagttgtgattgcaacgggagtccataccttctttggaaaggccgcacatcttgtcgatacgaccaaccacgttggccattttcaacaggtgttaactgccattgggaacttttgcatctgctctatcgcagtggggatgataattgagattgtcgttatgtatcccattcaacaccgtgcatatcgtcctggaattgataaccttcttgtgcttctcattggcggtatcccaattgccatgcctacagttctctctgtgaccatggccattggctcgcataggttatctcagcagggagcaataaccaagaggatgacagcgattgaggaaatggctggcatggatgtgctttgcagcgacaagaccggaactttaacattgaataaacttactgttgacaaaaatcttatcgaggttttcacgaaaggagtggatgcggatacagtagttctaatggcagctcaagcctctagactggaaaaccaagatgccattgatgctgctatagttgggatgcttgctgaccctaaagaggcacgggctggtgttcgagaggttcactttcttccattcaatcccactgacaagaggacggctcttacatatattgacagtgatggtaaaatgcatagggtcagcaaaggtgcacctgagcaaatcctaaatcttgcacacaatagagcagagattgagcggagagtacatgctgtaatagacaagttcgctgaacggggtttgcgatctcttgccgtggcataccaggaagttccggaagggacgaaagaaagtgctggaggcccttggcaatttatgggtctcatgcctctttttgacccacctaggcatgacagtgccgagacaattagaagggctttaaatcttggggtgaatgttaaaatgatcacaggggatcagttggctataggaaaagagactggccgccgtttaggaatgggaaccaacatgtacccctcatctgctttgcttggacagcacaaggatgagtctattggtgccttacccatcgatgatcttatagaaaaggccgacggctttgctggcgtttttcctgagcataaatatgagatagttaagcgactacaagcgaggaagcatatctgtggaatgacaggtgatggagtaaatgatgcgcctgctcttaaaaaggctgatattggcattgcagttgctgatgcaactgatgcagcacgtagtgcttcagatatcgttcttactgaacctggtcttagtgttatcatcagcgctgtcttaaccagccgtgctatcttccagagaatgaaaaattatacaatctatgcggtttccatcactatccgtattgttcttggcttcatgctgctagctcttatatggaagtttgactttccacccttcatggttcttatcattgccattctgaatgatggcacaattatgacaatatcaaaagacagagtgaaaccttcccctcttccagatagctggaaactctcagagatttttgcaactggcgttgtgtttgggagctacatggcgatgatgacagttatatttttctgggctgcatataaaaccgacttcttcccgcgaacatttggagtttcaaccctggagaaaacagcacatgatgatttccggaagcttgcctcggcaatatacctgcaagtcagcatcataagtcaggcgcttatctttgtgacccgatcacggagttggtcttatgtagaacgtcctgggatgttgcttgtggtagcctttatccttgcacaattggtggctactctaattgcagtctatgcgaattggagctttgctgcaatagaagggatcgggtggggatgggccggggtcatctggctttacaatatcgtattctatattcctcttgatatcatcaagttcttgattcgttatgcccttagcggaagagcctgggatcttgttatcgaacaaagggttgcattcacgaggcagaaggatttcgggaaagaacaaagggagctacaatgggcacatgcacagagaaccctgcacggtctgcaagcaccagatgctaagatgttcccggagcgaacccatttcaacgagctttcccaaatggccgaagaagctaagagaagagccgagatcgccaggttgcgggagcttcacacacttaagggtcatgttgaatctgttgtcagactaaaaggtctcgacattgaaaccattcaacaagcttacaccgtctgagagaagcatagagagagcccaagaaccgtctcaaactcattcaaaaaggtcaatattcctgtgtgaaacatcgatacaaattatgcatgtaagtatcagtttcttagtagagtctttttggttgggttttatttgttcttccgagttttaagatatgttctgttattatgatgaagtatgacagaaaatagaaacagagtcctcacaatgaaagacaaattttattctgaaatacatctgatgttataaatc

SEQ ID NO: 931 - DNA, 3271 bp, Arabidopsis thaliana
gagtgtgttagcttcccatactgccactaacctttagcggttttctcatcttctctactcttctttctcttttctgagaaacccaaaagacaaaaacgaagaagaagattaggaaatcatcttgagaaacaggaggtagcaggagaatatgggggacaaggaagaagtccttgaggctgttttgaaagaaactgtggatctggagaatgtacctattgaagaagtttttgagagtctgagatgtagcagagaaggtctcactacagaagctgctgatgaaaggctggctctttttgggcataacaagctcgaagagaagaaggaaagcaaattcctgaaatttcttggtttcatgtggaaccctctttcttgggttatggaagctgctgctatcatggctattgctcttgctaatggaggagggaagccacctgattggcaagactttgttggtattattactctgcttgtgattaactccactatcagtttcatagaggagaacaatgccgggaatgctgctgctgcactcatggcacgtcttgccccaaaagcaaaggttcttcgagatggaagatggggtgagcaggatgctgcaattcttgttccgggtgatataatcagcataaagctcggggatattgttccagctgatgctcgccttctcgagggtgatccccttaaaatcgatcagtcttctcttaccggtgaatctctcccagtaaccaaaggtccaggggatggtgtgtattctggctccacttgcaaacagggagagcttgaagcagttgtgattgcaacgggagtccataccttctttggaaaggccgcacatcttgtcgatacgaccaaccacgttggccattttcaacaggtgttaactgccattgggaacttttgcatctgctctatcgcagtggggatgataattgagattgtcgttatgtatcccattcaacaccgtgcatatcgtcctggaattgataaccttcttgtgcttctcattggcggtatcccaattgccatgcctacagttctctctgtgaccatggccattggctcgcataggttatctcagcagggagcaataaccaagaggatgacagcgattgaggaaatggctggcatggatgtgctttgcagcgacaagaccggaactttaacattgaataaacttactgttgacaaaaatcttatcgaggttttcacgaaaggagtggatgcggatacagtagttctaatggcagctcaagcctctagactggaaaaccaagatgccattgatgctgctatagttgggatgcttgctgaccctaaagaggcacgggctggtgttcgagaggttcactttcttccattcaatcccactgacaagaggacggctcttacatatattgacagtgatggtaaaatgcatagggtcagcaaaggtgcacctgagcaaatcctaaatcttgcacacaatagagcagagattgagcggagagtacatgctgtaatagacaagttcgctgaacggggtttgcgatctcttgccgtggcataccaggaagttccggaagggacgaaagaaagtgctggaggcccttggcaatttatgggtctcatgcctctttttgacccacctaggcatgacagtgccgagacaattagaagggctttaaatcttggggtgaatgttaaaatgatcacaggggatcagttggctataggaaaagagactggccgccgtttaggaatgggaaccaacatgtacccctcatctgctttgcttggacagcacaaggatgagtctattggtgccttacccatcgatgatcttatagaaaaggccgacggctttgctggcgtttttcctgagcataaatatgagatagttaagcgactacaagcgaggaagcatatctgtggaatgacaggtgatggagtaaatgatgcgcctgctcttaaaaaggctgatattggcattgcagttgctgatgcaactgatgcagcacgtagtgcttcagatatcgttcttactgaacctggtcttagtgttatcatcagcgctgtcttaaccagccgtgctatcttccagagaatgaaaaattatacaatctatgcggtttccatcactatccgtattgttcttggcttcatgctgctagctcttatatggaagtttgactttccacccttcatggttcttatcattgccattctgaatgatggcacaattatgacaatatcaaaagacagagtgaaaccttcccctcttccagatagctggaaactctcagagatttttgcaactggcgttgtgtttgggagctacatggcgatgatgacagttatatttttctgggctgcatataaaaccgacttcttcccgcgaacatttggagtttcaaccctggagaaaacagcacatgatgatttccggaagcttgcctcggcaatatacctgcaagtcagcatcataagtcaggcgcttatctttgtgacccgatcacggagttggtcttatgtagaacgtcctgggatgttgcttgtggtagcctttatccttgcacaattggtggctactctaattgcagtctatgcgaattggagctttgctgcaatagaagggatcgggtggggatgggccggggtcatctggctttacaatatcgtattctatattcctcttgatatcatcaagttcttgattcgttatgcccttagcggaagagcctgggatcttgttatcgaacaaagggttgcattcacgaggcagaaggatttcgggaaagaacaaagggagctacaatgggcacatgcacagagaaccctgcacggtctgcaagcaccagatgctaagatgttcccggagcgaacccatttcaacgagctttcccaaatggccgaagaagctaagagaagagccgagatcgccaggttgcgggagcttcacacacttaagggtcatgttgaatctgttgtcagactaaaaggtctcgacattgaaaccattcaacaagcttacaccgtctgagagaagcatagagagagcccaagaaccgtctcaaactcattcaaaaaggtcaatattcctgtgtgaaacatcgatacaaattatgcatgtaagtatcagtttcttagtagagtctttttggttgggttttatttgttcttccgagttttaagatatgttctgttattatgatgaagtatgacagaaaatagaaacagagtcctcacaatgaaagacaaattttattctgaaatacatctgatgttataaatc

SEQ ID NO: 932 - DNA, 3402 bp, Orobanche aegyptiaca
tctttcttctttaacctgggctgccttctgtttctccttgtttcttctcagcagcataagagcccttgttcatggtgatttttgtgaactaaagcttgatttgtaagtagtttttggagaaagaaagtttatagattctgaagatgggggagaagccagaagttttagacgctgttctgaaggaaactgtggatttggaaaatattccagttgaggaggtgtttgaaaatttgagatgcacaaaagatggtctttcaactgacgctgctcaagagaggttatccatttttggatacaacaagcttgaggagaagcgggagagcaaattctttaagtttctggggtttatgtggaaccctctttcatgggttatggaagctgctgctataatggctattgctcttgctaatggaggaggtaagcctcccgattggcaggactttgtgggtatcatcacattacttgtgataaactcgacaatcagttttatcgaggagaataatgccggcaatgcagcagctgctctcatggctcgtctagctccgaaagcaaaagttctgagagatggaaggtggaatgaggaagaggcatccgttttagtgcctggtgatataatcagtatcaaattaggtgatatagttcctgctgatgctcgtttgcttgagggcgatccattgaaaattgatcagtctgctttgacgggagagtcccttcctgtgacgaaggggccaggggacggtgtatactcgggctcgacttgcaaacaaggagaaatcgaggctattgttattgccactggggtccacacattctttggaaaggccgcgcatctcgttgatagcactaaccaagtggggcatttccaaaaggtgctgacggcaatcggaaacttctgtatttgctcgatcgctgtaggaatgattatagagataattgtgatgtaccctattcaacatagggcataccgtcccggaatcgacaatcttcttgtgcttctcattggtggaattccaattgctatgccgactgtcctttcggtgaccatggccattggttctcatcgtttggctcaacagggagctattactaaaagaatgactgctatagaggagatggctggcatggatgtgctttgcagtgataagacggggactttgacactgaacaagcttaccgttgacaagaatctcattgaggttttcgccaaaggagtcgatgcagataccgttgttttgatggcggctcgagcctctcggacagagaatcaagacgccatagacgcagctatagttgggatgttggctgatcccaaggaggcacgagctggcattcgagaaatacacttccttccttttaaccccaccgacaagcgaactgcattgacttatatagatggtcaaggaaaaatgcacagggtcagtaaaggtgcacccgagcagattctaaaccttgcccacaataagtccgacatagagaggagggttcatgctgtgattgacaagtttgcggaacgaggtttaagatctcttgcggtggcatgtcaggaagttccagaaggaacgaaagagagtcctggaagccaatggcagtttattggtctgatgcctctctttgatcctccgagacacgacagtgcggaaactataagaagggcattaaatcttggagtgaatgtcaaaatgattactggggatcaactcgcaataggaaaggaaacaggacgaaggttgggaatgggaactaacatgtatccttcgtcggctttgcttgggcagcacaaggatgaatctattgctgctctaccagttgatgagctcatagagaaagctgatggttttgctggtgttttccctgagcacaaatacgaaatagtaaaacgcctacaagccttaaaacatatttgtggaatgacgggtgacggagttaacgatgcgcctgctttgaagaaggctgatatcggaattgctgtggctgatgccaccgatgccgctcgaagtgcttctgacattgtacttacggagcctggacttagtgttattattagtgctgttctaaccagtcgtgcaatatttcaaaggatgaagaattacacgatttatgctgtttctattacaattcgaatcgtgctcggtttcatgttgttggccctcatatggaaattcgatttccctccttttatggtgcttatcattgcaattctcaatgatggtacaatcatgacgatatcaaaagacagagtaaaaccatctccgctgccggacagctggaagctagctgagattttcgcaactggagtcattcttggtggttacttggcaatgatgactgtcattttcttttatgcagcatacaaaacagatttctttccgaaagtatttggggtgtcgacccttgagaagacggcccatgatgactttagaaagcttgcttcggcaatatatcttcaagttagcactattagtcaggcactaatattcgtcacaaggtcccggagctggtcatttgttgaacgtcctggtttgttgcttgtggcagcatttctggtcgcccagctggtagctactctgatagcggtttatgcaaattggagttttgcagcaattgaaggaatcggttggggctgggcaggagtgatttggctttataatatcgttttctacatcccacttgatatcatcaagttcttgacccgttacgctcttagtgggagggcttgggatcttgttctcgagcaaaggattgcattcaccaggaaaaaggatttcgggaaagagcagcgtgagctcaaatgggcgcatgcacagaggacccttcatgggctgcaagtgcccgataccaaaatgttcaacgagactaacaatttctcggaactcaatcagttagccgaggaagcaaaaaggagagctgagattgccaggttaagggagctccacacactgaaaggtcatgttgaatcggtggtgaggttgaagggtctcgatatagacacaattcagcaagcatacaccgtgtgatcgaggagatactattaacctatcttccaaaggtgcaaattcaactcgtgtttggagtcgaggtatttgtatcgttatgttgtatgagtatatatataatactaagatgtgcggcaagctctggaccggttatataaacttgcatccgcaggaactaaatttgtaatttttatatttatgcaaatcgtatgctgtctccttcacgtcgttccagtcgatatttatcttcgaaattgatgtttatagatatgtaatgcctttaagtagtgtacgtggttagttattatgttttgctaaagtatcgggtgtacatggaataacaaaatgtgagacattttggtcattttgtgcatgaatttcccttcgtagtatcgttctttttacttca

SEQ ID NO: 933 - DNA, 3288 bp, Sciadopitys verticillata
aaattgtggtggtaggaacagtgaaattgtggtggttgagctgcaattgtggaatgatcgggcgtagcaaagtgccaaggtagtaaatctgatttgcagaaatgggtgataaggcggccactctggaggccattaacaaagaagctgtagatttggagaatattcctatcgaggaggtttttgagaatctgagatgtagcagggagggtttgagcagccaagctgctcaggagaggctcggtatatttggctacaacaagctcgaagagaaaaaggaaagcaaattcctcaagttcttggggtttatgtggaaccctttgagttgggtaatggaagcggcagctatcatggctattgccttggccaatggaggaggtaagcctccagattggcaggattttgtaggcatcataacattgcttattataaactccacaataagtttcttagaagaaaacaatgctggtaatgctgctgcagcactgatggctcggctggctccaaaggccaaagtcctcagagatggacagtggagggaagaggatgcagcagtactagttcctggtgacataatcagcattaaacttggagatattgttcctgcggatgctcgtcttcttgagggagacccattaaaaattgatcagtctgcactcactggggagtctttgccagtaaccaagggtcctggtgatggggtttattctggatctacttgcaaacaaggtgaaattgaagccattgtcattgccactggagtccacactttttttggaaaagcagcccatcttgtggatagtacgaatcaagttggtcatttccaaaaggttttgacagcaattgggaatttttgcatttgctcaattgccatcggtatgataattgagattattgttatgtatcctattcaagaccgtaaatatcgcccagggatcgataatcttctggtgctcctaattggtgggattccaatagcaatgcctactgttctttctgtgacaatggcaattggatctcatcgtctatctgaacagggtgcgatcacaaaacggatgacagcaattgaagaaatggctggaatggatgtgctttgtagtgacaagacagggacattaactctaaacaagcttactgtggacaaaaaccttattgaggtctttgccaaaggagttgacaaggatacagttgtcttgatggctgcaagagcatccagaacagagaaccaagatgccattgatgctgcaattgttgggatgcttgctgatcccaaggaagctcgggcaggcattcaagaaattcatttccttccttttaatccgactgacaaaaggacagctttgacctatattgacggtgaaggaaaaatgcatcgtgttagcaaaggtgccccagaacagattctcaaccttgcacataacaagtcagaaattgagcgccgagttcatacagtaattgacaagtttgctgaacgcggtcttcgttctcttgcagttgcctatcaggaagttccagagggcacgaaagatagccctggagggccctggcagttcattggattgatgcctctttttgatcctccacgtcatgacagtgctgaaacaattcgaagggctcttaatctcggtgtgaatgtaaaaatgattacaggcgaccaattagctatcggcaaggagacaggccgacggctgggtatgggtacaaatatgtatccatcatcgtctttgctagggcagcataaggatgaatcaattgcagctttgcctattgatgaattgatagaaaaggctgatggctttgctggcgttttcccagagcataagtatgaaattgtgaagcgtttgcaggctagaaagcatatatgtggaatgactggtgacggtgttaatgatgcacctgcattaaaaaaggcagatatagggattgctgttgcagatgcaactgatgcagcacgaagtgcctctgatatcgttcttacagagccaggattgagtgtgattatcagtgcagtgttgacaagtcgtgcaatctttcagagaatgaagaattacactatatatgcagtgtcaatcaccatacgtattgtgttgggctttatgcttttggctttaatatggcagtttgactttccaccattcatggtacttataattgccatattgaatgatggtactataatgacaatttccaaagatagggttaaaccatcgcctctaccagacagctggaagcttgctgagatttttgcaactggaattatcattggcagttaccttgctttgatgaccgtaatatttttctgggctgcttacaagacagatttcttcccgcgaacatttggtgttgaaagtcttcagcataaagatcaagatgacatgagaaaactaagtgcagcagtttacctgcaagttagtaccatcagtcaggcacttatatttgtgactcgttccagaagttggtcttttgtggagcgaccgggtcttttgcttgtatttgcattttgcgttgcccaactgattgcgacaataattgcagtttatgcgaactggggatttgctgcaataaagggcatgggctggggctgggccggtgttgtgtggctttacaatataattttttacttcccccttgatattataaaattctttattcgatatgcaatgagtgggaaggcctgggatcttgttattgagcaaaggacggcattcacaaggcaaaaggattttggaaaagaggcccgtgagcttaagtgggcacatgctcagcggacactgcatggtttgcatcctccagatacaaaaatgttcagtgagagaagcaactttactgatcttaatcaaatggctgaggaggcgaaaagacgtgctgagattgcaaggctgagagagctgaatactttgaaaggacacgtagagtctgttgtaaggctgaaggggttggacatcgatacaattcaacaagcatacactgtttgaattaatgtatcttcttctttccagcttaatataggggtttggataaaaatattttgctctatgacatgttgtgtaatatagttcaaaggctgttattttaacatttggcatagaccaaaagacttccaggcattgtagagataatactaaatagctatttggccgaattcccagacctttgtaattcagttaggtttcttagagctagaaaatgtggctttaatatcctttgttttaggtgtaagttttgtgtactaggaagcagtgaaatatctttgtgattttggtggtttatatcttgccagggaggtggggc

SEQ ID NO: 934 - DNA, 3900 bp, Populus trichocarpa
cactactcgacagcggttggttctcctagttgttggctctctttgcagatttggtgttggtggggtgtcttcgttttggctcctgaactcgtttttcacgctcgaaatcaagtcttttttaacttggtaatgcttgtctgaactggaaatctcaagtttttttgcctcttttcatggcggttgtgctgtgaagtttgatctttgattggtttggtctgtagagagagagagtttacttaaggagaagatgggagacaagggtgaagttttggaggctgttttgaaggaaactgtggatttggagaacatacccattgaggaagtattagagaatctgagatgtagcagagaaggtctcacaactcaggctgctgaggagaggctagccattttcggtcacaacaagcttgaagagaagaaggagagaaaattcttgaaattcctgggctttatgtggaatcctctgtcatgggttatggaggctgctgctatcatggctattgctcttgcaaatggaggaggaaagcctccagattggcaagactttgtgggtatcattactctgcttgtgattaactctaccatcagttttatcgaggaaaataatgcgggtaatgctgctgctgctctcatggctcgtcttgcacccaaagctaaggttcttcgagatggaagatggaatgagcaagatgctgctgttttagttcccggtgacattattagcatcaaacttggagatattatccccgctgatgctcgtttactagaaggagatccgcttaaaattgatcaatctgcacttactggtgagtcccttcccgtgacaaaaggtcctggagatggtgtttactctggttctacttgcaaacaaggagagattgaagcagtagttattgccactggtgtccacaccttctttgggaaggctgctcaccttgtggatacaactaaccaagtcggccacttccaaaaggcaaggagatataattgttacatgatctttgtcttgactgcaatagggaacttctgcatatgttcaattgctattgggatggttatagagcttattgtcatgtaccccattcaagataggaaatatcgtcctggaattgacaatcttcttgtgcttctcattggtggaattccaattgccatgcctacggtcctctcagtcacaatggctattggttctcataggttatcgcagcagggagccatcacgaagagaatgactgcaattgaagagatggctggcatggatgtgctttgcagtgacaagactggaacattgacattaaacaaactaactgtggacaaaaatctcattgaggtttttgcaaaaggagtagatgcagatgctgttgttttgatggcagctcgagcctctagaatagagaaccaagatgcaatagatactgctattgttggaatgctggctgatccaaaggaggcacgtgctggaattcaggaagttcatttccttcctttcaatcctactgataagcggacagccttgacatatattgatagtggaggtaaaatgcacagagtcagcaaaggtgcaccagaacagattctaaatctttcacacaataagtcagacattgagcgaagagtacatgccgtgattgataaatttgcagaaagaggtttacgttctcttgcggtagcataccaggaggttccagaaggaaggaaagagagtgctggaggcccttggcaattcattggcctcttgcctctctttgatccaccaaggcatgatagtgcggagactattaggcgggctttgaatcttggagtgaatgtcaaaatgatcactggggatcaactggcgataggaaaggaaactggacgtcgtttgggaatgggaaccaacatgtacccttcatctgcattgctagggcaaaacaaggatgagtctattgccgctttaccaattgatgaattaatagaaaaagctgatggatttgctggcgttttccctgagcacaaatatgagatagtaaaacgtttgcaagctaggaaacatatctgtgggatgactggtgatggagtcaatgatgctcctgctctcaagaaggctgacattgggattgctgttgctgatgcaactgatgcagctcgtagtgcttctgatattgtccttactgaacctggccttagtgtcattatcagtgctgtcttgacaagtcgagcaatctttcagaggatgaaaaattacacgatctatgcagtttccattacaatccgtattgtgcttggtttcatgctgctggctctcatatggaagtttgactttccaccttttatggtgcttatcattgccattctcaatgatggtaccataatgacaatatcaaaagatagggtgaagccatctcctctaccagacagctggaagttggcggagatatttacaactggaattgttcttggtagttatctggccatgatgactgtcatattcttttgggtagcatataaaacagacttcttcccaagggtatttggagtgtcaaccctggagaaaacagctcacgatgacttccgaaagcttgcatcagcaatttatttgcaagttagcactatcagtcaagcacttatatttgtcacccgatctcgaagttggtcatttgttgaacgtcctgggttattacttgtggtggcttttatcattgctcagctgattgccactctgattgcagtctatgcaaattggagctttgcggcaattaaagggatcggttggggttgggctggtgtaatttggctctataatatcatcttctattttccacttgacttcatcaagttctttatccgctatgctttgagtgggagggcatgggatcttgtaattgagcaaaggattgctttcacaaggcaaaaagattttgggaaggaacaacgcgagcttcaatgggcacatgcacagagaaccttgcatgggttgccactaccagacacgaagatgttcactgagcggacacatttcaccgaactcaatcagatggctgaggaagcaaaaaggagagctgaaattgcaaggttgagggaactccatacactcaagggtcatgtagaatctgtggtgaggctgaagggccttgatatagacacgattcaacaagcatacacagtctgaagatcatctggagggatagagcacaataaatggcaaatcttaccactaccagcatgttgttgtgagttacctggaactacaatgccaattatcggtacaatgttctgagttccatacctaacagtgatgggcatctttaatctatttcttctctggtctattcttactttgcaatgcccacaagagggaaagctcatctttttgccgtttatgtttatataggaaggttatggacgctggtccttttctctgttgtattatgtttatatagccgggtaattatcatggaactgtcttttttctctgttgcactacaaacaaactcgagttcagtttagtaatcatcgtggcagccaatgtggtttggggacgagccattgaacatcagatagttgggtgataaaactgctgtttcggctgctatttgtttcatgtcatctgttgccaaactatttcatgcctccgtattttccagtccaacactgcttgtgtctggttatgtcttgagaatcaatttacaatgtgttgaggtagcgaatgtgcctgaagaagctgatgtacgacatcaattcttgtttctggttgcagtttgctcattgaacggatattgaccattgatttttagcaaaatccttgaagccagttgtttgaatcttttaattcgttggcattatgacagtttaaatgttggggatattattcccagggattgaaacccattgaaagttgcttttgtcgatgcaaagtacacg

SEQ ID NO: 935 - DNA, 3543 bp, Populus trichocarpa
atgggagacaagggtgaagttttggaggctgttttgaaggaaactgtggatttggagaacatacccattgaggaagtattagagaatctgagatgtagcagagaaggtctcacaactcaggctgctgaggagaggctagccattttcggtcacaacaagcttgaagagaagaaggagagaaaattcttgaaattcctgggctttatgtggaatcctctgtcatgggttatggaggctgctgctatcatggctattgctcttgcaaatggaggaggaaagcctccagattggcaagactttgtgggtatcattactctgcttgtgattaactctaccatcagttttatcgaggaaaataatgcgggtaatgctgctgctgctctcatggctcgtcttgcacccaaagctaaggttcttcgagatggaagatggaatgagcaagatgctgctgttttagttcccggtgacattattagcatcaaacttggagatattatccccgctgatgctcgtttactagaaggagatccgcttaaaattgatcaatctgcacttactggtgagtcccttcccgtgacaaaaggtcctggagatggtgtttactctggttctacttgcaaacaaggagagattgaagcagtagttattgccactggtgtccacaccttctttgggaaggctgctcaccttgtggatacaactaaccaagtcggccacttccaaaaggcaaggagatataattgttacatgatctttgtcttgactgcaatagggaacttctgcatatgttcaattgctattgggatggttatagagcttattgtcatgtaccccattcaagataggaaatatcgtcctggaattgacaatcttcttgtgcttctcattggtggaattccaattgccatgcctacggtcctctcagtcacaatggctattggttctcataggttatcgcagcagggagccatcacgaagagaatgactgcaattgaagagatggctggcatggatgtgctttgcagtgacaagactggaacattgacattaaacaaactaactgtggacaaaaatctcattgaggtttttgcaaaaggagtagatgcagatgctgttgttttgatggcagctcgagcctctagaatagagaaccaagatgcaatagatactgctattgttggaatgctggctgatccaaaggaggcacgtgctggaattcaggaagttcatttccttcctttcaatcctactgataagcggacagccttgacatatattgatagtggaggtaaaatgcacagagtcagcaaaggtgcaccagaacagattctaaatctttcacacaataagtcagacattgagcgaagagtacatgccgtgattgataaatttgcagaaagaggtttacgttctcttgcggtagcataccaggaggttccagaaggaaggaaagagagtgctggaggcccttggcaattcattggcctcttgcctctctttgatccaccaaggcatgatagtgcggagactattaggcgggctttgaatcttggagtgaatgtcaaaatgatcactggggatcaactggcgataggaaaggaaactggacgtcgtttgggaatgggaaccaacatgtacccttcatctgcattgctagggcaaaacaaggatgagtctattgccgctttaccaattgatgaattaatagaaaaagctgatggatttgctggcgttttccctgagcacaaatatgagatagtaaaacgtttgcaagctaggaaacatatctgtgggatgactggtgatggagtcaatgatgctcctgctctcaagaaggctgacattgggattgctgttgctgatgcaactgatgcagctcgtagtgcttctgatattgtccttactgaacctggccttagtgtcattatcagtgctgtcttgacaagtcgagcaatctttcagaggatgaaaaattacacgatctatgcagtttccattacaatccgtattgtgcttggtttcatgctgctggctctcatatggaagtttgactttccaccttttatggtgcttatcattgccattctcaatgatggtaccataatgacaatatcaaaagatagggtgaagccatctcctctaccagacagctggaagttggcggagatatttacaactggaattgttcttggtagttatctggccatgatgactgtcatattcttttgggtagcatataaaacagacttcttcccaagggtatttggagtgtcaaccctggagaaaacagctcacgatgacttccgaaagcttgcatcagcaatttatttgcaagttagcactatcagtcaagcacttatatttgtcacccgatctcgaagttggtcatttgttgaacgtcctgggttattacttgtggtggcttttatcattgctcagctgattgccactctgattgcagtctatgcaaattggagctttgcggcaattaaagggatcggttggggttgggctggtgtaatttggctctataatatcatcttctactttccacttgacttcatcaagttctttatccgctatgctttgagtgggagggcatgggatcttgtaattgagcaaaggattgctttcacaaggcaaaaagattttgggaaggaacaacgtgagcttcaatgggcacatgcacagagaaccttgcatgggttgccactaccagacacaaagatgttcactgagcggacacatttcaccgaactcaatcagatggctgaggaagcaaaaaggagagctgaaattgcaaggttgagggaactccatacactcaagggtcatgtagaatctgtggtgagactgaagggccttgatatagacacgattcaacaagcatacacagtctgaagatcatctggagggatagagcacaataaatggcaaatcttaccactaccagcatgttgttgtgagttacctggaactacaatgccaattatcgctacaatgttctgagttccatacttaacagtgatgggcatctttaatctatttcttctctggtctattcttactttgcaatgcccacaagagggaaagctcatctttttgccgtttatgtttatataggaaggttatggacgctggtccttttctctgttgtattatgtttatatagccgggtaattatcatggaactgtcttttttctctgttgcactacaaacaaactcgagttcagtttagtaatcatcgtggcagccaatgtggtttggggacgagccattgaaaatcagatagttgggtgataaaactgctgtttcggctgctatttgtttcatgtcatctgttgccaaactatttcatgcctccgtattttccagtccaacactgcttgtgtctggttatgtcttgagaatcaatttacaatgtgttgaggtagcgaatgtgcctgaagaagctgatgtacgacatcaattcttgtttctggttgcagtttgctcattgaacggatattgaccattgatttttagcaaaatccttgaagcca

SEQ ID NO: 936 - DNA, 3183 bp, Glycine max
atgggggacaagtcccaagttttggaggctgttttgaaggaaactgttgatttggagaacatacccattgaggaggttcttgagaatctgagatgtggcagagaagggctcagcagtgaagctgctgaggagaggctcaccatttttggtcacaacaagctagaagagaagaaagagagcaaatttttgaagttcttgggatttatgtggaatcctctgtcatgggttatggaggctgctgctataatggctattgctcttgcaaatggaggggggaaggctcctgattggcaagactttgtgggtatcattaccttgcttctcatcaattcaactatcagtttcattgaggagaacaatgctggtaatgctgcagcagctctcatggctcggctcgctccgaaagcaaaggttcttcgagatggtaggtggaatgagcaagatgctgcggtcctggttcccggtgacataatcagcatcaaacttggagatattattcctgcagatgcccggcttcttgaaggggatcctttgaaaattgatcaatctgcacttaccggtgagtcactgccagtgacaaagggtcctggtgatggagtatattctggttctacatgcaaacaaggagagattgaagctgtggtcattgctactggtgttcatactttctttgggaaagctgctcatcttgtggatactaccaatcaagtcttgactgcaattgggaacttctgcatatgttcaattgcattggggatggttattgaaattattgttatgtatcccatccaagatcggccatatcgttctggaattgataacctccttgtacttctcattggaggaattccaattgccatgcccacagttttgtctgtgaccatggccattggttctcacaggctagctcagcagggggccatcaccaagaggatgacagccattgaagagatggcaggcatggatgtgctttgcagtgataaaactgggactctgacattgaataagcttactgttgacaaaaatcttgttgaggtttttgcaaaaggagtggatccagatactgttattttgatggcggcccgagcttcaaggcttgagaatcaagatgcaattgatacagccatagttgggatgttggctgatccaaaggaggcacgtgctggcatacaagaagtacattttcttcctttcaatcctaccgataagcggacagcattgacttatcttgatcaagatggcaaaatgcatagagtaagcaaaggtgcaccagaacagatcctgaatcttgcacacaataaggcagacattgaacgtagagttcattcagtgatagacaagtttgcagagcgtggtttacgatctcttgctgtagcataccaagaagttcctgatggaaggaaagagagtgctggaggcccgtggcaatttattggccttttgtctctctttgacccacctaggcatgatagtgcagaaacaatacgaagggcactaaaccttggagtaaatgtcaaaatgattacaggggatcagcttgctataggaaaggaaacaggtcgtcgcttgggaatgggtaccaacatgtatccttcatcagctttacttgggcaggacaaggatgaatccattgttgccttgccaattgatgaactaatagaaaaggctgatggatttgctggtgtatttcctgagcacaagtatgagatcgtgaaacgcttgcaagctaggaaacatatttgtggaatgactggtgatggagtgaacgatgcacctgccctcaagaaagcagacattggtatagctgttgctgatgctactgatgcagctcgcagtgcatctgatattgttctaacagaacctggacttagtgttattattagtgctgttttgacaagccgagcaatcttccagagaatgaaaaattatacaatttatgcagtatcaattacaatacgtattgtgcttggtttcatgttgctggctctcatttggaagtttgactttccaccctttatggtgcttattatcgctatcctaaatgatggtactattatgacaatttcaaaagatcgtgtaaaaccatctcctctgccagatagctggaagctagcagagatatttactactggagttgtgcttggaagttacctggcaatgatgacagttatattcttttgggcggcatacaaaactaactttttcccgcgagtgtttggagtcccaactcttgaaaaaactgctcatgatgattaccggaaacttgcctctgcaatctatcttcaagtgagcactattagtcaggctcttatatttgtaactcgatctcgaggttggtcttatgttgagcgtcctggtttattgctggtgtttgcttttattgttgctcaactgattgccaccttgattgcagtatatggaaactggagcttttgctcaattgaaggaataggttggggttgggctggtgttatatggttatataacatcatattctacatcccacttgatatcattaaatttttaattcgctatgctctgagtggtagggcttgggaccttgtcattgagcaaaggattgcattcacaaggcaaaaggactttggaaaggaacaacgtgaactacaatgggcacatgcgcaaagaacattgcatggattacaaccagctgacaccaagttcaatgagcgtacacatgtcaatgaactcaatcaaatggccgaagaagctaaaaggagagctgaaattgcaaggttgagagaactgcatacactaaaaggtcacgtagaatcagttgtgagattgaaggggcttgacatagacacaattcagcaagcatacacagtctgaatatgcttatatatatttgcatagttatactgtaaagagttacattctaatgttgctgagaagaatataatgtaatgattacacatgttcaactttaatgtcctttttactctgccgtctgttttgagcacttaaaggagtgcttttgtgaggtcactttatgtcatcttgtttcttgttatcactctatctgtcacacattctccacaatttcatgatgccatgaacgaagagaaattcatattcacccttgtatcttatgcttctgatttcattttctatctatgtacctcaatttctttcatctttggaaattaattataaagtttgaag

SEQ ID NO: 937 - DNA, 3785 bp, Pseudotsuga menziesii
gtgaaaacggggcgtggagagaataaaagtggggccaggtttgctgtattaataaggccatggtgaaaacggtgaaaacggggcgtggagagaataaaagtgggtttggacacctggaagcttattatatattataaggattacacctctcacattctttctttctgtcaactgaaattccatcgccccactggtattttaagcctaatccagtttatcacgtccccagttcgaatccccaaagttaaagtgactggttgttgccatatctaagcctgtggagctctatatgatgcattgattgctccattacatgtgcgtgctttgtgggagccgtggcagatagtgaatccgatttgcggaaatggctgacaaagcagctactctggaagccattaacaaagaagctgtggatttggaaaatattcccatcgaggaggtttttgagaatctgagatgcagcagggagggtttgagcagccaagctgcgcaggagaggctcaccatattcggatacaacaagctggaagagaaaaaggaaagcaaattcctcaagttcttgggttttatgtggaaccccttatcatgggtcatggaagccgcagctgtgatggccattgctttggcaaatggaggaggtaagcctcctgattggcaagattttgttggtatcttaacattgcttgttataaactccaccataagtttcatagaagaaaacaatgctggcaatgccgctgcagcactgatggctcggttggctccaaagagcaagattctcagagatggacaatggagtgaagaagatgcagcggtgcttgttcctggtgacataattagcatcaaacttggagatattgttcctgcagatgcacgtcttcttgaaggagaccctttaaagattgatcagtctgctctcactggtgagtctctgccagtaacaaagggccctggcgatggggtttattcgggctctacctgcaaacagggcgaacttgaatgtgttgtcattgctactggggtccatacattttttggtaaagcagcgcatcttgtggacagtacaaaccaagttggccacttccaaaaggttttgacggcaattgggaatttctgcatttgctctattgcaattggcatgataattgagatcattgttatgtatccaattcaagaccgtcactatcgccctggaatcgataaccttctagttctcctcattggtgggattccaatagcaatgcctactgtcctttctgtgacaatggctattggatcccaccgtctagctcaacagggtgctatcacaaaacggatgacagctattgaagaaatggctggaatggatgtgctttgcagtgacaaaactggaacattaacactgaataagcttactgtggacaagaaccttattgaggtttttaccaaaggatatgacaaggatacagttgttctgttggctgcaagagcatcccgaatagaaaatcaagatgccattgatgcagcaattgttgggatgcttgctgatcctaaggaggcgcgggcaggaattcaagaggttcattttcttccttttaatccgactgacaagaggacagctctcacttatgttgacaatgaagggaaaatgcatcgagctagcaaaggtgctccagagcagattctcaaccttgcgcataataagtcagaaattgagcgccgagttcatacagtcattgacaagtttgctgaacggggactccgatctcttgcagttgcatatcaggaagttccagagggcaggaaggagagtccaggagggccctggcatttaattggactgatgcctctttttgatcctccacgccatgacagtgctgaaacaatcagaagggctcttaatcttggtgtaaatgtcaaaatgatcactggagatcaattggctattgccaaagagacaggtcgccgactgggcatgggtacaaacatgtatccatcatccactttactaggtcaggataaggatgaatcaattgcagctttgccagttgatgacctgatagagaaggctgacggttttgccggtgttttccctgagcataagtacgagattgttaagcgattgcaggctagaaagcacatatgtggaatgactggtgatggtgttaatgatgcacctgcactaaagaaggcagacataggaattgccgttgctgatgcaactgatgcagcaagaggtgcttctgacatagttctgacagagccaggtctcagtgttattatcagtgcagtcttgacaagtcgtgcaattttccagcgaatgaagaattacactatatatgcagtgtcaattacaatacgtattgtgctaggttttatgcttttagcgttgatatggaagtttgacttcccgccattcatggtacttataattgccatattaaatgatggtactataatgaccatttctaaggacagggttaaaccatcacctttaccagatagctggaaactagcagagatttttgccaccgggatcattattggcagttacctagcattgatgactgttatatttttctgggctgcttacaagacagatttcttcccgagaacatttggtgttgcaagtcttcagaaaaaagaccaagatgatataagaaaactgagtgctgctgtttacctgcaagttagtactgttagtcaagcacttatatttgtgactcgttcgcggagctggtcttttatggagcggcctggtctcttgcttgtatttgctttttgcgttgcacaactgattgctacgctaattgcggtttatgcgaactggggatttgctgcaatagagggcatgggctggggttgggctggtgtggtgtggctttataatatcatcttttactttccccttgatataataaaattcttcattcgatatgctctgagtggcaaggcttgggatcttgttattgagcaaagaacggcatttacaaggcaaaaggacttcggaaaagaggcccgtgaacttaaatgggcgcatgcccaaaggacactacatggtttgcatacaacagacacaaaaatgttcagtgaaagaggcaactttactgacctcaatcaaatggcggaggaggctaagagacgtgctgagattgcaaggttgagagagttgcatactttgaaaggacacgtagagtctgttgttaggctgaaaggcttggatatagatacaattcagcaggcatacactgtttgaatcaatgcgatttttttctgccagcgtgctatggggacttgcttgaaaacagttgtacctttttgacatgtgttctgttagctaatgaagatattggtgttctaaacaagttctagtaacttttcttgtaaaagagttgaaaggataattttaagcgcgccgttctttgctcttcagtcgggcctattatagctgcagagtgttgtgttcaatgttccgtcggttttatgcggtgtttattggcacaaattaagaagcagtaagatctcggatggtattgtgggtcaactagttgggtttcatattcttgttgatctaaacctcgttttctgaatctgatggaactgcactcaacattgtcagactatatgaattgacatattggctagtacgacctgcaagaagttgaccatcactttgtgtttaatagtccgaatctcttagtttggacgtaatgctattttgaaagacctgtttatcttcaagtttttatggcaattttcagaatagctggtcaaaactttgttttgattactttgattacattaca

SEQ ID NO: 938 - DNA, 3204 bp, Brachypodium distachyon
cgatggacgagaaggcgtccaatctggacgccgtgctcaaggagtcggttgatctcgagaacataccgttggaggaggtattcgagaacctgagatgcagtcgcgagggtctctcctccacccaggccgagcagcgcctagccatcttcggccccaacaagctagaggagaaaaaggagagcaagttcctgaagttcttggggttcatgtggaacccgctgtcatgggtcatggaggcagccgccatcatggccattgcgctcgccaatggaggagggaagccacccgattggcaggacttcgtggggattattaccctgctcatcatcaactccacaatcagtttcattgaggagaacaatgctggaaatgccgctgctgctctcatggcccgcctcgcccccaaggccaaggttcttaggaacggtcggtggaacgaggaggaatcggccatccttgttccaggagacatcatcagtgtaaagcttggggatatcatcccggctgacgcccgtctccttgagggtgatccgctgaagattgatcagtcttcgctgacgggtgagtctctgccagtgaccaaaggccctggtgatggggtgtactctggctccacttgcaagcagggtgaaatcgaggctgttgtcattgccactggtgtgcacacattctttggcaaggctgcgcatcttgtcgattcaacaaaccaagttggccattttcagaaggcaagcttttgctccctgttcctggacttgtttgttctgactgccattggaaacttctgcatctgttcaattgctgtgggaatggttattgagattgttgtcatgtacccgattcaacacagggcttacagaccaggaattgacaaccttttggtgcttctcattggaggaattcccattgccatgcccactgttctttctgtgactatggcgattgggtcacaccgcctggctcaacagggagcaattacaaagaggatgacagcaattgaggaaatggctggcatggatgttctttgtagtgacaagacagggacactaaccttgaacaagttgactgtggacaagaatcttatagaggttttccaaaggggtgttgatcaggacactgtgatactaatggctgccagagcttcacgaacagaaaatcaggatgccatagatgccacgatggttggtatgcttgctgaccccaaggaggctcgtgctggtattcaagaggttcattttctgccgttcaatccaactgacaaaagaactgctttaacctacctcgatggagaggggaaaatgcatcgtgttagcaagggtgcaccagaacagattctagagcttgcatacaacaaatcagagattgaaagaagagtcagagttgtgattgacaaatttgctgagcgtggcctgcgatcacttggtgtggcataccaggaagtgccagatggtaggaaagaaagtcctggaggaccatggcagttcatcgggctcttgccactttttgacccccctcgacatgatagtgcagaaacaatcaggagagcactcaatcttggtgtcaatgttaaaatgattacaggtgatcaacttgcaattgggaaggaaacagctcgccgtttggggatgggtactaatatgtatccttcatctgctttactgggacaacataaggatgagtcaattgttgctttgccagttgatgaattgattgagaaagctgatggctttgctggtgtctttccagaacacaaatatgagattgtgaaacgtttgcaagcaagaaaacatatatgtggtatgactggagatggtgtaaatgatgctccagctttgaagaaggctgatattggtattgcagtggatgactcgactgatgcagctcgaagtgcttcagatattgtcttaactgaaccaggccttagtgtgattattagtgctgtgttaacaagtcgagcaattttccagcggatgaagaattacaccatatatgctgtgtcaattacaatccgtatagtgcttggttttatgcttcttgcgctgatatggcagttcgacttcccaccatttatggtcctaatcattgcgatcctcaatgatggtaccataatgacaatttcaaaggacagagtaaaaccatctccacaacctgatagctggaagttatctgagatttttgcaactggggttgtccttggtagttatttagccatgatgacagtcattttcttttgggcagcatacaaaactgacttcttcccgcgcgtgtttcacgttgaaagccttgagaaaactgcccaggatgacttccagaagcttgcatctgctatctacctgcaagtcagcacaatcagccaagctctcatctttgtaacacggtctcgcagctggtcatttatggagcgtcctggattcttactggtctttgctttcttggtggctcagctaattgctactctcattgctgtgtatgctgattggggatttgccgcaatcaagggcattggatggggctgggctggtgtcatctggctttacaacattgtcttttacttgccactggatgtcatcaagttcctcattcgttatgcgctgagtgggagagcatgggatcttgtccttgatcaaaggattgccttcacgcggaagaaggatttcgggcgggaagaacgtgagctcaagtgggccaccgctcagaggacgctacatgggctccagccaccagagtcgacaacattccaaggcatgaccagctacagcgaactcaatcagctcgcggacgaggcccggaggagagctgaaatcgcgaggctgagggagctgaacaccctgaaggggcggatggagtcggtggtgaggcagaaggggctggaccttgagaccatccagcagtcgtacaccgtatgatcggtttgctgaggcttgaatgaatacatgttgtgtactagctagctaggcaaacaataacgatgattccgattcgcgaggagcgtgggtttcgagtgtcgtcggtgcggtgctgatcgcagtcgcttcatccctatttatgtccattaatcgcccccggcagacaatctattagatgatcatatatatagtacggagtacatttttggtttttgttgttctggagctggcttggctctccctgtggttgtggtctgaattcagctgaatctggagcatcgtaacggcaacatggcca

SEQ ID NO: 939 - DNA, 3316 bp, Gossypium hirsutum
atggggatccctactttagaacaatcctacccttaaaaaaaaagtaatttggctcatttattattgatattcttatgagacaaaacaaacaatattaaccagaaagacagaaaaagcagagtatttgcagaggaaatgatggagtctgttttctgtctcctcaatttctgattttctttgtgttttaagtctttcaaattctctccttttgttttagtcttgtggtgtctaaggtctgaaaaacaccaactttattgatatggaaaacaaggatgaaactttggatgctgtgcttaaggaagctgttgatttggaaaatgtgccacttgaagaagtttttcaaactttgaggtgtaacagagatggtttaaccactgaagctgcagagcaaaggctttcgatttttggctataataagcttgaggaaaaacaggagagtaaaattttgaagtttttggggtttatgtggaaccctctctcatgggttatggaagctgctgctatcatggctattgctcttgccaatggaggagggaaaccacctgactggcaagattttgttgggattattactcttcttattattaattcaacaataagtttcatagaagagaacaatgctggcaatgcagctgctgctttaatggctcgtcttgctcctaaagctaaggtttttcgagatgggaagtggtctgaagaagaggcctctattcttgttccaggtgatgtcatcagcattaaactcggggacattattccggcagatgctcgactcctcgatggtgatccactcaaaatcgatcagtcttcattaactggtgagtctcttccggtaacgaaaggccctggtgacagtatttactcgggttctacatgcaaacaaggagagattgaagccgtcgtgatcgccaccggtgttcatacgttcttcggcaaagctgctcaccttgttgattcaacaaatcaacaaggtcactttcaaaaggtgttgactgccattggtaatttctgtatatgttccatcgcagtcggaatgataacagaaatcatcgttatgtacccgattcaggaccgtgagtatcgtcctggaatcgacaatttgctggtactactcattggaggaattcctattgccatgcccacagttctatctgttacaatggcaattgggtctcatcgcttatctcttcagggagctataacaaaaagaatgacagcaatagaagaaatggctggcatggatgtcctttgcagtgataaaactggaactttgacattgaacaagttatcagttgacaaaaatcttatcgagatttttgcgaaaggagtagatcccgatactgtagttctgatggcagctcgtgcatctcggctggaaaaccaggatgccattgatgctgctatagtagggatgttggctgatccaaaggaggcacgagccggtattcaagaagttcacttccttccattcaatccaaccgataagcgaacggctcttacatatattgataatcaaggtcgaatgcaccgagtcagcaaaggtgcacctgaacagattcttaatcttgcacacaataaatcagagttggaacgtcgagttcatgctgtaattgataagtttgcggagcgtggattgcggtcactggcagtagcatatcaggaagttcctgacggacgaaaggagagctcaggaggtccatggcaatttattggcctgatgcctttgttcgatccacctagacatgacagtgcagatacaattcgaagggcgttgaatctcggagtgaacgtgaaaatgatcacaggtgatcaactggcgatagcaaaggaaacaggacgccgtctcggaatgggaaccaatatgtatccctcatcatccttgttaggacaaaacaaagaagagtctattgctgctttaccagttgatgagttgattgagaaagctgacggttttgctggtgttttccctgagcacaagtatgagattgtgaagcgcctacaagccaggaaacatatatgtggaatgactggtgatggggtcaatgatgctcctgctcttaagaaagcagacattggcatagctgtggctgatgcaaccgacgcagctcgtagtgcttccgacattgtcttgaccgaacctggtcttagtgtcatcatcagtgctgtactaaccagtcgagccatattccagaggatgaaaaactacacaatatatgcagtctccattacaatccgtattgtgctcggtttcatgttattggcattgatatggaagtttgatttccctccattcatggtccttattattgctatccttaatgatggcaccattatgacaatatccaaggatagagtgaaaccatctccactgccagacagttggaagttagcagaaatctttgcaactggaatcattcttggtggttacttagccatgatgactgtcattttcttttgggcagcatacaagacagacttcttccctagaacatttggggttaaaagccttcagaaaaccgaccgcaaggacataaaaatgcttgcttcggcagtatacctgcaagtgagcattatcagtcaagctctcatatttgtaacacgagcaaggagttggtctttcctcgagcgtcccggtcttttactggttttggcttttgtcgtagctcagctgattgctacattaatagcagtatatgcaaactggggttttgctgcaattgaaggaattggatggggttgggcaggtgtgatatggctttacaaccttatcttttacattccactcgattttatcaagtttttcatccgatacgccctcagtggaaaagcttgggatctcgtcatcgaacaaaggatcgctttcacaaggaagaaagacttcgggaaagaagaacgtgaactgaaatgggcgcatgctcagaggacactccatggattgcagccaccggacaccaagatgtttggcgaccgaactagttacaatgaacttaatcaaatggctgaagaggcaaagagacgagctgaaattgcaaggttgagggaactgactacgctaaaagggcacgtcgaatcagtagttagactgaagggtcttgacatagacacaattcagcaagcgtacactgtctgaaaaagacataatacatttcggctctacttattgtacatatactgctgggagtaataatgacctataatatgtcatcttaatgcagtaactgctttcttatacgtttaaatccttcatcttcttcatagactcctgtttgtcatggcttcaatgtaatttttgcatactgttctatctatctccttt

SEQ ID NO: 940 - DNA, 3288 bp, Triphysaria pusilla
  misc_feature (6)..(6): n is a, c, g, or t
  misc_feature (125)..(125): n is a, c, g, or t
  misc_feature (815)..(815): n is a, c, g, or t
  misc_feature (856)..(856): n is a, c, g, or t
  misc_feature (1061)..(1061): n is a, c, g, or t
  misc_feature (1121)..(1121): n is a, c, g, or t
  misc_feature (1409)..(1409): n is a, c, g, or t
  misc_feature (1454)..(1454): n is a, c, g, or t
  misc_feature (2219)..(2219): n is a, c, g, or t
  misc_feature (2255)..(2255): n is a, c, g, or t
  misc_feature (2294)..(2294): n is a, c, g, or t
  misc_feature (2330)..(2330): n is a, c, g, or t
  misc_feature (2405)..(2405): n is a, c, g, or t
  misc_feature (2408)..(2408): n is a, c, g, or t
  misc_feature (2450)..(2450): n is a, c, g, or t
  misc_feature (2471)..(2471): n is a, c, g, or t
gccgcnttgagaggccatgtgcagttttgttgttctttggcctttctgctacttttacacatcaatagcatttatacctaaacataccaaaattcaatctttaccagaaaagcaaagaaaatacnacggtctaatactatttctcaaagttgaaaaattaatctctaatcactgctgcaactgcaaatatactctctgtgctgggaggggactgagtgacgacgaaagttagcagattttagaagatggcggagaagcctgaagctttggatgctgttttgaaggaaattgtggatttggagaatattccaattgaggaagtgtttgagaatttgagatgcactagagagggtcttacaaatgaagctgctgaggagagattggccatttttggacacaacaagcttgaggaaaagaaggagagcaaagtcctcaagttcttggggttcatgtggaacccactttcatgggtcatggaagctgctgctataatggcaatagctcttgctaatggaggaggtaagcctccggattggcaggattttgttggcatcatcactttgcttgttataaactcgacaattagttttatcgaggaaaacaatgccggaaatgcagctgctgctctcatggctagtctcgccccgaaagcaaaagttctgagaaatgggaggtggaacgaagaagaggcatccgttttagtgccgggtgatattatcagtatcaaactcggcgatatagttcctgctgattctcgtttgctcgacggtgatccgctgaagattgatcagtctgctttgacgggtgagtcactnccggtaacaaagtcgcccggggacggtgtatactcaggttngacgtgcaaacagggagaaatcgaggcgattgtcattgccaccggggtccacacgttcttcggaaaggccgcacatctcgtcgatagcactcatcaagtgggccatttccaaaaggtgttgacgtcaattgggaacttctgcatatgctcaattgctgtgggaatgattatagagattattgtgatgtacccaattcagcacagngattaccgtcccggaattgacaatctccttgtgcttctcattggagggattccgattgcnatgccgactgttctttccgttacaatggccattggttctcatcgtttggcacaacagggagctattacaaagagaatgacggctatagaggaaatggctggcatggatgtgctttgcagtgataagaccgggactttgacactgaataagcttaccgttgacaagaatcttattgaggttttcactaaaggaatagatgcagatactgttgttttgatggctgctcgagcctctaggactgagaatcaagatgcaatagatgctgctatagttgggatgttggctgancccaaggaggcacgagctggcattcgagaaatacacttccttccntttaaccctactgataagcgaactgcgttgacttacatagatggtgagggaaaatggcacagggtcagtaaaggtgcaccggagcagattatacaccttgcacacaataaatcggacatagagcgaagggctcatgctgtgattgacaagtttgctgaacgaggtttgaggtcgcttgccgtggcgtaccaggaagttccagaaggaacgaaagagagtccaggaggcccgtggcagtttattggtctaatgcccctctttgatcccccgagacatgacagtgcagaaactataagaagggctttaaatcttggagtaaatgttaaaatgataactggtgatcaactcgcaataggaaaagaaaccggacgaaggttaggaatgggtactaacatgtatcctttatcggctttgttgggaaagaacaaggacgaatcaattgctgctctaccaattgacgagcttatagaaaaagccgacggatttgccggtgtctttcccgagcacaagtacgaaattgtaaagcgcctacaagctctaaaacatatatgtggaatgacgggtgatggggtaaacgatgctccggctctgaagaaggctgatattggaattgccgttgccgatgccaccgatgcagctcgtagtgcttctgacattgttcttactgagcctggcctcagtgttattattagtgctgttttgactagtcgtgcaatttttcaaaggatgaaaaattatacgatttatgctgtttctattacgatncgtatagtgcttggcttcatgttgttagcactcatntgggaattcgactttccaccttttatggtgcttatcatngcaattctcaatgatggtacaattatgacgatatcnaaagatagagtaaaaccatctcctctgcccgacagctggaagcttgccgagattttcgcaactggagtcgttctnggnggttacttggctatgatgactgtcattttcttttgggctgcntacaaaacagatttctttccnagtgtatttggggtgtcgacccttgagaaaactgcccatgatgactttaggaagctagcttcggcaatatatcttcaagtgagcactatcagtcaagctctaatatttgtcacgagatcccgaagctggtcatatgtcgagcgtcctggtttgttgcttgtggccgcctttatagttgcccaactggtagctactctcatcgccgtttacgcaagttggagctttgcggctattgaagggattggttggggctgggccggcgtgatttggctttacaacatcattacctacatcccacttgatatcctcaaattcttgatccgttacgctctcagtggacgggcttgggatcttgtttttgagcgaaggattgcattcaccaggcaaaaggatttcggaaaagagcaacgtgagctcaaatgggcccatgcacaaaggacccttcatggccttgaagtacctgataccaaaatgtttggcgaaactaacaatttctcggaacttaatcagttggctgaggaagcaaaaaggagagccgagattgccaggttaagggagctgcatacactaaaaggtcatgttgaatccgtggtgaggctaaagggcctcgatatagaaacgattcagcaatcatacaccgtatgaggaggtttaatctatatgttcgacgtgtgcaattaaactcgagcttggagtcgaggtaatttgtctttgtttagttgctttgagtatatataatagatgtggcaagctctggatcgattataaacttgcatttgcggataaataacggtattttattgtcagtaagttgaca

SEQ ID NO: 941 - DNA, 2873 bp, Manihot esculenta
atgggtgacaaagatgaaaccttggaggctgtcctgaaggaagctgtggatttggagaacgtgccaattgaagaggtttttcaaactctgagatgtaattcaaatggtctcactacagaggctgcagagcagagacttgctatttttggatataataagcttgaggaaaagcaggagagtaagattttgaagttcttgggttttatgtggaaccctctttcatgggtcatggaggcagcagctatcatggctattgcacttgccaatggaggagggaaaccacctgactggcaagattttgtaggaattattactttgcttctcataaattctacaattagtttcatagaagagaacaacgctggtaatgctgctgctgctctcatggctcgtcttgctcccaaagccaagatccttcgagatggaagctggattgaggacgatgcttccattcttgttcctggtgatattatcagcattaagcttggagatatccttcctgcagatgctcgtcttcttgaaggtgatccattgaaaattgatcagtctgctcttaccggcgagtctcttcctgtgacaaaaggaccgggtgacagtgtttattcaggttctacatgcaagcaaggagagattgaagctgtggtcattgctacaggtgttcatacattctttggcaaggctgcccatcttgtggatacgacaaatcaagttggacactttcaaaaggtattgactgctattgggaatttctgtatatgctccatagccatggggatgataatagaaataattgtcatgtacccaattcaacaccgaaaataccgtccaggaattgataatttactagtacttctcattggaggcattcctattgcaatgccgacagttttatctgtgacaatggcaatagggtcccatcgtttatctcagcagggagctataacaaaacgaatgacagcgatagaagaaatggcaggcatggatgttctttgcagtgacaaaactggaactctaaccttgaataaacttacagttgataagaatttgattgagattttagctaaaggagtagacgcagatactgtggttctgatggcagcaagagcttctcgagtagaaaaccaggatgcaatagatgctgcaatagtgggaatgttggctgatccaaaagaggcacgagctaatattcaagaaattcacttccttcctttcaacccaatggacaagcgaactgctctgacatatattgatagtgaaggcaaaatgcatcgtgtcagcaaaggtgcaccagagcagattctgaatcttgtacacaacaaatcagaggtagaacgtagagttcatgcagtgatcgataagtttgcagaacggggtttacgatctcttgcagtggcataccaggatgttcccgatggtagaaaggaaagctcaggaggtccctggcaatttattggcctcatgcctctgtttgacccacctagacatgatagtgcagatactatacgaagggcattgaatcttggggtaaatgtgaaaatgataacaggtgatcaactagcaatagcaaaggaaacaggacgccgtctcggaatgggaaccaatatgtatccttcatcagccttattaggacataacaaggatgagtcaattgctgctttgcctgttgacgaacttattgaaaaagcagatggatttgctggtgttttccctgagcacaagtacgagattgtcaaacgtttacaagctaggaaacatatatgcggaatgactggtgatggagtaaatgatgctcctgctcttaagaaggctgacattggaatagctgttgctgatgcaactgatgcagctcgtagtgcttctgacattgtcctaacagaacctggtctcagtgttatcattagtgctgtcctaactagtcgggcaatattccagaggatgaaaaattacacaatatatgcagtctcaattacaatccgtatcgtgcttggctttatgttgctggcactcatctggcagtttgacttcccacccttcatggtgctgatcattgctatccttaatgatggcaccattatgacaatatcaaaggatagagtgaaaccatctcctcagccagacagttggaagttggcagaaatatttacaactggaatcattcttggtggctacttggctatgatgactgtcattttcttttgggcagcatacaggacagatttctttcctaaaacatttggggtttcaagccttcaaaagaaggatgaggaagactttagaaagcttgcctcagcagtctacctgcaagtgagcaccattagccaggccctcatatttgtgactcggtctaggagttggtcgtttattgaacgtcctggccttttactcgtagcagcttttgttgttgctcagcttatcgctactttaattgccgtctatgcaaactggagcttcgctgcaattgagggcactggatggggttgggctggcgttgtctggctttacaaccttatcttctatttcccacttgattttatcaagttcatcgtccgatacgccttgagtgggaaagcttgggatcttgttatcgagcaaaggattgccttcacaaggaaaaaggatttcggaaaggaagaacgtgagcttaaatgggcacatgcacaaaggaccctgcatggtttgcatccacctgataccaagatgttccatgagcgcagtaattacactgaacttaatcagatggctgaagaggcaaaaagacgagctgagattgcaagactgagagaactgcatacactgaaagggcatgttgaatcagtagtgagactgaagggcctagacatcgacacgattcagcaagcatacacagtttgaga

SEQ ID NO: 942 - DNA, 3588 bp, Populus trichocarpa
cactactctatagcggtttggttcctcgtgttgttggctttcttcgcagatttggtgttggtgggatgtcctcatttggcccctaaactcttagttcatgctcaaaatccagtctttttaacttgagagagaaattttagttaaggagaagatgggggaaaaagctgaagttttggaggctgtcttgaaggaaactgtggatttggagaacatacccattgaggaagtgtttgagaatctgagatgtagcagagaaggtctcacaagtcaggctgctgaggagaggctatctatttttggtcacaacaagcttgaagagaaaaaggagagaaaattcttgaaattcttgggttttatgtggaatcctctgtcatgggttatggaggctgctgctatcatggctattgctcttgcaaatggaggaggaaagcctccagattggcaagactttgtgggtattattacacttcttttcattaactctaccatcagttttatcgaagaaaataatgcaggtaatgctgctgctgctctcatggcacgtcttgctcccaaagcaaaggttcttcgagatggaagatggagtgagcaagatgctgctgttttagttcctggtgacattattagtatcaaacttggagatattatcccagctgatgctcgtttactagaaggagatcctcttaaaattgaccaatctgcacttactggcgagtcccttcctgtgacaaaaggccctggagatggtgtttactctggttctacttgcaagcaaggagagattgaagcagtagttattgccactggtgtccacaccttttttgggaaggctgctcaccttgtggatacaactaaccaagttggtcacttccaaaaggcaaggagatataattgttacatgttctttgtcttgactgcaatagggaacttctgcatatgttcaattgcaatcgggatgattatagagcttattgtcatgtaccccattcaagataggcagtatcgtcctggaattgacaatcttcttgtgcttctcattggaggaattccaattgccatgcctacggttctctcagtcacaatggctattggttctcataggttatctcagcagggagccatcacaaagagaatgacagcaatagaagagatggctggcatggatgtgctttgcagtgacaagactggaacattgacattaaacaaacttaccgtggacaaaaatcttattgaggtttttgcaaaaggagtagatgcagatactgttgtgttgatggctgctcaagcctctagaatagagaaccaagatgcaatagatactgctattgtcggaatgctggctgatccaaaggaggcacgtgctggaattcaggaagtccatttccttccttttaatcctactgataagcgaacagccttgacttatattgacagtggaggtataatgcacagagtcagcaaaggtgcaccagaacagattctgaatcttgcacacaataagtcagatattgagcgaagagtacatgctgtgattgataaatttgcagaaagaggtttacgttctcttgcagtagcataccagaaagttccagaaggaaggaaagagagtgctggaggcccttggcaatttattggcctcatgcccctctttgatccaccaagacatgacagtgcagagacaattaggagggctttgaatcttggagtaaatgtcaaaatgatcactggggaccaactggcgatagggaaggaaactggacgtcgtttaggaatgggaaccaacatgtacccttcatctgcattgctagggcaagacaaagatgagtctattgttgctttaccgattgatgaattgattgaaaaggctgatggctttgctggcgttttccctgagcacaaatatgagatagtaaaacgtttgcaagctaggaaacatatctgtgggatgactggtgatggagttaatgatgctcctgctcttaagaaggctgacattgggattgctgttgctgatgcaactgatgcagctcgtagtgcttctgatattgtccttactgaacctggccttagtgtcattatcagtgctgtcctgacaagtcgagcaatctttcagaggatgaaaaattacaccatctatgcagtttccattacaatccgtattgtgcttggtttcatgctactggctctcatatggaagtttgactttccaccctttatggtgcttatcattgctattctcaatgatggtaccattatgacaatatcgaaagatagggtgaagccatctcctctgccagacagctggaagttggcagagatatttacaactggagttgttcttggtagctatctggctatgatgacagtcatattcttttgggcagcatataaaacaaacttcttcccaagggtatttggagtgtcaactctggagaaaacagctcacgatgacttccgaaagcttgcatcagcaatttacttgcaagtgagcactatcagtcaagcacttatatttgtaacccgatctcgaagttggtcgtatgttgaacgtcctgggatattacttgtggtggcttttgtcattgctcagctgattgccactctgattgcagtctatgcaaattggagctttgcggcaattgaagggatcggttggggttgggctggtgtaatttggctctataacatcgtcttctacatcccacttgacttaatcaagttcattatccgctatgctttgagtgggagagcatgggatcttgttattgagcaaaggattgctttcacaacgcaaaaagattttgggaaggaacagcgtgagcttcagtgggcacatgctcagagaacattgcatgggctgcaagcaccagacacaaagatgttcacagagcgaacccatttcacagaactcaatcatatggctgaagaagctaaaaggagagctgaaattgcaaggctgagggaactccatacactgaagggtcatgtagaatcggtggtgagactgaagggccttgatatagacacaattcaacaagcatacacagtctgaggatcgtctggggagaatacaacacaataatggcgcatcttgctgaagaagagtagagacgtatagtctgtagttaccttaaacaacaacgccacctatggctacaacgttcggagttccatactttaacagtgatgcggctgtacttcttctctggtcccttcttcctctgcaatgcccacaagagggaaagctcgtctttctgccatttatgtttatatagtaaggtcatggccgctggttgttttctacactgtattatgcacaaactcatagtaggtggtgggtgatcatcaaggtactgcccttctttctctccactgtatcagacacaaactcatgttcggtttagtaattatcatggtagtcaatgtcgttgggggccaagaacctttgcaaatctgatagttgggtgatataacttctgtttcagctgctgtctttttgttttttgtcatctgttgtcgcaccatttcatcccccattatatcctggtcttatagacaaggtagaacttcaagaataagtttggagtt

SEQ ID NO: 943 - DNA, 3227 bp, Gossypium hirsutum
aaacaatattaaccagagagacagaaaaaacagagtatttgcagaggaaatgatggagtctgttttctgtctcctcaatttctgattttcattgtgtttcaagtctttcaaattctctccttttgtttaagtcttgtggtgtctaaggtttgaaaaacaccaactttatcgatatggaaaacaaggatgaaactatggatgctgtgcttaaggaagctgttgatttggaaaatgtgccacttgaagaagtttttcaaactttgaggtgtaacagagatggtttaaccactgaagctgcagagcaaaggctttctatttttggctataataagcttgaggaaaaacaggagagtaaaattttgaagtttttggggtttatgtggaaccctctctcgtgggttatggaagctgctgctatcatggctattgctcttgccaatggaggagggaaaccacctgactggcaagattttgttgggattattactcttcttactattaattcaacaataagtttcatagaagagaacaatgctggcaatgcagctgctgctttaatggctcgtcttgctcctaaagctaaggtttttcgagatgggaagtggtctgaagaagaggcctctattcttgttccaggtgatatcatcagcattaaactcggggacattattccggcagatgctcgactcctcgatggtgatccactcaaaatcgatcagtcttcgttaaccggtgagtctcttccggtaacgaaaggccccggtgacagtatttactcgggttctacatgcaaacaaggagagattgaagccgtcgtgatcgccacaggtgttcatacgttcttcggcaaagctgctcaccttgttgattccacaaatcaacaaggtcactttcaaaaggtgttgactgccattggtaatttctgtatatgttccatcgcggtcggaatgataacagaaatcatcgttatgtacccgattcaggaccgtgattatcgtcctggaatcgacaatttgctggtactactcattggaggaattcctattgccatgcccacagttctatctgttacaatggcaattgggtctcatcgcttatctcttcagggagctataacaaaaagaatgacagcaatagaagaaatggcaggcatggatgtcctttgcagtgataaaactggaactttgacattgaacaagttatcagttgacaaaaatcttatcgagatttttgcgaaaggagtagatcccgatactgtagttctgatggcagctcgtgcagctcggctggaaaaccaggatgccattgacgctgctatagtagggatgttggctgatccaaaggaggcacgagccggtattcaagaagttcacttccttccattcaatccaaccgataagcgaacggctcttacatatatcgataatcaaggtcgaatgcaccgagtcagcaaaggtgcacctgaacagattctgaatcttgcacacaataaatcagagttggaacgtcgagttcatgctgtaattgataagtttgcagagcgcggattgcggtcactggcagtagcatatcaggaagttcctgaaggacgaaaggagagctcaggaggtccatggcaatttattggcctgatgcctttgttcgatccacctagacatgacagtgcagatacaatacgaagggcgttgaatctcggagtgaacgtgaaaatgatcacaggtgatcaactggcgatagcaaaggaaacaggacgccgtctcggaatgggaaccaatatgtatccctcatcagccttgttaggacaaaacaaagaagagtctattgctgctttgccagttgatgagttgattgagaaagctgacggttttgctggcgttttccctgagcacaagtatgagattgtgaagcgcttacaagccaggaaacatatatgtggaatgactggtgatggggtcaatgatgctcctgctcttaagaaagcagacatcggcatagctgtggctgatgcaaccgatgcagctcgtagtgcttctgacattgtcttgaccgaacctggtcttagtgtcatcatcagtgctgtactaaccagtcgagccatattccagaggatgaaaaactacacaatatatgcagtctccattacaatccgtattgtgctcggtttcatgttattggcattgatatggaagtttgatttccctccattcatggtcctcattattgctatccttaatgatggtaccattatgacaatatccaaggatagagtgaaaccatctccactgccagacagttggaagttagcagaaatctttgcaactggaatcattcttggtggttacttagccatgatgactgtcattttcttttgggcagcatacaagacagacttcttccctagtacatttggggttaaaagccttcagaagaccgaccgcaaggacataaaaatgcttgcttcggcagtatacctgcaagtgagcattatcagtcaagctctcatatttgtaacacgagcaagaagttggtctttccttgagcgtcccggttttttactggttttggcttttgtcgtagctcagctgattgctacattaatagcagtatatgcaaactggggttttgctgcaattgaaggtattggatggggttgggcaggtgtgatatggctttacaaccttatcttttacattccgctcgattttatcaagttcttcatccgatacgccctcagtggaaaagcttgggatctcgtcatcgaacaaaggatcgctttcacaaggaagaaagacttcgggaaagaagaacgtgaactgaaatgggcgcatgctcagaggacactccatggattgcagccaccagacaccaagatgtttggcgaccgaactagttacaatgaacttaatcaaatggctgaagaggcaaagagacgagctgaaattgcaaggttgagggaactgactacgctaaaagggcacgtcgaatcagtagttagactgaagggtcttgacatagacacaattcagcaagcgtacactgtctgaaaaagacataatacatttcggctctacttattgtacatatactgctgggagtaatgacctataatatgtcatcttaatgcagtaactgctttcttatacgcttaaatccttcatcttcttcatagactcctgtttgtcatggcttcaatgtaatttttgcatactgttctatctatctccttt

SEQ ID NO: 944 - DNA, 3441 bp, Populus trichocarpa
atgggggaaaaagctgaagttttggaggctgtcttgaaggaaactgtggatttggagaacatacccattgaggaagtgtttgagaatctgagatgtagcagagaaggtctcacaagtcaggctgctgaggagaggctatctatttttggtcacaacaagcttgaagagaaaaaggagagaaaattcttgaaattcttgggttttatgtggaatcctctgtcatgggttatggaggctgctgctatcatggctattgctcttgcaaatggaggaggaaagcctccagattggcaagactttgtgggtattattacacttcttttcattaactctaccatcagttttatcgaagaaaataatgcaggtaatgctgctgctgctctcatggcacgtcttgctcccaaagcaaaggttcttcgagatggaagatggagtgagcaagatgctgctgttttagttcctggtgacattattagtatcaaacttggagatattatcccagctgatgctcgtttactagaaggagatcctcttaaaattgaccaatctgcacttactggcgagtcccttcctgtgacaaaaggccctggagatggtgtttactctggttctacttgcaagcaaggagagattgaagcagtagttattgccactggtgtccacaccttttttgggaaggctgctcaccttgtggatacaactaaccaagttggtcacttccaaaaggcaaggagatataattgttacatgttctttgtcttgactgcaatagggaacttctgcatatgttcaattgcaatcgggatgattatagagcttattgtcatgtaccccattcaagataggcagtatcgtcctggaattgacaatcttcttgtgcttctcattggaggaattccaattgccatgcctacggttctctcagtcacaatggctattggttctcataggttatctcagcagggagccatcacaaagagaatgacagcaatagaagagatggctggcatggatgtgctttgcagtgacaagactggaacattgacattaaacaaacttaccgtggacaaaaatcttattgaggttgtttttgcaaaaggagtagatgcagatactgttgtgttgatggctgctcaagcctctagaatagagaaccaagatgcaatagatactgctattgtcggaatgctggctgatccaaaggaggcacgtgctggaattcaggaagtccatttccttccttttaatcctactgataagcgaacagccttgacttatattgacagtggaggtataatgcacagagtcagcaaaggtgcaccagaacagattctgaatcttgcacacaataagtcagatattgagcgaagagtacatgctgtgattgataaatttgcagaaagaggtttacgttctcttgcagtagcataccagaaagttccagaaggaaggaaagagagtgctggaggcccttggcaatttattggcctcatgcccctctttgatccaccaagacatgacagtgcagagacaattaggagggctttgaatcttggagtaaatgtcaaaatgatcactggggaccaactggcgatagggaaggaaactggacgtcgtttaggaatgggaaccaacatgtacccttcatctgcattgctagggcaagacaaagatgagtctattgttgctttaccgattgatgaattgattgaaaaggctgatggctttgctggcgttttccctgagcacaaatatgagatagtaaaacgtttgcaagctaggaaacatatctgtgggatgactggtgatggagttaatgatgctcctgctcttaagaaggctgacattgggattgctgttgctgatgcaactgatgcagctcgtagtgcttctgatattgtccttactgaacctggccttagtgtcattatcagtgctgtcctgacaagtcgagcaatctttcagaggatgaaaaattacaccatctatgcagtttccattacaatccgtattgtgcttggtttcatgctactggctctcatatggaagtttgactttccaccctttatggtgcttatcattgctattctcaatgatggtaccattatgacaatatcgaaagatagggtgaagccatctcctctgccagacagctggaagttggcagagatatttacaactggagttgttcttggtagctatctggctatgatgacagtcatattcttttgggcagcatataaaacaaacttcttcccaagggtatttggagtgtcaactctggagaaaacagctcacgatgacttccgaaagcttgcatcagcaatttacttgcaagtgagcactatcagtcaagcacttatatttgtaacccgatctcgaagttggtcgtatgttgaacgtcctgggatattacttgtggtggcttttgtcattgctcagctgattgccactctgattgcagtctatgcaaattggagctttgcggcaattgaagggatcggttggggttgggctggtgtaatttggctctataacatcgtcttctacatcccacttgacttaatcaagttcattatccgctatgctttgagtgggagagcatgggatcttgttattgagcaaaggattgctttcacaacgcaaaaagattttgggaaggaacagcgtgagcttcagtgggcacatgctcagagaacattgcatgggctgcaagcaccagacacaaagatgttcacagagcgaacccatttcacagaactcaatcatatggctgaagaagctaaaaggagagctgaaattgcaaggctgagggaactccatacactgaagggtcatgtagaatcggtggtgagactgaagggccttgatatagacacaattcaacaagcatacacagtctgaggatcgtctggggagaatacaacacaataaatggcgcatcttgctgaagaagagtagagacgtatagtctgtagttaccttaaacaacaacgccacctattgctacaacgttccgagttccatactttaacagtgatgcggctgtacttcttctctggtcccttcttcctctgcaatgcccacaagagggaaagctcgtctttctgccatttatgtttatatagtaaggtcatggccgctggttgttttctccactgtattatgcacaaactcatagtaggtggtgggtgatcatcaaggtactgcccttctttctctccactgtatcagacacaaactcatgttcggtttagtaattatcatggtagtcaatgtcgttgggggccaagaacctttgcaaatctgatagttgggtgatataacttctgtttcagctgctgtctttttgttttttgtcatctgttgtcgcaccatttcatcccccattatatcctggtcttatagacaaggtagaacttcaagaataagtttggagtt

SEQ ID NO: 945 - DNA, 3041 bp, Mimulus guttatus
atggcggcgaatgatgaagcaatggaggctctcaagagagaagcagttgatttggagaatattccgatcgaagaggtgtttgataatttgaggtgcaccaaagaggggctttcgtcggaggatgctatcaggaggctcgaaattttcggctacaacaagcttgaggaaaaggaggagagtaaggttttgaagttcttagggtttatgtggaatcctctgtcatgggtgatggaagctgcagcaattatggcgattgctctcgcgaatggaggaggtaaaccaccagattggcaggattttgtcggtatcatcactcttcttgtgataaactcaaccataagtttcatagaggagaacaacgccggaaatgccgccgctgctctcatggctcggcttgcacccaaagcaaaggttctccgtgatggacactggaatgaggaagatgccgctgttcttgttccaggtgacgtagtcagtatcaaattgggcgatataattcctgccgatgctcgtcttcttgatggtgatcctttaaagatagatcagtctgctctaactggagaatcccttccagcgacgaaaagcccaggtgatggtgtatactctggttctactgtcaaacaaggggagattgaagcagtagtcattgcaacaggcgtacataccttcttcggcaaggctgcccatctagtagattccactaatcaagtcggacattttcagaaggtcttgacggcgattggaaatttctgcatctgttctattgcagtgggaatggttatcgagatcattgtaatgtaccctattcaacaccgtgattatcgtccgggaatcgataatctgcttgtgcttcttattggaggaattccaattgcaatgccgacagtattgtctgtgacaatggcaattggttcgcaccgtttgtcccagcagggcgccatcactaaaagaatgacagcaattgaagaaatggccggcatggatgtgctttgcagtgacaaaaccggaacgttgaccctgaacaaactaagtgttgacaaaaatcttattgaggtcttttctaaaggagtggatgcagatactgttgtcttaatggctgcccgagcctcccggatcgaaaaccaagatgccatcgatgctgcaatagtggggatgttggcggaccccaaggaggcaagggctggaattcaagagattcatttcttacctttcaacccgactgataagcgcacagctctaacttacttagacaatcaaggtaaaatgcatcgagtcagcaaaggtgcccctgaacagatattaaaccttgcctacaacagatctgagattgagcgaagagttcattctgtcattgatagctttgctgagcgtggattacgatctcttgcagtagcataccaggaagttccggaaggaacaaaggagagtcccggaggtccatggagatttgtaggactcatgcctctctttgatcctcctaggcatgacagtgccgagactataagaagggctctcaatcttggcgtaaatgttaaaatgattaccggtgatcaactagcaatagcaaaggaaacagggcgtcgtttgggtatggggaccaacatgtatccttcatcttctctattaggacataacaaagatgagtccatcgttgctttgcctgttgacgagttgattgaaaaggctgatggctttgccggtgtttttcctgagcacaagtatgaaattgtcaagcggttacaagctcagaaacatatatgtgggatgaccggagatggggtgaacgatgcacctgctctgaagaaggctgatataggaatagctgttgcagatgctactgatgctgctcgaagtgcatctgacattgtacttaccgaacctggtctaagtgtaatcatcagtgctgttctaactagtcgagcaatttttcagaggatgaaaaattacactatatatgctgtttccatcacgatacgtattgtgcttggtttcatgttgcttgcactcatatggaagttcgacttcccaccgtttatggttctgataattgccattctaaatgatggtaccatcatgacaatatcaaaggacagggtgaaaccatctcctttaccagacagctggaagctagctgagattttcgccacaggcgttgttcttggaggctacttagcaatgatgacagtcattttcttctgggcagtatacgatactgatttcttcccgagagtttttggagttaagtccctcgagagaacagtaaacctaaacttcaaaatgctcgcctctgcaatatacttgcaagtgagtataatatctcaggctctcatatttgtgacaaggtctagaagttggtcctttatcgaacgtccaggacttctactagttggtgctttccttgttgctcagcttattgctacactaattgcagtatacgcaaactggaattttgctgcaatagaaggcatagggtggggttgggcgggggttatatggctatataacatcgtattctacttcccacttgatatgatcaaattcttcatcagatatgcattgagtggaaaggcttgggatctcgttattgagcaaaggattgcttttacgagaaaaaaagatttcggtaaggaagatcgtgaactgaagtgggcacaggcacaaaggaccctccatgggcttcatccacctgagaagcaatctggtgaccgaactaattacaatgagcttaatcagatagctgaagaggcaaaaagacgagcagaaatggcaaggctgagagaattgcacactctgaaagggcacgttgaatctgttataaagatgaagaatcttgacatagacacgattcaacaatcgtacacggtttgagtttggagaattaaggttgcctctatgtaaagaaatcagaattttggaatgtaaagaaaccgagtggctctatgtatgatgaacaatgtccacttttaatacggcaaaatgccataggtgtagtgttgtatcagacggtgaacatttgatgctactttctctgtttttgtttg

SEQ ID NO: 946 - DNA, 3112 bp, Castanea mollissima
aaaacatacccattgaggaagtgttagagaatctgagatgtagcagagaggggcttacctctgtggctgctgaggagaggctggtccttttcgggcacaataagcttgaagagaaaagggagagtaagttcttgaagtttttggggttcatgtggaacccgttatcttgggttatggaagctgctgctatcatggccattgctcttgcaaatggaggagggaagcccccggattggcaagactttgtgggaatcatagtcctgcttttcatcaactcgacaattagtttcattgaggagaacaatgtaggtaatgctgcggctgctctcatggctcgtctcgctccaaaagccaaggttcttcgagatggaaggtggaatgaacaagatgctgcgattctcgttcccggtgacattatcagtattaaattaggagatattataccagccgatgctcgtcttcttgaaggagatccattgaaaattgaccagtctgctcttactggtgagtcccttccggtcacaaaaggccctggagatggtatctactctggttcaacttgcaaacagggagaaattgaagcagtggtcattgccacaggtgtccataccttctttgggaaggctgctcatcttgttgataccaccaaccaagtaggccacttccaaaaggtcttgactgccattgggaacttctgtatatgttcaattgctattgggatgattatagaaattattgttatgtatcccattcaagaccgtgagtaccgccctggaattgacaaccttcttgtgcttctcattggaggaattccgattgccatgcctaccgttctgtcagtgacaatggctattggttctcataggttagctcagcagggagctataacaaaaaggatgacagcaattgaagagatggcgggcatggatgttctttgcagtgacaagactggaactttgacattgaacaagcttactgttgacaagaaccttattgaggtttttgcaaaaggagtagatggagatactgttgtcctaatggcagctcgagcctctagaacggagaatcaggatgcaatagattctgctatagttgggatgctggctgatccaaaggaggcacgtgctggaattcaagaagtgcacttccttccttttaatcctactgataagcgaacagctttgacttatattgaccgtgatggtaaaatgcatagagtcagcaaaggtgcaccggagcagattctaaatctcgcccacaataagtcggaaattgagcgtagagttcatgctgtgatcgacaagtttgcagaacgaggtttaagatcacttgcagtagcataccaggaagttccagaaggaaggaaggagagtgctggaagcccatggcagtttattggtctcatgcctctctttgacccacctaggcatgacagtgcagagacaataaggagggctttaaatcttggagtgaatgtgaaaatgattacaggggatcaacttgcaataggaaaggagactggacgccggttgggaatgggtaccaacatgtatccttcatctgctttgctaggacaggacaaggacgagtctattgtagctttaccaattgatgagctgatagagaaagctgatggctttgctggtgttttccctgagcacaaatatgagattgtaaagcgtttgcaagctaggaaacatatctgtggcatgactggtgacggagtcaatgatgctcctgccctaaaaaaggctgacattgggatagctgttgctgatgcaacagatgcagctcgtagtgcttctgacattgtccttacagaacccggtctgagcgttatcattagtgctgttttgaccagtagggcaatcttccagaggatgaaaaattatacaatttatgcagtttccattacaatccgtattgtgcttggtttcatgttgctcgcactcatatggaagttcgactttccaccttttatggtgcttatcattgccatcctcaatgatggtactatcatgacaatatcaaaagatagggtgaaaccatctcctttaccggatagttggaagctagcagagattttcacaactggcattgttcttggtagttacttggcaatgatgacagtcatatttttctgggctgcgtacaagacagacttcttcccgcgcgtatttggggtgtcaacccttgagaaaaatgctcatgatgacttccgaaagcttgcttcagcaatatatctgcaagtgagcaccgttagtcaggccctcatatttgtaacacgatctagaagttggtccttcgttgagcgtcctgggatgttgcttgtagtagctttcattattgctcagctgattgccactgtaattgcggtctatgcaaactggagctttgctgcaattgaagggattggttggggttgggctggcgtgatatggctttataacatcatcttctacatcccacttgatttaataaagttcttcatacgctatgccttgagtgggagagcttgggatcttgtcattgaacagaggattgcttttacaagacaaaaggactttgggaaggagcaacgtgagcttcagtgggcacatgcacagagaacattgcatgggttgcaaccacctgacacaaagatgtttactgaacgaacgcatttcacagaactcaatcaaatggctgaagaagccaaaagaagagcagaaattgcaaggttgagagaactccatacactgaaaggtcatgtagaatcagtggtgagactgaaaggtctggacatagacacaattcagcaagcatacacagtctaaggaagatcatgtatgatatctcacctaatactgttaaagatgctataactagcactgagagtaaagacatgtaatgaacctcttgttatgagttaaccttcaaacaacttttcttcatatttgatactataatatccattttcagcactcaagcagctcctatctgttctttcgtctcttgttttttttggacacctctcaaatgacctcttgtagtgccccatgatagaaaagtgcttataatattaatggcatgtagtgttcatattagtaaggtttatgtacttctggccttt

SEQ ID NO: 947 - DNA, 3044 bp, Prunus persica
atggatggaaaatctgaaactttagacgccgtattgaaggaagctgtggatttggagaacgtgcctcttgaagaggtttttctgaccttgaggtgcaacagacatgggctcacatctgaggctgctgagcaaaggttggtcatttttgggtacaacaagcttgaggagaagaaggaaagtaaggttttgaagtttttggggtttatgtggaaccctctgtcatgggtgatggaagctgcagctatcatggccatagcgcttgccaatggaggaggaaagcctcctgattggcaagattttgttgggatcattactctgcttattatcaattcaactataagtttcatagaagagaacaacgcgggaaatgctgctgctgctcttatggcccatcttgcccccaaagccaaggtctttcgaggcgggaggtggattgaggaggacgcatccattcttgttcctggtgatataatcagcattaagcttggggacataattcctgcagatgctcgtctccttgatggcgatccattgaaaattgatcagtctgcacttacaggcgagtcacttcctgtgaccaaagggcccggcgacagcgtatattcgggttcaacgtgcaaacagggagagattgaagcagtggtaattgccaccggtgttcatacctttttcggtaaggctgctcaccttgtggacaccacgaatcaacagggccactttcaaaaggtgttgactgccattgggaatttctgtatatgttcgattgccgtgggaatgattattgagatcatagtcatgtacccaattcaacatcgcaaataccgaccaggaattgacaatctgcttgtgctacttattggaggaattcccattgctatgcccacagttttatctgtgacaatggctattggttcccatcgcttatctcagcagggcgctatcactaaaagaatgacagcaattgaagaaatggcaggcatggatgtcctttgcagtgacaaaactggcactctgacattgaataagctttcggttgacaaaaatcttttagaggtctttgctaaaggggtggatgcagacaccgttgttctaatggctgctcgagcctcccgaatggaaaatcaagatgcaatagatgctgctattgtgggaatgttggctgatccgaaggaggctagagccagcattcaagaggtgcacttccttccattcaacccaacagataagcgaacagctctgacatatattgacagtcaaggtaaaatgcatcgcgtcagcaaaggtgcaccagagcagattttgaatcttgtacacaataaatcagagatagaacgtagagtacatactgtgattgataaatttgcggagcgaggtttacgatccctagcagtggcataccaggaagttccagatggaaggaaggagagccagggaggggcttggcaatttattggcctcatgcctctgtttgacccgcctagacacgatagtgcagagacaattaaaagggcattgaaccttggggttaatgttaagatgattacaggtgatcaactggcaatagcaaaagagacaggacgccgtctaggtatgggaaccaacatgtatccatcgtccagtctgttaggacagaacaaagatgagtcaattgttactttgccagttgatgaacttattgaaaaagctgatgggtttgctggtgttttcccggaacacaagtatgaaattgtcaaacgattgcaagccagaaagcacatatgtggaatgactggcgatggagttaatgatgctcctgctcttaaaaaagccgatatcggcatagctgtcgctgatgcaactgatgcagctcgtagtgcttccgacattgtcttgacagaacctggccttagcgtcatcataagtgccgtattaaccagtaggtccatattccagaggatgaagaattacacgatatatgctgtttccattacaatccgtattgtgcttggtttcatgttactggcactcatatggcaatttgacttcccacctttcatggtgttgattattgcaattctcaatgatggtaccatcatgacgatatcgaaggatagggtgaaaccctctcctctcccagacagctggaaactgtcagagatctttacaaccggaatcatcctcggtggttacctggctatgatgacggtcattttcttttgggcagcatgcaagacagacttcttccctcgcacatttggggtttcaagcctccagcacaagaacgaggatgacaacaggaagcttgcctcggcagtgtacctgcaagtgagcaccatcagtcaggccctcatattcgtcacccgttcccggagttggtcttttgttgagcgtcctggtctgttacttgtagcagcttttgttattgctcagctgattgctacgttgatcgccgtctatgccaattggagttttgctgcaattaagggaattgggtgggggtgggctggcgttgtttggctatataacctcgtcttctatttcccacttgattttatcaagttcgtcgtccgatatgctctgagcgggagagcgtgggatctcataattgatcaaaggattgccttcacgaggaagaaggatttcggaaaggaagaaagggagctaaaatgggcacatgcacagaggaccctccatgggctgcacccaccagaagccaatatattcggcgaccgcagtaattactcagaactgaatcagatggctgaagaggcaaagagacgagctgaaattgccaggctgagagaattaagtaccctgaaagggcatgtggaatcagtggtgagaaacaagggcctggacatagacacaattcagcaatcatacacagtctgagcctctcctttgcaactccaactctccatagtattagtatttgtaataatgtaaagacaaagaagatatttaattgtgattttgaggctttttatttatttaagatttcctacagctagctgcttcatgttcatacaacaaagctttccaatcaatctatttatataaaaatt

SEQ ID NO: 948 - DNA, 3299 bp, Mimulus guttatus
attagcagattttaaggatggcggaggagaagcctgaagttcttgatgctgtcttgaaggaaacagttgatttggagaatattccaattgatgaagtgtttgagaatctgagatgcacgagagagggtcttacatctgaggctgctgaggagagattagccattttcggacacaacaagcttgaagagaagagggagagcaaattcctcaagtttttagggtttatgtggaaccctctctcatgggttatggaagctgctgctataatggcaattgctcttgctaatggaggcggcaagcctccagattggcaggactttgtgggtatcatcactttacttgtgataaactcgaccattagttttatcgaagagaataacgcaggcaatgcagccgctgccctcatggcccgtctcgctccaaaagcaaaaattcttagagatggaaggtggaacgaagaagatgctgccatgttagtccccggtgatataatcagtatcaaacttggagatattatccctgcagattcccgtttgctcgacggtgatcctctgaaaattgatcagtccgctttgaccggtgagtcacttccagtgacaaaaggaccaggagatggtgtatactccggttcaacttgcaagcaaggcgaaatcgaagccatcgttattgcaactggggtccacaccttcttcggtaaagctgcgcatcttgttgattccactaatcaagtcggacatttccaaaaggcgagtttttttttttttttttctgtgttgacttcaatcgggaacttttgcatttgctctatcgctgtgggaatggttatagagatagtcgtcatgtatccgattcaacatagaaaatatcgacccggaattgacaatcttcttgtgcttttgatcggaggaatcccaattgctatgccgactgtactttctgttacgatggctattggctctcatcgtttggctcaacagggagctattacaaagagaatgactgctatcgaggaaatggctggcatggacgtgctttgcagtgacaaaacggggactttgactttgaacaagcttaccgttgacaagaatctcatcgaggttttcacgaaagggatcgatgcagatactgttgttctaatggctgctcgagcctctcgtacggaaaatcaagatgcaatagacggggctatagttggaatgttggctgatcctaaggaggcgcgggcaggtgttcgagaaatacactttcttccgtttaacccgactgataaacgaactgcgttgacttatattgacggtgaaggaaaaatgcatagggttagtaaaggtgcaccggagcagattctaaacctctcacacaacaaatcggatatagagcgaagggttcatgctgtgattgacaagtttgctgaacgtggtttacgatcactcggggtggcgtatcaggaagttccggaatgtactaaagagagtgccggaggaccatggcagtttgttggtctaatgccactcttcgatccaccgagacacgacagtgcagaaactataagaagggcattgaatcttggtgtcaatgtcaaaatgattaccggtgatcagctcgcaattgcaaaggaaacgggacgaaggttaggaatgggaactaatatgtacccttcgtcggctttgcttggacagaataaagacgaatcaattgcttctttaccagttgacgaactcatcgaaaaagccgatggttttgccggtgttttcccggagcacaaatacgaaatagtgaagcgtctgcaagctaggaagcatatatgtggaatgacgggtgatggagtgaatgacgctcctgccctcaagaaggctgatattggaattgcggttgacgatgctactgatgctgcgcgtagtgcttcggatattgtacttacggagcctggccttagtgttattattagtgctgtcctaaccagtcgagcgatttttcagaggatgaaaaattacacgatctacgctgtttctattacaatccgtattgtgctcggttttatgttgctagccttgatatgggaattcgactttccgccttttatggtgcttatcatcgcaattctcaatgatggtacaatcatgacaatatcaaaagatagagtgaaaccttctccactgcctgacagctggaagctcggtgagattttcgcaaccggagtcgtcctcggtgcttacctggcaatgatgacagtcatattcttttgggcagcttataaaaccgatttctttccgcgagttttcggtgtttcgaccctcgaaaaaacggcccacgatgacttcagaaagcttgcttcggcaatatatcttcaagtgagcactataagtcaagctctcatattcgtaacgagatcgagaagctggtcgtatgtggaacgacccggtttattgcttgtggctgcatttttcattgcacaattggttgctactttaattgcggtttacgcaaattggagctttgcagcgatcgaaggaatcgggtggggttgggccggtgtgatttggctctacaatataatattctatattccgctcgatattattaaattcttgactcgatacgctcttagtggaagggcgtgggatcttgttctcgagcaaaggattgctttcacaaggcaaaaagatttcggaaaagagcagcgcgagctcaagtgggcccacgcgcagaggacccttcacggattgcaagtacccgacactaaattgtttaatgaaaacaacaatttctcggagctcaatcagttggctgaggaagcaaaaagaagagccgagattgctcggttaagggaactgcatacgctgaaaggccacgtcgaatcggtggttaggctgaagggtctcgatatagatacaatccagcaagcgtacactgtatgagcgcgcgcgctcgcgcttgcgcgtatatgtaaaacgacacatttcgtgggtgcaaattatttaaatggagctcattatcgaggtagagttaatagagttaccgcgtttgcattataatacggtaatttgttttttcacggagtttgcatctgcggaagtgtatgcttttcgagtcattcaaatcgcgcttttctttatctttcgatgtttttcttttttcttttttatttattttaatcttgtatgaaaaaaaatattaatctagaaggaactcaaatgttgttcataaagtattgtcttttggtgatgtggcatgttttttttttttttacataatttatttttctctttattccataatttcaatgttatttttttgcctag

SEQ ID NO: 949 - DNA, 2948 bp, Ricinus communis
ggctttgctgaaatggatgacaagtctgaaactttggaggctgtgttgaaggaagctgttgatttggagaatgtgccaattgaagaagtttttcaaacacttaggtgtaattcaaatggtctcacaacagaagctgctgagcaaaggcttaccatttttggatataacaagcttgaagaaaagcaggagagtaagtttttgaagtttttggggttcatgtggaatcctctttcatgggtaatggaggcagcagctatcatggctattgcacttgcgaatggaggggggaaaccacctgactggcaagattttgttggaattattattttgcttttcatcaactctacgataagttttatagaggagaataacgctggaaatgctgctgctgctctcatggcccgtcttgctcccaaagccaaggtccttcgagatgggaggtggatagaggaggatgcctccgttctagttcctggtgatattatcagtgttaagcttggagatatcattcctgcagatgctcgtcttcttgaaggtgatcctttgaaaattgatcaggcaatttttgcaactttcttgcccttctgctgttataatggactgcagtctgctcttactggcgagtctcttcctgtgacaaaaggacctggtgatagtgtttattcaggttctacatgcaagcaaggagagattggagccgtggtcattgccactggtgttcatacattctttggcaaggctgcccacctagtggattcaacaaatcaagtgggacactttcaacaggtgttgactgcaattgggaatttctgtatatgctccatcaccgtggggatgataatagagataattgtcatgtacccaattcaacaccggccatatcggccaggaattgacaatctattagtacttcttattggagggattcctattgcaatgcccacagttttatctgtgacaatggcgatagggtcgcataggttatctcagcagggggctatcacaaaacgaatgacagcaatagaagaaatggcaggcatggatgtcctttgtagtgataaaactggaactctgaccttgaacaaacttactgttgataagaatttgattgagattgtagctaaaggagtagacacagacactgtggttctgatggcggctagagcctctcgagtggaaaaccaggatgcaatagatgctgctatagtagggatgctggctgatccaaaggaggcacgagttggtattcaagaaattcacttccttccattcaatccaacagacaagcgaacagctctaacatatattgatattgagggcaaaatgcatcgggtcagcaaaggtgcaccagaacagattttgaatcttgtacacaacaaatcagagatagaacgtagagttcatacagtgattgataagtttgcagaacgaggtttacgatcccttgcagtagcataccaggaagttcctgaaggtagaaaggaaagctctggaggtccatggcaatttattggtctcatgcctctgtttgacccacctagacatgatagtgcagaaacaataagaagggcactgaatcttggggtaaatgtaaaaatgataacaggtgatcaactggcaataggtaaggaaacaggacgccgtctcggaatgggaaccaacatgtatccttcatcaaccttgttaggacataacaaagatgagtcaattgctgctttgcctgtagatgagcttattgaaaaagctgatggatttgctggtgtattccctgaacacaaatatgagattgtgaaacgtttgcaagctaggaaacatatatgtggaatgaccggtgatggagtgaatgatgctccggctcttaagaaggctgacattgggatagctgttgcggatgcaactgatgcagctcgcagtgcttctgacattgtcctaacagaacctggtctcagtgttattattagtgctgtactaactagtcgggcaatattccagagaatgaaaaattacacaatatatgcagtctctattactattcgtattgtgcttggcttcatgttactggcactcatctggcagtttgactttccacccttcatggtgttgatcattgctatccttaatgatggtactattatgacaatatctaaggatagggtgaaaccatcccctctaccagatagctggaagttggcagagatctttacaactggaatcatccttggtggttacttggctatgatgactgtcattttcttttgggcagcatatagcacagatttctttcctagaacttttggagtttcaagccttcaaaagaaggacgatgacgactttagaaagcttgcctcggcaatatacctgcaagtgagcaccataagtcaggcactcatatttgtgactcgggctaggagttggtcttttgttgaacgtcctggcctcttacttgtagcagcttttgttattgctcagctgattgctactttgattgccgtctacgcaaactggagttttgctgcaattgaaggcattggatggggctgggctggtgttgtctggctctacaacctcatcttctatttcccacttgattttatcaagttcattatccgatatgccttgagtgggaaggcttgggatcttgtgattgagcaaaggattgccttcacaaggaaaaaggattttggaaaggaagagcgtgagcttaaatgggcacatgctcaaaggaccctacatgggttgcatccacctgatatcaagatgttcaatgaccggagtagttacacagaacttaaccagatggctgaagaggcaaaaagacgagctgagattgcaaggctcagagaactgcatacccttaaggggcatgttgaatcagtagtgaggctgaagggtttggacatcgacacaattcagcaagcctacactgtctaataaaaacaatccttttt

SEQ ID NO: 950 - DNA, 2899 bp, Helianthus annuus
ttgcaggagagtatacccattgaggaggtttttgaaaatctgagatgtagcaaagagggtctcactactgctgctgctgaagaaagattagtcatttttgggcataataaacttgaagaaaaaaaggagagcaaattcttgaagtttttagggtttatgtggaacccattatcatgggttatggaagctgctgctattatggctattgcccttgcaaatggaggagggaagcctcctgattggcaagattttgtgggtattattactttgctaattatcaactccacaattagttttattgaagaaaacaatgctggtaatgctgcagctgctctcatggctcgtcttgccccgaaagcaaagattttacgcgatgggaaatggaacgaggaagatgcttctatgttggttcctggtgatataattagcataaagttaggtgatattattccagctgatgctcgtttgctcgatggcgaccctttaaagattgaccagtcggctctaaccggcgagtctctcccggtcacaaaaggtcccggagacggtgtttattccggttcgacttgcaaacaaggtgaaatcgaagcggttgtgattgccactggggtccacacgttctttggtaaagctgctcatcttgttgatagcacaaatcaagtcggtcactttcaaaaagttttgactgcgatcgggaatttctgtatttgttctattgctgtgggaatggttatcgaaattatcgtaatgttcccgattcaagataggcaatataggcctggaatcgataatcttcttgtgcttttgatcggaggcatcccgatcgctatgcctaccgttctttctgtaacgatggcaatcgggtctcatcgattggctcaacagggagcgattacgaaaagaatgacagcgatagaagagatggcgggaatggatgtgctatgcagtgacaagaccgggacgttgactttgaacaagcttacagtagacaagaatcttattgaagtgttttccaaaggagtagatgccgataccgttgttctgatggcagcgcgtgcctccagaaccgaaaaccaggatgccatcgatgctgcaattgtcggtatgctggctgatccaaaagaggcgcgtgctgatgttcaagagttgcactttctgccttttaatcctaccgataagcgtacggccttaacgtatctggacaatcagggtaaaatgcatagagtcagcaaaggtgcccccgagcagattttgaatcttgcgcacaacaaatcagacatcgaacgccgggttcatgctgtcattgataaatttgcagaccgtgggttaaggtcacttgctgtagcataccaggaagttccggagggacggaaagagagcgccggagggccgtggcagttcattgggctaatgccgctttttgatccgccacgtcatgatagcgcggagacgattcgaagggctttgaatcttggagtaaacgttaaaatgattacaggggatcaactggcaatcgggaaagaaaccggaagacgtcttggaatgggaaccaacatgtatccttcttctgctttactcggtcaaaacaaagacgagtcaactgccgctttacccatcgacgaactcatagagaaagccgacggttttgccggtgtttttccggaacacaaatacgaaatagtaaaacgtttacaagctaggaaacacatatgtggtatgactggagatggagtaaatgacgctcctgcccttaaaaaagccgatatcggaattgcggtggctgatgcaaccgatgcagcccgtagtgcttccgacattgtccttactgagcccgggcttagtgtcatcatcagtgctgttttgaccagtcgggccatcttccaacggatgaaaaattacactatttatgcagtttcaatcaccattcgtattgtgctcggttttatgcttctggcgttgatatggaagtttgacttcccacctttcatggtgcttatcatcgcaatccttaacgacggaaccataatgaccatatcaaaggatagagtgaagccatctcctcttcccgacagctggaaactggctgagatcttcaccaccggggtggttctcggtagttacctagccatgatgacagttatatttttctgggccgcttataaaacagacttctttccgcgtacatttggtgtaccgacgcttgaaaaaacagcgcacgatgacttccggaagctggcgtcagcgatatatctccaagtcagcacaatcagccaagctctcattttcgtaacgagatctagaagctggtcattcgtggaacgtcctggttggctgctcgttattgctttcgcgattgcccaattggttgcgacattaattgcggtttatgccaactggagcttcgctgcggtagaagggatcgggtggggatgggctggagtcatctggctctacaatatcgtgttctatttcccgctcgatatcatcaagttctttatccgatacgcgcttagtgggcgggcctgggaccttgttattgagaggaggattgcgttcacgagacaaaaggatttcgggaaggaacaacgtgagctccaatgggctcatgcgcaacgaacccttcacgggcttgaagttcctgacactaaaatgtttggcgaccgcaccaatgtcacggaacttaaccagatggctgaagaagccaaacggagggctgaaattgcaaggttgagagaattacacacgttgaagggtcatgttgaatcggtggttagactcaagggtctcgacattgagacgattcaacaagcgtacaccgtctgagacacagttggctggctgttggttaccgttggaacagtcgttttttgttttttatttatttttgttttgtcttggc

SEQ ID NO: 951 - DNA, 3220 bp, Arabidopsis thaliana
gtgtctcataataaggtagtgccactactactatagcggttttatcatcttctacgcttcgatttcgtcgtcctcctcccaacaaagtttgttaggaaacgaatactcgaacagccatttcttctctatttctcgtgcgatgacgacgactgtggaggacaatcgcgaggtcctcgaggctgttttgaaagaagcggtcgatctggaaaatgtgccaattgaagaagtatttgagaatctgagatgtagcaaggaaggtctcactacacaagctgctgatgaaagacttgctctctttggccataacaaactcgaagagaaaaaggaaagcaaattccttaagtttttaggctttatgtggaaccctctttcctgggtgatggaagctgctgctattatggctattgcgcttgctaatggaggaggaaaacctcctgattggcaagactttgttggtattatcactctgcttgtgattaactccaccatcagtttcattgaggagaacaatgcaggaaacgctgcagctgctctcatggcccgtctagccccgaaagcaaaggttcttcgagatggaaggtggggtgagcaggatgctgcgattctcgttcccggtgatataatcagcatcaagcttggggatatcgtcccagctgatgcacgccttctcgagggtgatccccttaagatcgatcagtctgctcttactggtgaatctctaccagtaaccaaaagttctggagatggtgtctattccggttctacatgcaaacaaggagagatcgaagcagttgttatcgcaactggcgtccataccttttttggaaaggctgctcaccttgttgatacgacaaaccaaattggtcatttccaacaggttttaactgcaattgggaacttttgcatctgctctattgctgtggggatgctcattgagattgtcgtgatgtaccctattcaacaccgagcataccgccctgggattgataaccttcttgtgcttctcattggtggaattccaattgccatgcctacagttctgtctgtgaccatggcaattggctcccacagactatctcagcagggagctatcactaagagaatgacggcgattgaggaaatggctggcatggacgttctttgcagtgacaagacgggcactttgacattgaataaacttactgttgacaaaaatctgattgaagttttcatgaaaggagtggatgcagatactgttgtcctgatggcagctcgagcctccagactagagaaccaagatgctatagatgctgctatagtcgggatgctggcagatcctaaagatgcacgagctggtatccaggaggttcactttcttcctttcaatcctactgataagagaacggctctgacatatattgacaatgagggtaacacacatagagtgagcaaaggtgctcctgagcaaatcttaaatcttgcacacaataaatcagagattgagcggagagttcatgctgttattgataagttcgctgaaaggggtctgcgatctcttgctgtggcgtaccaggatgttcctgaagggaggaaggatagtgctggaggtccttggcaatttgtgggtctcatgcctctttttgatccgcctaggcatgacagtgctgagacgataagaagggctttaaatcttggtgtgagtgttaaaatgatcacaggggatcaactggctataggaaaagagactgggcgccgtttggggatgggaaccaacatgtacccctcatccgctttacttggacagaacaaggatgagtcgatagttgctttacctgtcgatgagctcatagagaaagctgatggctttgcgggtgtcttccctgagcataaatatgagatagtgaagcgattacaagccaggaaacatatatgtggaatgacgggtgatggtgtaaatgatgctcctgctcttaaaaaggctgacataggcattgcagttgctgatgccactgatgcagctcgtagcgcatcggatattgttcttactgaacctggtcttagcgttatcatcagtgctgttttgaccagtcgtgctatcttccagagaatgaaaaattatactatctacgcagtctccatcacaatccgtattgttctgggctttatgcttctggctctcatatggcagtttgacttcccacctttcatggtccttatcattgccattcttaatgatggtacgatcatgacaatatcaaaggacagggtgaaaccttcccctcttccagatagctggaagctttctgagatttttgctaccggtgttgtctttggcagttacatggccatgatgaccgttatatttttctgggtttcatacaaaaccgatttcttcccgagaacttttggagttgcgacacttgagaaaactgctcatgatgatttccgaaagcttgcctcagccatatacctgcaagtcagtattatcagtcaggcacttatctttgtgacccgatcgcgaagctggtcttttgtggaacgtcccgggatatttcttatgattgcctttatcctcgctcagttggtggctactctaattgcagtctatgcaaattggagctttgctgcgatagaaggaataggttggggatgggccggggtcatttggctctataacatcatattctacatcccccttgatttcatcaaattcttcatccgctacgctcttagtggcagagcctgggatcttgttatcgaacaaagggttgcgttcacaaggcaaaaagattttgggaaagaacaaagagagctgcaatgggctcacgcacaaagaacgctccatggtctacaagcaccagatactaagatgttcacagatcgaacccatgtcagtgaacttaaccaaatggctgaagaagccaagaggagagctgaaattgctaggttgcgtgaacttcacacgctcaagggccatgttgaatcagtggtgagactcaaaggactcgacatagaaaccattcaacaagcttacactgtctgagaaagtgagtgcaagctgatttcagttgggtcatgaaggttgtgtctgtagttaatacatacatattgcatataaatatcgaatcctcgtagccttcttttagcggtttgttatgttctgttctgttgtggtgatgaaagaagaaacagaaacttcgtacggaggttgaaattagcaacaaaaaacttattttacaat

SEQ ID NO: 952 - DNA, 3263 bp, Setaria italica
ccacccccaccaagaaccacctcatcccatcccgccctcgctcgcagtttcacccaccccaatccatctatccagaggtgaaaagccacattcaccagcaagctttcctgtttgctgcatataaatctggaaggggaacagcacgaacaggagagggacagacagacaagggagggagatccgtgaggagggaaggccgcctccatggctgagaaggaaggcaacctcgacgccgtcctcaaggaggccgtggacctggagaacatccccctcgaggaggtgttcgagaatctgagatgcagccgcgagggtctctccactcagcaggcgcagcagcgcctcgaaatctttggccccaacaagctcgaggagaaggaggagagcaaatttctcaagttcttgggattcatgtggaatccactctcctgggtcatggaggctgcagcaatcatggccattgctcttgccaacggaggggggaagcctccggattggcaggattttgttggcatcataactctgcttgtcatcaactcaacaatcagtttcattgaggaaaacaatgctggtaatgctgcggctgccctcatggctcgtcttgcacctaaagccaaggtgcttcgtgatggccgatggactgaggaagaggcagccattcttgtaccaggagacgttgtcagtattaaactgggagacattatacctgcagatgcacgcctccttgagggggatcctttgaagatcgatcagtcagccctgactggagaatcactgccggtcaccaaaggtcccggtgatggcgtctattctggttcaacggttaagcaaggtgaaatcgaagctgttgtgattgccactggtgttcacactttctttggaaaggctgcacatcttgttgactccacaaaccaagttggccatttccagaaggtcttgacgtccattgggaacttctgtatttgctcaattgctgtggggatgtttgttgagatcattgtcatgtatcccatccagcacagggcataccgccctggaatcgacaacctcctcgtccttctcattggaggcatccccatagccatgccgacagtcttatctgtaactatggctattgggtcacatcgtttgtctcaacagggagctatcacaaagagaatgactgcaatcgaggagatggctggcatggatgttctttgcagtgataaaactggaacattgaccctgaacaagcttactgtggacaagaacctcgttgaggtgtttgaaagaggcattactcaggatcaagtgattctcatggctgctagagcatctcgtacggagaaccaagatgctattgatactgctatagttgggatgctagctgatcctaaagaggcacgtgccggcatccaagaagttcacttcctaccattcaatcctactgacaaaagaacagcattgacatacatagacagtgatggcaaaatgtttcgtgttagtaagggtgcacctgagcagattctccatctggctcacaacaagtcagagatagagaggagggtccacgctgtgattgataagtttgcagagcgtggacttagatcgcttgctgtagcatatcaggaagtacctgaggggaggaaagaaagtcctggtggcccatggcactttgttggtctgatgccactttttgaccctccaagacatgacagcgctgaaacaattcgaagggcactcaaccttggtgttaatgtcaagatgatcacaggtgatcagctggcaattggaaaggaaacaggacgtcgcctaggaatgggtacaaatatgtatccttcttctgctttgttaggacagaacaaggatgagtctattgctgctttaccagttgatgatctcatcgagaaagccgatggttttgctggtgtattccctgaacacaagtatgagatcgtgaaacgtctgcaagcacggaagcatatctgtggcatgactggtgatggagtaaatgatgcaccagccctaaagaaagctgatattggtattgctgttgctgatgcaactgatgcagccaggagtgcttcagatattgtcctcacagaaccaggacttagtgtgatcattagtgctgtgcttacaagtcgcgcaattttccagcgtatgaagaattacacgatctatgctgtctcgatcaccatccgtatcgtgcttggatttatgctccttgccctcatttggaaatttgatttcccaccattcatggtcctaatcatagcaattctaaatgatggtaccataatgactatatcgaaggatcgtgtaaaaccatctccactacctgacagctggaagctggctgaaattttcacaactggagttgtccttggtggatatcaggcaatgatgactgtcatcttcttttgggctgcatacaagacagactttttcccaagaatatttcatgttgaaagccttgagaagactgctcaagatgatttccaaaagcttgcctctgctgtctacctgcaagtcagcactgtcagccaagctctcatctttgtgacaaggtcccggagctggtcatttgttgagcgtcctgggtttctactggtctttgctttcttggttgcgcagctgattgctacgctgattgctgtgtacgctgactgggcattcacttcaatcaaaggcatcgggtggggctgggctggtattgtgtggctttacaacatcatcttctacttcccgctcgatatcatcaagttcctcatcagatatgttcttagtgggaaagcatgggatctggtcattgagcaaaggattgcatttacaaggaagaaggactttggagggagctgaaatgggcacatgcacagaggaccctccacgggctgcaggcaccggatgccaagatgttcccagagaaggctgggtacaatgagctgaaccagatggccgaagaggcgaagaggagggccgagattgcaaggctgcgggagcttcacacactcaaggggcatgtggagtctgttgtcaagctgaaggggctcgacatcgagaccatccagcagtcctacacagtgtgatattgcctgtccagaagaaaggattttttttctttttcctttctggccaccgaagtgtgaatttgacggtggctggcctctcttttgtttatttaactgaactgcaatcacatcaccgccaagtacttgaaatgagacggaatcgcttgatctctgtaatatgtcttgtcgtcgcatggtttactagtaagtagtaaa

SEQ ID NO: 953 - DNA, 3335 bp, Glycine max
agagtgtacctgcaagtacatgaaatcctcatagaggtgtttaccatgctgtccttaaaaagctgccactttgagagttaagttaggacacacacacaaagaagaaaccaaaagcacaagaaacgtcacaacacacattctatattgggttgaagatagaaaaaaaaaacagtgttttctttgtgtgatttctcttctggttctgggtattgtgttattcacctgaagcttacacctttctgttgtggatcacctaaaacttgggttttgattgagatggctgagaaggaagaagccatgcgcgttgttttgaaggaagctgtggatttggaaaacgtgccacttgaggaggtgtttcagactctgaggtgtgattcaaatggactcacaacagaatctgctgaggagaggttggccatctttggccacaacaaacttgaagagaagaaggagagcaaggttttgaagtttttaggatttatgtggaatcctctttcatgggtcatggaagctgcagcaatcatggccattgctttggccaatggaggaggcaaacctcctgattggcaagactttgttgggattatcacactccttattatcaattcaacaataagtttcattgaggagaacaatgctggtaatgctgccgcagctctgatggctcgtctagcacctaaagctaagttccttcgagatgggaaatgggttgaggaggatgctagcattcttgttccgggtgatataattagtgttaagctaggggatattatccctgcggatgctcgtctacttgaaggcgatccactgaagattgatcagtctgcacttacaggcgagtctcttcctgtcacgaaaggccacggtgatagtgtttattcgggctccacatgcaagcagggagagatcaatgcagttgttatcgccacaggagttcataccttctttggcaaggctgcccatcttgtggactccacaaatcaagttggccattttcagaaggtcctgactgctattggaaacttctgcatatgttccattgctgtgggaatgatagtagagatcattgtcatgtacccaattcaacaccgggaatatcgtcctgggattgacaatctgctcgtgcttcttatcggaggaattcctattgccatgcctactgttttgtcagtgacaatggcaattggatcccatcgcttagctcagcagggtgctattactaaaagaatgacagcaatagaagagatggcaggaatggatgtattatgtagcgacaaaactggaactttgactttgaataaactgacagttgacaagaatcttattgagatttttgctaaaggagttgacgtagatactgttgttctgatggccgctcgggctgcgcgattggaaaaccaagatgctatagatgcctctattgtaggcatgttgggtgatccaaaagaggcaagggctggtattcaagaggttcacttcctacccttcaatccaactgacaagcggactgcgatcacttatatagacagtgaaagtaaaatgcatcgtgtcagcaaaggagcaccggagcagattttaaatcttgcacgcaataaatcagagatagaacgtagagttcattctgtcattgataagtttgcagacaggggcttacggtctcttgcagtagcctaccaggaagttcctgatggaaagaaagaaagccaaggagggccttggcaatttattggactgttgcctttatttgacccacctagacatgatagtgctcagacaatacgaagggcattaaatcttggagtaaatgttaaaatgataacaggtgatcaactagcaataggaaaagaaacaggacgccgtctggggatgggaaccaacatgtacccttcatcagctttattgggccaaaacaaggatgaatcaattgctaccttgccagttgatgagttgattgaaaaagcagatggatttgctggtgtttttcctgaacacaaatatgagatcgtgaaacgtttacaagctaggaaacacatatgtggaatgactggtgatggggttaatgatgctcctgctcttaaaaaggcggatattggaatagctgttgctgatgctactgacgcagctcgtagtgcttctgacattgttctgactgaacctggtctcagtgttatcatcagtgctgtattgaccagtcgagcaatattccaaaggatgaagaattacacaatctatgcagtttccatcacaatccgtattgtgcttggtttcatgttactggccctcatatggcaatttgattttccaccattcatggtgctgattattgctattcttaatgatggtaccattatgacaatatcaaaggacagggtaaaaccatctccatatccagatagctggaagttggcagagatctttaccactggaataattcttggtggttatttggctatgatgacagttattttcttttgggcagcatacaaaacagattttttccctcaaacatttggagtctcaagtcttcagaaaaaagatagggatgactttagaaagcttgcctcagcaatatacctacaagttagcacagttagtcaggccctcatatttgttacacgggcacggagttggtcatttgttgagcgtccaggcttgttacttgtagcagcttttgttattgcccagttgatagctaccttaattgcagtttacgcaaattggagttttgctgcgattgaagggattggatggggctgggctggtgttgtttggctttacaacctcgtcttttatatcccacttgattttatcaagttcataattcgatatgccttgagtggaagggcttgggatcttgttattgaacaaaggattgcttttacaaggaaaaaagattttggaaaggaagaacgtgaacttaaatgggcacatgcacataggacgcttcacggccttcacccaccagagactaagatgttcaatgaacgtacaagttacacagaacttaatcagatggccgaagaggctagaagacgtgcaaacattgcaaggctgagagaactgcatacactgacgggccatgttgagtctgtgtttagactgaagggccttgacattgacacaatacagcaagcatacactatctagaataatgttgagtttcatgcatgaatcgtttatgtttaatgtatgtataatgccgttagaagagtgtgatcatagagcagcaaaaaatatatactttataaatgtttgttcaaagcagttttggtggacttttgtagacatgaaactattggtgcatttaaatgttaaagagttccatttatgcttcc

SEQ ID NO: 954 - DNA, 3647 bp, Theobroma cacao
ctccaagtgtcttgcttccactcatctaatttcttcagaacaagaaaaacaaaatgaaattagggaggaggatgtaatagaaacagagtgtacccgccaagtacatgatctacttttgttgctgtttatcaatttatccccaccttgaaacaatcaatcccacccttaaaagagcggccactttgagattctggtgagagaaaaaacaataacaaccaaactttttgagaaagacacagaaaaacagagtactctgtttctgtcttctgaattctgattctctttgagttttatgagttcttcaaattttagtcttttgatgttcttgtacttgattttgtaaggcttcagaaggaccaactctattgatatggaaaacaataatgagaccttggatgcagtgctgaaggaagctgttgatttggaaaatgtgccacttgaagaggtttttcagactttgaggtgtaacaaagatggtctaaccacagaagctgctgagcaaaggcttgctatttttggctacaataagcttgaggaaaaaaaggagagcaaaattttgaagttcttggggtttatgtggaaccctctctcatgggttatggaagctgcagcaatcatggccatagcacttgccaatggaggcgggaaaccacctgactggcaagatttcgttgggattattactcttctttttattaattcaactataagtttcatagaagagaacaatgctggcaatgctgctgcagctctcatggctcgtcttgctcctaaagctaaggtttttagggacgggaagtggattgaggaggatgccgctattcttgttcctggtgatataatcagtattaaactcggggacattattcctgcagatgctcgtctccttgatggtgatccactgaaaattgatcagtctgcgctaactggtgagtctcttcccgtaactaaaggccccggtgacagtatttactcgggttctacatgcaaacagggagagattgaggcagtggtgattgccacgggtgttcataccttctttggcaaggctgctcacctcgtggattctactaatcaacagggtcactttcaaaaggtattgactgcaattggtaatttctgtatatgttccatcgcggtggggatgataacagaaatcatcgtcatgtacccgattcaacaccgtgagtaccgtccaggaattgacaatttgctggtacttcttattggaggaattcctattgccatgcccacagttctatctgttacaatggcaattgggtcccatcgcttatccctgcagggagctatcaccaaacgaatgacagcaatagaagaaatggcaggcatggatgtcctctgcagtgacaaaactggaactttgaccttgaacaagttgtcagtggacaaaaatcttgttgagatctttgcgaaaggagtagatccagatactgtcgttctgatggcagctcgtgcatctcggctggaaaaccaggatgcaatagacgctgctatagtggggatgctggctgatccaaaggaggcacgagcaggtattcaagaagttcacttccttcccttcaatccaactgataagcgaacggctctgacatatattgacaatcaaggtagaatgcaccgggtcagcaaaggtgcacctgaacagattttgaatcttgcacacaataaatcagagttggagcgtagagttcatgcagtaattgataagtttgcagagcgtggattacgatcacttgcagtagcatatcaggaagttcctgatggaagaaaggaaagctcaggaggtctatggcaatttattggcctaatgcctttgtttgatccacctagacatgacagtgcggacacaatacgaagggcactgaatcttggagtgaacgtgaaaatgatcacaggtgcgtatccttatattgatactgcgtcaaactatctcaatgcacttggcgatcaacttgcaatagcaaaagaaacaggacgccgtctgggaatgggaaccaacatgtatccttcatcagccttgttaggacaaaacaaagatgagtctattgctgctttgccagttgatgagttgattgagaaagctgatggctttgctggtgttttcccagagcacaagtatgagatcgtgaagcgcttgcaagccaggaaacatatatgcggaatgactggtgatggggtcaatgatgctcctgctcttaagaaggctgacataggcatagctgtggctgatgcaactgatgcagcccgaagtgcttcggacattgtcttgacagaaccaggtcttagtgttataatcagtgctgtactaactagtcgtgcaatattccaaaggatgaaaaattacacgatatatgcggtttccattacaatccgtattgtgcttggtttcatgttactggccttgatatggcagtttgattttccccccttcatggtgctgattattgctatcctcaatgatggtaccattatgacgatatccaaggatagggtgaaaccatctcctcagccagacagctggaaattggcagaaatctttgctactggagtcattcttggtggttacttagccatgatgactgtcattttcttttgggcagcatacgagacagacttctttccccgcacatttggggtttcaagccttcagcaaaaggaccatgatgacatgagaaagcttgcttctgcaatatatctgcaagtgagcattatcagtcaggcgctcatatttgtaacaagagcaaggagttggtcttatgttgagcgtcctggcctgttacttgtaacagcttttgtagctgcccagctgattgctacactgatagctgtgtatgcaaactggagctttgctgccattgaaggaattggatggggttgggcaggtgtgatatggctttacaaccttgtcttctatatcccactcgactttatcaagttcttcatacgatatgccctgagcgggaaggcttgggatcttgttattgaacaaaggattgctttcacgaggaagaaagactttgggaaggaagaacgtgaactaaaatgggcacatgctcagaggaccctccatgggctccaggcacctgataccaagatgttcagcgaccgcaccagtttcacagaacttaatcagatggctgaagaagcaaaaaggcgagctgaaattgcgaggctgagagaactgactacgctgaaagggcatgtcgaatcggtagttagattgaagggtcttgacatagacacgattcagcaagcatacaccgtctaagaagacatcaacattttgcacctacatgctgtacatatactgctgcggctgctgctactgctgagagtaataaagccctgtaatttgtcatccaaaatattccaactgcttttcatatgcttaaatccatcatcttcctgaaaagactcttgtttcctatggattcaatgtaatcttggtcctgttctctctacctcttttccatatataatttcattttaatgctggctctctctctaatcctatcaaggaaaagcagaaagcaacagaacagagttgatctgaaatcctagaaagaatgaatgctaatcctttaataccaatcagaaatctttgtcaataatatgaagatgcctgt

SEQ ID NO: 955 - DNA, 2817 bp, Panicum virgatum
gtgggtcatggaggctgcagctatcatggccatcgtactggccaatggtggggggaagccaccagactggcaggactttgttggtatcatcacgctgctgcttatcaactcaactatcagtttcattgaggaaaataatgctggaaatgctgctgcggcacttatggctcgacttgcaccaaaagccaaggtgcttcgtgatggccattggactgaggaagaggcagccatccttgtgcctggggacatcatcagcattaaacttggagatatcattcctgcagatgctcggctccttgatggggatcctttgaaaatagatcagtctgcgttaactggagaatcattgccagtcaccaaaggtcctggtgatggcgtctactctggttcaacggtcaagcagggtgagattgaggctgttgtgatagcaactggtgtccacactttctttgggaaagctgcacatcttgtcgactccaccaatcaagttggccattttcagaaggtcttgacagccattgggaacttttgtatttgctcaattgctgtgggaatgtttgttgagataattgtcatgtatcctatccagcatagggcatatcgtcctggaattgacaatcttttggtgcttctcattggaggcattcccatagcaatgccaacagttttgtctgtgaccatggcaattgggtctcatcgcttagctcaacagggagccataacaaaaagaatgactgcaattgaagagatggctggtatggatgtactttgcagtgataaaacgggaaccttgaccctgaataaactcactgtggacaagaacctcattgaggtttttgaaaggggcgtgactcaagaccaagtaattctgatggctgctagagcatcccgaatagaaaatcaagatgctattgatactgcaatagttggaatgctagctgatccaaaagaggcacgtgctggtattcaagaggttcatttcctgccatttaatcctaccgacaaaagaactgccttgacatacattgatagtgatgggaagatgtaccgtgttagtaaaggtgcaccagaacagattctcaacctcgcctacaacaagacagagatagaacgaagagtccatgctgtaatagacaagtttgctgagcgtggacttcgatcacttgctgtagcatatcaggaagtgccagatggaaggaaagagagtcctggtgggccatggcatttcgttgctcttatgccactctttgatcctccaaggcatgacagtgccgaaacaatacgaagggcactgaaccttggtgttaatgtgaaaatgatcacaggtgatcagctagcaattgggaaggaaacaggacgtcgcttagggatgggtactaacatgtacccttcctctgctttgctgggacagaacaaggatgagtctattgctgctttaccagttgatgatttaatcgagaaggctgatggctttgctggtgtattcccagagcacaaatatgagattgtgaaacgtctgcaagcgcgaaaacacatttgcggaatgactggtgatggcgtaaatgatgctccagccctaaagaaagctgatattggtatagcagttgctgatgcaactgatgcagccagaagtgcttctgatattgtcctaacagagcctggcttgaatgtgatcattagcgctgttcttaccagccgggcaattttccagcgcatgaagaactacactatctatgccgtctcgattacaatacgtatcgtgcttggatttatgctgcttgccctcatatgggagtttgatttcccaccatttatggtgctgattattgcaatcctaaatgatggtaccataatgacaatatcaaaggatcgagtaaaaccttcgccgctacctgacagctggaagctggctgagattttcactactggaattgtgcttggtggatacttggcagtgatgactgttatcttcttctgggctgcatataagacaaactttttccctaggatctttcatgtcgaaagccttgagaagacagctcaagacgattaccagaaacttgcctctgctgtatatctccaagttagcactatcagtcaggctctcatctttgtcacaaggtctcgcagctggtcatttgttgagcgcccgggctttctgttagtgtttgctttcttggttgcacagctgatagctacattgattgctgtgtacgctaactggggtttcacttcaatcaaaggcattggatggggctgggccggtgttgtgtggctctacaatctcgtcttttacttcccacttgatatcctcaagttcctcatccgatatgctctgagcgggaaagcttgggatcttgtcattgagcaaagaattgcatttactaggaagaaggactttggcaaggaagagagggagctcaagtgggcacacgcacagaggaccctccacggactgcagccaccagatgccaagctgttccccgagagggtgaacgagctgaatcaaatggctgaagaggcgaaacggagggctgagattgcgaggctgagagagcttcacacgctgaagggacatgtggagtcggtcgtgaagctcaagggcctggacatcgacaccatccagcagtcgtacacagtgtaacggactcatagtcatatatatgccctgggttgagtatatttaaatatctgtttctcgcagaggaacagctaattctggtagttggctgtcatcttttacttaccgtagctgtggcaccagatcaatatagtacagtacataacgggaactgatgtttatcagttgtgtgtatg

SEQ ID NO: 956 - DNA, 3165 bp, Fragaria vesca
atggatgagaaagccgaagggttagaggtggtggtgaaggaggctgtggatttggagcacgtacctattgaagaggtattcctaaccttgaggtgtgacgaacatggactcacatctgaggctgctcagcagaggctggccctttttgggtacaacaagcttgaggagaagaaggaaagtaaggttttgaagttcttagggtttatgtggaaccctctctcatgggtgatggaagctgcagctatcatggccattgctctagctaatggaggaggaaagcctccagattggcaagattttgtagggatcattactctgcttgtcatcaattcaactataagttttattgaagagaacaacgctggaaatgctgctgctgctctcatggctcgtctcgctcccacagccaaggttcttcgagatgggaagtggatcgaggaggatgcttccattcttgttcctggtgatataatcagcattaaacttggagacattcttccagcagatgcccgtctcctcgatggtgatccattgaaaattgatcagtcatcacttacaggtgagtcacttcctgtgaccaaaagccctggtgacagtgtgtattctggttctacatgcaaacaaggagagattgaagcggtggtcattgccactggtgttcatacctttttcggcaaggctgcgcaccttgtcgatagcacgaatcaacagggtcattttcaacaggtcttgactgcaattgggaatttctgtatatgttccatcgctgtgggaatgatcatagagatcatagtcatgtacccaatacaacatcgtagttaccgccctggtattgacaacctgcttgtgctacttattggaggaattcccattgccatgcccacagttttatctgtgacaatggctattggttcccaccggttggcggagcagggtgctatcactaaacggatgacggcaattgaagaaatggcaggcatggatgttctatgcagtgacaaaactgggactctgacattgaataagcttacagttgacaagactcttttagaggtctttgttaaaggggtggacgtagatactgttgttctaatggcagctcgagcatcccggattgaaaatcaagatgcaatagatgctgctattgtgggaatgttggccgatccaaaggaggcgagagccaacattcgagaggtgcacttccttccgttcaacccaactgacaagcgaacagctcttacatatattgaccttgaaggtaaaatgcatcgtgtcagcaaaggtgcaccagaacagattttgaatcttgtgcacaataaatcagagttagaacgcaaagttcatgttatgattgataagtacgcagagcgaggattaagatccctagcagtagcataccaggaagttccagagggaaggaaggagagccttggagggccttggcaattcattgcgctggtgcctttgtttgatcctcctcgacatgacagtgcagagacgattcagagggcattgaatcttggtgtgaatgttaagatgattacaggtgatcagcttgcaatagcaaaggagacaggacgtcgtctcggtatgggaacaaacatgtacccttcatcagctcttttgggacagaaaaaggacgaatcagttgcgggtttgccagttgatgagcttattgaaaaagctgatgggtttgctggagttttccctgagcacaagtatgagattgtgaagcgtttgcaagcaaaaggacatatatgtgggatgactggtgatggagttaatgatgctcctgctcttaaaaaagctgatattggcatagctgttgctgatgcaactgatgcagctcgaagtgcttctgacattgtactcacagaacctggccttagtgtcatcataagcgctgtactaactagtcgagcaatattccagagaatgaaaaattacacgatatatgctgtttccattacaatccgtattgtgcttggtttcatgctactggcactcatatggcacttcgactttccacccttcatggttctgatcattgctattctcaatgatggtactataatgacaatttcaaaggatagagtgaaaccctctcctatgccagacagttggaaactagcggagatctttgccaccggtatcatcctgggtacttacttagcagttatgacggtcattttcttttgggcagcatacgatacagacttcttccctcgtcactttggggttccaagccttcatagaaaggataatgacagctataggaagcttgctgctgcagtgtacctgcaagtgagtaccatcagtcaggctctcatattcgtcacccgggcacgtagttggtctattctcgagcgacctggtcttttacttgtagcagcttttgttattgctcagctgattgctacactcattgctgtctatgccgattggagtttcgcggcgatagagggaattgggtggggttgggctggtgtggtttggttatataatctcgtcttctatcttccacttgatatcctcaagttcatcatccgatacgcactgagtgggagagcctgggatctcgtatttgagcagaggattgccttcacaagaaagaagcatttcggaaaggaagaaagggagcttagatgggcacacgcgcagaggactctccacggtctgcaaccgccggacagcaaaaagtttggtgaacgcagttcttacacagaacttaatcagatggctgaagaggcaaaaagacgtgcagaaattgccaggctgagggagttcggcaccctgaaggggcatgtcgaatcagtggtgaggatgaagggcctggacatcgacacaattcagcaatcgtacactgtctaagatgcgattaatttagcttatggtttgcagtaggacatagtgtttgcttaaacatagaatcatgtaacaagtatgcagtatgcttatcctctaaatcacaaacttatacaaaacttaacaacaaaactagaatttgataataagttttttttgaatcaaaccgagaaatctgagcaattttcgtaaatcacaaacttataagtactgaaatgaaaacttagcttatgcagagtgacggaacttctcaaccttcttctcaagttcatctttcttggcaccgacaacccgatccac

SEQ ID NO: 957 - DNA, 4186 bp, Aristolochia fimbriata
gtttacggctcctcttttgtttggtggaaggccagagaggattgggagggcgttcgctcaaccgctttacgtagaaacgggtgacttgggtatttttttgtttatttatttattttttcatatttttcgttctctataattgccggttgggttttcgttttatggagctctagttggggggtttctgtactcgagtttgtttaggatttaggattcgaaggtcatggtgggtgatatgatgtatttgtttatttttccgttcagaaaaggctgattttcagctgcggagtgcggagtgattcgtaaataattgccttcagttttatcaacggcagagactggagagtcagttatcacttgcttttggaaagttaactttgtgcttttaatggagtgatttacagtcttcaaaagaggctctctattttggaagagatctactgcactctgagggatcttacattcgacacaattccgggcagggaattagcacgaggaaaggtagattggacgaacgtttgaaacggacgaggtaggaaaatggacggccagaacgaaggtctggaggctgttctcaaggaggctgtcgatctggagaatataccaatcgaggaggttttccagactctgagatgtaatagggagggtttaacgagcgataatgctcagaggaggttggaaatattcggccacaataaacttgaagagaaaaggagagtaaattcttgaaattcctcgggtttatgtggaacccactttcatgggttatggaagcagctgctatcatggccattgctctagctaacggaggagggaaaccgccagattggcaagactttgttggaatcataaccctgcttattatcaactcgacgattagttttattgaagaaaacaacgccggtaatgctgctgcagctctcatggctcgtcttgcgccaaaagctaaggtactacgagatggtaggtggagtgaacaagatgctgctgtgcttgttcctggagacataatcagtatcaagctcggggatatcattcctgctgatgctcgccttcttgaaggtgatcctttgaaaatagatcagtctgctctaacaggtgagtctctcccagtgaccaaaggacctggagatggtgtgtattcaggatccacctgtaagcagggggagattgaagccgttgttattgccactggtgtgcatacgttctttggcaaggctgctcatcttgttgattcaacaaaccaagtgggccactttcaaaaggtcttgacagccattggaaatttctgtatctgttcaattgctgttggaatgattgtggagattattgttatgtatccgattcaagatcgccaatatcgaccaggaattgacaatcttttggttcttctcattggagggattcccattgccatgccaactgttctgtctgtcacaatggctattggctctcatcgtttatctcagcagggtgccatcacgaaaagaatgactgcaattgaagaaatggctggtatggatgtcttgtgcagtgacaaaactggcactctaaccttgaataaattgacagtggataagaatcttgttgaggtttttgctaaaggagtcgaccaggatactgtgattctaatggctgctagagcctccagaactgaaaatcaagatgctattgacactgcaattgtagggatgctagcagatccaaaggaggctcgggctggaattcaagaggtgcatttcctgccatttaatccgactgacaagcggacagctctcacatacttcgataaagatggaaaaatgcaccgtgtcagcaaaggtgcaccagagcagattttgaatcttgcacacaacaagtctgacattgagcgaagagtccattctgtgattgacaaatttgctgagcgtggtcttcgttcgcttgctgtagcctatcaggaggttcctgatggaaggaaagagagccccggaggtccatggcaatttattggtctcatgcctctcttcgatcctcctagacatgacagcgcggaaacaattaggagggctctcaacctgggtgtaaatgtcaaaatgattactggtgatcaacttgctattgggaaggaaactggccgccgtttgggaatgggcacaaacatgtatccttcttctgctttgctgggtcagaacaaggatgaatccattgctgctttacccgttgatgaattgattgaaaaagcagatggttttgctggtgttttccctgagcacaaatatgagatcgtgaaacgtttacaagcaaggaaacatatatgtggaatgactggtgatggggtgaatgatgcccctgctttaaagaaggccgatattggtattgcagttgctgatgcaaccgatgcagctcgtagtgcttctgatattgttcttactgaacctggtctcagtgttattattagtgctgttcttaccagtcgtgctatatttcagagaatgaaaaattacactatctatgctgtatctatcaccattcgtatagtgcttggctttatgctactagctcttatatgggagttcgactttcctcctttcatggtgcttatcattgccattctgaatgatggtacaataatgacaatatcaaaagatcgggtgaaaccatctccacttccagacagctggaagctggctgagatctttgctactggtatcattctagggagttacttggcaatgatgacggtcattttcttctgggcagcatataaaactgacttcttcccgcatacatttggagttgctagccttcatcaaaaatcacaagaagataccaaaaagcttgcctcagcagtatacctgcaagttagcactatcagtcaggctctcatatttgtgactcgttcacgaacctggtcatttgtggagcggcctgggttgatgcttgtttcggcattcatgattgctcagctggttgccactttaattgcggtatatgcgaactggggatttgctgcaataaaaggaattggatggggttgggctggagttatttggctctataacatcatcttttatttcccacttgatattattaaatttgttatccgctatgctctcagtggaagggcctgggatcttgttattgagcaaaggattgccttcacgaggcagaaagactttggaaaggaagccagagaacttaagtgggcacatgctcagagaactctgcacggcttgcaacctccagacaccaagatgttcaatgatagaactaattttactgatcttaatcagatggcagaagaagccaaacggcgagcagagatagcaaggttgagggaactgcacactttgaaaggacatgtagagtcggtggtgagattgaagggactggatatagatacgattcagcaagcttacactgtttgagactgaaaggctcttcagtgggagatgtaaagtgggtcggtgccagcgaagtattttccccttggtctactgttttaaaaagtgaacaagaatgctctcattggtgctgagagcacagcttgtggcatgtacccctcactgttggtgtataccatcgttatacggatgcttgtagtttatctattcaggatctttaatatggtctcctttacctcacctatttgaagacatctcggctctagttttgataagctggaaatgctattgaacttgttcccataagtacaagtctgtggacaccagtattttatatgggaaatcccttgatcgacatgttctctttctatgattaagttgtattaaaatatgcaaggatggtagtacagatacagttggaatgtgaaaaaagaagtaattttgtaccattgttcacttaggtttcaaggagctgtggcatgggatgcattggatgttatgaatgagtcaatagtcaatagcagaaatttggaccgtcctcaaggtcaagaaattgctttgtaaatggcattgaagctgctttaaaaattatgaagtgctatgatactggatagacgcctctccgagcaaaagatattttaaaatttaaaggccttaattacacaaaggaaggagtcatgaactagagacataaacaaaaggaaaagcatggaacgtctagagacaaggaagaagcactccatatatcaatccatagtaataaaaaatcaagttgaatacttggtaaataaattaagtaa

SEQ ID NO: 958 - DNA, 3398 bp, Pinus taeda
catccgctcgcagatgaccttttttaactctggttcactgcaaattaacggatactgaggctgagctgattgctgggtaaagatggcggagggggctgttgatcttgaaatgatcaacaaagaagcggtagatttggaaaatattcccattgaggaggtttttgtaaaccttcgatgcaaacgggaaggtttgacatccaatgaaatacagcagcggttggagctctttggacccaacaagcttgaagagaaaaaggaagtaaattcttgaaatttttgggctttatgtggaatcctttatcatgggtcatggaagctgcagcagtgatgtccattgctttggcaaatggaggaaacaaacctcctgattggcaagattttgttggtattatagcacttcttttgatcaactcgactataagtttcatcgaagagaacaatgcaggcaatgcagctgcatcactaatggcacagttggctccaaaagcaaaggttttaagggatggacggtggagtgaagaagatgctgcttgtctggttcctggtgacataattagcattaaacttggagatattgttcctgcagatgctcggcttcttgaaggagaccctttaaaaattgaccagtctgcacttactggagaatcattgccagtaaccaagaatcctggtgatggggtttattcaggctccacatgcaaacaaggtgaactagaagccgtggtcatagccacaggagtgcatacattttttgggaaagcagcccatctggtagactctacaaataatgttggtcatttccaaaaggttttgacagcaattggaaatttctgtatttgttccattgctgttggcatggcagtggaaattattgtccagtatccaatccaaggccgaccatatcggcctggaattgacaatctgttggtgcttcttattggtgggattccaatagcaatgcccacagttctttctgtcactatggccattggttcacatcgcctttctcaacagggtgctattactaaaaggatgactgctattgaggaaatggctgggatggatgttttgtgtagcgataagacaggaacgctaacattgaacaagcttactgtagacaaaaccgcagttgaggtatttgcaaaaggagttgataaggatgcacttctcttgatggctgcaagagcatccagaatagagaaccaagatgcgattgatgcagctgttgttggggttcttgctgatcctaaagaggcgcgggcaggtattcaagaggttcattttcttcctttcaacccaactgacaaacggactgcactcacctacattgatagggaaggaaggatgcatagagttagcaaaggtgcacctgagcagatccttgccctagcacacaacaagtcagaaattcaacgcagagtacatacagtgatagacaagtatgctgaacgtggacttcgttctcttgcagttgcctatcaggaggtaccagatggcaagaaggaaagtccaggaggaccctggcaatttattggtctcatgcccctttttgatcctccacgtatggacagtgcagaaacaataagaagggctctcgatctgggtgtgagtgttaaaatgatcacaggagatcagctagctataggcaaggagacaggccgtcgattggggatgggtacaaacatgtatccatcatcatcattactaggtcaggccaaagatgctgctgctgaagctgtaaatattgatgatttgattgagaaggctgatggttttgctggtgtcttccccgagcacaaatatgagatagttaaacgactgcaagcaaggaaacacatttgtggcatgaccggtgatggagtcaatgatgcaccggcacttaagaaggcagatataggaattgctgttgcagatgcaacggatgcagcccgaagtgcatctgatattgttcttacagagccaggcttgagtgttatcattagtgctgtgttaacaagccgtgcaatctttcaacgcatgaagaattacactatttatgctgtatcgataacaatacgcattgtggttggtttcatgcttttggcattaatatggaagtttgactttccaccattcatggtactgataattgctatattaaatgatggtaccataatgacaatctcaaaagacagggtgaaaccatcacctctgccagataactggaacctttcagaaatttttgccacagggattattattggcagttacctagcaatgatgaccgtcatctttttctgggtcaccttcaagacagatttctttccaagaacatttggtgtttctagtcttcatattcccagtgaagaaaatactcagaaactaaattccgcagtgtatcttcaagtcagcactataagtcaggctctcatatttgtcactcgatctagaagctggtcttttgcagagcgtcctggcctgttgctagtaactgcatttgccattgctcaattgggtgcaacattaattgctgtctacttagacttggactttgcttctataaggggcattggctggggctgggcaggggtaatatggctttataacataatcttttactttccacttgatcttatcaagtttgcaattcgttatgccatcagtggaagggcatgggatttactgattcagcaaagggttgcctttaccacccagaaggattttgggagagaggccagagagataaaatgggctcatgctcagaggactttgcatggattagaaacaccagacacgaaactgtttggtgacagaagcaccttcagggaactcaatcaaatggccgaagaggcaaaaagacgtgctgaaattgcaaggctgagagagataaatactttaaaggggcatgtggaatctgttgtaaggctcaagggtttggatattaatacaattcaacagtcttacactgtttgagggatgccatttttttctactttcataatgtagaaagaatcaaatagcacctacactccaagtgaaaagaaattttagtgctatgaattattacacgcggattatggtggtgataaaagagtggaaatcgttcttccattcaacattggagttgagtcttgcattggagttgagtcttgtctcgactaaatcaagatttgaaaaaaatcaaaaaagtttgttagttgtattaggatggagtatattactatatatttcaaaatgggttattttcaccataagtttaaactctacaaattgccatcttggccagtacaatggagtggggccgaacccctttgccatattggcatgtacaagtaggattagttatataggcacgactaaaagattgtccaattttgaaagtttatgtacagtttatgttggtccaatataactttgcg

SEQ ID NO: 959 - DNA, 3122 bp, Manihot esculenta
atgggggacaaagctgaagttttggaggctgtgttgaaggaaactgtggatttggaaaacatacccattgaagaagtgtttgagaatctgagatgtagcaaagacgggcttacaactgaggctgctgaggagaggctgacaatctttggccataacaagcttgaagagaaaaaggagagcaaattcttgaagtttttggggtttatgtggaatcctctgtcgtgggtgatggaggctgctgctatcatggctattgctcttgcaaatggaggagggaaacctccagattggcaagacttcgtcggtattattactcttcttttaatcaactcgacgatcagttttattgaggaaaacaatgctggtaatgctgctgctgctctcatggctcgtctcgctccaaaagctaaggttcttcgagatgggaggtggagtgagcatgatgctgctgttttagttcctggtgacattattagcatcaaacttggagatattattccagctgatgctcgtctattagaaggtgatccactgaaaattgaccagtctgcacttactggtgagtctcttcctgtgacaaaaggacctggagatggcatttactcgggttctacttgcaagcaaggagagattgaagcagtggttattgccactggcgtccacaccttctttgggaaggctgctcaccttgtggataccacgaaccaagttggtcacttccaaaaggcaaggagatagagataaaatagtcttgactgcaatagggaatttttgcatatgttcgattgctgtggggatggttatagagattgttgtcatgtatcccattcaagatcgagaatatcgtcctggaattgacaatcttcttgtgcttctcattggaggaattccaattgccatgccaactgtcctgtcagtgacaatggctattggttctcacaggttatctcagcagggtgccatcacaaagagaatgactgctattgaagagatggcaggcatggatgtgctttgcagtgacaagactggaactctgacattaaacaaacttactgttgacaaaaatctcgtcgaggtttttgcaaaaggagtggatgcagatactgtcgttttgatggcagctcgagcctccagaacagagaatcaagatgcaatagattctgctattgttggaatgctggctgatccaaaagagatcctgaatcttgcacataataggtcagacatcgagcgaagagttcatgccgtcattgacaagtttgcagagaggggtttacggtctcttgctgttgcataccaggaagttccagaaagaaggaaagaaagtctgggtggcccttggcagttcattggcctcttgcccctttttgatccgccaaggcatgacagtgctgagactataaggagggctttgaatcttggtgtaaatgtcaaaatgattacaggtgatcaactggccataggaaaggaaactggacgtcgtttgggaatgggaaccaacatgtatccttcatctgcattgctaggacatgacaaggacgagtccattgcagctttaccaattgatgaactgatcgagaaggctgatggctttgctggtgttttccctgagcacaaatatgagattgtaaaacgcttgcaagctaggaaacatatctgtgggatgactggtgatggggtcaatgatgcgccagctcttaagaaggctgacattgggattgctgtcgctgatgcgactgatgcagctcgtagtgcttctgatattgtcctcacagaacctggactcagtgtcatcattagtgctgtcttgacaagtcgagcaatcttccagaggatgaaaaactacacaatctatgcagtttctattacaattcgtattgtgcttggtttcatgctgctggctctcatatggaagtttgactttccaccttttatggtgcttattattgctattctcaatgatggtaccattatgacaatatctaaggatagggtgaagccatctcctctgccagacagctggaagctggcagagatttttactactggaattgttcttggtagttacctagcaatgatgacagtcatcttcttttgggcagcatataagacagacttcttcccgaggatatttggagtatcaactctggagaaaacagctcatgatgacttcagaaagcttgcatcagcaatttacttgcaagtgagcaccatcagtcaggccttaatttttgtgacacgatctcgaagttggtcatatgttgaacgccctggaatactactcatggtggcttttttggcggctcagctggttgctactttgattgcagtctatgcaaattggagttttgctgcaattgaagggattggttggggctgggctggtgtcatatggctttataacatcatcttttacatcccacttgacttcatcaagttctttatacgctatgctctgagtggtagggcctgggatctcgttattgagcaaaggattgctttcacaacgcaaaaggatttcgggaaggaacaacgtgagcttcaatgggcacatgcacagagaacattgcatgggttgcaaccaccagacaccaagatgttcacagagcgaactcatttcactgaactcaatcagatggctgaagaagctaaaaggagagctgaaattgcaagactaagggaactgcataccctcaagggtcatgtagaatcagtgattagattgaagggcatagacatagacacaattcaacaagcatacacagtttgaagatctacatggtgtacaagaacaataaacgacgcattttacgttttcctagagtagagacctgtaagcagcagtctcctatgaatcatctccgaacaacaacgtttcatgagttccaccattttaaggttgtcatcctcattttttgtctatttgttctccactctctccttctctctcccccacaccccacctttcaattcatgagagggggaaggcttatcttttttgccatatgtgtctatattagcaaggttatggttcgttggtccttttctttgtgtactacatatttatatcaataccatggtactccatatagttaggggatggaagcttttcaactttttat

SEQ ID NO: 960 - DNA, 3011 bp, Setaria italica
gttcctgggcttcatgtggaacccgatgtcctgggtcatggaggcagccgccatcatggccatcgcgctcgccaacggaggaggcaagccaccggactggccggacttcgtagggatcatcactctgctcatcatcaactccactatcagtttcagcgaggagaacaatgccggcaatgccgctgccgctctcatggcccgcctcgccccaaaggccaaggttctcagaaatggccggtggaccgaggaggaatcggctatccttgtgccaggagacatcatcagtgtgaagcttggggatatcattccagctgatgctcgtctgcttgagggtgaccctctgaagatcgatcagtctgcacttactggtgaatcccttccagtgaccaaaggccctggtgatggagtgtactctggttccacttgcaagcagggcgaaattgaggccgttgtcattgccactggtgtgcacacattctttggcaaggcagcacatcttgtcgattcaacgaaccaagttggtcatttccagaaggttctgactgccatcgggaacttctgcatctgttcaattgctctgggaatgctcgtggagcttatcgtcatgtaccctatccaacgcagggcttaccgaccaggaattgacaatctgttggtgcttctgattggagggattccaattgccatgcccacggtcctttctgtgactatggcaattggagcgcatcgcttggctcaacagggagcaattactaaaagaatgacagcaattgaggaaatggctggcatggatgtcctttgcagtgacaagactgggacattaacattgaacaaattgactgtggacaagagcctcattgaggttttccaaagaggtgttgatcaggatacggtaattctgatggctgccagagcttctcgtacagaaaatcaggatgccatagatgccacaatagttggtatgctggctgatccaaaggaggctcgtgctggtgttcaagagattcactttctgccatttaatccaactgacaaaagaactgctttaacctaccttgatggagagggaagaatgcatcgcgttagcaagggagcaccagagcagatccttcatcttgcgcacaacaagtcggatattgaaagaagggtcagagctgtgattgacaaatttgctgagcgtggcttgcgagcacttggtgtagcttaccaggaagtgccagatggtaggaaagagagtcctggaggaccatggcagttcattgggctcttgcccctttttgacccccctcgtcatgatagtgcagaaacgatcagaagggcactcgatcttggtgtcaatgtcaagatgattacaggtgatcagcttgctattgggaaggaaacagcacgtcgtttgggcatgggtaccaatatgtacccttcatctgctttactcgggcagcataaggatgagtcaattgtttctttgccagttgatgaattgatcgagcaggctgatggttttgctggagtctttccagaacacaagtatgagatcgtgaaacgcttgcaagcaaggaaacacatttgtggcatgactggggatggtgtaaatgatgccccagctttgaagaaggctgatatcggtattgcagtagcagactccaccgacgcagcacgtagtgcatcagacattgtcctgactgaaccaggccttagcgtgattattagtgctgtgctgacgagtcgggcaattttccaaaggatgaagaattatacgatatatgctgtgtcaattaccatccgtattgtgcttggctttatgcttcttgcgctgatatggaagtttgacttcccaccgtttatggtcctgataattgccatcctcaacgatggtaccattatgactatctcgaaggacagagtaaaaccatctccacagcctgatagctggaagttagctgagatctttgcaactggagtagttcttggtggatatttggccatgatgacagtcattttcttctgggctgcatacaagactgacttcttcccgcgagtgtttggtgtcgaaagccttgagaaaactgcccaggatgattttcagaagcttgcctctgccgtgtaccttcaagtcagcaccataagtcaagccctcatctttgtgacacggtctcgcagctggtcgtttgtggagcgtcctgggttcttgctggtctttgctttcttggtggcgcagctgatcgctactctgattgctgtatatgccaactgggcatttgccgctatcaagggtattggatggggctgggccggtgtcatctggctttacaatgttgtcttctacttcccgctggatgtcatcaagttcctcacccgttacgctctgagcgggagggcatgggatctcgtccttgagcagaggatcgcattcacaaggaagaaggatttcgggagggaagagagggagctcaagtgggcgcacgctcagaggacgctccatgggctccaggcaccggaggcatccatattcgagaacaagacgaccttcaacgaactcaaccagctcgcggaggaggcacgcaggagagccgagatggcgaggttgcgagaagtgaacaccctgaaggggaagatggagtcagtggtgaggcagaaggggttggacatggagaccatccagcagtcctacaccgtgtgatggatcgatggattgattatagaggcagcttcttcttactatatactgtactaggcagcaataaggaaacccatgcttggtccttgatgatgatgatgatatgtttctaacgtcggtgcggtgcttatcgcctttagtctcaccccaatatgctgttgtccattaaccacccccggcagaccatttaccggattgagatgagacatactcctgtagtgcttattagtagatgatagtatagtacaacatttttgctttgttatatcctgtgctatctggccttggttgcctgcctgctgccctggattcctgaatctgatgtgtgtgtggg

SEQ ID NO: 961 - DNA, 3056 bp, Zea mays
tgcgagagtcgccagcctaccgccctacccccgactgccgaccccgcctgcccgcggcaccgcgaagacgagctgccatcctagcagatgggaacgacggaggacaaggcgtccaacctggacgccgtgctcaaggaggccgtcgatctggaaaacatagcgatccaggaggtgttcgagagcctccgatgcagcccgcagggtctctccacggagcaggccgagcagcgcctcgccatcttcgggcccaacaagctggaagagaagcaggagagcaaattcctcaaatttttgggcttcatgtggaacccgctgtcctgggtcatggaggcggccgccatcatggccatcgcgctcgccaatgggggaaacaagccgcccgactggcaggacttcgtggggattatcactctactcatcatcaactccactattagcttcattgaggagaacaatgccggcaatgccgcggccgccctcatggcgcgcctcgcccccaaggccaaggttctcaggaacggccggtgggccgaggaggaatcggctatccttgtgccaggagacatcatcagtgtgaagcttggggacatcattccagctgacgctcgtctgcttgaaggggatccactgaaaattgaccagtctgcactcaccggcgagtcgcttccggtcaccaaaggccctggcgatggagtgtactctggctccacttgcaaacagggcgagatcgaggccgttgtcattgccaccggtgtgcacacattcttcggcaaggcagcacatcttgtcgattcaacaaaccaagttggtcatttccagaaggttctcaccgccataggaaacttttgcatctgttcaattgctgtgggaatgctcgtggagatcattgttatgtaccctatccaacacagggcttaccgatcagggattgacaatctgttggtgcttctgatcggaggaattccgattgccatgcccactgtcctttctgtgactatggcaatcggggctcatcgcttggctcaacagggagcaattactaagagaatgacagcaattgaagaattggctggcatggacattctgtgcagcgacaagactgggacattaaccttgaacaagttgactgtagacaaaagtcttgtagaggttttccaaagaggggttgaccaagatactgtaattctgatggctgccagagcttctcgtacggaaaatcaggatgccatagatgccacaatagttggtatgctggctgatccaaaggaggctcgtgctggtgtccaagagatccattttctgccatttaatccaaccgacaaaagaactgctttaacctaccttgatggcgagggaagaatgcatcgtgttagtaagggagcaccagagcagatccttcatcttgcccacaacaagacggatattgaaacaagggtcagagctgtgattgacaattttgctgaacgtggtctgcgagcacttggtgtagcttaccaggaagtgccagatggtaggaaagagagtcctggaggaccatgggagttcatgggcctcttgccactttttgatccccctcgcaaagatagcgcagacactatcagtaaggcactcgatcttggtgtcaatgtcaagatgattacaggcgatcagcttgctattgggaaggaaactgcacgtcgtttgggaatgggtactaatatgtacccttcatctgctttactcgaacagaataaggatgagtcaattgcttctttgccaattgatgaattgattgagactgctgatggctttgctggagtctttccagaacacaagtatgagatcgtgaagcgcttgcaagcaagaaaacatatttgcggtatgaccggggatggtgtaaacgacgctccagctctgaagaaggccgatattggtattgcagtggcagactccaccgacgcagctcgtagtgcttctgacatcgtcctaaccgaagtaggccttagtgtgattatcagtgccgtgctgacgagccgtgcgatttttcaaagaatgaagaactacacgatctacgctgtatcaatcaccatccgtatcgtgcttggtttcatgcttcttgcgctgatttggaagtttgacttcccaccatttatggtcctgatcatcgccatcctcaatgatggaaccattatgactatctccaaggacagagtgaagccatctccgcagcctgacagttggaagctagctgagatttttgcgactggagtagttctcggtacttacttggccatgatgactgtcatcttcttctgggctgcgtacaagaccgacttcttcccgcgactgttccatgtcgaaagccttgcccacgacgatttccagatgcttgcctctgcggtataccttcaagtcagcacgatcagtcaggcccttatcttcgtgacgcggtctcgcagctggtcctttgtggagcgtcctgggttcttgctggtgtctgctttcttggtggcgcagctgatcgctactctgattgctgtgtatgccaactgggcgtttgctgcgatcaagggcatcggatggggctgggccggcgtcatctggctgtacaacatcgtctgctacctcccgctggacatcatcaagttcctcatccggtacgcgctgagcgggagagcgtggaacctcgtccttgagcagaggatcgcattcacaagcaagaagaacttcggtgccgaggaacgggaacgcagatgggcgcatgctcagaggtctctccacgggctggagctccagccgccggaggcagcgtccatgttcgagaacaagacgagcttcagtgaagtgaaccagctcgctgaagaggccagaaggagagcggagatggcgaggtccgactgttgtttgtcgagcatctccactgaacgcggcgaccagactttgcactgccctgtctgattaataggggaagatgaggatggagtcggtggtgaaggagaaggcggagtatagaggcggcttctttttactgtatatattatatatactaggcagcaatatagaaacttatatatata

SEQ ID NO: 962 - DNA, 2910 bp, Glycine max
gtctttctgtatgaattttgcaggagagcaaggttttgaagtttttaggatttatgtggaatcctctttcatgggtcatggaagctgcagcaatcatggccattgctttggccaatggaggaggaaaacctcctgattggcaagactttgttgggattatcacactccttattatcaattcaacaataagtttcattgaggagaacaatgctggtaatgctgcggcagctctgatggctcgtttagcacctaaagctaagttccttcgagatgggaaatggattgaggaggatgctagcattcttgttcctggtgatataattagtgttaagctaggggatattatccctgcggatgctcgtctacttgaaggtgatccactgaagattgatcagtctgcacttacaggcgagtctcttcctgtcacaaaaggccctggtgatagtgtttattcaggctccacatgcaagcagggagagatcaatgcagttgttattgccacaggagttcataccttctttggcaaagctgctcatcttgtggactccacaaatcaagttggtcatttccagaaggtcctgactgcaattgggaacttctgcatatgttccattgctgtgggaatgatagtagagataattgtcatgtacccaattcaacaccgggaatatcgtcctgggattgacaatctgcttgtgcttcttattggaggaattcctattgccatgcctactgttttgtcagtgacaatggcaattggatcccatcgcttagctcagcagggtgctattactaaaagaatgacagcaatagaagagatggcaggaatggatgtattatgtagtgacaaaactggaactttgactttgaataaactgacagttgacaagaatcttattgagatttttgctaaaggagttgacgtagatactgttgttctcatggccgctcgggctgcacgattggaaaaccaagatgctatagatgccgctattgtagggatgttgggtgatccaaaagaggcaagggctggtattcaagaggttcacttcctacccttcaatccaactgacaagcgaactgcaatcacttatatagacggtgaaagtaaaatgcatcgtgtcagcaaaggagcaccagagcagattttgaatcttgcacgcaataaatcagagatagaacgcagagttcattctgtcattgataagtttgcagagcgaggattacggtctcttgcagtagcttaccaggaagttcctgatggaaagaaagaaagccaaggtgggccttggcaatttattggactcttgcctctatttgacccacctagacatgatagcgctgagacaatacgaagggcattaaatcttggagtaaatgttaaaatgataacaggtgatcaactagcaataggaaaagaaacaggacgccgtctggggatgggaaccaacatgtacccttcatcggctttattgggccaaaacaaggatgaagcaattgctaccttgccagttgatgagttgattgaaaaagcagatggatttgctggtgtttttcctgaacacaaatatgagatcgtgaaacgtttacaagctaggaaacacatatgtggaatgactggtgatggggttaacgatgctcctgctcttaaaaaggcagatattggaatagctgtcgccgatgctactgatgcagctcgtagtgcttctgatattgttctgactgaacctggtctcagtgttatcatcagtgctgtactgaccagtcgagcaatattccaaaggatgaagaattacacaatctatgcagtttccatcacaatccgtattgtgcttggtttcatgttactggccctcatatggcattttgattttccaccattcatggtgctgattattgctattcttaatgacggtaccattatgacgatatcaaaggacagggtgaaaccatctccatatccagatagctggaagttggccgagatctttaccactggaataattcttggtggttatttggctatgatgacagttattttcttttgggcagcatataaaacagattttttccctcaaacatttggagtctcaagtcttcagaaaaaggatagggatgactttagaaagcttgcctcagcaatatacctacaagttagcacaattagtcaggccctcatattcattacacgggctcggagttggtcttatgttgaacgtccgggtttgttacttgttgcagcttttgttatcgcccagctgatagctaccttaattgcagtttatgcaaattggagtttcgctgctattgaagggattggatggggttgggctggtgttgtttggctttacaacctcatcttttatatcccacttgactttatcaagttcataattcgatatgccttgagtggaagggcttgggatcttgttattgaacaaaggattgcttttacaaggaaaaaagattttggaaaggaagaacgtgaacttaaatgggcacatgcacagaggacgcttcacggccttcacccaccagagactaagatgttcaatgaacgtacaagttacacagaacttaatcagatggctgaagaggctagaagacgagcagaaattgcaaggctgagagaactgcatacacttaagggtcgtgttgagtctgtggttagactgaagggtcttaacattgacacaatacagcaagcatacactgtctagaatgttgagtttcatgcatgaatcgtgtatgtataatgtgtgtataatgccgttagaagagtgtgatcatagagcagcaaaaaatatatactttaaatgtttgttaaagcagttttggtggacttttttagacatgaaattattggtgcattaatacttaaatgttaaaaagagttccatttatgctttc

SEQ ID NO: 963 - DNA, 2799 bp, Glycine max
atggctgagaaggaagaagccatgcgcgttgttttgaaggaagctgtggatttggaaaacgtgccacttgaggaggtgtttcagactctgaggtgtgattcaaatggactcacaacagaatctgctgaggagaggttggccatctttggccacaacaaacttgaagagaagaaggagagcaaggttttgaagtttttaggatttatgtggaatcctctttcatgggtcatggaagctgcagcaatcatggccattgctttggccaatggaggaggcaaacctcctgattggcaagactttgttgggattatcacactccttattatcaattcaacaataagtttcattgaggagaacaatgctggtaatgctgccgcagctctgatggctcgtctagcacctaaagctaagttccttcgagatgggaaatgggttgaggaggatgctagcattcttgttccgggtgatataattagtgttaagctaggggatattatccctgcggatgctcgtctacttgaaggcgatccactgaagattgatcagtctgcacttacaggcgagtctcttcctgtcacgaaaggccacggtgatagtgtttattcgggctccacatgcaagcagggagagatcaatgcagttgttatcgccacaggagttcataccttctttggcaaggctgcccatcttgtggactccacaaatcaagtcctgactgctattggaaacttctgcatatgttccattgctgtgggaatgatagtagagatcattgtcatgtacccaattcaacaccgggaatatcgtcctgggattgacaatctgctcgtgcttcttatcggaggaattcctattgccatgcctactgttttgtcagtgacaatggcaattggatcccatcgcttagctcagcagggtgctattactaaaagaatgacagcaatagaagagatggcaggaatggatgtattatgtagcgacaaaactggaactttgactttgaataaactgacagttgacaagaatcttattgagatttttgctaaaggagttgacgtagatactgttgttctgatggccgctcgggctgcgcgattggaaaaccaagatgctatagatgcctctattgtaggcatgttgggtgatccaaaagaggtaggttcatatatgataatatatataactttttcatgcttgcaaaacatgctgttcaatttaattgttgttattttaaatcttgcacgcaataaatcagagatagaacgtagagttcattctgtcattgataagtttgcagacaggggcttacggtctcttgcagtagcctaccaggaagttcctgatggaaagaaagaaagccaaggagggccttggcaatttattggactgttgcctttatttgacccacctagacatgatagtgctcagacaatacgaagggcattaaatcttggagtaaatgttaaaatgataacaggtgatcaactagcaataggaaaagaaacaggacgccgtctggggatgggaaccaacatgtacccttcatcagctttattgggccaaaacaaggatgaatcaattgctaccttgccagttgatgagttgattgaaaaagcagatggatttgctggtgtttttcctgaacacaaatatgagatcgtgaaacgtttacaagctaggaaacacatatgtggaatgactggtgatggggttaatgatgctcctgctcttaaaaaggcggatattggaatagctgttgctgatgctactgacgcagctcgtagtgcttctgacattgttctgactgaacctggtctcagtgttatcatcagtgctgtattgaccagtcgagcaatattccaaaggatgaagaattacacaatctatgcagtttccatcacaatccgtattgtgcttggtttcatgttactggccctcatatggcaatttgattttccaccattcatggtgctgattattgctattcttaatgatggtaccattatgacaatatcaaaggacagggtaaaaccatctccatatccagatagctggaagttggcagagatctttaccactggaataattcttggtggttatttggctatgatgacagttattttcttttgggcagcatacaaaacagattttttccctcaaacatttggagtctcaagtcttcagaaaaaagatagggatgactttagaaagcttgcctcagcaatatacctacaagttagcacagttagtcaggccctcatatttgttacacgggcacggagttggtcatttgttgagcgtccaggcttgttacttgtagcagcttttgttattgcccagttgatagctaccttaattgcagtttacgcaaattggagttttgctgcgattgaagggattggatggggctgggctggtgttgtttggctttacaacctcgtcttttatatcccacttgattttatcaagttcataattcgatatgccttgagtggaagggcttgggatcttgttattgaacaaaggattgcttttacaaggaaaaaagattttggaaaggaagaacgtgaacttaaatgggcacatgcacataggacgcttcacggccttcacccaccagagactaagatgttcaatgaacgtacaagttacacagaacttaatcagatggccgaagaggctagaagacgtgcaaacattgcaaggctgagagaactgcatacactgacgggccatgttgagtctgtgtttagactgaagggccttgacattgacacaatacagcaagcatacactatc

SEQ ID NO: 964 - DNA, 3298 bp, Podocarpus macrophillus
tgggtgaaaatgcagacgcttccactttggaggccattaacaagaagctgtggattggaaaatatccaatagcggaggttttgagaatctgagatgtaggagggagggtttgagcagcgaaggtgctcaagagaggctcaacatatttggccacaataagcttgaagagaaaaaggaaagcaagtttctcaagtttttggggtttatgtggaaccctttatcatgggtgatggaagctgcagccgtgatggccattgcactggcaaatggaggaggaaagcctcctgattggcaagattttgtaggtatcataacattactttttataaactccacaataagtttcatagaggaaaacaatgctggcaatgctgctgcagcactgatggctcggttagctccaaaggccaaagtcctcagagatgggcgttggagcgaagaggatgcagcggtacttgttcctggtgacataataagcattaaacttggagatattattcctgcagatgcacgccttcttgacggagatccattaaaaattgatcagtctgctctcactggggagtcgttgccagttagcaagggtcctggtgatgggatttattctggatctacctgcaagcaaggtgaaattgaagctattgttattgccacaggagtacataccttttttggaaaagcagctcatcttgtggacactacaaaccaagttggtcatttccaaaaggttttgacagcaattgggaacttctgcatttgctcaattgcggttggcatgatagtggagattattgttatgtatcctattcaagaccgaaaatatcgtcctggaattgataacctcctcgtgctcctaattggtggaattccaatagcaatgcctacagttctttctgtgacaatggctattggatctcatcgtctatctcaacagggtgcaattacgaaacggatgacagctattgaagaaatggctggaatggatgtcctttgcagtgacaagactgggacgttaactcttaacaaacttagtgtggacaaaaatctgattgaggtctttgctaaaggagttgataaagatacagttgttttgatggctgcaagagcatcgagaacagagaaccaagatgccattgatgctgcaattgttggaatgcttgctgatcctaaggaagctcgggcaggtattaaggaagttcatttccttccatttaatcccactgataagagaacagcacttacctatattgatagtgaaggaaaaatgcatcgtgtaagcaaaggtgctccggagcagattctcaaccttgcacataacaagtcagaaattgagcgccgagttcatacagttattgacaagtttgctgaacgtgggcttcggtctcttgcagttgcttatcaggaagttcacgagggcacgaaagaaagtcctggaggaccctggcagttcataggactgttgcctctttttgatcctccaaggcatgatagcgccgaaacaattcgaagggctcttaatcttggtgtgaatgtgaaaatgattacaggtgatcaattggcaattgccaaggagacaggccggcggcttggaatgggtacaaacatgtacccgtcatcatctttactagggcaggaaaaggatgaatcaattgcagctttgccagttgatgaattgatagaaaaggctgatggatttgctggtgttttccccgagcacaagtatgaaattgtgaagcgtttacaggctagaaagcatatatgtggaatgactggtgatggtgttaatgatgcacctgcccttaaaaaggcagatatagggattgcagttgcagatgcaactgatgcagcaagaagtgcttctgacatagttctcacagaaccgggtctcagtgttatcatcagcgcagtgttgactagtcgtgcaatctttcagaggatgaagaattacactatatatgcagtgtcaatcacaatacgtattgtgttgggatttatgcttctggctttaatatggagatttgacttcccaccatttatggtacttataattgccatattgaatgatggtactataatgacaatttctaaagacagggttaaaccatcgcctctaccagacagctggaagcttgcagagatttttgcaacagggataatcattggcagttaccttgcattaatgactgttatatttttctgggctgcttacaagacagatttcttcccgcgaacatttggtgttgaaagtcttcaacataagaatggaaaactaagcgcagcagtttaccttcaagttagtacggttagtcaggcacttatatttgtgactcgttcccgaagctggtcttttgtggagcgtcctggtctcttgcttttttttgcattttgtgttgctcaactgattgcaacaatcattgcagtttatgcaaactggggatttgctgcaatcgaaggcatgggctggggatgggcaggtgttgtgtggctttacaatataatcttttactttccccttgatattattaaattcttcattcgatatgcattgagtggaaaggcctgggatcttgtttttgagcaaaggactgcattcacaaggcaaaaggattttggaaaagaggcccgtgagcttaaatgggctcacgctcagaggacattgcatggtttgcatcctccagatacaaaaatgtttggcgaaagaagcaactttactgaaattaatcaaatggccgaggaggctaaaagacgagcggagatagcaaggttaagagagctgaatactttgaaaggacatgtagaatctgttgtaagaatgaagggcttggatatagatacaattcagcagtcatacactgtttaagttattccatattttcacttccagcttgctacagggattaacttgaagacattaaatttcattatattctgtaatttaagcaacatgttgtaagttgtaacaccagacagttatgtttcttgtgaaagggtttaaaggctgttagattaaacagtggcataacatcataagatagtttctcttcttgtagtgattctaaacggccttaactatctttttggtattaagtgtcagcgtactggagactgtagaacatgttaggaagcagtaggaaatctttatcatttaggtgttcaagccttgacagcaaggtgggtttaataatattaatggccccaactgtgcatgtctgctggctaggaagatgtaattaagatattggtgcttgcaagactttaaaaagttttcttggctggcatgatccaaacaagtgatacc

SEQ ID NO: 965 - DNA, 3339 bp, Cleome gynandra
aaactcgcttcacacatatctctctctccctcccttccctctctctccctccctttccctctctctggttatgattgagtgctgaaagcgcatagagagctgttgtgttaactttattttaactgttggttaagtgaagaagggcgagatgtcaagtcttgaggatatcaagaacgagaccgtcgatctggagaaaatcccgatcgaggaagttttccagcagctaaaatgttccagggaaggtctaacatcgcaggaaggggaagacaggcttcagatctttggccccaacaagctggaagagaaaaaggaaagcaaactcctcaagttccttggtttcatgtggaatcccctttcatgggtcatggaagctgctgccatcatggccattgctttggccaatggcggcggtaagccccctgactggcaagactttgttggtattgtctgtttgctggttatcaactccaccatcagtttcattgaggaaaacaatgctgggaatgctgctgctgctcttatggccggtcttgctcctaaaaccaagctgcttagggatggaaaatggagtgaacaggaagctgccattcttgttcctggggacatcatcagcatcaaattgggagacattatcccagctgatgcccgtcttcttgagggtgatcccttaaaggtggaccagtctgctctgaccggagaatcacttcctgtcaccaagcaccctggggatgaagttttctcaggttcaacctgcaaacagggagaaatcgaggctgttgttattgccactggtgttcacaccttctttggtaaagctgcccaccttgtggacagcaccaacaatgtcggacacttccagaaggttctcacagccattgggaacttctgtatctgttccattgctgtgggtatgttgatcgagataatcgtcatgtacccgattcagcacaggaaatacagggatggaattgataatcttttggtgctcttgatcggtggtatccccattgctatgcctacggtgttgtctgtcaccatggctattgggtctcatagattgtctcagcaaggtgccattaccaagcgtatgactgccattgaggagatggcgggaatggatgtcctttgcagtgacaaaactgggacacttacactcaacaaattgagtgttgacaaaaacttggtcgaggtttttgccaagggtgtagataaagatcaagtcatcttatttgcggctagggcttctagggttgagaaccaagatgctattgatgcagccatggtgggaatgcttgctgatccaaaggaggctcgagcggggatcagggaggtccacttccttccattcaatcctgttgacaagagaactgctttgacttacatcgattctgatggtaactggcacagggtcagcaagggtgcacctgagcagatccttgatctttgcaaagcaagggatgacctcaggaagaaggtgcatgctgttattgacaagtacgctgagcgtgggcttaggtcattggcagttgctcgtcaggtggtgcctgagaaaacaaaggaaagtcctggtggtccatgggaatttgttggcttgttgcctctttttgaccctccaagacatgacagtgcagaaaccatccggagagctctgaatctcggtgttaatgtcaagatgatcactggtgaccaactggccattggtaaggaaactgggcgtaggcttggaatgggaaccaacatgtatccgtctgcttccttgcttgggcaggacaaagactctagcattgcatcacttcccgtagaggagttgatcgagaaagccgatgggtttgccggggtctttccagagcacaaatacgaaattgtgaagaaattgcaagagaggaagcacattgttggaatgacgggtgatggtgtcaatgatgcacctgctctgaagaaagcagatattggtattgccgtggctgatgccacggatgcggctcgtggtgcttcagatattgttctcactgagcctggtttgagtgttattatcagtgcagtactcactagtagggctattttccagagaatgaagaactataccatttacgccgtatccatcaccatccgtattgtgtttggattcatgcttattgctcttatatggaagtttgacttctcagcattcatggttctgatcattgccattctcaacgatggtaccatcatgacaatctcaaaggacagagtgaagccatctcccacacccgatagctggaaactcaaagagattttcgctactggagttgtgctcggtggctacttggctatcatgactgtcatcttcttctgggcaatgtataagactgatttcttctcggacaaatttggggtgaagtctattaggaacagcccggatgagttaatggctgcattgtacctacaagttagtattatcagtcaagctttaatctttgtaacgaggtcaaggagttggtcgtttgtggaacgccctgggatgttactgatggttgcatttctgattgcacaattgattgcaacaatcattgccgtgtatgccgattgggaatttgcaaagatcaagggaatcggatggaaatgggctggtgtgatctggctatacagtcttgtgacatacttccccttagacatcatgaaattcgcgatccgatacatcctgagtggaaaggcttggaccaacttgttcgagaacaagactgctttcacctccaagaaagattatggtaaagaagagagagaggctcaatgggcgttggctcaaaggacgcttcatggtcttcaaccaaaagaagccgttaacatcttccccgagaaaggaaactacagagaattgtctgagatcgcagagcaagccaagagaagagccgagattgccagacttagggagttgcacacgctgaagggtcatgtggaatcagtggtgaagctgaagggattggacattgacactcctggacattacactgtgtaagccagaaacccacaaactaaaaacagaacagaagatgactcttttctttttctcttaagctttatgatgatgaatgatgggaagagaactttgtttattgccataactctcccaaaactcattctgtcttattcttccatcttctgtcattcagcttccctcttatgttctacttttcaaaatttgccttgcaagaaaacagagtatttttctgtactatgtaattttgaactcttcatcgccgcttgtttcatatcggccaagacataaactttgaactcatatatatggtattgggcaatcctaatatcacaacatcttatatattatgacccattctcttt

SEQ ID NO: 966 - DNA, 3514 bp, Manihot esculenta
gaaggacgccataaaagagaaacacagtctccctttatttctcttttcatttgctttcttcttccttctcctcttagctttctgttatgagtctctgaagccactcccagcccttctctctctcgctcgctatatcttttgtagcttcagattcatcgagcatggctaccaagggaggaatcagtcttgaagagataaaaaatgagtccgttgatctggaacggattcctatagaggaagtgtttgagcagctgaaatgtaccagggaaggtcttacttcagaggaaggagccaatcggcttcaagtttttgggccaaacaaactagaagagaaaaaggaaagcaaaattctcaagttcttgggttttatgtggaacccattgtcatgggtcatggaagcagcagctatcatggccatagctttggcaaatggtgatggaagacctcctgattggcaagacttcgttgggattgttgctttgttgttcataaactccacaataagttttatcgaagaaaataatgctggaaatgcagcggcagcccttatggctggtcttgctcccaagactaaggttcttagagatggtagatggactgaacaagaagctgcgattctggtcccaggagacattatcagcattaaattgggagatataatccctgctgatgctcgtcttcttgagggtgatcctttgaaggttgatcaatctgctcttactggggagtcgcttcccgttactaagaacccctcagatgaagtgttttcaggctcaacatgtaagcagggcgaaattgaagcggtagtaattgccactggtgtgcataccttttttggtaaggctgcacatctggtggacagcaccaatcaagttggacatttccaaaaagttctgactgccattggtaacttctgtatttgctcaatcgctgttgggataattattgaaattatagtaatgtacccaatacagcatcgcaagtacagacagggaattgacaacttattagttcttctcatcggaggaattcccattgccatgcctactgttttatctgtcaccatggctatcggttcacacaggctatctcagcagggtgcaattacaaagagaatgactgccatcgaggaaatggctggcatggatgtcctctgtagtgacaagactggaactctaactctgaacaagcttactgttgacaggaccctaattgaagtatttgcaaagggtgtggataaagagtatgtgatacttcttgcagctagagcttcaagaactgaaaatcaggatgctattgatgctgcaattgtagggatgcttgcagacccaaaggaggcaagagctggaatcagagagcttcatttccttccattcaatcctgtggacaagagaactgcccttacctacattgattctgatggaaactggcaccgagttagcaagggtgctcctgagcagatattaggtctatgcaatagcaaggaggatgtcaagaagaaggttcatgctgtgattgataagtttgctgaacgagggcttcgttctctagctgttgcaagacaggaagtacctgagaaatcaaaggatagtccaggaggcccatggcagttagttggtttgttgcctttgttcgatcctcccaggcacgacagtgctgaaaccatcagaagagctctcaaccttggtgtgaatgttaaaatgataactggggatcaacttgccatcggtaaggaaaccggtcggaggcttggaatgggaacaaacatgtatccatcttcttcattgcttggtcaagataaggatgcttctattgcagctctacctgtagatgagttgatcgaaaaggccgatgggtttgctggagtttttccagaacacaaatacgaaattgtcaagaggttgcaggagaggaagcacatctgtggaatgacaggagatggtgttaatgatgcaccagctttgaagaaggcagatattggaatagctgttgctgatgctacagatgccgccagaagtgcttctgatatcgtcctcaccgaacctggccttagtgtaattattagtgcggttctgaccagcagagccatattccaaagaatgaaaaactacacaatatatgcagtttcaattacaatccgtattgtgtttggcttcatgtttattgccttgatatggaaatatgactttgctccattcatggttctaattattgccatcttaaacgacggaacgatcatgactatatcgaaggatcgagtaaaaccatcaccaatgccagacagctggaaacttaaagagattttcagtactggtattgttcttggcggttacttggcactaatgacagtgatatttttctgggcaatgtatgacaccgacttcttcacggacaaatttggagtaagatcattgcatggtagggaacgtgaaatgatggcagctttatacctgcaagtgagcattgtaagccaggctcttatttttgtcacaaggtcgcgcagctggtcctttgttgaacgtcctggacttcttctagtcagtgcattcgtggttgctcagctggtagccacgttgatagcagtttatgcaaattggggttttgctcgtatagaggggtgcggctggggctgggctggtgtaatctggctttacagtttggttacttacgtgccacttgatctgctcaagtttgcaattcgctacattctcagcggcaaggcttgggataatcttttggagaacaagactgcctttacaacaaagaaagattatggaaaggaagagagagaagctcaatgggccacagcgcagaggacacttcatggccttcaacctccagaaagcagtaacctctttgctgacaaaaatagttaccgagaactttcagagatcgcagagcaagccaagcggagggctgaagtggcaaggctgagggagctacatactctcaaggggcatgttgaatcggtggtgaagttgaaaggacttgatattgacacaattcaacaacattacacagtttagaagagccaaactcccaaaagagactaatcttctccgagagagggagagctaaaaattaaaaatgatgacgaagatatcccagttggaaattttctctagattagaatttatatttatcttgctataatatgtggtagtttttctcttacacaaggttttattcctccgcatttatggccagaggagagggattctcctttgaaagcaaagcatgtttgttttctgcttggtgtacaattttttttcctatgttgacgtctttcacctcatctcctgctgctaaagtatataacttaataaaagctttgacaatcaacggacccctatccgctcaaatgatgttttatagccttgttaattagtctatcctcttgcgtagactaagagatggagagttgaaaacgaaacgagagcttatagctttgcatacacttgtatgtcaaaatattatgtggaaaatgtatttccttctacggaaattgtctttt

SEQ ID NO: 967 - DNA, 3133 bp, Populus trichocarpa
atggcaaaggcctttagtctcgaggagatcaagaatgagaacgttgatctagaaaagattccggttgaggaagtgtttgagcaattgaaatgtacaaaagaaggtttgacctcggaggaaggagccaaccggcttcaaatctttggccccaacaaattggaagagaaaaaggaaagcaaatttctcaagttcttggggttcatgtggaatcctctatcatgggttatggaagctgcagctatcatggctattgcattggcgaatggcgatggaaggcccccagattggcaagactttgtcggtatcacctgcttgcttgtgatcaactctaccattagtttcattgaagaaaacaatgcgggaaatgctgctgctgcacttatggctggcctggctcctaaaaccaaggttcttagggatggaaagtggactgaggaggatgctgcaattctggttcccggagacatcattagtgtcaaattgggagatatcattcctgctgatgcccgtctccttgagggtgatcctttaaaggttgatcaatctgctctcaccggggagtcacttccagtaactaagcatccaggcgatgaagttttctcaggctccacttgtaaacaaggagagattgaggctgttgttattgctactggtgttcacaccttcttcggaaaggctgcgcatctggtggacagcaccaaccaagttggccacttccaaaaggttcttactgctattgggaacttctgtatttgttccatagcagttggaatggttattgagatcatagtcatgtacccgattcagcaccgcaagtacagagatggaattgacaatcttttggttctcttgattggaggcatccccattgctatgccaacggtcttgtcggtgacgatggctattggatcccacaagctgtcccaacaaggtgccatcactaagcgtatgactgccattgaagagatggcaggtatggatgtactctgcagtgacaaaactgggactctaaccctcaacaaactgagcattgacaaaaacttgattgaggtttttgcaaagggtgtggacaaagattatgtcatcctgcttgctgccagggcctctagagttgaaaatcaagatgccattgatgctgccatggttggaatgcttgctgatccaaaggaggcaagggctggtataagagaggtacacttccttccattcaatcctgtggacaagaggactgctttaacctacattgatgctgctggaaactggcatagagcaagtaaaggtgcccctgagcagatcctcgccctatgcaattgcagggaagatgttaagaagaaggttcattcttgtattgataagtttgctgaaagagggcttcggtcattggctgttgctagacagcaagtacctgagaaaagtaaggaaagtccgggtggtccatgggagtttgttggcttgttgaacctctttgatcctccaagacatgacagtgctgagaccatccgtagagctctcaatctcggcgtaaatgtcaagatgattactggtgatcagcttgctattgcaaaggagacaggacgaaggcttggaatgggaacaaacatgtacccttcagcttctttacttggtcaggataaggatgcaagcatagctactcttcctgttgaagagttgattgagagggcagatgggtttgctggcgtgtttccagagcacaaatatgaaatcgtgaagaaattgcaagaaaggaagcacattgtcggaatgactggtgatggtgttaatgatgcacctgcattgaagaaggcagatattggaattgctgttgctgatgctacagatgctgcaagaagtgcgtctgacattgttctaacagagcctggattgagtgtcattataagtgctgtgctgaccagtagagctattttccaaaggatgaagaactacactatctatgcagtttccatcacaatccgtattgtgtttgggttcatgcttattgctctgatatggaaatacgacttctctcctttcatggttttgattattgccatcctaaatgatggtacaattatgacgatctcaaaggatagagttaagccatcacccttacctgatagctggaaactaaaagagatatttgccactggaatcgtacttggtggttacctggcattgatgactgtgatattcttctgggcagtgcacgatactgatttcttttcggaaaaatttggtgtcagatcgttaaggaaaaatgatgaagaaatgatgggtgctttataccttcaagttagtattgtgagccaagctctcattttcgtgactcgttctcgcagctggtcctttattgaacgacctggtctgctactggtgtctgctttcatgattgcacagctggttgcaactgtgattgccgtttatgccaactggggttttgcaaggatcaagggaattggctggggttgggctggtgtcatctggatttacagtattgttttctatttcccacttgatattatgaagtttgccatccgctacatcctaagtggaaaggcttggctcaatttgctagagaacaagaccgcctttaccacgaagaaagattatggtaaagaggagagagaagctcaatgggctcttgcacaaaggaccttgcatgggcttcaaccaccagagactgctggtgtcttcaatgaaaagagcggctatagggagttgtctgaaatcgctgagcaggctaagagacgagcagaggttgcaaggctccgggagcttcacacacttaaggggcatgttgaatcggttgttaaactcaagggtttggatattgataccatccagcaacattatacagtgtaaaaatcctgaaataactttgttacctgagaaggaaaggcctgaagttcaatgacaaaccctcgagaaaagcagatagacctgaatagctgagaacttctgtagacgggggagaaaatgctatttatataattctagtatcttgtactttttgtttttgtgttttcaactctggaagaaaaagggcactgttcccctacttcttgctccatgaagagccttgtaatgccaccttgtcacagttttttcaaggttaatcttctgcttagtaacttct

SEQ ID NO: 968 - DNA, 3647 bp, Glycine max
ttcactttcacatcaccaaacacctctctcaaggctagctagcttcaatctctttccttctgcttctttttcctctcctcactgcatttattttcttttggacttttccactcatgcaccctcttatcccctctatttaaccctctctatcttcttctcctcacataattcacacacactcattattactatacacaccctctttctcctcctcctccttcttcttcttctccttctttctctttttcattctttctttcaacatgggtggcatcagcctcgaagaaataaaaaacgagaacgtcgatctggaacggattccaatagaggaagtgtttgagcagctgaaatgttcaagagcaggtctaacatcagaggaaggggccaatcggctccaagtctttggaccaaacaaattggaagagaaaaaagagagcaagtttttgaagttcttgggctttatgtggaaccccttgtcttgggtcatggaagctgctgccataatggccattgctttggcaaacggaggaggaaggccaccggattggcaggactttgtcggaattattgcactgctagtgatcaactccacaatcagttttattgaggaaaacaatgctggcaatgctgctgctgctcttatggctggtttagctccaaagactaaggtacttagggataaccgatggagtgaacaagatgctgcaattttagtaccaggagacataatcagcatcaagttaggagatatcattccggctgacgctcgtcttcttgagggtgatcctttgagtgttgatcagtctgctttgactggagaatctcttcccgtaacaaagagcccctcggatgaagtgttttcgggatcaacagttaagaagggtgagatagaagcagttgtgattgctactggggtgcacaccttttttggcaaagcagctcatctggtggacagcaccaaccaagttggacacttccagaaagtgcttacagcaattggtaacttctgcatttgctcaattgcggttggaatcgccattgagctcatagtcatgtacccgattcagcaccgcaggtacagggaaggaattgacaacctgttagtgctcttgattggaggaattcccattgccatgccaactgtgttgtctgtcactatggctattggttcccacaggctttctcagcagggtgccatcacaaaaagaatgacagctattgaggaaatggcagggatggatgtcctatgcagtgacaaaactgggactctcaccttaaataagttgagtgttgacaggaacttgattgaggtgtttgctaagggtgttgagaaagagtatgttatccttcttgcagcaagagcttctaggactgaaaatcaagatgccatagatgctgcaattgttggcatgcttgctgacccaaaggaggcacgtagtggtgttagggaggtacatttccttccattcaatcctgtagacaagaggactgcactgacctacattgattctgatggaaattggcatagagctagcaaaggggctcctgagcagataatcaccctttgcaactgcaaagaggatgtcagaagaaaggtccatgctgtaattgataagtttgctgagcgtggacttcggtctttaggtgtcgcaagacaggaagtacctgaaaaatcaaaagatagtcccggtggaccatggcaatttgttggtctgctaccattgtttgatcctcccaggcatgatagtgctgaaaccattcgaagagctcttaaccttggtgtcaatgttaagatgattactggggatcagcttgccattggaaaggaaacaggccgaaggcttggaatgggaacaaacatgtacccttcatcggcattgcttggccaagacaaggatgcttctatttcagctcttccagttgatgagttgattgagaaggctgatggatttgcaggagtatttcctgaacacaaatatgaaattgttaagaggctgcaagagaggaagcatatatgtggaatgacgggagatggtgtaaacgatgcccctgcattaaagaaagcagatattggaattgctgttgccgatgctacagatgctgctagaagcgcttctgatattgtcctcactgaacctggtctgagtgtcattattagtgcagtgctcaccagcagggcaattttccagaggatgaagaactatactatctatgctgtgtcaatcaccattcgtattgtgtttggtttcttgtttattgcgttgatctggaagtttgattttgcacccttcatggttttgattattgccatactcaatgatggtaccattatgactatatccaaggatagagtgaaaccatcaccacttcctgatagctggaaactgagggagatatttgctactggcgttgtgctaggaagttacatggcactaatgacagtagtatttttctgggcaatgaaagataccaacttcttctcgaacaagtttggtgtgaggccattgagagatagccccgatgaaatgatggcagccttataccttcaagtcagcataattagccaggctctaatcttcgtcacaaggtcccgcagctggtcttttgttgaaagacctggtcttctcctactaggtgcattttttattgctcagttggtggcaacttttatagcagtgtatgctaactggggctttgcaagaataaagggaatgggatggggttgggctggtgtaatctggctgtacagtgtggtaacctatatccctcttgatttactcaaatttgctatccgctatattctaagtgggaaggcttgggataatcttttggagaacaagactgccttcactacaaagaaagactatggtaaagaagagagggaagctcaatgggcggctgcacagaggacacttcacggtcttcagcctccggaaacttccaaccttttcaatgacaaaaatagctacagggagctttcagagattgcagaacaagccaagagacgtgctgaagttgcaaggcttagggagcttcatactctaaagggacatgtcgagtcagtggtgaagctgaaggggcttgacattgacacgattcagcagcactatacagtttaaggagcttggacaagtttcaagaagaaccgtgcttttttgagaaaaaatcacatataaagacgaagaaagaccatgttcaatttgtctttaagttacataaaaaaatgagtcctgtgaaaatttgaatggcctctctcactgtctccatcttttctaggagatactatgctctttacgcaccaaataacataattggtagggtttactatcatctttttatctggtagtatgctagtgttattgcttactaagataatattaaaagctcaatacattggtattgacaccgttgctcaatattgaactcaatcttactctattttcctccaaccaaaataagttgagtctgagatgactagcccaatttttcaaggttcttttttttaaagtccatattatctataagtgttttaaattgaaactttcacggtctaatacataaaatttggtacataatcatctcagtttgatatggttgtagcaataacagataaaaatgaaataaatgcttaactgtttgaattgaac

SEQ ID NO: 969 - DNA, 2865 bp, Musa acuminata
atggctggcaacaaggcgatcaccttggaagagatcaagaacgaaaccgtcgatcttgaacggataccgatcgaggaggtgttcgaggaactgaaatgtaccaaacaaggcctatcgtcggaggaaggagccagccggctccaaatcttcggccccaacaagctcgaagagaaaaaggagagcaagattctcaagttcttgggcttcatgtggaatcctctatcgtgggtcatggagatggccgctatcatggccatcgcgttggccaacggcgacaataaggcgccggactggcaagacttcgtcggcatcatcgttcttctcgtcatcaactccaccataagcttcatcgaagaaaacaatgctggtaacgccgccgccgcgctgatggccggtctcgctcccaagaccaaggttcttagagatggccgctggagcgagcaggacgcagcaattcttgtgccaggtgatattattagcatcaaactcggagatatcgtccctgctgatgcgcggctgctcgaaggtgatccgctgaagattgatcagtctgccttgactggtgaatccctcccagtcaccaagaatcccggagacgaagtgttctctggctcgacctgcaagcagggtgagatcgaggccgtcgtcatcgccaccggcgtccacaccttcttcgggaaggcagcccatctggtggacagcacgaaccaagtcgggcacttccagaaggtcctgacagccatcggtaacttctgcatctgctccattgcgatcggcatgatcgtggagatcatagtcatgtacccaattcagcgcaggagatacaggaatgggatcgacaacctgttggtcctcttgatcggaggcatcccgattgccatgcccaccgttctgtcggtgaccatggctatcgggtcgcacaggttatccgaacaaggcgctatcacgaagagaatgactgccatagaggagatggctggcatggacgttttgtgcagtgacaaaactgggacgctgaccctcaacaagttgagcgtcgacaataatctgatcgaggtgttcacaaagggtatgtttaaggagcatgtaatcctattagctgctagagcatcaagaacagagaatcaagacgctatcgatgctgccatggtggggatgcttgcggaccccaaggaggcaagagctggtatcagggaagtacattttctccccttcaaccctgtcgacaaaagaactgctcttacctacattgatgctgatgacaattggcatcgtgtaagtaaaggtgcaccggagcagattttgaacatttgcaactgcaaagaagatgtcaggaataaggttcatacggtaatcgataagtttgctgaacgcggacttcgatctctagccgttgcaagacaggaagttccagagaagtgcaaagagagtgcaggagcaccatggcaatttgtgggtttgttacccctgtttgatcccccgaggcatgatagtgcagaaaccattcgaagagctctcaaccttggtgtcaatgtgaaaatgatcacaggcgatcagctttctattgccaaggagacaggccggagacttggaatgggaacaaatatgtatccttcctcttcattgctaggccaaaacaaggatgcatcaattgctgcacttcctgttgatgaactgatagagaaggctgatggatttgcaggagtattcccagaacacaaatatgagattgtgaagaagttacaggagaggaagcacatatgtggaatgaccggggatggagtcaatgatgcccctgctttaaagaaggctgatattggtattgcggttgctgatgcaacagatgcggcaagaagtgcttctgatattgttcttactgaacctggtcttagcgtcatcatcagtgctgtccttactagcagagctattttccagaggatgaagaactatactatctatgctgtctctatcactatccgtattgttctcggatttatgcttattgcacttatatggaggtttgacttctcacccttcatggttttgatcattgccatcctaaatgatggtacaattatgacaatttcaaaggaccgggtgaagccatctccattgcctgatagttggaagttgaaagaaatatttgctacaggcattgtgtttgggagttatttggcattgatgactgttattttcttctgggccatgaaagatactaccttcttctcagatatatttaaagttaggtcgcttaaagacagtgaggatgaaatgatggctgctttgtatctgcaagttagtattgttagtcaggctcttatatttgttacacgatcacgcagctggtgctttgttgagcgccctggacttcttctagtcagtgcctttatcattgctcagcttgttgcaacagtcatagctgtctatgctgactggggctttgcacggataaaaggtataggatggagatgggctggtgttatctggatttacagcattgttttcttcttccctctggattggttcaaatttgctatccgctacattctaagtggaaaggcttgggataaccttctccaaaataagactgctttcactaccaagaaagattatggtaaggaagaaagggaagctcagtgggctatggcacaacgaactcttcatggacttcaaccccctgaaaccaccaatcttttctccgacaagagtagctacagggaactatcagaaattgctgaacaagccaaaaggcgcgctgaaatcgcaaggctccgcgaactgcacactctgaagggacacgtcgagtcagtggtcaagcttaaagggctcgacatcgacaccatccagcagcattacaccgtatga

SEQ ID NO: 970 - DNA, 3533 bp, Ricinus communis
ttcaaaagacgatagatatattataaattttattttatttctcttctatttatatttgggcgcgctctctctctctccctccctccctccctccctcccttatgagtctctagaactagtttcactgaaggttttccggaggaatttagccagccatggccaccaaaggcggtatcagtctcgaggagataaaaaacgagtctgttgatctggaacggattcctatagaggaagtgtttgagcagctgaaatgttccagggaaggtctttcctcagaggaaggaaccaacaggcttcaagttttcggaccaaacaaattggaagagaaaaaggagagcaaaattctcaagtttttgggctttatgtggaatccattgtcatgggtcatggaagctgctgctataatggctattgctttggcaaatggtgatggaagacctccagattggcaggacttcgtgggtattgttgccttgttgctgatcaactccacaattagttttatcgaagaaaacaatgctggaaatgcagcagcagccctcatggctggtcttgctccaaagactaaggttctcagagatggtagatggactgagcaagaagctgcaattttggttccaggagacattatcagcattaagttgggagatattatccctgctgatgcgcgtcttcttgaaggcgatcccttgaaggttgatcaatctgctcttactggggagtcactacccgttacaaagaacccttcagatgaagtgttttctggctcaacatgtaaacagggtgaaattgaagcagtagtaattgccaccggtgtgcacacattttttggtaaagctgcccatctagtggacagcaccaaccaagttggtcatttccaaaaagttctaactgccattggtaacttctgtatttgctcaatcgctgttggaataattattgaacttatagtcatgtacccaatacagcatcgcaagtacagagatggaattgacaacttattggttcttttgattggaggaattcccatagctatgccaactgttttgtctgtcaccatggccattggttcgcacaggctctctcagcagggggcaattaccaagagaatgactgccattgaggaaatggcaggcatggatgttctttgcagtgacaagactggaactctaaccctgaacaagctgactgttgacaggaccctcattgaagtgtttgtgaagggtgtggataaagagtatgtaatccttcttgcagctagagcttcaagaactgaaaatcaagatgctattgatgctgcaattgtaggaatgctggcagacccaaaggaggcacgagctggtattagagagcttcatttccttccattcaaccctgtggacaagaggactgccttgacctatatagattctgatggaaactggcaccgagctagcaagggtgctcctgagcagattctaacactgtgcaatagcaaggaggatgtcaagaagaaagttcatgctgtgattgataagtttgctgaacgtggacttcgatctttagctgttgcaagacaggaagtacctgagagatcaaaagaaagtcctggtggcccatggcaacttgttggtttgttgcctttgtttgatcctcccaggcatgacagtgctgagactatcagaagagctcttaaccttggcgtgaatgttaaaatgattactggggatcagcttgccattgctaaagaaactggtcggaggcttggaatgggaacaaacatgtatccatcttcttcattgcttggccaagacaaagatgcttccatcgcaaccctccctgtagatgagttgattgaaaaggctgatggatttgctggagtttttccagaacacaagtacgaaattgttaagaggctgcaggagaggaagcacatttgtggtatgacaggagatggcgttaacgatgcccctgctttgaagaaggcagatattggaattgctgttgctgatgctactgatgctgccagaggtgcttcagacattgtccttactgaacctgggcttagtgtaattataagtgcagtgctgaccagcagggccatattccaaagaatgaagaactacacgatatatgcagtctcaattaccatccgtatagtgtttggcttcctgtttatcgccttgatatggaagtttgacttttctccattcatggttttaatcattgccatcctaaacgacggaacaatcatgacaatttcaaaggatcgagtgaaaccatctccgcagccagacagctggaaacttaaagagatttttagtactggtgttgttcttggaggttatctggcactaatgactgtgatatttttctgggcaatggaagagactgacttcttttccgacaagtttggtgtaagatcattgcataatagtgaaggtgaaatgatggcagctctatacctacaagtcagtattgtgagccaggcccttatttttgtcacaaggtctcgcagctggtcctttgttgaacgtcctggacttcttctaatcggtgcattcatagctgctcaactgatagcaacagtgatagcagtttatgcaaactgggggtttgctcgtatagagggatgtggttggggatgggctggtgtaatctggctttacagtgtggttacttatgtgccacttgatctgctgaaattcgccatacgctacattctgagcggcaaggcttgggataatcttttggagaacaagactgcctttactacaaagaaagactatggaaaagaagagagagaagcacagtgggctacagcacagaggactcttcatggcctccaaccacctgaaactactaacttctttgctgacaagaatagttacagggagctttcagagatcgcagagcaagccaagcggcgggctgaggtggcaaggctgagggagcttcataccctcaagggacacgtggagtcggtggtgaagctgaaaggacttgacatcgacacgattcaacaacattacacagtttgaagagttggaattctcgagagaaccaatcttctccgagagagcgcccctccccccaacccccaaaaaaaaaacagagaaaaaaaaaagaacatatgatgacgaagaaaggcctaatggaaaattttcattttcatttgattatgatgatattgctcttgctataatttgtggtacttttatttttgttactcatcgtccacttttgtggccagaggagaggatttctctccttggaagtcagtagtatcaccttgaaattttctcctcctttgtgtacaatttctctattatttacaatttacatgctttgcctgtgtgtgcttcccctactagattataccacttaaaagctttgacactgccgaattgtgttttgcatggggaagaccttggtgttagctgagttgtatttagagttttaacaagacttgacccataattaccctggcctgtttcatgcctttgatggtatctttttttattgatgctagatcaattggaaagccctcaatt

SEQ ID NO: 971 - DNA, 3388 bp, Mimulus guttatus
tttctatttaaattaatataaacataactaatttaattcctcttattatataagaaatggcataatatatatatatatatatacatattagaccagcttttcatcttcttcgatcaacccatttaacttgagttaattattagatacacacacatatagtgttacagagatgggcagcacaaagggtctcactcttgaggagattaagaatgaagctgttgatttggaaagaatcccagtcgaggaagtgttcgagcagttgaaatgcacgcgcgaaggtctaacatccgaagaaggtcagaaccgcctgcaaatattcggtccaaacaaattggaagagaaaaaggagagcaagattctcaagttcttggggttcatgtggaaccccttgtcatgggttatggaagctgctgctttaatggctatcgtcctcgctaacggagataatcgcccgcctgattggcaagattttgtcggcattgtcgccttattgttcatcaactccacgattagttttatcgaagaaaacaatgctggtaatgctgctgcagctcttatggctggacttgctcccaaaactaaggttttgagagatggccgatggagtgagcaagatgcttcgatcctcgtcccgggtgacatcatcagcatcaagcttggtgacatcatcccggccgacgcccgccttctagaaggcgaccctttgaaagttgaccagtcagcattgaccggagagtctctccctgtcacgaaaagcccttccgacgaggtcttctccgggtccacatgcaagcaaggcgagatcgaagcagttgtcatagcaaccggggtccacactttcttcggcaaggcagcccatctagtggacagcacgaatcaggtcggacacttccagaaggttctgacggcaatcggaaacttctgcatatgctcgatcttcgtcgggataatcatcgaattaattgtgatgtaccccatacagcaccgtaagtatagggacggaatcgacaatctgcttgttctgttgatcggagggattccgattgcgatgccgactgttctgtctgtgacgatggcgatcgggtcccacaggctgagtcagcagggggcaattactaagcggatgactgctattgaggaaatggcgggaatggatgtgctgtgcagtgataaaacggggactttgactttgaataagttgaccgttgaccggagccttgtcgaagtatttgtgaagggattggataaagagcaagtgattttgcttgcagctagggcttcgagaaccgaaaatcaggatgctattgatgccgccattgtcgggatgcttgccgatccaaaggaggcgagagctggtgcgagggaggtgcattttctacctttcaatcctgtcgataaaaggacagcgttgacttacatagatgccaatggtaattggcatcgtgctagcaaaggtgcacccgagcagatactggcactttgcaatagtaaggaagatgtgagaaagagggttcactcggttatcgataagtttgctgaacgtggactccgttctttaggggttgctcgacaggaagttccggaaagaacaaaagagagccttggtggaccatggcaactcgttggtttattacctttgttcgatccacctaggcatgatagtgcagaaacaattagacgagcgttgaatcttggtgtgaatgtgaagatgatcactggtgaccagctagcaatagccaaggaaacgggacgaaggctcggaatgggaacgaatatgtacccgtcttcatctttgctcggccaacacaaagatgaagctattgcgtcacttcctgtcgatgagctaattgagaaagccgacggttttgccggagtatttcctgagcacaagtatgaaatagtgaagagattgcaagaaagaaagcacatttgtggaatgacgggggacggtgtgaacgatgctccagcactaaagaaggccgatatcggaatcgctgttgccgatgcaaccgatgctgctaggggcgcttccgacattgtcttaacggaacctggtctgagtgtcataataagtgctgtccttacgagccgagctattttccaacgaatgaaaaattacaccatatacgctgtctcgattacaatccgtatagtgtttggattcatgcttattgctttgatatggaaattcgactttgctccgttcatggttctaatcatcgccatcctaaacgacgggaccatcatgacaatctcgaaggatcgagtgaagccgtctccattaccggacagctggaaactaaacgagattttcgccaccggagttgtcttaggagggtaccttgcactcgggactgtattattcttttgggtcatgaaagataccgactttttctctgaaaaatttggtgtaaggtccctaagagatagtcccgaggaaataatggcagcattatacttgcaagtgagtattgtgagtcaagcacttattttcgtgacgaggtcccgtagctggtcctttgccgaacgtcccggaatgttcttattgggcgctttcttgattgctcagctggttgcgactctaatagctgtttatgctgattggagctttgcgaagataaaaggatgtggttggggttgggccggtgttatttggctttacagtatcgtaacttactttcctctcgacattctcaagttctgcattcgctacgttttgagtggaaaagcttgggataatcttttggagaaccggactgcatttactaccaaatccaactatgggaaggaagagagagaagcccagtgggcggcttcgcagcggactttgcacggtcttcagccaccggaaaccgccaacctctttgccgagaaaagcagctacagagagctctccgagattgccgaacaagccaaacgccgcgctgaggtggcaaggcttagagagctgcatacgctgaaggggcacgtggaatcggtggtgaagctgaaaggattggatatcgacacgattcaacagcattatactgtctgatgaatcaatgccgatttcttttaaggaaatgaaagctggttcaattagtttcgtgcaataagtttttatttagtactagtttatgtaaaccaaatagtaattggtcccattttctgttgcttaatatttgaacttcgaagttatatagtggacgaaaatggttctggtatttcgatcgtcgaacaaaatcgcaaaaaatcgtgcactatatcacacgctttgtgctgaaaaagaaaaggttatctagaaattatttcagtaatttttaaactgtgaagcaaaattacgaaaaattgtgaacttatagcatagatttttttataaaaaaatcattgaaatgacaataataatttt

SEQ ID NO: 972 - DNA, 3491 bp, Sorghum bicolor
ccgcacccatctcctcccgttccactcgacgcccaccaccgctaccactctccacttgcccttttctcaccgccccgtcccgttcattggaccctcctccccttcccttcccttctcgctcgcacgacgagaagagaagcgaggaggcgccggcatatgcccgtgcctgccgtcgggcttcttcgcctctaggccgggtccgctccgccgtcgtccgccatgggtggactcgaggagatcaagaatgaagccgtcgatctggagaacatccccatcgaggaggtgttcgagcaactgaaatgcacccgcgaggggctgagctccagcgagggccagcagcgtctcgagatctttggccccaacaagctcgaggagaagaaggagagcaagatcctcaagttccttgggttcatgtggaacccgctgtcatgggtcatggagatggctgccatcatggccattgcccttgccaacggtggtggcaagcccccggattgggaggacttcgtcggtatcatcgtgctcctggttatcaactccaccatctcattcattgaggagaacaatgccggcaacgccgctgctgcactcatggccaaccttgctcccaaaaccaaggttctgagagatggccgatggggcgagcaagaggctgcaatcttggttcctggtgacatcatcagcatcaagcttggtgatatcgtccctgccgatgctcgcctcctcgagggtgatcctctcaaggttgaccagtctgcgcttactggagaatccctcccggttaccaggggccctggggacgaagtcttctcggggtccacttgcaagcagggtgagatcgaggccgtggtcattgccacaggagtgcacaccttcttcggcaaggctgctcatcttgtggacagcaccaaccaggtcggacacttccaacaggtcctgacagcaattggtaacttctgcatctgctcgattgcggtcggcatcatcgtcgagatcatcgtcatgttcccgatccagcaccgcaaataccgcagcggaatcgagaacctgttggtcctcttgatcggtggtatcccaattgccatgcctactgtgctttcagtcaccatggccatcggttcgcacaagctgtcacagcagggtgccatcactaagaggatgactgctattgaggagatggctggtatggatgtgctttgcagtgacaagaccggcacactcaccctcaacaagcttagtgtcgacaagaacctcgtcgaggtgttttgcaaaggcgtcgacaaagaccatgtgttgctgttggctgcaagggcttcaaggactgagaaccaggatgccatcgatgctgccatggttggcatgcttgctgatcccaaggaggccagggctggtatcagggaagtccacttcttgcccttcaaccctgttgataagaggactgctctgacatacattgatggcgatggcaactggcaccgtgtcagcaagggtgctcccgagcagattcttgacctgtgccactgcaaggaggatttgaggcggaaggtacacggtattatcgacaagtatgctgagcgtggtcttcgttcgcttgctgttgccagacaggaagtgcctgagaaaaataaggagtcccctggtggaccatggcaattcgttggtttgttgcccctgtttgatccacctaggcacgacagtgctgagacaattcgcaaggctcttgttcttggtgttaatgtcaagatgattactggtgatcagcttgctattggtaaggagaccggaaggaggcttggtatgggtaccaacatgtatccttcctcagctttgctcggccaaaacaaggattctacgcttgaagcacttcctgttgatgagctcattgagaaggccgatgggtttgctggagtcttccctgaacacaagtatgagattgtgaagagattgcaagagaagaaacacattgttggtatgactggagatggtgtcaacgatgccccagctcttaagaaggccgacatcggtattgctgtcgcggatgctactgatgctgcaaggagtgcttctgatattgtccttactgagccaggtcttagtgtcattatcagcgctgtccttactagcagatgcatcttccagaggatgaagaattacaccatttatgctgtttccatcaccatccgtatagtgcttggatttatgctcattgctttgatctggaaatatgatttctctcccttcatggtccttatcattgccattctcaatgacggtactatcatgaccatctctaaggacagagttaagccatctcccttgcccgacagctggaagctgaaggaaatcttcgctaccggtatcgtgctcggaagctaccttgctataatgactgtcattttcttctgggctatgcacaagaccgacttcttctcggacaaattcggtgtgaggtcaatcagggacagtgagcatgagatgatgtctgcgctgtacctccaagtcagtattgtgagccaggctctgatcttcgtcacccgttcccgtagctggtctttcgtggagcgccctggtctgctcctggtcaccgcgttcctgctcgctcaacttgttgcgaccttcctcgctgtctacgccaactggggcttcgccaggatcaagggtatcggctggggctgggctggtgtcgtctggctctacagcatcgtgttctacttccctctggacctgatcaagttcttcatccgatttgtgctcagcggcagggcatgggacaaccttctcgagaacaagaccgccttcaccaccaagaaggattacggacgggaagagagggaggcgcaatgggccaccgcgcagaggacgctgcacggtctccagccgccggaggctgccaccaacactctgttcaacgacaagagcagctaccgcgagctgtcggagatcgctgagcaggccaagagacgagctgagatcgcgaggctgagggagctcaacaccctcaagggccacgtggagtcggtggtgaagctcaaggggctggacatcgacaccatccagcagaactacacggtgtgagagccgcctgctgcgatcgatgtcgacgaaaaaaacctttggcgcccgaccccgccttattgcgacggagtcatctctgattattacagacaaaaaaattttccggtgatgaattgaaaacaaaagaaccgtgtggctgatctgactgagcagccctagttgtaaagcgctataccaccagatactgctatatgatggtatggtttggtacccgtctttctagggagcttcttttttgttctcatattatgtttaaatcaatagtggagtgtgcgcttgttgtaatcattttacttgcgttttcccctaactagccggtgatctcgtggaaagcgaggtgaatgaagaaataatgcaacaaaaattttctgccaagagcattgtgttcctttctgacttgattgatgcagacaaca

SEQ ID NO: 973 - DNA, 3132 bp, Glycine max
cattgaaatgaaccttgtcctcaggaacggattccaatagaggaagtgtttgagcagctgaaatgttcaagagcaggtctaacatcagaggaagggggcaatcggcttcaagtctttggaccaaacaaattggaagagaaaaaagagagcaagtttttgaagttcttgggttttatgtggaaccccttgtcttgggttatggaagctgctgctataatggccattgctttggcaaatggaggaggaaggccaccagattggcaggactttgtcggaattatcgcgctgctagtgatcaactccacaattagttttattgaggaaaacaatgctggcaatgctgctgctgctcttatggctggtttggctcccaagactaaggtactaagggataaccgatggagtgaacaagatgctgcaattttagtaccaggagacataatcagcatcaagttaggagatatcattccggccgacgctcgtcttcttgagggtgatcctttgagtgttgatcagtctgctctgactggagaatcactccctgtaacaaagagtccctcggatgaagtgttttcgggatcaacggtcaagaagggtgagatagaagcagttgtgattgctactggggtgcacaccttttttggcaaagcagctcatctggtggacagcaccaaccaagttggacacttccagaaagtgcttacagcaattggtaacttctgcatttgctcaattgcggttggaatcgtcatcgagctcatagtcatgtacccgattcagcaccgcaggtacagggatggaattgacaacctgttagtgctcttgatcggaggaattcccattgccatgccaactgtgttgtctgtcactatggctattggttcccacaggctttctcagcagggtgccatcacaaaaagaatgacagctattgaggaaatggcaggcatggatgtcctatgcagtgacaaaaccgggactctcaccttgaataagttgagtgttgacagaaacttgattgaggtgtttgctaagggtgttgagaaagagtatgttattcttctcgcggcaagagcttctaggactgaaaatcaagatgccatagatgctgcaattgttggaatgcttgctgacccaaaggaggcacgtagtggtattagggaggtacatttccttccattcaatcctgtagacaagaggactgcactgacctacattgattctgatggaaattggcatagagctagcaaaggggctcctgagcagataatcaccctctgcaactgcaaagaggatgtcagaagaaaggttcatgcagtaattgataagtttgccgagcgtggacttcggtctctaggtgttgcaagacaggaagtacctgaaaaatcaaaagatagtcctggtggaccatggcaatttgttggtctgctaccattgtttgatcctcccaggcatgatagtgccgaaaccattagaagggctctgaaccttggtgtgaatgttaagatgattactggggatcagcttgccattggaaaggaaacgggccgaaggcttggaatgggaacaaacatgtacccttcatctgcattgcttggccaagacaaggatgcttctatttcagctcttccagttgatgagttgattgagaaggctgatggatttgcaggagtatttcctgaacacaaatatgaaattgttaagaggctgcaagagaggaaacatatatgtggaatgacgggagatggtgtaaacgatgcccctgcattaaagaaagcagatattggaattgctgttgctgatgctacagatgctgctagaagtgcttctgatattgtcctcactgaacctggtctgagtgtcattattagtgcagtgctcaccagcagggcaattttccagaggatgaagaactatactatctatgctgtctcaatcaccattcgtattgtgtttggtttcttgtttattgcgttgatctggaagtttgattttgcacccttcatggttttgattattgccatactcaatgatggtaccattatgactatatccaaggatagagtgaaaccatctccacttcctgatagctggaaactgagggagatatttgctactggagttgtgctaggaagttacatggcactaatgacagtagtatttttctgggcaatgaaagataccaacttcttctcgaacaagtttggtgtgaggccgttgagcgatagccctgacaaaatgatggcagccttatacctacaagtcagtataattagccaggctctaatcttcgtcacaaggtcccgcagctggtcttttgttgaaagacctggtcttctcctactaggtgcattttttattgctcagttggtggcaacttttatagcagtatatgctaactggagctttgcacgaataaagggaatgggatggggttgggctggtgtaatctggctctacagtgtggtaacctatatccctcttgatttactcaaattcgcaatccgctatattctaagtgggaaggcttgggataatcttttggagaacaagactgctttcactacaaagaaagactatggtaaagaagagagggaagctcaatgggcggctgcacagaggacacttcacggtcttcagcctccggaaacttccaaccttttcaatgacaaaaatagctacagggagctttcagagattgctgaacaagccaagagacgtgccgaagttgcaaggcttagggagcttcatactctaaagggacatgttgagtcagtggtgaagctgaaggggctggacattgacacgattcagcagcactatacagtttaaggagcttggacaagcttcgggaagaaccggctcagtgcttttttgagaaattttttttacatataatgacgaagaaagaccatgttcaatctgtctttaagttacataaaaaaatgagtcctgtgaaaatttgaatggtctctctcactgtctccatcttttcttggagatactatgctctttttacgtaccaaataacataattggtagggtttactatcatctttttatctggtagtatgctagtgttattgcttactaagatagtattaaaagctcaatacattggtattaacaccg

SEQ ID NO: 974 - DNA, 3365 bp, Saccharum officinarum
ccaccactttccacttgccctttctctccgccccgttccgttcattggatcctccccctccttctcgcacgagaagcgaagcgaggaggcgcggcgtatgcccgtgtctgccgtcgggcttcgcctctagcaacgccagccgtcgtccgccatgggtgggctcgaggagatcaagaatgaagccgtcgatctggagaacatccccatcgaggaggtgttcgagcagctgaaatgcacccgcgaggggctgagctccagcgagggccagcaacgtctcgagatctttggccccaacaagctcgaggagaagaaggagagcaagatcctcaagttccttgggttcatgtggaacccgctgtcatgggtcatggagatggctgctatcatggccattgccctcgccaatggcggtggcaagcccccggactgggaggacttcgtcggtatcatcgtgctcctggttatcaactccaccatctccttcatcgaggagaacaatgccggcaacgctgcggctgcactcatggccaaccttgctcccaaaaccaaggttctgagagatggccgatggggcgagcaagaggctgcaatcttggttcctggtgatatcatcagcatcaagcttggtgatatcgtccctgccgatgctcgtctcctcgagggtgaccctctcaagttgaccagtctgcgcttaccggagaatccctcccagttaccaggggccctggggacgaagtcttctcggggtccacttgtaagcagggcgagatcgaggccgtggtcattgccactggagtgcacaccttcttcggcaaggctgctcatcttgtggacagcaccaatcaggtcggacacttccaacaggtcctgacagcaattggtaacttctgcatctgctcgattgcggtcggcatcatcgtcgagatcatcgtcatgttcccaatccagcaccgcaaataccgcagcggaatcgagaacctgttggtcctcttgatcggtggtatcccaattgccatgcctactgtgctttcagtcaccatggccatcggttcgcacaaactgtcacagcagggtgccatcactaagaggatgactgccattgaggagatggctggtatggatgtgctttgcagtgacaagaccggcacactcaccctgaacaagcttagtgtcgacaagaacctcgtcgaggtgttttgcaaaggcgtcgacaaagaccatgtgttgctgttggctgcaagggcttcaaggactgagaaccaggatgccatcgatgctgccatggttggcatgcttgctgatcccaaggaggccagggctggtatcagggaagtccacttcttgcccttcaaccctgttgataagaggactgctctgacatacattgatggcgatggcaactggcaccgtgtcagcaagggtgctcccgagcagattcttgacctgtgccactgcaaggaggatttgaggcggaaggtgcacggtattatcgacaagtatgccgagcgtggtcttcgttcgcttgctgttgccagacaggaagtgcctgagaaaagtaaggagtcccctggtggaccgtggcaattcgttggtttgttgcccctgtttgatccacctaggcacgacagtgctgagacaatccgcaaggctcttgttcttggtgttaatgtcaagatgattactggtgatcagcttgctattggtaaggagaccggaaggaggcttggcatgggtaccaacatgtatccttcctcagcattgctcggccaaaacaaggattctacacttgaggcacttcctgtagatgaactcattgagaaggctgatggttttgccggagtcttccctgaacacaagtatgagattgtgaagagactgcaagagaagaaacacattgttggtatgactggagatggtgtcaacgatgccccagctcttaagaaggccgacatcggtattgctgttgcagatgctactgatgctgcaaggagtgcttccgatattgttcttactgagccaggtcttagtgtcattatcagtgctgtccttaccagcagatgcatcttccagaggatgaagaactacaccatttatgctgtttccatcacaatccgtatagtgcttggatttctgctcattgctttgatctggcaatatgatttctctcccttcatggtccttatcattgccattctcaatgacggtactatcatgaccatctctaaggacagagttaagccatctcccttgcccgacagctggaagctgaaggaaatctttgctaccggtgtcgtgcttggaagctaccttgctctgatgactgtcattttcttctgggctatgcacaagaccgacttcttctcggacaaattcggtgtgaggtcaatcagggacagtgagcatgagatgatgtctgcgctgtacctccaagtcagtattgtgagccaggctctgatcttcgtcacccgttcccgtagctggtccttcgtggagcgccctggtctgctcctggtcaccgcgttcctgctcgctcaacttgttgctaccttcctcgctgtctacgccaactggggcttcgccaggatcaagggtatcggctggggctgggctggtgtcgtctggctctacagcatcgtgttctacctccctctggacatgatcaagttcttcatccgcttcgtactcagcggcagggcatgggacaacctcctcgagaacaagaccgccttcaccaccaagaaggattacggacgggaagagagggaggcgcaatgggccaccgcgcagaggacgctgcacggtctccagccgccggaggctgccaccaacaccctgttcaacgacaagagcagctaccgcgaactgtcggagatcgctgagcaggccaagagacgagctgagatcgcgaggctgagggagctcaacaccctcaagggccacgtggagtcggtggtgaagctcaaggggctggacatcgacactatccagcagaactacacggtgtgagagcctgctgcgatgatgtcgacgaaaaaacctttgccgcccgaccccctccttactgcgacggagtcatctgattacagaaaaaattttccagtgattgaatgaatgaaaacaaaagaaccgtgtggctgatctgactgagcagccctacttgtaaagcgctataccaccagacactgctatatgatggtatggttgggtacccgtctttctagggagcttcttttttttcctcttcttatatcgtgtttaaatcaatagtggagtgtgcgcgtgttgtaatcgtttcacttgcgttttcccctaactagccggtgatctcgtggaaagcgaggtgaagaaataatgcaacaaaaatt

SEQ ID NO: 975 - DNA, 3400 bp, Zea mays
gccccatctcctcccgttccactcgacgcccaccaccactctctagtctcaccgccccccgtcccgctcattggacgagacgacggacccttcctttctcgcacgggaagagtagcgaggaggcgcggcgcccgtgcggcgtatgcccgtgcctgccgtcgggctccgcctctaggactagggtccgctccagcgccagccgtccgccatgggtgggctcgaggagatcaagaacgaagccgtcgatctggagaacatccccatcgaggaggtgttcgagcagctgaaatgcacccgcgaggggctgagctccagcgagggccagcagcgtctcgagatctttggccccaacaggctcgaggagaagaaggagagcaaggtcctcaagttccttgggttcatgtggaacccgctgtcatgggtcatggagatggctgccatcatggctattgcactcgccaacggtggtggcaagcccccggactggcaggacttcgtcggtatcatcgtgctcttggttatcaactccaccatctccttcattgaggagaacaatgccggcaacgccgccgccgcactcatggccaaccttgctcccaaaaccaaggttctgagagatggccgatggggcgagcaagaggctgcaatcttggttcctggtgacatcatcagcatcaagcttggcgatatcgtccctgccgacgctcgtctcctcgagggtgatgcactcaaggttgaccagtctgcgcttactggagaatccctcccggttaccaagggcccaggggacgaagtcttctcgggttccacttgtaagcagggtgagatcgaggccgtggtcattgccaccggagtgcacaccttcttcggcaaggccgctcatcttgtggacagcaccaaccaggtcggacacttccagcaggtgctgacagcaatcggtaacttctgcatctgctccattggggtcggcatcctcgtcgagatcatcgtcatgttcccaatccagcaccggaagtaccgcagcggaatcgagaacctgttggtcctcttgatcggtggtatcccaatcgccatgcctaccgtgctttcagttaccatggccattggttcgcacaagctgtcacagcagggtgccatcactaagaggatgactgccattgaggagatggctggtatggacgtgctttgcagtgacaaaaccggcacactcaccctcaacaagcttagcgtcgataagaacctcgtcgaggtgttctgcaaaggcgtcgacaaagaccatgtgttgctgttggctgcaagggcttcaaggactgagaaccaggacgctatcgatgccgccatggttggcatgcttgctgatcctaaggaggccagggctggtataagggaaatccacttcttgcccttcaaccctgttgataagaggactgctctgacgtacattgatgccgatggcaactggcaccgtgtcagcaagggtgctcctgaacagattcttgacctgtgccactgcaaggaggatctgaggcggaaggtgcactctattatcgacaagtatgccgagcgtggtcttcgttcgcttgctgttgccagacaggaagtacctgagaaaaacaaggagtcccctggtggaccatggcagttcgttggtctgttgcccctgtttgatccgcctaggcatgacagcgctgagacaattcgcaaggctcttgttcttggtgttaacgtcaagatgatcacgggtgatcagcttgctattggtaaggagactggaaggaggcttggcatgggtaccaacatgtatccatcctctgcgctgctcggccaaaacaaggatgctacgcttgaagcgcttcctgtagatgagctcattgagaaggccgatggttttgccggagtcttccctgaacacaagtacgagatcgtgaagagactgcaggagaagaagcacatcgttggtatgactggagatggtgtcaacgatgccccggctcttaagaaggctgacatcggtattgctgttgcggatgctactgacgctgcgaggagtgcttccgatattgtccttactgagccaggtcttagcgtcattatcagcgccgtcctcaccagcagatgcatcttccagaggatgaagaactacaccatctatgcagtttccatcacaatccgtatagtgctcggatttatgctcattgcgttgatctggcaatacgatttctctcccttcatggttcttatcattgccattctcaatgacggtactatcatgaccatctctaaggacagagttaagccatctccgttgcccgacagttggaagctgaaggagatctttgctacgggcatcgtgcttggaagctaccttgctctgatgactgtcattttcttctgggctatgcacaagaccgacttcttctcggacaaattcggtgtgaggtcgatcagggacagcgagcatgagatgatgtccgccctgtacctccaagtcagtatcgtgagccaggctctgatcttcgtcacccgttcccgtagctggtccttcgtggagcgccctggtctgctcctggtcaccgcgttcctgctcgctcaacttgttgccaccttcctcgctgtctacgccaactggggcttcgccaggatcaagggtatcggctggggctgggcaggtgtggtctggctctacagcatcatcttctacttccccctggacctgctcaagttcttcatccgcttcgtgctcagcggcagggcatgggacaacctcctcgagaacaagaccgccttcaccaccaagaaggactacgggcgggaagagagggaggcgcagtgggccaccgcgcagaggacgctgcacgggctccagccgccggaggcttcctccaacacgctgttcaacgacaagagcagctaccgcgagctgtccgagatcgccgagcaggccaagagacgagctgagatcgcgaggctgagggagctcaacaccctcaagggccacgtggagtcggtggtcaagctcaagggcctggacatcgacaccatccagcagaactacacggtgtgagagcccctctgctgcgatgtcgacgacaacacctttgctgcccgacgggagccatctgattacagataaaaattttcctagctgtaaagctctctataccaccagatactgccatatgatggtatggttgggtacccgtctttctagggagtttcttttctctctctcttttcttattgttatgtttttcaatagtggagtgtgcgcgtgttgtaatcgtttttacctgcgttttcctctaactagccggtgatctcgcgggaagcgaggtgaagaaataatgcaactaaaattctctgccaaaagcattgttccttctcacttgggtaccgtttg

SEQ ID NO: 976 - DNA, 3246 bp, Quercus alba
gagatatttatatttatattgtagcttgagagctcttgtcgtcgtcgtctccagcttccaccatgggtggcgataagcctatcagcctcgaggagatcaaaaatgagtccgttgatctggaacggattccaattgaggaagtgtttgagcagttgaaatgtacaaggcagggtctatcagcagaggaaggagcccacaggcttcaagtttttggaccaaacaaactagaagagaaaaaggagagcaaacttctcaagttcttgggtttcatgtggaacccattgtcttgggtcatggaagctgctgctctcatggctattgccttggcaaatggtgatggaaagcctccggattggcaggactttgttggtatcattgtccttttgctgatcaactctacaatcagttttattgaggaaaacaacgctggcaatgcagctgcagcacttatggctggtcttgctcccaagactaaggtcctgagagatggtcgatggagtgaacaagatgcttcgattttggttcccggagacattatcagcattaaattgggagatattgttcctgctgatgctcgtcttctcgagggtgatcctttaaaaattgatcagtctgctctgactggagaatcccttcctgtcactaagaacccctcagatgaagtgttttctggctcaacatgtaaacagggtgaaatagaagcagtcgtgattgccactggtgtccacacctttttcggtaaagctgcccatttggtagacagcaccaatcaagttgggcacttccagaaagttctcactgcaattggtaatttctgtatatgttcaattgctatcggaattatcattgagattatagtgatgtacccaattcagcatcgcaagtataggagtggaattgacaatctactggttctcttgattggaggaattcctattgccatgccaactgttttgtctgtcacgatggctattggttcacacaggctctcacagcagggtgctattacaaagagaatgactgccatagaggaaatggctggcatggatgttctctgcagtgacaaaacgggtactctaaccctgaataagttgactgttgacacaaatttgactgaggtatttgcaaagggtgtggagaaagagcttgttatgcttctcgcagcaagggcctctaggactgaaaatcaagatgccattgatgcttgtattgtagggatgcttgcagatccaaaggaggcaagagctggtatcagagaggttcatttccttccattcaatcctgtagacaaaaggaccgctctgacctacattgatgaaaagggaaactggcatcgtgctagtaaaggtgctcctgagcagattataaccctttgcaactgcaaggaggatgttaggaaaaaggttcatgcagtgattgataagtttgctgaacgtggacttcgatctttaggtgttgccagacaggaagtacctgaaaaaacaaaagagagtccagggggaccatggcagtttgttggtttgttgcctctgtttgatcctcctaggcatgacagtgcagaaaccatcagaagagcacttaaccttggtgtgaatgtcaagatgattactggggaccagcttgccattgccaaggaaacaggtcgtaggcttggaatgggaacaaacatgtacccctcttcttcattgctcggccaagacaaggatgtttccattgcagccctccctgtagatgagttgattgagaaggctgatggatttgctggagtttttccagaacacaaatatgaaattgtgaagaagctgcaagagaggaagcacatttgtggaatgacaggagatggtgtcaatgatgcccctgctttaaagaaggcagatattggaattgctgttgctgatgcaactgatgctgctagaggtgcttcggacattgtcctcactgaaccaggtttgagtgtcattataagtgctgtgctgactagcagggctattttccaaaggatgaagaattacacaatctatgcagtttcaatcactattcgtattgtgtttggattcatgtttattgctttgatatggaaatttgactttgcaccattcatggttctaattattgccatcctaaatgacggtacaatcatgacaatatcaaaggatagggtgaagccatctccaatgccagacagctggaaactgaaagaaatttttgctactggcattgttctaggaggttacttggccctgatgacagtgatatttttttgggctatgaaagacacaacctttttctcagacaagtttcacgtgaggccattgaaaggaaatgatgaagaaatgatggcagccttataccttcaagttagtattgtaagccaggccctaatttttgtcacaaggtctcgcagctggtcctttattgaacgacctggccttctcttgcttggtgcttttgtaattgctcagctgatagcaactttcatagcagtatatgcagattggggttttgcacggataaaaggaatgggctggggttgggccggtgtaatctggctttatagtcttgtaacatatttcccacttgatatcctcaaatttgcaatccgctacattctgagtggaaaggcttgggataatcttttggagaacaagactgcctttactacaaagaaagactatggaaaagaagagagagaagcacaatgggcagctgcacagaggaccctgcacggtcttcaaccacctgaaaccagcaaccttttcactgagaagagtagttacagggagctttcagagatagcagagcaagccaagcgacgtgctgaggttgcaaggttaagggagctgcataccctgaaggggcacgtcgaatcagtggttaagctgaaaggactggacattgatacaatccagcaacattacacagtttaaagagctaagttagtcttccttagagagaactcatcaaagtgttatgttctcccagagaaagccaacaatgatgacgaacgaagccttaaactttaatttctagtttagagcgataattaatccttttggttcatgtcaattagttactaaagcttgttgtctctctgacaagttcagatgaagagcgctgttctctttttaaaagccaaataatatcatttgcacagtttcatccttttgtatttttcccgctaaggtttatctttttcctgttggttgttacatgaatctacagctctgatggaccaagaaaattttt

SEQ ID NO: 977 - DNA, 3219 bp, Castanea mollissima
atttatataaaagcttgagagctctcttgtcgtctccagcttccaccatgggtggcgataagcctatcagtctcgaggagatcaaaaacgagtccgttgatctggaacggattccaattgaggaagtgtttgagcagttgaaatgtacaaggcagggtctatcagcagaggaaggagccaacaggcttcaagtttttggaccaaacaaactagaagagaaaaaggagagcaaacttctcaagttcttgggtttcatgtggaacccattgtcttgggtcatggaagctgctgctctcatggctattgccttggcaaatggtgatggaaagcctccggattggcaggactttgttggtatcattgtccttctgctcatcaactctacaatcagttttattgaggaaaacaacgctggcaatgcagctgcagcccttatggctggtcttgctcccaagactaaggtcctgagagatggtcgatggagtgaacaagatgcttcgattttggttcccggagacattatcagcattaaattgggagatattgttcctgctgatgctcgtcttctcgagggtgatcctttaaaaattgatcagtctgctctgactggtgaatcccttcctgtcactaagaacccctcagatgaagtgttttctggctcaacatgtaaacagggtgaaatagaagcagtcgtgattgccactggtgtccacacctttttcggtaaagctgcccatttggtggacagcaccaatcaagttgggcacttccagaaagttctcactgcaattggtaatttctgtatatgttcaatcgctattggaattatcattgagattatagtgatgtacccaattcagcatcgcaagtataggagtggaattgacaatctactggttctcttgattggaggaattcctattgccatgccaactgttttgtctgtcacgatggctattggttcacataggctctcacagcagggtgctattacaaagagaatgactgccatagaggaaatggctggcatggatgttctctgcagtgacaaaacgggtactctaaccctgaataagttgactgttgacacaaatttgactgaggtatttgcaaagggtgtggagaaagagttagttatgcttctcgcagcaagggcctctaggactgaaaatcaagatgccattgatgcttgcattgtagggatgcttgcagatccaaaggaggcaagagctggtatcagagaggttcatttccttccattcaatccagtcgacaaaaggaccgctctgacctacattgatgacaagggaaactggcatcgtgctagtaaaggtgctcctgagcagattataaccctttgcaactgcaaggaggatgttaggaaaaaggttcatgcagtgattgataagtttgctgaacggggacttcgatctttaggtgttgccagacaggaagtacctgaaaaaacaaaagagggtccagggggaccatggcagtttgttggtttgttgcctctgtttgatcctcctaggcatgacagtgcagaaaccatcagaagagcacttaaccttggtgtgaatgtcaagatgattactggggaccagcttgccattgccaaggaaacaggtcgtaggcttggaatgggaacaaacatgtacccctcttcttcattgctcggccaagacaaggatgcttccattgcagccctccctgtagatgagttgattgagaaggctgatggatttgctggagtttttccagaacacaaatatgaaattgtgaagaagctgcaagagaagaagcacatttgtggaatgacaggagatggtgtcaatgatgcccctgctttaaagaaggcagatattggaattgctgttgctgatgctactgatgctgctagaggtgcttcggacattgtcctcactgaaccaggtttgagtgtcattataagtgctgtgctgactagcagggctattttccaaaggatgaagaattacacaatctatgcagtttcaatcactattcgtattgtgtttggattcatgtttattgctttgatatggaaatttgactttgcaccattcatggttctaattattgccatcctaaatgacggtacaatcatgacaatatcaaaggatagggtgaagccatctccaatgccagacagctggaaactgaaagaaatttttgctactggcattgttctaggaggttacttggccctgatgacagtgatatttttttgggctatgagagacacaacctttttctcagacaagtttcacgtgaggtcactgagaggaaatgaggaagaaatgatggcagccttataccttcaagtcagtattataagccaggccctaatttttgtcacaaggtctcgcagctggtcctttattgaacgacctggccttctcttgcttggtgcttttgtaattgctcagctgatagcaactttcatagcagtatatgcagattggggttttgcacggataaaaggaatgggctggggttgggccggtgtaatctggctttatagtcttgtaacatatttcccacttgatatcctcaaatttgcaatccgctacattctgagtggaaaggcttgggataatcttttggagaacaagactgcctttactacaaagaaagactatggaaaagaagagagagaagcacaatgggcagctgcacagaggaccctgcacggtcttcaaccacctgaaaccagcaaccttttcactgagaagagtagttacagggagctttcagagatagcagagcaagccaagcgacgtgctgaggttgcaaggttaagggagctgcataccctgaaggggcacgtcgaatcagtggttaagctgaaaggactggacattgatacaatccagcaacattacacagtttaaagagctaagttagtcttccttagagagaactcaagtattatgttctcccaaagaaagccaacaatgatgacgaacaaagccataaactttaatttctagtttagagcgataattagtccttttggttcatgtcaattagttactagagcctgttaccactctgacaagttcagaggaagagagctgttctctttttaaaagccaaataatatcatttgcacagtttcctccttttgtacttttcccgctgaggtttatgtctttcctgttggttgttacatgaatctatagctctgatggtggaacc

SEQ ID NO: 978 - DNA, 3441 bp, Setaria italica
gcccactactaccaccacttccattcctctccctcccccttcccttctctccctccctctcgcgagaggagagaagcgagaacccagagctcgccgctgctggagctcggcctctagagccccgctctgtttccggcgctcgcttcccccggccgggctcggcgcggactgacaggacccgtccgccatgggtgggctcgaagagattaagaatgaagccgtcgatctggagaacattcccatcgaggaggtgttcgagcagctgaaatgcacccgcgaggggttgtcctccaacgagggcgctcagcgtctcgagatcttcggccccaacaagctcgaggagaagaaggagagcaagattctcaagttcctcgggttcatgtggaacccgctgtcgtgggtcatggagatggctgccatcatggccattgcgctggccaacggtggtggcaagcctccggactgggaggacttcgtcggtatcattgtgcttcttgttattaactccaccatctctttcatcgaggagaacaacgctggtaatgctgcagctgcgctcatggccaaccttgcccccaagaccaaggtgctgagagatggccgatggggcgagcaggaggctgcaatcttggttcctggtgacatcatcagcatcaagctcggtgacattgtccctgctgatgctcgtctccttgagggtgatcctcttaaggttgaccagtctgcacttactggagagtccctcccggtgaccaagggccctggcgatgaggtcttttccggctcaacatgcaagcaaggtgagattgaggctgtggtcattgccactggagtgcacaccttctttggcaaggctgctcatcttgtggacagcaccaaccaggttggacacttccagaaggtcctcactgctattgggaacttctgtatctgctccattgcggtcggtatcgttatcgagatcatcgtcatgttcccgatccagcaccgtgcataccgcagtggaattgagaacctgttggtcctcttgatcggtggtatcccaattgccatgccgactgtgctgtcagttaccatggccatcggctcccacaagctgtcacagcagggtgccatcactaagaggatgactgctattgaggagatggctggcatggacgtgctttgcagtgataagactggcacactcaccctcaacaagcttagtgttgacaagaacctcgtcgaagtgttttgcaaaggcgtcgacaaagatcacgtgttgctgttggctgcgagggcttcaaggactgagaaccaggatgccattgatgctgccatggttggaatgcttgctgatcctaaggaggctagggctggtatcagggaggtgcacttcttgcccttcaacccagtcgacaagaggactgcgctgacatacattgattctgacggcaactggcaccgtgtcagtaagggtgctcctgagcagattctcgacctgtgcaactgcagggaggatatgaggaggaaggtgcactctataatcgacaagtatgctgagcgtggtcttcgttcacttgctgttgccagacaggaagtacctgagaaatcaaaggacgcctctggtggaccatggcaatttgttggtttgttgcccctgtttgatccccctaggcacgacagtgctgagacgatccgcaaggctcttgttcttggtgttaacgtcaagatgatcactggtgatcagcttgctattggtaaggagactggaaggaggcttggcatgggtaccaacatgtatccttcctcctcattgctcggccaaaacaaggactccacacttgaatcacttcctgtagatgagctcattgagaaggctgatggttttgctggagtcttccctgaacacaagtatgagattgtgaagaggttgcaagagaagaagcacattgttggtatgactggtgatggtgtcaacgatgccccagctcttaagaaggccgacattggtattgctgtcgctgatgctactgatgctgcaaggagcgcctccgatattgtcctaactgagccaggtcttagcgtcattatcagcgctgtcctcaccagcagatgcatcttccaaaggatgaagaactacaccatttacgctgtctccatcaccatccgtattgtgcttgggtttatgctcattgctttgatctggaaatacgacttctcgcccttcatggtccttattattgccattctcaatgacggtactatcatgacaatctctaaggacagagttaagccgtctccccttcctgacagctggaagctgaaggaaatctttgctactggtgttgtactcggcagctaccttgctctgatgactgtcattttcttctgggccatgcacaagaccgacttcttcccggagaaatttggtgtgaagccaatcagggacagtgagggcaagatgatgtctgcgctgtacctccaagtcagtattgtgagccaggctctgatcttcgtcacccgttcccgtagctggtccttcgtggagcgccctggtctgctcctggtcaccgctttcctgcttgctcaacttgttgcgaccttccttgctgtgtacgccaactggggttttgccaggatcgagggtatcggctggggctgggctggtgttgtctggctgtacagcatcgtgttctacttcccgctcgacctgttcaagttcttcatccgcttcgtgctcagtggcagggcctgggacaacctccttgagaacaagacggccttcaccaccaagaaggattacggccgggaggagagggaggcgcaatgggccaccgcccagaggacactccacggtctccagccgccggaggccgcctccaacacgctgttcaacgacaagagcagctaccgcgagctgtccgagatcgcggagcaggccaagagacgagctgagatcgcgaggctgcgggagctgaacacgctcaagggccacgtggagtcggtggtgaagctcaaggggctggacatcgacaccatccagcagaactacacggtgtgagacaccgccgggatgtcgacgaaacctttgcccgcccgcccagtatttgcgaatggagtcatctgattactacaggaatttttccggtgatgaaccaaaacaaagaaaaaaaccgtgtggctgatctgaccgagcagccctagtgcgctataccaccaccagatactgctatatgatggtatggttgggtgccccgtcttgctagggagcttttttttttctctcctttcactcttacgcttttcactagtggagtgtgcgcgtggtgtaatcgtttttacttgcgttttcccctaactagcccggtgatctcgcggaatgcgagatggagaaataatgcaacaaaaattttctgccacatcccaatagtgctgttgtgttctctcctcacttttgag

SEQ ID NO: 979 - DNA, 3405 bp, Zea mays
actcgacgcccagcaagcgctactactccaccaccaccactactttgcttgcttgcccctttcccttcccttctcacacgagaagagaagcgagtcggcgttcgcgtggcatatgcccgtgtctgccgccgggcttggcttctagggtccgctccagcgccggccgaccgccatgggtgggctcgaggagatcaagaatgaagccgtcgatctggagaacatccccatcgaggaggtgttcgagcagctgaaatgcacccgcgaggggctgagctccagcgagggccagcagcgcctcgagatcttcggccccaacaggctcgaggagaagaaggaaagcaagatcctcaagttcctcgggttcatgtggaacccgctgtcgtgggtcatggagatggccgccgtcatggccatcgccctcgccaacggcggcggcaagccccccgactgggaggacttcgtcggcatcatcgtgctcctggtcatcaactccaccatctccttcatcgaggagaacaatgccggcaacgccgcggccgcgctcatggccaaccttgctcccaagaccaaggttctgagagatggccgatggggcgagcaagaggctgcgatcttggttcctggtgacatcgtcagcatcaagctcggtgacatcgtccctgccgacgcgcgtctcctcgagggcgatcctctcaaggttgaccagtccgcgcttaccggagagtcgctcccggttaccaagggtcccggggacgaggtgttctcggggtccacctgcaagcagggcgagatcgaggccgtggtgatcgccaccggagtgcacaccttcttcggcaaggccgctcacctcgtggacagcaccaaccaggtggggcacttccagcaggtcctgacggcgatcgggaacttctgcatctgctcgatcgcggtgggcatcgtcgtcgagatcatcgtcatgttcccgatccagcaccgcaggtaccgcagcgggatcgagaacctgctggtgctcctgatcggcggcatcccgatcgccatgcccaccgtgctctcggtcaccatggccatcggctcgcacaagctgtcgcagcagggcgccatcaccaagaggatgaccgccatcgaggagatggccgggatggacgtgctctgcagcgacaagaccggcacgctcaccctcaacaagctcagcgtcgacaagaacctcgtcgaggtgttctgcaagggcgtcgacaaggaccacgtgctgctgctggccgcgagggcgtcgaggaccgagaaccaggacgccatcgacgccgccatggttggcatgcttgctgaccctaaggaggccagggctggtatcagggagatccacttcttgcccttcaaccctgtcgacaagaggactgctctgacgtacattgatgccgatggccactggcaccgtgtcagcaagggtgcccctgaacagattcttgacctgtgccactgcaaggaggatctgaggcgtaaggtgcacggtatcatcgacaagtatgccgagcgtggtcttcgttcgcttgctgttgccagacaggaagtgcctgagagaaacaaggagtcccctggtggaccatggcagttcgttggtctgttgcctttgtttgatccgcccaggcatgacagtgctgagacgattcgcaaggctcttgttcttggtgtcaacgtcaagatgattacgggtgatcagcttgctatcggtaaggagaccggaaggaggctcgggatgggtaccaacatgtatccttcctcagcattgctcggccaaaacaaggatgctacgctcgaggcacttcctgtagacgagctcatcgagaaggccgacggttttgccggagtcttccctgaacacaagtacgagatcgtgaagagactgcaagagaagaagcacatcgttggtatgactggagacggtgtcaacgacgccccggctcttaagaaggccgacatcggtatcgctgtcgcggacgctaccgacgcggccaggagcgcttccgacattgtccttactgagccaggtctcagtgtcatcatcagcgctgtcctcaccagcagatgcatcttccagaggatgaagaactacaccatctatgcagtctccatcacaatccgtatagtgcttggatttatgctcattgcattgatctggcaatacgatttctcccccttcatggtccttatcatcgccattctcaacgacggcactatcatgaccatctctaaggacagagttaagccgtctccgttgccggacagctggaagctgaaggagatctttgccacgggcatcgtgcttggaagctacctcgctctgatgactgtcattttcttctgggctatgcacaagaccgacttcttctcggacaaattcggtgtgaggtcgatcagggacagtgagcatgagatgatgtccgcgctgtacctccaagtgagtatcgtgagccaggctctgatcttcgtcacccggtcccggagctggtccttcgtggagcgccctggcctgctcctggtcaccgcgttcctgctcgcccagcttgtcgcgaccttcctcgctgtctacgccaactggggcttcgccaggatcaagggtatcggctggggctgggccggtgtggtctggctctacagcatcgtgttctacttccctctggacctgatcaagttcttcatccgcttcgtgctcagcggcagggcatgggacaacctcctggagaacaagaccgccttcaccaccaagaaggactacgggcgggaggagagggaggcgcagtgggccaccgcgcagaggacgctgcacgggctccagccgccggaggccgccaccagcacgctgttccacgacaagaacagctaccgcgagctgtccgagatcgcggagcaggccaagaggcgcgccgagatcgcgaggctgcgggagctcaacaccctcaagggccacgtggagtcggtggtcaagctcaagggcctggacatcgacaccatccagcagaactacacggtgtgagatgtgtgctgtgatgtcgacgaaaacacctttgccatgccacccttgttgttcttgcgacgacggagtcatgtgattgttacagaaaaaaagaagaaaattttccggtgatgtgattggagacaatagaagcgtgtacgtacgtacgtgtggctgatcctgaccccgagcatgcagagcagccctaggtgaggtgaccattgccaccagatatatacccgtctttctagcttagctagggagcttcttcttcttttttttccctcttgttattgtcaagtgtgtgcgcgtgttgtaatggttttactcgcctaactagccggtggtctcgcgaggcgaagaaataatgcaaccgaaagcattattgctctcttctg

SEQ ID NO: 980 - DNA, 3354 bp, Populus trichocarpa
ctctctctctctgtttcttaatctctggcccttttcttgggatgtacaaagtctcattgaatggcctttaactccatttctcttcttcttccttattgagttcacatataatcttgttaccaaaaaaccaaaagagagattcttttttgttttgtttttgtattgctctgtgttcgtggtttctcggctagagttaaaagatggagaaggccactagtcttgaggagatcaagaatgagactgttgatctggaacggattccggttgaggaagtgtttgagcaattgaaatgcaccaaagaaggtttgtcctcagaggaaggagccagcaggattcaaatctttggccccaacaaattggaagagaaaaaggaaagcaagtttctcaagtttttggggttcatgtggaaccctctatcatgggttatggaagctgcagctatcatggctattgcattggcaaatggaagtgggaagcccccggattggcaagactttgtcggtattatttgcttgcttgtgatcaactctaccattagtttcattgaagaaaacaatgctggcaatgctgcggctgcactcatggctggccttgctcctaaaaccaaggtgcttagggatggaaagtggaccgaggaggatgctgcaattctggttccaggagacatcattagtgttaaattgggagatattattcctgccgatgcccgtcttcttgagggtgatcctttgaagattgatcaatctgccctcactggggagtcacttccagtaactaagcaccctggtgatgaagttttctcaggttccacttgcaaacagggagagattgaggctgttgttattgctactggtgtccacaccttctttggaaaggctgcgcatcttgtggacagcaccaaccaagttggtcacttccaaaaggttctcactgctattgggaacttctgtatttgttccatagcagttggaatggttatcgagctcgtagtcatgtacccaattcagcaccgcaggtacagagatggaattgacaatcttttggttctattgattggaggaatccccattgctatgcctacagtcttgtctgtgacgatggctattggatctcacaagttatcccaacaaggtgctatcactaagcgtatgactgccattgaagagatggcaggtatggacgtactctgcagtgacaaaactgggactttaaccctcaacaaactgagcgttgacaaaaacttgattgaggtttttgcgaagggtgtggacaaagatcatgtcgtcctgcttgccgccagggcctctagagttgaaaatcaagatgccattgatgctgccatggttggaatgcttgctgatccaaaggaggcaagagctggtataagagaggtgcacttccttccattcaatcctgtggacaaaaggactgctttgacttacattgatgctgatggaaactggcatcgagcaagtaaaggtgctcctgagcagatcctcgacctatgcaatgccagggaagatgttaagaagaagactcattcttgtatggataagtttgccgaacgagggctccgatcattggctgttgctagacagcaagtgccagagaaaagtaaggaaagtccaggtggtccatgggagtttgttggcttgttgaacctctttgatcctccaagacatgacagtgctgaaaccatccgtagagctctcaatctcggtgtgaacgtcaagatgattactggtgatcagcttgctattgcaaaggagacaggaagaaggcttggaatgggaacaaacatgtacccttccgcttctttacttggtcagcataaagatgcaagcattgcttctcttcctgtagaagagttgatcgagaaagcagatgggtttgctggcgtgtttccagagcacaaatatgaaatcgtgaagaagttgcaagagagcaagcacattgtcggaatgactggtgatggtgttaatgatgctcctgcattgaagaaggcagatattggaattgctgttgctgatgctacagatgctgcaagaggtgcatctgacattgttctaacggagcctggattgagtgtcattataagtgccgttctgaccagtagagctattttccaaaggatgaagaactacactatctatgcagtctctatcacaatccgtattgtgtttggtttcatgcttattgctctgatatggaagtacgacttctctcctttcatggttttgattattgctatcctaaatgacggtacaattatgacaatctcaaaggatagagtgaagccatcacccttgcctgatagctggaaactaaaagagatatttgccactggaatcgtactcggtggttacctggctctgatgaccgtgatattcttctgggcagtgcatgatactgatttcttttcgaataaatttggtgtcagatctttgaggcaccatgatgaagaaatgatgggggctttgtaccttcaagtcagtattgtgagccaagctctcattttcgtgactcgttctcgcagctggtcctttattgaacgacctggtctgctactactgtctgctttcatgcttgcacaactggtggcgactctgattgctgtttatgccaactgggggtttgcaaggatcaagggaattggatggggttgggctggtgtcatctggatttacagtatcgttttttatttcccacttgatattatgaagtttgctatccgctacatcctaagtggaaaggcttggctcaatttgctggataacaagactgcctttaccaccaagaaagattacggtaaagaagaaagagaagctcaatgggctcatgcacaaaggaccttgcatgggctccaaccacctgagacagctggtatcttcaatgaaaagagcagctacagggagttgtctgaaatcgcagagcaggctaagagacgagcagaggttgcaaggcttcgggagcttcacacactcaaagggcatgtggagtcagttgttaaactcaagggcttggatattgataccatccagcagcattataccgtgtaaaaatcctggaataaatttacctgagatggaaaggcctaaagttcaatgacaaaccctcaagaacatcagataaggcctcaacagctgaaaacttttctagataggggagaaaatggtattagtatgaatctcctgatctgtttacatttcttgtctttgtgtgctttaaactgctggaagagaaagggctgtgcttccctacttcttgctctatcaagggccatgtaatgccacctggttacacagtatttccaagttttttaatcttaattttcttctgcttaacttcttataa

SEQ ID NO: 981 - DNA, 3513 bp, Oryza sativa
ccaccgacacgtgggccccacgacccagccagccagagtcccagaagttaacgggggcacgcgaacagagaggggggccccgcgcggcgaggtggggaccagtgcgggtatgaagcggggaggcgctatatagagcgcacccatcctcctcccccttcctccctctcctctccactactaataccaccaccgccgcgccggaggtggaagacggacggggtagagttggggtctcgcggtgagccgattcctctctagtggtcgcgcctggtgtgttcgccgacgacgccggcgtcgcgtcagccatgggtgggctcgaggagatcaagaatgaggccgttgatctggagaacataccgatcgaggaggtgttcgagcagctgaaatgtacgcgcgaggggctctcctccgaggaggggaaccggcgtatcgagatgttcggccccaacaagctcgaggagaagaaggagagcaagatactcaagttcttggggttcatgtggaacccgctgtcgtgggtcatggagatggccgccatcatggccatcgcgctggccaacggcggcggcaagccaccggactgggaggacttcgtcggtatcattgtcctgctggttatcaactccaccatctccttcatcgaagagaacaacgccggcaacgccgctgctgctctcatggccaaccttgcacccaagaccaaggtgctgagggatggccgatggggcgagcaggaggcagcaatcttggttcccggtgacattatcagcatcaagctcggtgacatcgtccctgctgatgctcgtctccttgagggtgatccccttaagattgaccagtctgcacttactggggagtcccttccagtgaccaagaaccctggtgatgaggtcttctctggctcgacctgcaagcagggtgagattgaggccgtggtcattgccactggagtgcacaccttcttcggcaaggcggcgcatcttgttgacagcaccaaccaagttggtcacttccagacggtgctcactgcgatcgggaacttctgtatctgctcgattgcggttggtatcgtgatcgagatcatcgttatgttcccgatccagcaccgtgcctaccgcagtggcattgagaacctgttggtcctcttgatcggtggtatcccaattgccatgcctaccgtgctctcggtcaccatggccattggttcccacaagttgtcccagcagggtgctatcaccaagaggatgactgccatcgaggagatggctggcatggatgttctgtgcagtgacaagaccggaaccctcacccttaacaagttgagcgtcgacaagaacctcgttgaagtgttcactaaaggtgttgacaaggaccatgttttgttgctggctgcaagggcatctaggacagaaaaccaagatgccatcgatgctgccatggttggtatgcttgctgatcccaaggaggcaagagccggtatcagggaagtgcacttcttgcccttcaacccagttgacaagaggactgctctaacatacatcgatgccgatggtaactggcaccgtgccagcaagggtgctcctgagcagatcctgaccctgtgcaactgcaaggaggatgtaaagaggaaggtgcatgctgtgattgacaagtatgctgagcgtgggcttcgttctcttgctgttgcaagacaggaagtacctgagaagtcgaaggagtctgctggtggaccatggcaattcgttggtctgctgcccctgtttgatcccccgaggcacgacagtgctgaaactatccggaaggctctccatcttggtgttaatgttaagatgatcactggtgaccagcttgctattggtaaggagactggtaggaggcttggaatgggtacaaacatgtatccttcatccgcattgctcggacaaaacaaggacgcttcacttgaggcacttcccgtggatgagctcattgagaaggctgatggttttgccggagtcttccctgagcacaaatatgagatcgtgaagaggttgcaagagaagaagcacatcgtcggtatgaccggagatggtgtcaatgatgcccctgctcttaagaaggccgacattggtattgctgttgctgatgctacagatgctgcaagaagtgcttccgacattgtgctcactgagccaggtcttagtgtcattatcagcgctgtcctcactagcagatgcatcttccagaggatgaagaactataccatttatgcagtttccatcaccatccgtatagtgcttggatttttgcttattgctctgatctggaaatacgacttctcacccttcatggtccttatcattgccatcctgaatgacggtactatcatgacgatctcgaaggacagagttaagccttctcccttgccagacagctggaagctgaaggaaatcttcgctaccggtattgtgcttggaagctaccttgctctgatgaccgttattttcttctgggccatgcacaagacagactttttcacggacaaattcggtgtcagatcaatcaggaacagtgaacatgagatgatgtctgcactgtacctccaagtcagtattgtgagtcaggccctcatcttcgtcacccgttctcgcagctggtccttcatcgaacgccctggtcttctcttggtcactgcattcatgcttgcacaactggttgcgacattcctcgctgtctatgccaactggggctttgccaggatcaagggcattggctggggctgggctggcgttatctggctttacagcattgtgttctacttccctcttgacatcttcaagttcttcatccgctttgtgctgagtggaagggcctgggacaacctccttgagaacaagattgcattcaccaccaagaaggattacggtagggaggagagggaggcacaatgggccaccgcacaaagaacacttcacggccttcagccaccggaggtcgcctccaacacgctcttcaacgacaagagcagctaccgcgagctctctgagatcgctgagcaagccaagagacgagctgagatcgcgaggctgagagagctgaacactctcaagggccacgtcgaatcggtggtgaagctgaaggggctggacatcgacacgatccagcagaactacacagtgtgaggaaccccctcggcattcaacgagagatcgtcatcagcgctggagcgggaattgcaaacggcgctctggttaaaggaaattttcgatgaatgattggaagaacaaaaaacaaaaaaacatggctgatctgaacagccctagttgtaaagtgctaccaaatatatggtccggtttccctcttctagagaggttttacgttctagtggagtaccgtacgtacgtgttggagtacgacgacgtgttgtgatcgtttttggtctttttttactcttttccccctaactagcggtcttcttgcggaatgcaagatggagaaataatggatgaaaaattttctgccacgttaattctc

SEQ ID NO: 982 - DNA, 3427 bp, Glycine max
ggaataggagagagaaagttgaatttgttttagagagagaaagtgagtgtgaggggaggtgtatttacatagtcttcttaattgagtttgaggcctcattcatacacttgtgaaaagagggtatataaagagaggcatatatagaggtgcctcttttgtctttgctgaacaagaaaacatggctggggacaagggaaccatcactcttgaagagatcaagaacgagacagttgatctggaacgtattccaattgatgaagtgttcgagcaactgaaatgtaccagggaaggtttgtcctccacggaaggagaaaaccggcttcaaatatttggacccaacaaattagaagagaagaaggaaagcaagtttctcaagtttctcgggttcatgtggaatccactttcatgggtcatggaggctgcggctattatggccattgctcttgcaaacggcgaagggaagcctccggattggcaagatttcgttggtattgtttgcttgttgctgatcaactccactatcagtttcattgaagaaaacaatgctggaaatgctgctgctgctcttatggctggtcttgctcctaagacaaaggttcttagagatggtaaatggagtgagcaagaagctgcaattctagtccctggagacatcataagcatcaagctaggtgacattatccctgccgatgctcgtcttcttgaaggtgatccactgatggttgatcaagcagctctgactggagaatcccttcctgtgaccaagcatccagggcaagaagttttctctggctcaacttgcaaacaaggagaaatcgaagccgttgtgattgcaactggtgtgcacacattctttggaaaggcagcacatctggtggatagcacgaaccaagttggacatttccagaaggttcttacagcaattggaaacttctgtatttgctccatcgcgatcggtatgttagctgagattatagtgatgtacccgattcagcaccgcaagtacagggaaggaattgacaacctgttggtgctcttgattggaggaattcccattgctatgcctactgtgttgtctgtgacaatggccattggttctcacaagctttcccaacaaggtgccatcactaagagaatgactgctattgaagaaatggcaggcatggatgtcctttgcagtgacaagacaggaacactcaccctcaacaaactcactgttgacaagaacttggttgaggtctttgcaaagggtgtggacaaggatcatgtgatccttcttgctgccagggctgccaggactgaaaaccaggatgccattgatgctgccattgtgggaatgcttgctgatcctaaagaggcaagggctgggataagagaggtgcactttctaccattcaatcctgttgacaagaggactgctttgacttacattgatgctaatggaaattggcacagggcaagcaaaggtgctcctgagcagatcatgtccctgtgtaacctcagggatgatgctaagaagaaggttcatgctattattgacaagtttgctgaaagagggcttcgttcacttgctgttgctagacaggaagttcctgagaaaacaaaagaaagtgctggtgctccatggcagtttgttggtctgttgtcactgtttgatccccctaggcatgatagtgctgaaaccattcgccgagctcttaaccttggtgtaaatgttaagatgattacaggtgatcaacttgccatagctaaggaaacaggaaggagacttggaatgggaacaaatatgtatccatctgcttcattgcttggtcaagacaaagatgcaagtattgccgcacttcccgtagaagagctgattgagaaggcagatggatttgctggagtttttccagagcacaaatatgaaattgtaaagaagttgcaagagaggaagcacatttgtggaatgactggagatggtgtcaatgatgctcctgcgttgaagaaggctgatattggaattgctgttgctgatgctactgatgcggcaagaagtgcttctgacattgtcttgacagaacctggattgagcgttattattagtgcagtcttaactagcagagctattttccaaagaatgaagaactacaccatctatgcagtatctatcacaatccgtatagtgtttggcttcatgtttattgcactgatctggaaatttgacttctcacccttcatggttttgattattgccattctgaatgatggaacaatcatgacaatttcaaaggacagggttaagccatctcccttgcctgatagctggaaactgaatgaaatctttgctactggggttgtgcttggaggttacttggcactgatgactgttatattcttctgggcaatcaaagagacgacattcttccccgacaaatttggagttagaccaattcatgacaatccagatgaaatgactgctgctttgtatctacaagtcagtatagttagccaggctttgatatttgtcacccgttcgcgcagctggtccttcatcgaacgccctggattgctgttagtgactgctttcgttattgctcagctgattgctacagtaatagcagtgtatgccaactggggctttgcaaggatccaaggaattggttggggttgggcaggagtgatttggctctacagtattgtcttctatttcccacttgacatcatgaagttcgccatccgctacattttgagtggcaaagcatggaacaatctcctagaaaacaagactgccttcaccaccaagaaagactatggtaaagaggagagggaagctcaatgggctcttgctcagaggaccctgcatggacttcaaccaccagaaacttctaatatcttcaatgaaaagagcagttatagagaactcactgagattgctgagcaggccaagaggagagctgaagttgcaaggcttcgtgagcttcacacacttaagggacatgttgagtctgtggtgaagctgaagggtctggacattgacacaatccagcagcattacaccgtgtaatagttacacaagaacgatgtagataacaaaagggccaaaattcaatgattaaaatgaacggagagacaaggagaaggcctaactctatttatgcttactcggttgggagaggaagcctgtgatatatctctctctcagtctgtttatctttctttcatgtcttttcagatgttttggtctaaatttttgctttgatgcttggggaaaagtggtgttagcttcaatccttgattttcatatgcttttgggtccttccctcaaccagggtggtgttaattgatgtatgtcactttgaagtggcaagtgactagacaatgagcttattgggaattttgtggttggagaataagagtttatggaaaagctttaacggcatcttgc

SEQ ID NO: 983 - DNA, 3677 bp, Glycine max
ttgtgaaagagggtatataaagagaggcattgggagtgagctcatacccttcttctatctctcctttcattcattcactttcttttcttgggatacagaattctcattcaatggccctttaatcttttttatccctttctgccttgaaaacttattgttttttgcggtgcctcttttgtctttgctgaacaagaaaacatggctggggacaagggaaccatcactcttgaagagatcaagaacgagactgttgatctggaacgtattccaattgaggaagtgttcgagcagctgaaatgtaccagggaaggtttgtcctccacggaaggagaaaaccggcttcaaatatttggacctaacaaattagaagagaagaaggaaagcaagtttctcaagtttcttgggttcatgtggaatccgctttcatgggtcatggaggctgcagctataatggccattgctcttgcaaacggcgaagggaagcctccggattggcaagattttgtaggtattgtttgcttgttgctgatcaactccactatcagtttcattgaagaaaacaatgctggaaatgctgctgctgctcttatggccggtcttgctcctaagacgaaggttcttagagatggtaaatggagtgagcaggaagctgcaattctagtccctggagacatcataagcatcaagctaggtgacattattcctgctgatgctcggcttcttgagggtgatccactgatggttgatcaagcagctctgactggagaatcacttcctgtgaccaagcacccagggcaagaagttttctctggctcaacttgcaaacaaggagaaatcgaagccgttgtgattgcgactggtgtgcacacattctttggaaaggcagcacacttggttgatagcaccaaccaagttggacatttccagaaggttcttacagcaattgggaacttctgtatttgctccattgcggttggtatgctagctgagattatagtgatgtacccgattcagcaccgcaagtacagggatggaattgacaacctgttggtgctcttgattggagggattcccattgctatgcctaccgtgttgtctgtgacaatggccattggttctcacaagctctcacagcagggcgccatcacaaagagaatgactgccattgaagaaatggcaggcatggatgtcctttgcagtgacaagacaggaacactcaccctcaacaaactcactgttgacaagaacttggttgaggtctttgcaaagggtgtggacaaggatcatgtgatccttcttgctgccagggctgccaggactgaaaaccaagatgccattgatgccgccattgtgggaatgcttgctgatcctaaagaggcaagggctgggataagagaggtgcattttctaccattcaatcctgttgacaagagaactgctttgacttacattgatgctaatggaaattggcacagggcaagcaaaggtgctcctgagcagatcatggccctgtgcaacctcagggatgatgctaagaagaaggttcatgctattattgacaagtttgccgaaagagggcttcgttcacttgctgttgctagacaggaagttcctgagaaaacaaaagaaagtgctggtgctccatggcagtttgttggtttgttgtcactgtttgatcccccaaggcatgacagtgctgaaaccattcgccgagctcttaaccttggtgtaaatgttaagatgattacaggtgatcaacttgccatagctaaggaaacaggaaggagacttggaatgggaacaaatatgtatccatctgctacattgcttggtcaagacaaagatgcaagtattgccgcacttcccgttgaagagctgattgagaaggctgatggatttgctggagtttttccagagcacaagtatgaaattgtaaagaagttgcaagagaggaagcacatttgtggaatgactggagatggtgtcaacgacgctcctgcattgaagaaggctgatattggaattgctgttgctgatgctactgatgctgccagaagtgcttctgacattgtcttgacagaacctggattgagtgttattataagtgctgtcttaactagcagagctattttccaaagaatgaagaactacacgatctatgcagtatctatcacaatccgtatagtgtttggcttcatgtttattgcactgatctggaaatttgacttctcacccttcatggttttgattattgccattctgaatgatggaacaatcatgacaatttcaaaggacagggtcaagccatctccattgcctgatagctggaaactgaacgaaatatttgctactggggttgtgcttggaggttacttggcactgatgactgttattttcttctgggcaatgaaagagacaacgttcttccccgacaaatttggagttagaccaattcatgacaatccagatgaaatgactgctgctttgtatctacaagtcagtatagtcagccaggctttgatatttgtcacccgttcgcgcagctggtccttcattgaacgccccggactgctattaatgactgctttcattattgctcagctgattgctacagtaatagcagtgtatgccaactggggttttgcaaggatccaaggaattggttggggttgggcaggagtgatttggctctacagtattgtcttctatttcccacttgacctcatgaagttcgccatccgctacatcttgagtggcaaggcttggaacaatctccttgaaaacaagactgccttcaccaccaagaaagactatggtaaagaggagagggaagctcaatgggctcttgctcagaggaccctgcatggacttcaaccaccagaaacttctaacatcttcaatgaaaagagcagttatagagaactgactgagattgctgagcaggccaagagaagagctgaagttgcaaggcttcgcgagcttcacacacttaagggacatgttgagtctgtggtgaagctgaagggtctggacattgacacaatccagcagcattacactgtgtaataaacaacacaagaacgttgtagatagtaaagggccaaaattcaatgttttaaatgatcggagagacaaggagaaggcctaactctatttatgcttactaggtagagagagaaagcctgtgatatatatatagctctctctctctctcagtctgtttatctttttttcatgtattttcagatgttttggtctaaatttttgctttgatgcttggggaaaagtggtgttagcttcaatccttgattttcatatggttttgggttcttcctcaacagggtggttaatgtttaatgcatgtcactttaaagtggaaatgactagacactgagcttatagggaattttgtggtgggagaataagagtttatggaaagttttaacggcatcatgcaaaatttgaaactttgacttggtctcaacatagaatttatgttatttggctgtcttttggaaacactatcaccagaaaagatcgaattctagggaatgaaataagggactgcaaaattttaaatgctttgaagatgtttccaccattgtcctagtcctatacatgggtgactagtggtttttttttttttttttccataaatacatattttctcttctcct

SEQ ID NO: 984 - DNA, 3476 bp, Solanum tuberosum
cacaaagagggctaaaaaacctctgtcattcccttccgccgttctcaattttgggatctctctgttcgatgagtctcatcattcattacacttactgaaatcaaccctttttctgcttagtttttgacttgttgctgctggttttcgtttgattttaccgagatggcgaaagctataagcctcgaagagatcaaaaatgagactgttgatctggagaaaatccccattgaagaagtgtttgaacaactaaaatgttcgcgagagggtctgacttcggacgaaggagccaacaggcttcaaatctttggaccgaacaagttggaagagaaaaaagaaagcaaaatactgaagttcctggggtttatgtggaatcctttgtcatgggttatggaggctgcagctatcatggccattgcactggctaatggaaatggaaagcccccagattggcaagattttgttggtattgtttgcttgctggtgatcaattcaactatcagttttattgaagaaaacaatgctggaaatgctgccgcagctcttatggctgggcttgctcccaaaaccaaggttcttagagatgggcgatggagtgaacaggaagctgctattctggtgcctggtgatattataagtgtcaagttgggagacattgttcctgctgatgctcgtcttcttgaaggtgatcctttaaagattgatcaatctgcccttacaggagaatctcttcccgtgacaaagaatcctggagatgaagttttctctggatcaacctgcaaacaaggtgaacttgaagctgtagtcattgccactggagttcacactttctttggcaaggcagcacaccttgttgacagcacaaacaatgttggtcatttccagaaagtgctaacagccataggaaacttctgtatctgctccattgcagttggtatgctgattgagattattgtcatgtatccaatccagcacaggaagtacagggatggaattgacaatctcttggtgctccttattggtggtattcccattgctatgcctactgtgttgtcagtcactatggctattggatcccacaggctctcccaacagggtgccatcaccaagagaatgactgctattgaagaaatggctggaatggatgtgctgtgcagtgacaagacaggtaccttgactcttaacaagttgagtgtcgacaaaaccttggtcgaggtgttcgttaagggagtagataaagaatatgtgctcctccttgccgcaagggcctctagagttgaaaatcaggatgcaattgatgcttgcatggttggcatgcttgccgatccaaaagaggcacgagctggtatcagggaggtgcatttcttgcccttcaatccagtggacaagagaactgctttaacatatattgacaacaatggcaactggcaccgtgccagcaagggagctcctgagcagattttggacctatgtaactgtaaggaagatgtcaggagaaaggttcattcaatgattgataaatacgctgagcgtgggttgaggtcactggctgtagctagacaggaagtgccagagaaatcaaaggagagcgctggaggtccatggcaatttgttggattgctacccctctttgatccccccagacatgatagtgctgagaccatccgtagagctctcaaccttggtgtaaatgttaagatgatcactggggatcaattggctattgccaaggagactggccgtaggcttggaatgggaacaaacatgtacccgtcagcatctttacttggtcaagacaaggattcatctattgcttcacttcctgtagaagagttgattgagaaggcagatggatttgctggagtatttcctgagcacaaatatgagattgtgaagaagttgcaggagagaaagcacattgtgggaatgactggtgatggtgtgaacgatgctcctgctttgaagaaggcagatatcggaatcgctgttgcagatgctactgatgcagcacgaggtgcttctgatatcgtgctcactgagccaggtctaagtgttatcatcagtgctgtgttgaccagtagagctattttccagaggatgaagaattacacaatatatgcagtttccatcacaatccgtattgtgtttggtttcatgcttattgctctgatatggaagtacgacttctctgcatttatggttttgatcattgccatcctaaatgatggaaccattatgacaatctcaaaggatagagtgaaaccatctccaatgcctgatagctggaagttgaatgaaatctttgcaactggtgttgttcttggaggttaccaagcattgatgactgttcttttcttctgggcgatgcatgacactaatttcttctcggacaaatttggtgtgaaggatattaggggaagtgatgaagaaatgatgtctgctttgtacctgcaagtgagtattatcagccaggctttgattttcgtgacccgttcacgaagctggtccttcgttgaacgcccaggagctctgttaatgattgctttcttgatcgcccaactggttgccactttaattgctgtctatgccgactggacttttgcaagagtcaaaggatgtggatggggatgggctggtgtcatctggattttcagcattgttacctacttcccacttgacataatgaaatttgccatccgctacatcttaagtggaaaggcttggaataacttgcttgacaacaagactgctttcaccaccaagaaagactatggaaaagaagagagggaagctcaatgggcacttgctcagagaactttacatggacttcaaccaccagaagcctcaaacctgttcaacgaaaagaacagctaccgagaactgtctgaaattgctgaacaagcaaagaggagagcagagatggccaggcttcgtgagctgcacacactcaagggtcatgttgaatcagtggtgaagctgaaaggtctggatatcgaaacgatccagcagcattatacagtttaagaaacataatcatcatatctacacaagaaagggcatctcatgttaattactgtattaattagagaagaagagacacacaagcttttggcctttaaccaccacatataaaaaaaattgtcttaagataaagggggaaaactttcgtcttctgtgatctttcccccctcctctcatctattttctttaacttcgttatgtattttgaagcaccacccattgaaagggattgtgtccatgttttttccaaatttttaatggtgaagtgacatttccttgtaacaacagtttttccttcttcttcatttgatgttgacgataacgtctctctctctgcttttttgcacattcactgttgtatgaaaataatatttactccaacactggattttcttttactctcttctaacttgtttgttgttaaaagattgagaaatacaactgtttggaaatttcat

SEQ ID NO: 985 - DNA, 3040 bp, Pseudotsuga menziesii
ttttgggctttatgtggaatcctttatcatgggtcatggaagctgcagcactgatggccattgccttggcaaatggaggaaacaaacctcctgattggcaggattttgttggtattatattgcttcttgtgctcaactcgactataagtttcatcgaggagaacaatgcaggcaatgcagctgcatcactaatggcgcagttggctccaaaagcaaaggttctaaggaatggacgctggagtgaagaagatgctgcttgtctggtccctggtgacataattagcattaaacttggagatattgttcctgcagatgctcgacttcttgaaggagacgctttaaaaatcgaccagtctgcacttacaggggaatcattgccagtaaccaagaattctggtgatggggtctattcaggctccacatgcaaacaaggtgaactagaagctgtagtcatagccacaggagtgcatacgttttttgggaaagctgcccatctggtagattccacaaataatgttggtcatttccaaaaggttttgacagcaattggaaatttttgtatttgttccattgctgttggcatggtagtggaaattatagtccaatatccaatccaaggccgaccatatcggcctggaattgacaatctgttggtgctacttattggtgggattccaatagcaatgcctactgttctttcagtgactatggccattggttcacatcgcctttctcaacagggtgctattactaaaaggatgactgctattgaggaaatggccgggatggatgttttgtgtagcgataagacaggaaccttaacattgaacaagcttactgtagacaaaaatctggttgaggtgtttgcaaaagatgttgacaaggatgcacttatcttgatggctgcaagagcatccagaatagagaaccaagatgcgattgatgcagctattgttggggttcttgctgatcctaaagaggcacgggcaggtattcaagaggttcactttcttccttttaaccccactgacaaacgaacagcactcacctatattgatagggaaggcagaatgcatagagttagcaaaggtgcacctgagcagatcctttccctagcacacaacaagtcagaaattgaacgcagagtccatacagtgatagacaaatttgctgaacgtggacttcgttctcttgcagttgcctatcaggaggtaccgaatggcaagaaggaaagcccaggaggaccctggcaattcattggtctgatgcccctttttgatccaccacgccatgacagtgcagaaacaataagaagggctctcaacctgggtgtgagtgttaaaatgatcacaggagatcagctagctatagggaaggagacaggccgtcgattggggatgggtacaaacatgtatccatcatcatcattattaggtcaggccaaaggtgaatctgctgaagctctagaaattgatgacttgattgagaaggctgatggttttgctggtgtcttccctgagcataaatatgagatagttaaacgattgcaagcaagaaaacacatttgtggcatgactggtgatggtgtcaatgatgcaccggcacttaagaaggcggatattggaattgctgttgcagatgcaacagatgcagccaggagtgcatctgacatcgttctcacagaacctggcttgagcgttatcattagtgctgtgttaacaagccgtgcaatctttcaacggatgaagaattacactatttatgctgtctctataacaatacgtattgtgtttggtttcatgctcttggcattgatatggaagtttgactttccaccattcatggtactgataattgctatattaaatgatggaaccataatgacaatctcaaaagacagggtgaaaccatcacctctgccagatagctggaacctttcagaaatttttgccacagggattattcttggcagttacctagcagtgatgaccgtcatctttttctgggccaccttcaagacagatttctttccaagaacattcggtgtttctagtctccatattcccagtgaagaaaatactcaaaaactaaattctgcagtgtatcttcaagtcagcactataagtcaggctctcatatttgtgactcgatctcgaggctggtcttttgtagagcgtcctgggcttttgctcgtaactgcatttgctattgctcaactggctgcaactttaattgctgtctatttaaacatgggatttgcttctataaggggcattggttggggctgggctggggtgatatggctttacaacctaatcttttactttccacttgaccttctcaagtttgcgattcggtatgccatcagtggaagggcatgggatttacttattcagcaaagggttgcctttactacccagaaagattttggaaaagaggccagagagataaaatgggctcatgctcagaggactttgcatggattacagccaccagacacgaaactgtttggtgacagaagcagcttcagggaactcaatcaaatggctgaagaggcaaaaagacgagctgaaattgcaaggctgagagagctaaatactttgaaggggcatgtggagtctgtcgtaaggctcaagggtttggatattaatacaattcaacagtcttacactgtttgagggatgcctcttctattactttcatgttgaagaatcaaatagcatctgaactccaagtgaaaccagcttttattgctacaaattaacacaacttggatcatggtggtgataaaatagtagaaatgtttgttggttttattgggaatggtgtattttactatatattttaaaggattgttcatggaaatgaggcatctcaccataaataactctacaagttggcatgttggccagtacaatggagtggggccaaacccctttgccatattggcatgtgcaagtaggattatttatatgtatgggtaaaattgaaaggattgcccaattttgaaatattatgtacattttctactggtctaata

SEQ ID NO: 986 - DNA, 3484 bp, Solanum phureja
acctcacaatttctctcatcacaaagagggctaaaaaacctctgttcattcccttccgccgttctcaattttgggatctctctgttcgatgagtctcatcattcattacacttgctgaaatcaaccttttttctgtttagtttttgacttgttgctgctggttttcgtttgattttaccgagatggcgaaagctataagcctcgaagagataaaaaatgagactgttgatctggagaaaatccccattgaagaagtgtttgaacaactaaaatgttcgcgagagggtctgacttcggacgaaggagccaacaggcttcaaatctttggaccgaacaagttggaagagaaaaaagaaagcaaaatactgaagttcctggggtttatgtggaatcctttgtcatgggttatggaggctgcggctatcatggccattgcactggctaatggaaatggaaagcccccagattggcaagattttgttggtattgtttgcttgctggtgatcaattcaactatcagttttattgaagaaaacaatgctggaaatgctgccgcagctcttatggctgggcttgctcccaaaaccaaggttcttagagatgggcgatggagtgaacaggaagctgctattctggtgcctggtgatattataagtgtcaagttgggagacattgttcctgctgatgctcgtcttcttgaaggtgatcctttaaagattgatcaatctgcccttacaggagaatctcttcccgtgacaaagaatcctggagacgaagttttctctggatcaacctgcaaacaaggtgaacttgaagctgtagtcattgccactggagttcacactttctttggcaaggcagcacaccttgttgacagcacaaacaatgttggtcatttccagaaagtgctaacagccataggaaacttctgtatctgctccattgcagttggtatgctgattgagattattgtcatgtatccaatccagcacaggaagtacagggatggaattgacaatctcttggtgctccttattggtggtattcccattgctatgcctactgtgttgtcagtcactatggctattggatcccacaggctctcccaacagggtgccatcaccaagagaatgactgctattgaagaaatggctggaatggatgtgctgtgcagtgacaagacaggtaccttgactcttaacaagttgagtgtcgacaaaaccttggtcgaggtgttcgttaagggagtagataaagaatatgtgctcctccttgccgcaagggcctctagagttgaaaatcaggatgcaattgatgcttgcatggttggcatgcttgccgatccaaaagaggcacgagctggtatcagggaggtgcatttcttgcccttcaatccagtggacaagagaactgctttaacatatattgacaacaatggcaactggcaccgtgccagcaagggagctcctgagcagattttggacctatgtaactgtaaggaagatgtcaggagaaaggttcattcaatgattgataaatacgctgagcgtgggttgaggtcactggctgtagctagacaggaagtgccagagaaatcaaaggagagcgctggaggtccatggcaatttgttggattgctacccctctttgatccccccagacatgatagtgctgagaccatccgtagagctctcaaccttggtgtaaatgttaagatgatcactggggatcaattggctattgccaaggagactggccgtaggcttggaatgggaacaaacatgtacccgtcagcatctttacttggtcaagacaaggattcatctattgcttcacttcctgtagaagagttgattgagaaggcagatggatttgctggagtatttcctgagcacaaatatgagattgtaaagaagttgcaggagagaaagcacattgtgggaatgactggtgatggtgtgaacgatgctcctgctttgaagaaggcagatattggaatcgctgttgcagatgctactgatgcagcacgaggtgcttctgatatcgtgctcactgagccaggtctaagtgttatcatcagtgctgtgttgaccagtagagctattttccagaggatgaagaattacacaatatatgcagtttccatcacaatccgtattgtgtttggtttcatgcttattgctctgatatggaagtacgacttctctgcatttatggttttgatcattgccatcctaaatgatggaaccattatgacaatctcaaaggatagagtgaaaccatctccaatgcctgatagctggaagttgaatgaaatctttgcaactggtgttgttcttggaggataccaagcattgatgactgttcttttcttctgggcgatgcatgacactaaattcttctcggacaaatttggtgtgaaggatattagggaaagtgatgaagaaatgatgtctgctttgtacctgcaagtgagtattatcagccaggctttgattttcgtgacccgttcacgaagctggtccttcgttgaacgcccaggagctctgttaatgattgctttcttgatcgcccaactggttgccactttaattgctgtctatgccgactggacttttgcaagagtcaaaggatgtggatggggatgggctggtgtcatctggattttcagcattgttacctacttcccacttgacataatgaaatttgccatccgctacatcttaagtggaaaggcttggaataacttgcttgacaacaagactgctttcaccaccaagaaagactatggaaaagaagagagggaagctcaatgggcacttgctcagagaactttacatggacttcaaccaccagaagcctcaaacctgttcaacgaaaagaacagctaccgagaactgtctgaaattgctgaacaagcaaagaggagagcagagatggctaggcttcgtgagctgcacacactcaagggtcatgttgaatcagtggtgaagctgaaaggtctggatatcgaaacgatccagcagcattatacagtttaagaaacataatcatcatatctacacaagaaagggcatgttaattactgtattaattagagaagaagagacacacaagcttttggcctttaaccacataaaaaaactgtcttaagataaagggggaaaactttcgtcttctgtgatctttccccccctcctctcatctattttctttaacttcgttatgtattttgaagcaccacccattgaaagggattgtgtccatgttttttccaaatttttaatggtgaagtgacatttccttgtaacaacagtttttccttcttcttcatttgatgttgacgataatgtctcactctgcttttttgcacattcactgttgtatgaaaataatatttactccaacactggattttcttttactctcttttaacttgtttgttattaaaagattgagaaatacaactgtttggaaatttcat

SEQ ID NO: 987 - DNA, 3366 bp, Glycine max
caagaacctaatattcattcatgacccttctttgattcattttctctcttcacaattcccccgtctttcacctcttctgctcatggcagctgacaaggcagcaatcagcctcgaggaaatcaagaatgagaccgttgatctggaacgcattcctattgaggaagtgtttcagcaattgaaatgtaccagagaaggattgtcctcggacgaaggagccaatcggcttcaaatatttgggccaaacaagctagaggagaaaaaggaaagtaaatttctcaagtttcttgggttcatgtggaatcctctgtcatgggtcatggaagctgcagctgttatggcaattgctcttgcaaatggggatgggaagcccccagattggcaagattttgtgggtattgtttgcttgttggtgatcaactccaccatcagtttcattgaagaaaataatgctggtaatgcagctgctgctcttatggctggtcttgctcccaagacaaaggtccttagagatggtaaatggactgaggaagaagcggctattctagttcctggagacatcataagcatcaaactaggagatatcattcctgctgatgctcgtcttcttgagggtgatcctttgaaggttgatcaatccgctttgacaggagagtcacttcctgtaaccaggggtcctggagaagaagttttctctggctcaacttgtaaacaaggtgaaattgaagctgttgtcattgcaactggtgtccacacatttttcggcaaagcagctcacctggtggatagtaccaaccaagttggacatttccagaaagtgcttacagcaattggaaacttctgtatttgttccattgcagttggtatgttggctgagatcatagtcatgtacccaattcagcaccgtaagtacagagatggaattgacaaccttttggtcctcttgattggaggaattcccattgctatgcccactgtgttgtctgtgacaatggccattggttctcataggctctctcagcagggtgctataaccaagagaatgactgccattgaagaaatggctggtatggatgtcctttgcagcgacaagacaggtacactcacacttaacaagctgagtgttgacaagaatttgattgaggtcttcgcaaagggtgtggaaaaggatcatgtgatccttcttgctgcaagggcttccaggactgaaaaccaggatgcaatagatgctgccattgttggaatgcttgccgatccaaaagaggcaagggctggggtaagagaggtgcacttcttaccatttaatcctgtcgacaagagaactgctttgacttacattgatgctgatggaaattggcaccgggcaagcaaaggtgctcccgagcagatcatgaccttgtgtaacctcagggatgatgcaaagaggaaggtccatgctattattgataagtttgcagagagagggcttcgttcacttgctgttgctagacaggaagttcctgagaaaacaaaagaaagcgctggtgctccatggcagtttgttggtttgttgtcactgttcgacccccctagacatgacagtgctgaaactattcctagagctctccatcttggtgtaaatgtcaagatgatactgggaagtatccaggagaccggccgaagactggggatgggaactaatatgtacccatctgcttctttgcttggtcaagacaaagatgcaagtattgctgcacttccagtagaagagctgattgagaaggcagatggttttgctggagtatttccagaacacaaatatgaaattgtaaagaagttgcaagagaggaagcacatctgtggaatgactggagatggtgttaatgacgctccggctttgaagaaggctgatattggaatcgctgttgctgatgcaactgatgctgccagaagtgcttctgatattgtcttgacagaacctggtttgagtgttattattagtgcagtcttaactagcagggctattttccagagaatgaaaaactacacgatatatgcagtatctattactatccgtatagtgtttggcttcatgttcatagcactgatatggaaatttgacttctctccttttatggttttgatcattgctattctgaatgatggaacaatcatgacaatttcaaaggacagggtgaagccatctcccttgcctgatagctggaaactgcaagaaatatttgctactgggattgtacttggaagttacttggcgctgatgactgtcatattcttctgggcaatgaaagaaaccgatttcttccctgacaaatttggagttagacacttgagtcatgatgagatgatgtctgctttgtatttacaagtcagtatagtcagccaggctttgatatttgtaacccgttctcgaagctggtcctttattgaacgccctggaatgctgttagtttgcgctttcgttattgctcagctgattgctacaatcatagcagtatatgctgactggggctttgcaaaggtgaaaggaattggttggggttgggcaggagtcatctggctctacagtattgtcttctatattccacttgatgtcatgaagtttgccacccgttatgtattgagtggcaaggcttgggtaaacatgctagaaaacaagactgccttcaccaccaagaaagactacggtaaggaggagagggaagctcaatgggctcatgctcagagaaccctgcatggacttcaaccaccagaaacttctggcattttcaatgagaagaacagttatagagaactctctgagattgctgagcaggccaagagaagagctgaagttgcaaggcttcgtgagcttcacacactgaagggacatgttgagtctgtggtgaagctgaagggtttggacattgatacaatccagcagcactacacggtgtgagaaaacactggaaaattgtagatagcaagagtgaccaaattcagttgcatgcctgaaacaacaagagactaggatgtctttgcctttcatatataggctttaccaatttgttctccatgtattttcggtgctggctaaatggatgtctatgccttccgtgatagagccaaagtagtgttagtttctttagtccttacttttcccctgccttcatatggctttgggtgcttcctcatttctgtgttctcagttgtgtatgccacatttaggtggcagtgatcatattgtgtcaatattgggattttttaaggtaggagaataagagtttctcgaagttcttttccagcatcatgcaaaatttaaaaccatgaatttggtttcagtctaatttataggagacactcatcataaaaaacagtaaagaattaataata

SEQ ID NO: 988 - DNA, 3742 bp, Theobroma cacao
tcatttacgtagtaattaaaatcctcgaaaaaaggaaaaagaaaaagaaaaaaaaaaagagagagacgtctctctctttgctctatcttcatttttcttcatagactttttatagtggcgcttcttagtattggtgttagcctttttctttgctttgaattatgagtctttaagtatcgacctttcctttctatatttgcttgcaaatactctaacagctcgttccttctctggctggcgctgctactccaactaaccttggaagatgggcggcgataagggcatcagcctcgacgagatcaaaaacgagtccgtcgatctggaacggattcctattgaggaagtcttcgagcagctgaaatgtacaagagcaggcttgactaccgaggaaggcgccaatcgccttcaagtttttggaccaaacaaactagaagagaaaaaggagagcaaatttctcaagttcttgggttttatgtggaaccctttgtcatgggtcatggaagctgctgctataatggctattgccttggcaaatggtgacgggaggcctccagactggcaggacttcgttggtatcattgtcttgttgtttatcaactccaccatcagttttattgaagaaaataatgctggtaacgctgcagctgccctcatggctaatcttgctccaaaaaccaaggttcttagagatggtcgatggagtgaacaagaagcagcaattctggtgccaggggacattataactattaaattgggagacatagttcctgctgatgctcgtcttcttgagggtgatcctttgaagattgatcaatctgcacttacaggggagtctcttcccgtcacaaagaatccatcagatgaagtgttttctggctcaacgtgtaaacagggtgaaatagaagcagtggttattgcaactggtgtgcacaccttctttgggaaagctgcccacctagtggacagcaccaatcaagttgggcatttccagaaagtacttactgccatcggaaatttctgcatttgctcaattgctgttggaatagtcgttgagataatagtcatgtacccaatacagcaccgcaagtacaggcagggaattgacaatttactagttctcttgattggaggaatccctattgctatgccaactgtgttatctgtcaccatggctattggttctcataggctttcccaacaaggggctatcacaaaaagaatgacagccattgaggaaatggcaggcatggatgttctctgcagtgataagactgggaccctgaccctgaacaaacttactgttgatagaaacctaattgaagtgtttgcaaagggagtcgaaaaagagcaagttatcctttatgcagcaagggcttcaaggactgaaaatcaggatgctattgatactgcaattgtaggaatgcttgcagatccgaaggaggcacgagctggtatcagagagattcacttcctaccattcaaccctgtagacaagagaactgctctgacctacattgattctgatggaaactggcatcgtgctagcaaaggtgcaccagagcagatcataactctttgcaattgcaaagaagatgtcaagaaaaaggttcatgcagttattgataaatttgctgaacgtggacttcgatctttaggcgttgcaagacaggaagtacctgagaaaacaaaagaggcccctggggcaccgtggcagtttattggtttgttgccactgtttgatcctccaagacacgatagtgctgaaaccatcaggagagctctaaaccttggagtgaatgttaagatgattactggggatcagcttgctattgccaaagaaactggcaggaggcttggaatgggaacaaacatgtacccttcttcttccttgctgggccaagacaaggacgcttccattgctgccctccctattgatgaattgattgagaaggccgatggatttgcaggagtatttccagagcacaaatatgaaattgttaagaggctacaggagaggaaacatatttgtggcatgacaggagatggtgtcaacgatgcccctgctttaaagaaggcagacattggaattgctgtggctgatgctacagatgccgctcgaagtgcctcagacattgtacttactgaacctgggctaagtgtcattataagtgcagtgctgaccagcagggctattttccaaaggatgaagaactacacgatctatgcagtttcgatcaccattcgtattgtgtttggcttcatgtttattgccttgatatggaagtttgacttcgcacccttcatggttctaattattgccatcctcaatgatggtacaatcatgacaatttccaaggacagagtaaagccatctccccagccagacagctggaaactcaaggagattttctgtactggcattgtgcttggaggttacttggcactaatgaccgtgttattcttctgggcaatgcatgacactgatttcttcacagacaagtttagtgttagatcactgaggggtagtgataaagagatgatggcagctttataccttcaagttagtattgtgagccaggccctcatttttgtcacacggtcccgcagctggtcctacgttgaacgtcccggacttctactagtcagtgcttttgtaattgctcagctggtggccactttgatagctgtctatgcaaattggggtttcgcaaggattaaaggtatgggatggggatgggctggtgtaatctggctttacagtgtggtgacttttgtcccacttgatcttatcaaatttgcaacccgatacgttcttagcggaaaggcttgggataaccttttggagaacaagactgccttcaccacaaagaaagattatggaaaagaagaaagagaagcacaatgggcagctgcacagagaactctgcacggtcttcaaccacctgaaacttcaaacattttcagtgaaaggagcagttacagggaactttcagagattgcagagcaggccaagcgcagggctgaggttgcaaggctgagggagctgaatacactgaaggggcatgtggaatcagttgttaagctgaagggacttgatatcgatacgattcagcagcattacacggtttaaaagagggatttggaacaaaagaagcatagaaccaggatgatctttcccttcagaaaagcaaaaacaaaaatattataatgacgaacaaggcctaaagtgaagaagaaacctacgacgaccaatgttaaggagatacttactagttatagaaataggcgcattttccttttactaaatgttgcgattttagtgtcattgtcactcttctcttttttcgaatgaacaaggtaaggaactgttgtcctttttttaacagcaaaaaaaagaaaaaaaaaataacaccgcctttcatggctgctgcttacccactttcttttctttttctggtcttcccgttactacatcggaagtacttggttctttccatgcggatgaaccttttgagtttcaaaatgcaaatgtcacgtgattattaccttttgcgcaatgtcggtggttagtgcgatttaatacgtggccaatacaagggatttaaaataagaaatgaaaccatgaaccctaaacaacacaacgaaattcttgttctttgtttttaggcattttatctttcatcttcattttttcccttaacatctccaaaggtcgagcacaatataaaatagacatgttgag

SEQ ID NO: 989 - DNA, 4232 bp, Theobroma cacao
agtagaatgggtataacgtaataaatgtcaggtggaggcttgattcgatgaatgatatgatgatgatgtactgctgaaccgacaactcagcggtaagaagagagagaaaggtgaagcgaaatagtgaaagcaaaggcagggggccaggggtcccacagaaggaaggagaggggcaggggctaaacggcgggggtgagggccttatttaatgttctatgaggcacttcgtctccagtttgagggctatataaaaagcgaggcttgcagccttcctgcaggggaaaaaaaaccagggaaaagcctaaaaaatttctctctggtagcatccccaacccatttcgttttcttttttcttctgttcattgggatactgaaaatctcattcaaaggtctttactttctcacccccttccctctcttcattgatttcatagttgtaggagattttgctcttgtttttattttgcttttgagtaccctctgttgctggtggctgtacaaaaacaaaacatgggtggtgacaaaggtatcagccttgaagagatcaagaacgagactgttgatctggaaaaaatcccgatcgaggaagtgtttgagcagctgaaatgtaccagagaaggattgtctgcggacgagggagccaacaggctgcagatttttggacccaacaagctagaagagaaaaaggaaagcaaaattctcaagtttttggggttcatgtggaatcccctctcatgggtcatggaatctgctgccatcatggccattgctttggctaacggtgatgggaagcccccagattggcaagactttgttggtattgtttgtttgttggtcattaactctaccatcagtttcattgaagaaaacaatgctggcaatgctgctgctgctcttatggctggtcttgctccaaaaaccaaggtgcttagagatgggaagtggactgagcaagaagcagcaattctggttccaggagacatcattagcattaaattgggagatattatccctgctgatgcccgtcttcttgaaggtgatccgttgaaggttgatcaatctgccctaacaggagaatcacttcctgtaaccaagaatcccggggatgaaatcttctctggttcaacttgtaaacaaggtgaaattgaagctgttgttattgctactggtgttcataccttcttcgggaaggctgcacatcttgtggatagcactaaccaagtaggacacttccaaaaggtgctcacagcaattggaaacttctgtatttgttccattgccatcggtatgttggttgagatcatagtcatgtatccaattcagcaccgcaagtacagggatggaatcgacaatctcttggttctcttgattggtggtattcccattgctatgcccactgttttgtctgtgaccatggccattggatctcacaggctgtctcagcagggtgccatcaccaagcgtatgactgccattgaagaaatggctggtatggatgtcctttgtagtgataagaccggaacattgacactcaacaagctgagtgttgataaaaacttgattgaggtgtttgtaaaagatgtggataaagagcatgttgttttacttgctgctcgagcctctagaactgaaaatcaagatgccattgatgctgccattgttggaatgcttgctgaccctaaggaggcaagagctggtattagagaggtgcacttcttcccttttaatcctgtggacaagagaactgctttgacttacattgattccaatggcaactggcaccgagcaagcaagggtgctcctgaacagatcttggccctttgcaatgcaagagaagatcttaagaaaaaggttcattctatcattgataagtttgctgaacgtgggcttcggtcattagctgttggcagacagcaagtgccagagaaaacaaaagaaagtgctggtaccccatggcaatttgtaggtttgttgcctctgtttgatcctcctagacatgacagtgcagaaactattcgaagagctcttaatcttggtgtgaatgtcaagatgatcactggtgatcaacttgcaattgcaaaggagacaggccgcagacttggaatgggaacaaacatgtatccatctgcttctttgctaggtcaagacaaggatgcaagcatagctgcccttcctgtggaagagttgattgagagggcagatgggtttgctggcgtgtttccagagcacaaatatgaaattgtgaggaagttgcaggagaggaagcacatttgtggaatgactggagatggtgttaatgatgctcctgctttaaagaaggcagatattggtattgctgtggctgatgctacagatgccgcacgaagtgcttcagacattgttctcacagaacctggactgagtgttattatcagtgcagtgttaactagcagagctattttccagaggatgaagaactatactatctatgcagtctccatcactatccgtattgtttttgggtttttgtttattgctctcatctggaagtttgacttttctccattcatggttttgatcattgccattctaaatgatggaactattatgacaatctcaaaggacagagtgaagccatctcccttgcctgatagctggaaattgaaagagattttcgccaccggaattatgcttggaggctatttggcattgatgactgttatattcttctggcttatgcatgatactaaattctttccggacaaatttggtgttaggtctttaaggggcagtgatcatgaaatgatggctgctctatatttacaagtgagcattgtgagccaggctttgatttttgtgactagatcacgtagctggtcctatgttgagcgtcctggactgctattggttactgccttctttattgcacagctggttgctactttgattgctgtatatgctaactggggatttgcaaagattaaaggaattggttggggatgggctggtgttatatggctttacagtattgttttctatattccactggatctaatgaagtttgccattcgttacatcttaagtggaaaagcttggctcaacttactggaaaacaagactgcgttcaccaccaagaaagattatggcaaggaagagagggaagctcaatgggctcttgctcaaaggacattacatggtcttcaaccacctgaagctactaatctcttcaatgacaagagcagctatagagagttgtctgagattgctgagcaggccaagagacgagcagaggttgcaaggctacgagagcttcacaccctcaagggtcatgttgagtcagtggtgaagctgaaggggctggacattgatacaatccagcagcattatactgtttagaagtcagaacaatgcttgaaagcaaaggttgcaccgttgcagtttgatgacatatgcaggtcatgaagagaaagagaactaattagtttaaactttctagatagcgacatatctgtggtataattttcctgccctgtttactttgcctttcttatgtaattcaaggccggaagaaaaggttgtgttttggtcatttcttgctccaataaggagccatgtaatgttccatgttacacagtttcaagcttcaaatctacttttcccttgggttttctatactctttgaattcttgtgtacactgtcttcattttccattgtgctagttgacttccttgaccggcaactatcaaatgccaaagagaatattgagtttgtttatttaatgagattaggtttatggaattgatatatgactagagttttatcaccttgcaatatccttgatagtttacaaagatcactcaacggtacagtgtattccaagaaaagatctgtgaaaatgataggaatgacaatattcatggtgtttagatttgccattaaaggaaaaaactctttctgtccagtacttgttggtttcttgttaacattgatgggtgctagcactttttttgcttggtggtaattgttgtcaggttggcgtttctgttgaattttgagatcatcttgaaaatagttttttggtgccaatgtgaagttccttttgaatccatcaacaggcaagtgacctgccttgctcagttagaagtcacacactgacagaagtgaagcttttgagactgaatgaccttgaccatgctgctcaccttattcattttgttcaagtagtttaggttaatcaaatatctgaaaatgt

SEQ ID NO: 990 - DNA, 5384 bp, Gossypium hirsutum
ctaaagaagaagggcaacgtctccgtttattgttataccgtcattatcttcttagagtttttcattagtgttgcttcttagcattggtattagccattattggcttgtgtatgtggctctaaatagctgctactactactagttctttaatctagctaatacagatggctggcaacaagggcatcagcctcgacgagatcaagaatgagtccgtcgatctggaacggattccaattgaggaagtgttcgagcaactgaaatgtacaagagcaggcttgagtacccaggaaggcaacaatcgccttcaagtttttggaccaaacaaactagaagagaaaaaggagagcaaatttctcaagttcttgggttttatgtggaaccctttgtcatgggtcatggaagctgctgccatcatggctattgccttggcaaatggtggtggaaggcctccggactggcaggacttcgttggtatcattgtcttgttggtcatcaactccaccatcagttttattgaagaaaacaatgctggtaatgcagctgctgctctcatggctaatcttgctcccaaaactaaggttcttagagatggtcgatggagtgagcaagaagcagcaatcctggttcctggggacattatcactattaaactgggagacatagttccggctgatgctcgccttctcgagggtgatcctttgaagatcgatcaatctgctctcactggagagtctcttcctgtcaccaagaatccttcggatgaagtgttttcgggatcaacctgtaaacagggtgaaatagaagcagttgttattgcaactggtgttcacactttctttggtaaagctgctcacctggtcgacagcaccaatcaagtgggacacttccagcaagtgcttactgccattggtaacttttgcatttgttcaattgccgttggaatagtcattgagttaatagtcatgtacccgatacagcgccgcaagtatagggatggaattgacaatttactggtactcttgatcggtggaatcccgatcgctatgccaactgtgttgtctgtcactatggctattggttcccataggctttctcagcaaggggctatcacaaagagaatgaccgccattgaggaaatggcaggcatggatgttctctgcagtgataagactgggaccctaactctaaacaaacttacagttgatagaaacttaattgaagtgtttgcaaagggagtcgaaaaagagcaagtgctgctttatgcagcaagggcttcaaggactgaaaaccaggatgctattgatgctgcaattgtaggaatgcttgctgatccaaaggaggcacgagccggtatccgagaggtccatttcctaccattcaaccctgttgacaaaagaactgctctaacctacatcgattccgatggaaagtggcatcgtgctagcaaaggtgcaccagagcagatcataactctttgcaactgcaaagcagatgtgaggaacaaagttcatgcagttattgataaatttgccgaacgcgggcttcggtctttagctgttgcaagacaggaagtacctgagaaaacaaaagagagtcctggagcaccatggcagcttgttggtttgttgccactgtttgatcctcctaggcatgatagtgctgaaactatcacaagagccctaaaccttggagtgaatgttaaaatgattactggggatcagcttgccattgccaaagaaactggcaggaggcttggaatgggaaccaacatgtacccttcatcttccttgcttggtcaagacaaggattcttccgtttctgccctccctgttgatgaattgattgagaaggctgatggatttgctggagttttccctgaacacaagtatgaaattgttaaaaggctacaagagaggaaacatatttgtggtatgacaggagatggtgtcaacgatgctcctgctttaaagaaggcagacattggtatcgctgtcgctgatgccaccgatgccgctcgaagtgcttcagatatcgtacttactgaacctgggcttagtgtcattatcagtgcagtgctgaccagtagggctattttccaaaggatgaagaactacacgatctatgctgtttcaatcaccatccgtattgtgtttgggttcttgttcatagccttaatatggaagtttgatttcgcaccgttcatggttttaatcattgccattctaaatgatggtacaatcatgacaatttccaaggacagagtaaagccatctccacaaccagatagctggaaactcaaagagattttctctactggcattgtgcttggaggttacttagcactaatgaccgtgttattcttctgggcaatgaaagacactgatttcttctctgacaagtttcatgttaggtcactgagggatcgtcctgaacaaatgatggcagctttataccttcaagttagtatagtaagtcaggccctcatttttgtcacacggtctcgcagctggtcctttgtcgaacgtcctggacttctattagtcactgcatttattgctgctcagctggtggccactttgatagctgtctacgctaattggcgttttgcaaagatacaaggcatgggttggggatgggctgctgtaatctggctttacagtttggtcacttatattccacttgatcttataaaatttgcaatccgctatgtccttagtggaaaggcttgggacaaccttttggagaacaagactgccttcactacaaagaaagattatggaaaagaggaaagagaagcacaatgggcagctgctcagagaactctgcatggccttcaaccacctgaaacctcaaacgtcttcaatgaaaggagcagttacagggaactttcagagattgcagagcaggccaagcgcagggctgaggttgcaaggctgagggagctgaatacactgaagggtcatgttgaatcagttgtgaagctgaagggacttgatatcgatactattcagcagcattacacagtttaaagctaaagccaccgcagatgatgacgatatgcattttaatttgagacaaacaaaggatcattcatgattttcctcccttgctacaaagaaaatgttgatgatgaacaaggcctatggagtatggcctatgttatgagaaaaaaataatgaaacaggaatttgtattatggtaagtattctaagatggtataggttatgtatgttatgttctcatttggaacacgggataagctagaatagggaagggaaagaagtgttttacctttttataactgcaaaataacaacaggctttcaattcatagcctggccttgtttgcagaaccttgcttcttaatcttcttcatttcccccaatccttttttttctttctttccttttttgatggttctacatctacaattagttctatgtatatacatatacgcatatatgtattcagcaaagccaaaccaatttgctactctcttattgtagctaatactagcctatcaatatcattcaccatttaagttaatctctaaacatcgaaagcaaagaaaaaaaaaggcaatttcttgtcttgggcactaaaaggaaagattactgtcctatatgtgaatttgcaaacaactattgttgattgatagatataaaactactgttgttgattgttgattggatatatatgaagttgtcccttgtttagaattcctgtatgaagttgcacttgcagaaccatcatgctaggttggtcgcgttgcagaatgcttgcaattttctgcattctgatgcctaaacatctggaatgggaaaagggcagttgccaagagacaaaccggtcacgctcggtaagtaacatttgtcagtttgtactttgtccctttgatttctattcaacttcaactcaattatggggcgaaaatttgcaaatagggcaccaattcttcacctgcagccaattctgtatgcatgtcacgtgatacctatgctcacactgcaacatccctacttcatctccatttacatattcttcctgacatatactacatttggtatcatcctttcaccgtcacagtcgacactagcaccttcatagatgcttttcataaggcattttgacaatgcttcttctgatagcacagtgctcacattacccatcctttcttctagatctagtaattcctcatatgacatattgtctatatccagcctcatgtcactatgctggtcgtaaaagtttaggccatcaagaaacaaggtggtctctagagcaagtaattgctcatgtgtcaaatcttcatcttgttcgatcctctctaatgctaataacacctccccaatgccatcaatattgtagtgccagaagctatcacggttaacaccgacttctgaaggactagatgccatgatatcgagtaaactctcgcttatattatctggttgagtgtaagaactagcacgagttgagacaatttctgtggaaacaggatcattcaaattgataggtatatcagatcgaggcacttggggcatgatcacgtggtactcgtttgaacttaacctatttccatttgcttggttagagaagctccctctaccataactactgtttgacctcctggtccgaactgaagaagcaacaccactatccctccagtttctggtttgccttgaatcagcagaactaaaaacaccgtgactaggaccgttgttctgtccctccaaagatgacccactcaacttctttcccctactggaaccggaggaacttccctctccatcagagtttctcgttttaactgtgtcttcccttcttctagtgcttgaatctgatgatgaacaaccagatgggacaacatcggatatggacttacatcttaaatttctcaaaccatacctgcttgcgttagcacgagttgccaagcccacagaagcccttggagatctctgaatcatgtttctcctcgatcttgtgctcgatgccacaccagaacttcgcacttcccaggaatccacatttccagattcagactgtggaacgagctccgactcttgcaattcatcccgaacactactagtttccagctgagatgatagcttcttctgaggatttatagaggattttctattgttactaacagtagggtttactctagatgaacttccaattattccctttccatttcttgagcagccattaggagtatcattcatggagtttagcctggcaccacatccatttcgattgcaaaaccgagcatttcgttctctgttattaacatgatcgttcaaaaccagacctgatccctttccaagcccaccagcacctcttttaccaccatactcatccatctaggtaaacaaatacccttta

SEQ ID NO: 991 - DNA, 3434 bp, Cucumis sativus
tcctctctttctctctcacacacacacacacccaaactctctcttttctccccttccatttttcctttctccccaaacacctcttattttcccgggaatcttattattttctcgggaaaatcacccctccttctttcaatgcttcttcttcttccttaaaacaccaaacccacaaaaacaaagcccccctctgcttccatctccttaagctacaactaaaacaatcaggatgggaaacgacaccgctttaactctcgaagagatcaagaatgaaactgttgatttggagaaaatccccattgaggaagtgtttgagcagctgaaatgtacaagagaaggtttaagttctcaagaaggggagaatcgtctccaaatctttggtcccaacaagctagaagagaaaaaggaaagcaagatcttgaagtttcttgggtttatgtggaatcctctgtcttgggtcatggaagctgcagctatcatggccattgccttggccaacggtggcaatcggggaccggattggcaggatttcgttggtatcgtctgtcttttggttatcaactccaccattagtttcattgaagagaacaatgctggtaatgcagctgctgctcttatggctggtcttgcacctaaaaccaaggttctgagggatggaaaatggtgtgaacaagatgcatcaattctagtaccaggagatgtgatcagtgtgaaattgggagatatcatcccagccgatgctcgtcttctcgaaggtgatcctttaaaggttgatcaatctgccttgaccggagaatcacttcccgtgaccaagaatccaggggatgaagttttctctggttccacttgcaaacaaggagaaatcgaggctattgttattgctactggtgtgcacactttctttggtaaagcagctcatcttgttgatagtactaaccaagttggacacttccaaaaggttctcactgccattggaaacttttgtatttgctccattgccattggtatgttgattgagatcctcgttatgtacccgatccaacaccgtgcctatagagatggtatcgacaaccttttggttctcttgattggaggcattccaattgctatgcctactgtcttgtcagtgactatggctattggttctcacaagctgtctcaacaaggtgctattaccaagagaatgactgctatcgaagaaatggccggtatggacgtactttgcagtgacaaaactggaactctgactcttaacaagttgagtgttgacaagaacttgattgaggtgtttgtcaagggtgttgacaaagaacatgtcattctgcttgctgcaagggcatctaggactgaaaaccaggatgcaattgatgctgccatggttggaatgctcgctgacccgaaagaggcaagagctggaattagagaaattcacttcttcccatttaatcctgtggataagagaactgctttgacttacattgattctaatggaaactggcaccgtgctagcaaaggtgctcctgaacagatcttgactctttgcaactgcaaagaggacttcaagaggaaggtgttttctgtaattgacaagtttgccgagcgtggacttcgatctttggctgtttctagacaggaagtgcctgaaaagaataaggaaagtcccggtgctccatggcaatttgttggtttgttgccccttttcgatcctcctagacacgatagtgctgaaaccatccgcagggctctcaacttgggtgtgaatgtcaagatgattactggtgatcaacttgctattgcaaaggaaaccggtcgaagacttggaatgggaacgaacatgtatccatcttcttccttactcggtcagcacaaggacgaaagcattgctggccttccagttgaggagttgattgagaaggctgatggatttgctggagtgtttccagaacacaaatacgaaatcgtaaagaagttgcaagaaagaaagcacatttgtggaatgactggagatggtgtgaatgatgctcctgctttgaagaaggcagacattggtattgctgttgctgatgctactgatgctgcacgaggtgcatctgacattgttcttaccgagcctggtttgagcgttatcattagtgccgtgttgaccagcagagcaattttccaaaggatgaagaactatactatttatgcagtctccatcactattcgtattgtgtttggtttcatgttgattgctctcatttggaaatttgatttctctcccttcatggttttgattattgctatcttgaacgatggtacaattatgaccatctcaaaggacagggtgaagccatctccattacctgacagttggaaactaaaggagattttcgcaaccggaatagtacttggtgggtacttggctttgatgacggttatattcttttggttaatggacggaacaaatttcttttcggataaattcggtgttagatccatccgtcataatgaagatgagatgatggctgctttgtacctgcaagtcagtattgtcagccaggctttgatttttgtaacaaggtcgcgtggctggtcgtacgctgagcgacctggacttctattggtcggcgctttcttcattgcacagctggttgcaaccttgatcgcagtatatgcgaactggggatttgcaaagatcaagggaatcggatggggatgggccggtgtcatctggctttacagcattgttttctatattccactcgatgtcatgaagttcgctattcgatacatattgagcggaaaggcatggctcaacttgttagaaaacaagaccgctttcaccaccaagaaagactatggaaaagaggaaagagaagcacaatgggcacttgctcaaagaacattacatggacttcaaccacccgagtcgacaaacatcttctccgaaaagagcagctacagagaactctctgagatcgccgagcaagctaagagacgtgccgagattgcaaggctccgagagctgaacacactcaagggacacgtcgagtctgtggtgaagttgaagggactcgacatcgacaccattcagcagcactacacagtgtgagaaaagtattattgcttcctcatataaaatgagagattttaatgaaattgtgatttcactttgctgtgccaaggaaagaaaaagagaaaatgtttgagaaagagacaacaaaacaaacatttaaaaaaaaaaagaaggaagttgctaatttgccaaacctttccaacatacagagagattgtgtggtgcctttgccttgtaatttttcctagttttttgcttactatttttcttccatatgtatttgcaatgttagtaagataaaagaattgtgtttggctttgacaaactcctagtcctcaccatcatcataatgcaatttttaagcattcaaatcaaa

SEQ ID NO: 992 - DNA, 3543 bp, Mimulus guttatus
cgtttgtggagacgtataaaaagaggggttgtaggcagaagagactccgacgaactgaggagagctaattttccccttttttctctctcattactcttttttcattttccttggggagtgaaaaacctcgttcaatgaatcactgattttctctctctctctgtatatatatatatatctcctctccctctctctctctcctctgttttctctctctaagaagaaaaaaaaatactgatctagcagggggggagattccctgtgagtgtgctgtaatcaaacatgggaggcgacaaggctatcagtcttgaggagatcaaaaatgagaccgttgatctggaaaaggttccaattgaggaggtcttcgagcagttgaaatgtacccgagagggtttgagtgccgacgaaggggaaagcaggcttcagattttcggcccgaacaagttggaagagaaaaaggaaagcaaatttctcaagtttctcggttttatgtggaacccgctctcatgggttatggaagctgctgctatcatggcaattgcgctggcaaacggaggtggcaagcctccggattggcaagactttgttggaattgtttgcttgctcgttatcaactcgactatcagtttcattgaagagaacaatgcaggaaacgctgctgctgcccttatggctggtcttgctccaaaaaccaaggttctcagagatggccgatggagcgagcaagaagccgcaatccttgttcctggagacattatcagcattaagttgggagatatcgttcctgctgatgcccgtcttctagaaggtgatcctttaaagattgaccaatctgccctcaccggagaatcccttcccgtgaccaagaactcgtatgacgaagtcttctccggttcaacctgcaagcaaggtgagcttgaggctgtcgtaattgccacaggtgtccacaccttcttcggtaaggcagcacatctagtggacagcactaaccaggtgggacacttccagaaagttctaacagcaattggaaacttctgtatctgctctattgccgttggtatgctggcagagatcatagtcatgtacccgatccagcacagggagtacagaaagggaattgacaatctcttggttcttttgatcggaggtattcccattgctatgcccactgtcttgtctgtcacgatggctatcgggtcccacaggctgtcacagcagggagccatcaccaagagaatgacagctattgaggaaatggctggcatggatgtattgtgcagtgacaagaccgggactttgactctcaacaaattgactgtcgacaaatccttgattgaggtcttcacaaagggtgtggaacctgatcatgtgctgcttcttgctgcaagggcttccagagttgaaaatcaagatgctattgatgctgctattgtcggtacactcgctgacccgaaggaggcaagagctggtgtcaaggagattcatttcttccccttcaaccctgtggataagaggactgctttgacttacattgactctgatgggaactggcacagagctagcaagggagccccggaacagattttgactctctgcaattgccgtgaagacttaaagaagaaggtgcacagtgttattgataaatttgctgagcgtgggctccgttcgttggctgttgctagacaggaagtgccggagaaatcgaaggaatcccctggttctccatggcaattcattggactcttgtcccttttcgatcctccaagacacgacagtgctgaaaccattcgaagggctctaaatcttggtgtgaatgtcaagatgattactggtgatcaacttgccattgctaaggagactggccgtaggcttgggatgggagtaaacatgtacccgtcttcttctttacttggtaaccacaaggacgagtctatagctggacttcctgttgaagaactcattgagaaggcagacggttttgccggggtctttccagagcacaaatacgaaattgtgaagaaattgcaggagaggaagcatatagttggaatgacaggagatggtgtgaatgatgcccctgctctaaagaaggccgatatcggtattgctgtggctgatgctactgatgctgcaagaggtgcttcggacattgtgctcacggaacctgggcttagtgtcatcattagtgcagtgttgaccagccgagctattttccagaggatgaagaactataccatatatgcagtctccatcaccatccgtattgtgtttggtttcatgttcattgctttgatctggaagtttgatttctccccattcatggttttgatcatcgccatcttgaatgacggcacaatcatgaccatctccaaggatagagtgaagccttcaccattgcccgacagctggaaattgaatgagatatttgccaccggcgtcgttcttggaggctatcttgcattgatgactgttatattcttctggatgatgcacgaaaccgactttttccccgacaaatttggagtcagatctattagagataatgaagacgaaatgatggctgctctatacttgcaagtgagtattgttagccaggcccttatcttcgtcaccaggtcaagaagttggtcattcgttgaacgccccggacttctgctactagtcgctttctgcattgcacaattgattgcaaccctgattgctgtatatgcaaactggggtttcgcaagaatccaagggtgtggttggggatgggctggtgttatctggctttacagcattgtcttctacgtacccctcgacctaatgaagttcgccatccgttacatcttaagtggaaaggcgtggcaaaatctctatgacaacaagattgcattctcgaccaagcaagattatggaaaaggagagagagaagctcaatgggctcatgctcagaggactttgcacgggcttcaaaatccggaagctggtaatctattcaacgagaagagcagctacagagaactgtctgaaattgcagagcaggccaagaggagagctgagattgccaggcttcgtgagctgcacacactaaagggtcacgtcgaatcggtggtgaagctaaagggtctcgacattgacaccatccagcagcactacaccgtctgaagaaaccaaaagaaatcccgaacgaacgaatgaatctttttttttaacgatgaattgtggctcttgaaacagagagcgaaaataatcttagggaaacagaaaagagtgcttttttctagaatttaaaactgcttttttaaaaagaggaagaacggcagtattatgcctcgtatttccctgacatgtttctatttttgtttttctaaaaagtgtccccagaaaggggttagtttctctgtttgatattcgtctctgttgagtacaattgcatctctactttgtaacagtttttcaccatctctcttattttttgcctggttgtttttattctcttgtttgttttactgcacaaatgttctctttgtgaaatatatcgattgtgttcctcttcggttt

SEQ ID NO: 993 - DNA, 3556 bp, Orobanche aegyptiaca
gttaaaactataggcgggtatcatttgtgtataaaaagaggggtatagccaccaggcatctttactcgctcatccaaatagaggaccgttttctttgtggggggagtccttttcgagattttcccttcattggggaataaaaactctttaaatctctcctctttatatatattcttcatcttcttcccctctatctctctcataaagattcttacaaatacgctgatttaacgggggagagagtccctgcgtgagtgcttgaacatgggtggtgacaaggctattagtcttgaagaaatcaagaatgagaccgttgatttggaaaaagtcccgattgaggaagtcttcgagcagttgaaatgcacccgcgagggtttgagttccgacgaaggcggcaacaggcttcagattttcggtcccaacaagttggaagagaagaaggaaagcaagttactcaagttcctcgggtttatgtggaacccactctcatgggtcatggaggctgctgccttgatggcaatcgtgctggcaaatggaggcgggcaaggcccggattggcaagactttgtcggtattgtctgcttgctcgttatcaactcgactatcagtttcattgaggaaaacaatgcaggaaatgctgctgccgcccttatggctggtcttgctcctaaaacaaaggtcctaagagatggccgatggagcgagcaggaagccgccattctcgtcccgggtgacatcatcagcatcaagctcggagacatcatccctgccgacgcccgtctcctcgaaggcgaccccttaaaggtcgaccaatccgccctcaccggagaatccctacccgtcaccaaaaactgctacgacgaggtcttctccggctcgacctgcaagcagggcgagatcgaggctgtcgtcatcgccaccggggtccacaccttctttgggaaggcggcccacctcgttgacagcaccaaccaggtaggacacttccagaaggttcttaccgcaattggaaacttctgcatctgctcgatcgccgtcggcatgctggccgagatcatcgtcatgtaccctatccagcacaggcagtacaggaaggggatcgataatctgcttgtgctcttgataggagggattccaatcgcgatgccgacggtgttgtcggtcacgatggctattgggtcccacaggctgtcacagcagggagcgatcacgaagaggatgacggccatcgaggagatggccgggatggatgtgctgtgcagtgacaagacggggacactgacgctgaataaactgacggtcgataagagcttgatcgaggtctttgccaagggtgtggaccccgatcacgtcttgctgcttgcagcgagggcttccagggtagagaatcaagatgctattgatggcgccattgttggtacacttgctgatcccaaggaggccagagctggtatcagagaggttcatttcttgcccttcaaccctgtggagaagaggactgctttgacttacatcgatgctaatggaaactggcatagagctagcaagggagctcccgagcagattttggatctctgcaagtgcaaggaagacttgaagaaaaaggttcacagtgtcattgataaatttgccgagcgcgggctccggtcattggctgttgcttatcaggaagtgccagagaaatcaaaggactcccctggcgcaccatggacatttatcggactcttatcccttttcgatcctccaagacatgatagtgcagaaactatccgcagggctttaaatcttggtgtaaatgtcaaaatgattactggtgatcaacttgcaattgggaaggagaccgggcgcaggcttggtatgggagtaaacatgtacccatctgcttctttacttggtaaccacaaggacgagtcaattgccggccttcctgttgaagagttgattgaaaaggcagacggttttgctggggtctttcctgagcacaaatacgaaatcgtgaagaagttgcaagaaaggaagcatatagttggcatgactggagatggtgtcaatgatgcccctgctctcaagaaagccgatattggaattgctgttgctgatgctacggatgctgcacgaggtgcttctgatattgtgttgactgaacctgggctcagtgtcattattagcgctgtcttgacgagtagagctatctttcagaggatgaagaattatacgatatatgcggtttccatcaccatccgtattgtgtttggtttcatgttcattgctttgatttggaagtttgatttctcccccttcatggttttgattattgccattttgaatgacggcacaattatgaccatctcgaaagatagagtgaagccatctccattgcctgatagctggaagttgaacgagatttttgccactggagttgctcttggaggctatcttgcattaatgacggttgtgtttttctggctcatgcataaaaccgactttttccatgacaaatttggagtaaaaaatattagaaacaacgaggacgaaatgatggctgctctatatttgcaagttagtattgttagccaagccctaatattcgtcacaaggtcacgaagctggtcttttctcgaacgccctggactcttgctagtgactgctttcttcatcgcccaactggttgcgactcttatagccgtatatgcagactggggctttgcaagaattaaaggatgtggttggggatgggcaggtgttatatggatttacagtattgtcttctatttccccctcgacttaatgaagtttgccattcgttacatcttaagtggaaaggcatggcaaaacttgtacgacaacaagactgcgttcacgaccaagaaagattacggaaaagaggagagagaagctcaatgggctcatgctcagaggactttgcacgggcttcaaacatcggaagctaataatatcttccacgagaagaacagctacagagaattgtctgaaattgctgaacaggctaagaggagagccgagattgcaaggcttcgtgagctgcatacactcaagggacacgttgaatctgttgtgaagcttaaaggccttgacattgagacgatccagcagcactacaccgtttgaagaaggcaaacgaaatctttacgtaatgaattgagcaaaatgatttacagaacataaagtgtgctttttatatagaactgaacaaaatgaaagtgcccccttgaaagggatccttggctcttttatgagtacaatagcataacagtgttttttccgactgaaatctcttattttcccctggtttagtcttgtactttgatcttttcccggtaattgatctttaatgttgtactttaccgtgatgatggattatgatcgtcagaaaacgtaacaatcaatgtgtcacattcttgcgttcatgttgtaatagtaaacggttcaagttgtaataatgaacgaaatggtcttcattacggtagaataaatatatgtagaatgtgatgatgataaattttttcatttgaagtgcacatgttgcagatgaaat

SEQ ID NO: 994 - DNA, 3613 bp, Physcomitrella patens
acttcatgagctgagtccaacccggtctcgccgtgatcctttccgttgggttgcttcgcttctctggttcatggggctgcattaaagcaccccactctgggctgttcattttcattgtgggttaaggcagggtgtcctcaatgcgttccccctgctagacctggctttgcgttttgtttgggtgcgccgaggaatcatcggtagtggcatccgtgagttttaacgatgggggagaaactagcgaccaaattggcaggcctcgaggccctcaacaacgagacagtcgatttggaacacatccctgtcgatgaggtcttccagcacttgcgctgtactgaagaagggctgtcaaatgaggaggctgaagcgaggcttcagatcttcggcttcaacaagttggaggagaaatcggagagcaaattcctcaaattcttggggtttatgtggaacccattgtcatgggtcatggaggctgctgcaattatggccatcgctcttgcgaacggagggggacaacctccagattggcaagatttcattgggattatatgtttgctgatcatcaactcaaccatcagttttgttgaggaaaacaatgcgggtaacgcagctgctgctctcatggcacgactagctccaaagactaaggtgctgcgcgatggtcaatggggtgagcgtgatgcaatgatcttggtgcctggggatattattagcatcaagcttggggacatcattcctgctgatgcacgtctgcttgaaggagatcctttaaaaattgaccagtcggctctgacaggggaatcactacctgctaccaagaaaccgggagacgaagtatactcaggatcgacatgtaaacaaggggagattgaggctgtagttattgccacaggtgtgcacacgtttttcgggaaggccgctcacttggtagactccacaaacaatgtgggccacttccagaaggtgctgaaatcgatcggaaacttctgtatcgtttccatcgccattggtatcgtcatcgaaattattgtgatgtaccccattcagcaccgcaaataccgagatggaatcaacaatctgttggtgttgctcattggaggcattcccattgccatgcccactgtactctccgtgacaatggctattggatcccataggctttctcaacagggagccattacgaaacgtatgactgctattgaggagatggcaggcatggacgtgctgtgtagtgataagaccgggacactcacccttaacaagttgaccgttgacaagaacttggtggagtgtttcacaaaaggtgttgacaaggacctggtgtgcttgatggctgctcgggcatccagattggagaaccaggatgctattgatacggccattgtttcaattcttgccgatccaaaggaggctcgtgcagggattcaagaaattcactttctccctttcaatcctgtcgacaagcgaaccgctatcacatacatcgacaatgctgacggcaagtggtaccgatctagcaagggagctcctgagcagattcttgaccttgcccacaacaaaacggacatttctgcgcgtgtgcattcgatcattgacaaattcgcggaacgtggtctgcgttccttggctgtagctaggcaggaagttccggggaaaagcaaagaggatcctggtacaccctggcagtttctaggcttgatgcccctttttgaccctccccgacatgacagtgctgaaacaattcgaagggctttgaatctgggagttagtgtgaagatgattacgggtgatcagcttgccatcggaaaggagacaggacgacgcttgggcatgggaaccaacatgtacccctcatcatctctactcggggcacacaaagatgagagcattgcagctctgcccgtggacgagctcattgagaaggcggatggctttgcaggcgtctttcctgagcacaagtacgaaatcgttgcaaggttgcaaggtttgaagcacattgtaggaatgacgggtgacggtgtaaatgatgctcctgcattaaagaaagcagacattggaattgcagtggctgatgcaactgatgctgcccgaagtgcctctgatattgtgctcactgaaccggggctcagtgtcatcattagtgctgtcttgacaagccgagcaattttccagcggatgaagaactacacgatatatgctgtttccattaccattcgtatagttatgggattcttgctgctggccttgatctggaaatttgacttttctccattcatgattctggtcatcgccatcctcaacgatggtaccatcatgaccatctcaaaggatcgtgtaaagccatctcctttgccagacagctggaagttgagagaaattttctccatcggtgttgtgctgggtacttacatggcgttgatgacagttctcttcttctggctcatgcacgagacgagctttttcactgaccgattcggggtgagacacatcgggcggagtagtgaccaaatgacagcagcaatttacctacaagtcagcatcatcagtcaggctctaattttcgtcacacgttcacgaagttggtcttttatggagagaccaggagggttgctcatgtttgcatttgtggctgctcagctgattgccacattcatttcagtgtatgcgaactggggatttgccagtatcaaaggcattggatggggctgggctggagtcatctggctatacagcatagtcacttaccttcctctcgatatcatcaagttctttgtccgttacattcaaagtggaaaggcctgggacaatttgattgagcgcaggacggcattcacgaggcagaaggactttggaaaggaagctcgggaagcgcagtgggcgcatgcacagagaacattgcacgggctgcatccaccggaatccaaggacgacgtcggcatatcgagcggcagcggtaccaggggagagctgggagacatggcggagcaggccaagcggagggccgagatcgccaggctgcgcgagcataacactctcaagggacatgtggaatcggttgtccggctcaagaacctggacatcgacatgatccagcagtcctacacagtctaaagcaccagaagcaaatgtgctaagagtctaattcagtcttggcctagttttagtaattctgtttactgtcgccataaaaagcttagcaatgagaatggccggagcttgtgttgactaatgtggtgcaatctcagccatatcatgtagattggagaagaaataggaagaggaggacaatggggtgaaaaagacaataccatcatcatggatagatattggaccattgcaacaactcgtaactagatattaaaaacagaatttgtgtagagaacaaccagccgtgtttcgagaggagcaggtgtgtccggtgaatgagcccagtcctagaaaaacatgggctccaaagacttgaaacacatgttttcttcttgtaactcagtgcatgtagatgatgagagtttggtctgcatcatcctcatgcactgcatcagttttgttccttgtcttccacacttgtgcagcaaggtctctcactttctaaagaaatctattttgatcacac

SEQ ID NO: 995 - DNA, 3439 bp, Populus trichocarpa
ctcgccttcttcattatttctgcttcttcaaaaaaaaaaaacaaacactcacttctttcgctactgtcatttcgatagcaaataatattattacgagtctgtaattgtctcttgaatttttttttattaatatatatttttggaaattaaggcgaggagactgatgtctagtaagggcgggatcagcctagaagagataaaaaatgagtctgttgatctggagaggattcctatagaggaagtgtttgagcagctcaaatgttcaagggaaggtcttacttcagacgaaggagccaccaggcttcaagtttttggaccaaacaaactagaagagaaaaaggagagcaagattctcaagtttctgggatttatgtggaatccgttgtcatgggtcatggaagctgctgcattgatggccatagtcttggcaaatggtgatggaagacctccagattggcaggactttgtcgggatcgttgtcttgttggtgattaactccactattagtttcatcgaggaaaacaatgctggtaatgcggcagcagccctcatggctggtcttgctcctaaaacaaaggttctgagagatggccgatggagcgagcaagacgctgcaatcttggttccaggagacattatcagcattaaattgggagacatagttcctgcagatgcccgtcttcttgagggtgatcctttgaagattgatcaatctgcccttacaggggagtcacttcctgtcaccaagaacccctctgatgaagtgttttctggctcaacatgtaaacaaggtgaaattgaagcagttgtgattgccaccggtgtgcacacctttttcggaaaggctgcccatctcgtggacagcaccaatcaagttggacatttccagaaagttcttactgccattggtaatttctgtatttgctcaatcgctattggaataatcattgagattgtagtcatgtacccaatacaaaagcgcaagtacagagatggaattgacaacttgctggttctcttgattggaggaattcctattgctatgccaactgttttatctgtcaccatggctattggttcccatagactttctcaacagggtgccattaccaagagaatgactgccatcgaggaaatggcaggaatggatgttctctgcagtgacaagactgggactctcactctgaacaagcttactgttgacaagagcttgattgaagtgtttgcaaagggtgtggagaaggagcatgttatgcttcttgcagcgagagcttcaaggacggaaaatcaggatgccattgatgctgcaattgttgggatgcttgctgacccaaaggaggcacgagctgggatcagagaagttcatttccttcctttcaaccctgtggacaagaggactgctctgacttacattgataataatggaaactggcaccgggctagcaagggtgcccctgagcagatcttaactctatgcaattgcaaggaagatgttaagaggaaggttcattctgtgattgacaagtttgctgaacgtggacttcgatctttaggtgttgcaaaacaggaagtacctgagaaatcaaaagatgctccaggggcaccatggcaacttgttggtttgctgcccttgttcgatcctcccaggcacgacagtgctgaaaccattagaagagctctccaccttggtgttaatgttaagatgattactggggatcagctcgcaattgctaaggaaactggcaggaggcttggaatgggaacaaacatgtacccctcttcttcattgctcggccaagataaggatgctgccattgcagccctccctgtggatgagttgattgaaaaggctgatggatttgctggagtttttccagaacataaatatgaaattgttaagaggctacaggagaggaagcacatatgtggaatgactggagatggtgttaatgacgcccctgctctgaagaaagcagatattggaattgctgttgctgatgctactgatgctgccagaggcgcttccgacattgtccttactgaaccaggacttagtgttattataagtgcagtgctgaccagcagggctatattccaaaggatgaagaactacactatatatgcagtttcaattaccattcgtattgtgtttggcttcatgtttattgccctgatatggaagtttgacttcgctccattcatggttttgatcattgccatcctaaatgacggaacaatcatgacaatatcgaaggatcgagtgaagccatctccactgccagacagttggaaacttaaagagatatttagtactggtgttgtgcttggaggttacttggcactaatgacagtattattcttctggattatgaaagacacagacttcttctcagataagtttggcgtaagatcactgagagatagcaaatatgaaatgatggcggccttgtacttgcaagtgagtattgtgagccaggcccttattttcgtcacacgatcccgcagctggtcttttgttgaacgtcctggacttcttcttgtcagcgcgtttgtagtcgctcagctgattgcgacattgatagcagtctacgcaaactggggttttgcacatatcaaggggtgcggctggggatgggctggagtaatctggctatttagcttggtgacatatctgccgcttgatgttctcaaatttgcaatccgctatatcttgagcgggaaggcttgggataatttcttggagaacaagactgcctttactacaaagaaagactatgggaaagaagagagagaagctcagtgggccacagctcagaggacccttcatggcctccaacccgctcagaccaacactatcttttccgacaagagtagttacagggagctttctgagatcgcagagcaagccaagcgtagggctgagatggcaaggctgagggagctgaacaccctcaaggggcatgtggaatcagtggtgaagctgaagggactagacattgatacaattcaacaacattacaccctttaaggagttaacaagtctcgaagagaacaaactcctcggagaaaagccggaagcagctatagctatatgacgacgaagaaggcctcgagagaatccttttaatcagactagaatggcattcctcttgctataacttaggtactcttttgttgtttgttatctaccattcaagcccagaggacatggtttctcctttaggagctaaatataatcagccatctatttcctcctctgtaccaattttctatcacgtttaattttacatgccctgcatcaatttacgttgctaatagagttatgcaatccgaggctactgtttaaagtgacacttcagagctttctctttctttaaaccatctaactgttgctattagttattgatggaatcacttgttccattaaccaagtttccaa

SEQ ID NO: 996 - DNA, 3184 bp, Prunus persica
ttaagtttgtgaaagatggggggcacagacaaggctatcagcctcgaggagatcaagaacgagactgttgatctggagcggattccaattgaggaagtctttgaacagttgaaatgttccagagaaggtttaaatggagaggaaggagcccagaggctagagatttttggtcccaacaaactagaagagaagaaggaaagtaaatttctcaagttcttggggttcatgtggaatcctctgtcatgggtcatggaagctgcagccattatggcaattgctctggccaatggagatgggaagcccccagattggcaagactttgttggtattgtctgcttgctggtcatcaactccaccatcagtttcattgaagaaaacaatgctggaaatgcagctgctgcccttatggctggtcttgctcctaagacaaaggtgcttagagatggaaaatggagtgaggaggatgctgccattctggttccaggagacatcatcagcatcaaattgggagatatcgtcccagctgatgctcgtcttcttgagggtgatcctttaaagattgatcaatctgccctcactggagaatcacttccagtgaccaaaaatcccggcgatgaagttttctccggttccacctgcaagcagggtgaaattgaagctgttgttattgccaccggtgttcatactttcttcgggaaggctgcacatctcgtggacagcactaaccaagttggacacttccagaaggtgctcactgcaattgggaacttctgtatctgctccattgcggttggaatgttgattgagatcgtagtcatgtacccaattcagcaccgcaagtacagggatggaattgacaatctcttggttctcttgattggaggcattcccattgccatgcccactgtcttgtctgtgacaatggctatcgggtctcaccggctgtctcagcagggtgccatcaccaagaggatgactgccattgaagaaatggctggtatggatgtgctttgcagtgataagacaggaacactaactcttaacaagctcagtgttgataaaaaccttgttgaggtgtttgcaaagggtgtggagaaagaacatgtggttttgcttgctgcaaggtcctcaagaacagaaaaccaggatgccattgatgctgctatggttggaatgctcgccgatccaaaggaggcccgagctggtattagagaggtgcacttcttaccatttaatcctgtggacaagagaactgctttgacttacattgatggtgatggaaactggcacagagcaagcaaaggtgcccctgagcagattttgaccctctgcaactgtaaagaggatttcaagaagaaggcttttgccattattgataaatatgctgaacgtggccttcggtcattggctgttgctagacaggaagtacctgcaaaatcaaaagaaagtgctggcggtccttggcagtttgttggattgttgcctctttttgatcctccaagacatgacagtgcagaaactatccgccaagctcttaatctcggtgttaatgttaagatgattacaggtgatcaacttgccattgccaaggaaactggtcgaagacttggaatgggaacaaacatgtacccatctgcttccttacttggccaagacaaggatgcaagcatagctgcccttcctatagaagagttaattgagaaggctgacgggtttgccggagtgtttccagagcacaaatacgaaattgtgaagaagttgcaagagagaaaacacatttgtggaatgactggcgatggtgtgaacgatgcccctgcattgaagaaggcagatattggaattgctgttgctgatgctacagatgctgcccgaggtgcttccgacattgttcttacagaacccggattgagtgtcatcattagtgcagtgttgaccagtagagctattttccagagaatgaagaactacacaatctatgcagtttccatcacaatccgtattgtgtttggtttcatgttcatcgcactgatatggaagttcgacttctcacctttcatggttttgattatcgccatattgaatgatggcacaattatgacaatctcaaaggatagagtaaagccatcccccttgcctgatagctggaaattgaaagagatatttgcgaccggaattgtgcttggaggttacttggcattgatgactgttatcttcttctggttgataaaagaaaccgacttcttctctgacaaatttggcgtacgatccataagagagagtcctggggaactaatggctgccttatacctacaagtgagtattgtgagtcaggctctcattttcgtgactagatcccgcagctggtccttccttgaacgccctggactgctactactcggtgctttcatgattgcacagctgattgcaactctggtagcagtgtatgccaactggggttttgcaagaatacacggagttggttggggatgggccggtgtcatctgggtttacagtattgtcttttatttcccactcgacgtgatgaagttcgccatccgttacatcttgagtggaaaagcctggcttaacttgcttgagaacaagactgcctttaccaccaagaaagattatggaaaagaggagagagaagctcaatgggctcttgctcaaaggaccctgcatggtctccaggcaccagaagctgctaatctcttcaatgacaagagcagctacagagagctgtctgagattgctgagcaggccaaaagacgagccgaagttgcaagacttcgggagcttcacacactcaagggacatgtggagtcggtggtgaagctaaagggcctggacatcgatacaatccagcagcattatacagtgtaagaatccagaaatgttacctgggaaaggaagggagagtcgcaagcaacgatgtatcaaagtgaagaggagatacaggaagaaagtgggacaaactgaaagcaggactaattagttaaacatttctagatatcatggacagcatgtctgtgctatatatcaaactctcctactctgtttacttttccattctaatgtatttcaagtgccagaaaagggttgtgtttggtttatttttgctctggtgcaggggccaaacagtgtctcgcagttttcttgccataatctgctatctatctatctt

SEQ ID NO: 997 - DNA, 3290 bp, Arabidopsis lyrata
acagaaccacctaatatctcctcctctccttctttctctcgccggaatacgtatgatcgagtgaaacggcggataaagctgtcgttttgagtactaattcgccgtgaaggagtggtgtgagagatgtcgagtctcgaagatatcaagaacgagactgttgatctggaaaaaattccgattgaggaagttttccagcagctaaaatgttcaagggaaggattgacaacgcaggaaggggaagacaggattcagatctttggccccaacaagctcgaagagaaaaaggaaagcaaaattctcaagtttttggggtttatgtggaatccactttcatgggtcatggaaatggctgcaatcatggccattgctttggccaacggtgatggtaggcctccggattggcaggattttgtcggtatcatctgtctgttggttatcaactctaccatcagttttatcgaagaaaacaatgccggtaatgctgccgctgctcttatggctggtcttgctcctaaaaccaaggttcttagggatggaaaatggagtgaacaagaagctgctattcttgtcccaggagatattgttagcattaaattgggagacattatccctgctgatgctcgtctacttgaaggtgatcctttaaaggttgaccaatctgctctaactggagagtcccttcctgtaaccaagcacccaggtcaagaagttttctctggttcaacctgcaaacaaggagaaatcgaggcggttgttattgccacaggggttcacaccttcttcggtaaagctgctcaccttgtcgacagcaccaaccaagttggacatttccagaaggttcttacagccattggaaacttctgtatctgttccattgctatcggtatggtgattgagatcatcgtcatgtacccgattcaacgccgaaagtacagagatggaattgataaccttttggtcctcttgatcggtggtatccccattgctatgcccacggtcttgtctgtgaccatggctattgggtctcacaggctgtctcagcaaggtgccatcaccaagcgtatgactgccattgaagagatggcaggaatggatgtcctgtgcagtgacaaaaccgggacactaaccctcaataagttgagtgtggataaaaacttggttgaggttttctgcaagggtgtggagaaagatcaagtcctattatttgcagctatggcttccagggttgagaaccaggatgccattgatgcagccatggttgggatgcttgctgatccaaaggaggctcgagctggaattagggaggttcacttccttcccttcaatcctgtggataagagaactgctttgacttacattgacggtaatggtaactggcacagagtcagtaaaggtgctcctgagcagatcctcgaacttgccaaagccagcaatgaccttagcaagaaggtgctctccattattgacaagtatgccgagcgtggtcttaggtcgttggctgttgctcgccaggtggtgccagagaaaacaaaggaaagcccaggtgcaccatgggaatttgttggcttgttgccactttttgatcccccaagacatgacagtgccgaaaccattcgacgggctttgaatctcggtgttaatgttaagatgatcactggtgaccaacttgctattggtaaggaaactggtcgcagacttggaatgggaacaaacatgtatccatcttcggctcttcttggtacacacaaagacgcaaaccttgcatccattcctgttgaggagttgattgaaaaggctgatggatttgccggagtcttcccagagcacaaatacgaaattgtgaaaaagttgcaggagaggaagcatattgttggaatgactggtgatggtgtcaatgatgcccctgctctaaagaaagctgatattggtattgctgtggctgatgctacagatgctgctcggggtgcttcagatatcgtgctcactgagcctggactcagcgttattatcagtgctgttctcaccagcagagctattttccagagaatgaagaactatactatctatgcagtctcaatcaccatccgtattgtgtttggtttcatgcttattgctttgatatgggaatttgacttctcagctttcatggttctgatcattgccattcttaacgatggtaccatcatgacaatctcaaaggacagagttaagccatctcccacacctgatagctggaaacttaaagaaatttttgccactggagtcgttctaggaggataccaagccatcatgactgttattttcttctgggctgcgcacaagactgactttttctcggacacattcggtgtgaggtccattagggacaataaccacgagctaatgggagctgtgtatctacaagttagtatcattagtcaagctctgatcttcgttacgagatcaaggagttggtcatttgttgaacgtcctggggctttattgatgattgctttcctcattgcacaactgattgcaactttgattgcggtttatgccaactgggaatttgcaaagattaggggtattggatggggatgggctggtgtgatctggctatacagtattgtcacatactttccattggacgttttcaagtttgccattcgatacatcttgagtggaaaggcgtggctcaacttgtttgagaacaagacggctttcacgatgaagaaagattacggaaaagaagagagagaggctcaatgggcacttgctcaaagaacacttcacggtttacagccaaaagaagctgttaacatcttccctgagaaaggaagttacagagagttgtctgagatcgcagagcaagccaagagaagagctgagatcgctaggcttagagagctgcacacactcaagggacacgttgaatcagtagtgaagctaaagggcttggacattgaaactcccagtcactacactgtgtagtaaaaccaaacatgattgatcttcgatcttctcctgttttgtcttttttttttttctttttctttttcttcaccacctcttatgatgattatttacatagggagagatctttgtttattgccataactcttcccaaatcttattgttagtgttcttgtttctcaaatctgtaattttgcaaaatttgcttttttgaagaaacaaggcatgcctttgtggttggcatttggcacatgcacattctcttctttgctcttattccatgggcctatgtaatcttaatcttcttcttttacttaatacaaattttcttccggctt

SEQ ID NO: 998 - DNA, 3307 bp, Arabidopsis thaliana
aacagaaccacctaatctctcctcctctccttctctctattttgccggaatacatatgatcgagtgaaacggcggacaaagctgtcgtgttgagtactaattcgccgtcgtttttctcagtgaaggagtggtgagagatgtcgagtctcgaagatatcaagaacgagactgttgatctggaaaaaattccgattgaggaagttttccagcagctaaaatgttcaagggaaggattgacaacgcaggaaggggaggacaggattcagatctttggccccaacaagctcgaagagaaaaaggaaagcaaacttctgaagtttttggggtttatgtggaatccactttcatgggtcatggaaatggctgcaatcatggccattgctttggccaacggtgatggtaggcctccggattggcaggattttgttggtattatctgtctgttggttatcaactctaccatcagttttatcgaagaaaacaatgctggtaatgctgctgctgctcttatggctggtcttgctcctaaaaccaaggttcttagggatggaaagtggagtgaacaagaagctgctattcttgtcccaggagatattgttagcattaaattaggagacattatcccagctgatgcccgtctacttgaaggtgatcctttaaaggttgaccaatctgctctaactggagagtcccttcctgtaaccaagcacccgggtcaagaagttttctctggttcaacctgcaaacaaggagaaatcgaggcggttgttattgccactggggttcataccttcttcggtaaagctgctcaccttgtggacagcactaaccaagttggacatttccagaaggttcttacagccattgggaacttctgtatctgttccattgctatcggtatggtgattgagatcatcgtcatgtatccgatccaacgccgaaagtacagagatggaattgacaaccttttggtcctcttgatcggtggtatccccattgctatgcctacagtcttgtccgtgaccatggctattgggtctcacaggttgtctcagcaaggtgccatcaccaagcgtatgactgccattgaagagatggcaggaatggatgtcctgtgcagtgacaaaaccgggacactaaccctcaacaaattgagtgtggacaaaaacttggtcgaggttttctgcaagggtgtggagaaagatcaagtcctattatttgcagctatggcttccagggttgagaaccaggatgccattgatgcagccatggttgggatgcttgctgatccaaaggaggctagagctggaatcagggaagttcacttccttccattcaaccctgtggataagagaactgctttgacttacattgacggcagtggtaactggcacagagtcagtaaaggtgctcctgagcagatcctcgaacttgccaaagccagcaatgatcttagcaagaaggtgctctccattattgacaagtatgctgagcgtggtcttaggtcgttggctgttgctcgccaggtggtgccagagaaaacaaaggaaagcccaggtgcgccatgggaatttgttggcttgttgccactttttgatcccccaagacatgacagtgctgaaacaattcgacgggctttgaatcttggtgttaacgtcaagatgatcactggtgaccaacttgctattggtaaggaaactggtcgcagacttggaatgggaacaaacatgtatccatcttcggctcttcttggtacacacaaagacgcaaacctcgcatccattcctgttgaggagttgattgaaaaggctgatggatttgccggagtcttcccagagcacaaatacgaaattgtgaaaaagttgcaggagaggaagcatattgttggaatgactggtgatggtgtcaatgatgcccctgctctaaagaaagctgatatcggtattgctgttgctgatgctacagatgctgctcgtggtgcttcagatatcgtgctcactgagcctggactcagcgttattatcagtgctgttctcaccagcagagctattttccagagaatgaagaactatactatctatgcagtctcaatcaccatccgtattgtgtttggtttcatgcttattgctttgatatgggaatttgacttctcagccttcatggttctgatcattgccattcttaacgacggtaccatcatgacaatctcaaaggacagagttaagccatctcccacacctgatagctggaaacttaaagaaatttttgctactggagtcgttctaggaggctaccaggccatcatgactgttattttcttctgggcggcgcacaagactgactttttctcggacacattcggtgtgaggtccattagggacaataaccacgagctaatgggtgcggtgtacttacaagttagtatcattagtcaagctctgatcttcgtcacaagatcaaggagttggtcttttgttgaacgtcctggagcattgctgatgattgctttcctcattgcacaactgattgctactttgattgcggtttacgccaactgggaatttgcaaagattaggggtattggatggggatgggctggtgtgatctggctatacagtattgtcacatacttcccattggacgttttcaagtttgccattcgatacatcttgagcggaaaggcgtggctcaacttgtttgagaacaagacggctttcacgatgaagaaagattacggaaaagaagagagagaggctcaatgggcacttgctcaaaggacacttcacggtttacagccaaaagaagctgttaacatcttccctgagaaaggaagttacagagaattgtctgagatcgctgagcaagctaagagaagagctgagatcgctaggcttagggagctgcacacactcaagggacatgtggaatcagtcgtgaagctaaagggcttggacattgaaactcccagtcactacactgtgtagtaaaaccaaacatatgactgatcttcgatcctctcatgttttgtcttcttcttcttctttttttcttcaccacctcttatgattattattcacatagggagagatctttgtttattgccataactcttcccaaaccttattgttagtgttcttgtttctcaaatatgtacttttgcataatttgctcttttgaagaaacaaggcatgcctttgtgtttggcatttggcacatgcacattctcttctttgctcttattccatgagcctatgtaatcttaatcttcttctttttcgtaatccaacttttcttccggcttctttac

SEQ ID NO: 999 - DNA, 3309 bp, Gossypium hirsutum
ccgcgcaggtcattcatttacgtttctaatgcccaaaaggtcagaaaaaaaactgggatacgtctctcattttttttcgtagacatttttgtcattattttactctgaatatgagtatttaagcgtttctttggcatttcctttattttttacaattccaataccttcttccattactggctgctgcttcaaccactaagcttggaagatgggaggcgaaaaaggcatcagtcttgaggagatcaaaaacgagtccgttgatctggaacggattcctattgaggaagttttcgagcagctgaaatgtacaagggaaggcttgtcaaccgaggaaggcaacaatcgccttcaagtctttggaccaaacaaactagaggagaaaaaggagagcaaggtgctcaagttcttgggttttatgtggaaccctttgtcatgggtcatggaagctgctgctataatggctattgccctggcaaatggtgatggaaggcctccggactggcaggacttcgttggtatcattgtcttgttggtcatcaactccaccataagttttattgaagaaaataatgctggtaacgctgcagctgctctcatggctaatcttgctccgaaaactaaggtacttagagatggccgatggagtgagcaagaagcagcaattctagttccaggggacattatcactattaaattgggagacatagttcctgctgatgctcgtcttctagagggtgatcctttgaagattgatcaatctgctcttactggggagtctcttcctgttacgaagaatccatcagatgaagtattttccggctcaacatgtaaacagggtgaaatagaagcagttgttattgcaactggtgttcacaccttctttggtaaagctgcccacctagtggacagcaccaatcaagttgggcatttccagaaagtgcttacagccattggtaatttctgcatttgctcaattgctgttggaataatcgttgagctaatagttatgtacccgatacagcaccgcaagtatagagatggaattgacaatatgctagttctcttgattggtggaatcccaattgctatgcccactgtgttgtctgtcaccatggctattggttcccacaggctttctcaacaaggggctatcacaaagagaatgacagccattgaggaaatggctggcatggacgttctctgcagtgataagactgggactctgactttaaacaaacttactgttgatagaaacctcattgaagtatttacaaagggagtcgaaaaagagcatgttattctttatgcagcaagggcttcaaggactgaaaatcaggatgctattgatgctgcaattgtaggaatgcttgcagatccaaaggaggcacgtgctggtgtccgagagattcacttcctaccattcaaccctgtagacaagagaactgctctaacctacattgattctgatggaaactggcatcgtgctagcaaaggtgcacctgagcagattatagatctttgcaaatgcaaagatgatgtcaggaaaaaagttcattcagttattgataaatttgctgaacgtggacttcgatctttagctgttgcaagacaggaaatacctgagaaaacaaaagagagtcctggatccccgtggcagtttattggcttgttgccactatttgatccaccgaggcatgatagtgctgaaacaatcagaagagctctaaaccttggagtgaatgttaagatgattactggggatcagcttgccattgccaaagaaactggcaggaggcttggaatgggaacaaacatgtacccttcatcttctttactgggccaagacaaggacgcttccattgctgcccttcctatagatgaattgattgagaaggctgatggatttgcaggagtgtttccagaacacaaatatgaaatcgttaagaggctacaggagagaaaacatatttgtggtatgacaggagatggtgtcaatgatgcccctgctttaaagaaggcagacattggaattgctgttgctgatgctacagatgctgcccgaagtgcttcagacattgtccttactgaacctgggctaagtgtcattatcagtgcagtgctgaccagcagggctattttccaaagaatgaagaactacactatctatgcagtttcaatcaccatccgtattgtgtttggattcatgtttattgccttgatatggaagttcgactttgcacccttcatggttttaattatcgccatcctgaacgatggtacaatcatgacaatttcaaaggacagagtgaagccatctccacagccagacagctggaaactcaaggagattttctctaccggcattgtgcttggaggttacttagcactaatgactgtgatattcttctgggcaatgaaagacaccaatttcttctcgaacacatttaatgttagatcactgaggcatagtattgatggtgagagagaaatgatggcagctttataccttcaagttagtattgtgagtcaggccctcatttttgtcacaaggtctcgcagctggtcctactttgaacgccctggacttctactagtcagtgcctttctagttgctcagttggtggccactttaatagctgtgtatgcagactgggggtttgcaaggattaaaggtatgggttggggatgggctggtgtaatctggctatacagtgtggtgacttttatcccactggattttatcaaatttgcaatccgctatgttcttagtggaaaggcttgggataaccttttggagaacaagactgccttcactacgaagaaagattacgggaaagaggaaagggaagcacaatgggcagctgcgcagaggactctgcatggccttcaaccacctgaaaccacaagcattttcaatgaaaggagcagttacagggaactttcagaaatcgcagagcaggccaagcgcagggctgaggttgcaaggctgagggagctgaatacactgaaggggcatgttgaatcagtcgttaagctcaaggggcttgatatcgataacattcagcagcattacaccgtttaaagatggatgttatttcccctccaagaaaaaaaggagttataatgacgaacaatcaccccggatattaatattaatattgttatcaatcggcttatagtagtagtatagatttaggataattttcctttttcctaaatgtcggaatttgtgttcattgtgattacctcttttggaatgcagaaaggttaattaataacatcatctaatccaaggctctttgtttgctc

SEQ ID NO: 1000 - DNA, 3400 bp, Pennisetum glaucum
gtcgacgcccaccaccacttcccattcctccctctctctcccccttctctacctctcgcgagaggagaggagagaaaccttgctgctggagctcggccgctctggttccggcgtaaaccagccggcgggctcggcgcggagtgtgacaggaaccgtcgtccgccatgggtggcctcgaggagattaagaatgaagccgtcgatctggagaacattcccatcgaggaggtgttcgagcagctgaaatgcacccgcgaggggttgtcctccgccgagggcgctcaacgtctcgagatctttggccccaacaagctcgaagagaagaaggagagcaaaattctcaagttcctcgggttcatgtggaacccgctgtcgtgggtcatggagatggctgccatcatggccattgcactggccaatggtggtggcaagcctccggattgggaggacttcgtcggtattattgttcttctggttatcaactccaccatctctttcattgaggagaacaacgctggtaacgccgcagctgcgctcatggccaaccttgcccccaagaccaaggtgctgagagatggccgatggggtgagcaggaggccgcaatcttggttcccggtgacatcgtcagcatcaagctcggtgacattgtccctgctgatgctcgtctccttgagggtgatcctcttaaggttgaccagtctgcacttactggagaatccctcccagtgaccaggggccctggcgatgaggtcttctctggctcaacatgcaagcagggtgagattgaggccgtggtcattgccactggagtgcacaccttctttggcaaggctgctcatcttgtggacagcaccaaccaggttggacacttccagcaggtcctcactgctattgggaacttttgtatttgctccattgcggtcggtatcgttatcgagatcattgtcatgttcccgatccagcaccgtgcataccgtagtggaattgagaacctgctggttctcttgatcggtggtatcccaattgccatgcctactgtgctttctgttaccatggccatcggctcccacaagctgtcacagcagggtgccatcactaagaggatgactgctattgaggagatggctggcatggacgtgctttgcagtgataagaccggcacactcacccttaacaagcttagtgttgacaagaaccttgttgaggtgttttgcaaaggtgtcgacaaagaacatgtgttgctgttggctgcgagggcttcaagaactgagaaccaggatgccattgatgctgccatggttggaatgcttgctgatcctaaggaggctagggctggtatcagggaggtgcacttcttgcccttcaaccctgttgacaagaggactgctctgacttacattgattctgacggcaactggcaccgtgtcagcaagggtgctcctgagcagattctcgacctgtgcaactgcagggaggatgtgaggaggaaggtgcactctatcattgacaagtatgccgagcgtggtcttcgttcccttgctgttgccagacaggaagtacctgagaaatcaaaggactctgctggtgggccatggcaatttgtcggtttgttgcccctgtttgacccccctaggcatgacagtgctgagacgatccgcaaggctcttgttcttggtgttaacgtaaagatgattactggcgatcagcttgctattggtaaggagaccggaaggaggcttggcatgggtactaacatgtatccttcctctgcattgctcggcacaaacaaggacgctacacttgaatcgcttcctgtagatgagctcattgagaaggctgatggttttgctggagtcttccctgaacacaagtatgagattgtgaagaggctgcaagagaagaagcacattgttggtatgactggtgatggtgtcaacgatgccccagctcttaagaaggccgacattggtattgctgttgctgatgccactgatgctgcaaggagtgcctccgatattgtccttactgagccaggtcttagtgtcattatcagtgctgtcctcaccagcagatgcatcttccaaaggatgaagaactataccatttatgctgtctccatcaccatccgtattgtgcttgggtttatgcttattgctttgatctggaaatacgatttctcgcccttcatggtccttattattgccattctcaatgatggtactatcatgaccatctctaaggacagagttaagccctctcccctgcccgacagctggaagctgaaggaaatctttgctactggtgtcgtcctcggaagctaccttgctttgatgactgtcattttcttctgggccattcacaagaccgacttcttcacggacaaatttggtgtgaggtcaatcagggacagtgagcacgagatgatgtctgctctgtacctccaagtcagtattgtcagccaggctctgatcttcgtcacccgttcccgtagctggtccttcgtggagcgccctggtctgctcctggtcactgctttcctgcttgctcaactcgttgctaccttccttgctgtgtacgccaactggggctttgccaggattaagggtatcggctggggctgggccggcgtcgtctggctgtacagcatcgtgttctacttcccactggacctgttcaagttcttcatccgcttcgtgctcagtggcagggcctgggacaacctccttgagaacaagactgccttcaccaccaagaaggattacggccgggaagagagggaggcgcagtgggccaccgcccagaggaccctccacggtctgcagccgccggaggccgcctccaacacgctgttcaacgacaagagcagctaccgcgagctgtcggagatcgcggagcaggccaagagacgagctgagatcgcgaggttgcgggagctgaacacgctcaagggccacgtggagtcggtggtgaagctcaaggggctggacatcgacaccatccagcagaactacacggtgtgagaacaccgccgccgcctggacgtcgacgaaacctttgcccgcccgcccgctcccaacggatatctgattactacaggaattttcccggtgatgaaccaaaacaaaaggaaaaaaaaaaccggctgatctgaccgagcagccctagttgtaaagcgctataccaccaccaccaccatttactgctatatgatggtatggctgggtgccccgacttgatagggagctttttctttttttcctcctttcacttttttactctttttcactagtggagtgtgcgcgtgttgtaatcgtttttacttgcgttttcccctaactagccccggtggtctcgcggaatgcgagacggagaaataatgcaacaagaattttctgccaca

SEQ ID NO: 1001 - DNA, 3492 bp, Solanum lycopersicum
atacctcacaatttctctcttcacaaagaggccttaaaaacctctcttcattcccttccgccgttctcaattttgcgatcgatgagtctcattagtcgttatactcactgaaatcaatccgttttctgcttaattttgtattgacttgtttgctgctggtttaccgacatggcgaaagctataagcctcgaagagatcaaaaatgagactgttgatctggagaaaatccccattgaagaagtgtttgaacaactgaaatgttcgcgagagggtctgacttcggacgaaggagccaacaggcttcaaatctttggaccgaacaaattggaagagaaaaaagaaagcaaaatactgaagtttcttgggtttatgtggaatcctctgtcatgggttatggagatggcggctatcatggccattgcactggctaatggagatgggaagcccccagattggcaagattttgttggtattgtttgcttgctggtgatcaattcaactatcagttttattgaagaaaacaatgctggcaatgctgccgcagctcttatggctggtcttgctcccaaaaccaaggttcttagagatgggcgctggagtgaacaggaagctgctattctagtgcctggtgatattataagtgtcaagttgggagacattgttcctgctgatgctcgtcttcttgaaggtgatcctttaaagattgatcaatctgcccttacaggagaatctcttcctgtgacaaagaatcctggagatgaagttttctctggatcaacctgcaaacaaggtgagcttgaagctgtagtcattgccactggagttcacactttctttggcaaggcagcacaccttgttgacagtacaaacaatgttggtcatttccagaaagtgttaacagccataggaaacttctgtatctgttccattgctattggtatgctggttgagattattgtcatgtatccaatccagcacaggaagtacagggatggaattgacaatctcttggtgctccttattggtggtattcccattgctatgcctactgtgttgtcagtcactatggctattggatcccataggctctcccagcagggtgccatcaccaagagaatgactgctattgaagaaatggctggaatggatgtgttgtgcagtgacaagacaggtaccttgactcttaacaagttgagtgtcgacagaagcttggttgaagtgtttactaagggagtagataaagaatatgtgctcctccttgccgcaagggcctctagagttgaaaatcaggatgcaattgatgcttgcatggttggcatgcttgccgatccaaaagaggcacgagctggtatcagggaggtgcatttcttgcccttcaatccagtggacaagagaactgctttaacatatattgacagcaatggcaactggcaccgtgccagcaagggagctcctgagcagattttggacctatgtaactgtaaggaagatgtcaggagaaaggttcattcaatgatcgacaaatacgctgagcgtgggttgaggtcactggctgtagctagacaggaagtgccagagaaatcaaaagagagcactggaggtccatggcaatttgttggattgctacccctctttgatcctcccaggcatgatagtgctgagaccatccgtagagctctcaaccttggtgtaaatgttaagatgatcactggggatcaattggctattgccaaggagactggccgtaggcttggaatgggaacaaacatgtacccatcagcatctttacttggtcaagacaaggattcatctattgcttcacttcctgtagaagagttgattgagaaggcagatggatttgctggagtatttcctgagcacaaatatgagattgtgaagaagttgcaggagagaaagcacattgtgggaatgactggtgatggtgtgaacgatgctcctgctttgaagaaggcagatatcggtatcgctgttgcagatgctactgatgcagcacgaggtgcttctgatatcgtgctcactgagccaggtctaagcgttatcatcagtgctgtgttgaccagtagagctattttccagaggatgaagaattacacaatatatgcagtttccatcacaatccgtattgtgtttggtttcatgcttattgctctaatctggaagtacgacttctctgcatttatggttttgatcattgccatcctaaatgacggaaccattatgacaatctcaaaggatagagtgaaaccatctccaatgcctgatagctggaagttgaatgaaatctttgcaactggtgttgttcttggagggtaccaagcattgatgactgttattttcttctgggcgatgcatgacactagtttcttcacggacaaatttggtgtgaaggatattagggaaagtgatgaagaaatgatgtctgctttgtaccttcaagtgagtattatcagccaggctttgattttcgtgacccgttcacgaagctggtccttcgttgaacgtccaggagctctgttaatgattgctttcttgattgcccaattggttgccactttaattgctgtctatgccgactggacttttgcaagagtcaaaggatgtggatggggatgggctggtgtcatctggattttcagcattgttacctacttcccacttgacataatgaaattcgccatccgttacatcttaagtggaaaggcttggaataacttgcttgacaacaagactgctttcaccacaaagaaagactatggaaaagaagaaagggaagctcaatgggcacttgctcagagaactttacatggacttcaaccaccagaagcatcaaacctgttcaacgaaaagaacagctaccgggaactgtctgaaattgctgaacaagcaaagagaagagcagagatggcaaggcttcgtgagttgcacacactcaagggtcatgttgaatcagtggtgaagctgaaaggtctggatatcgaaacgatccagcagcattatacagtttaagaaagataatcatgatacacacaagaaaagggaatggcaggctctgatatatctcatgttaattattaattagagaagaagagagagacaagcttttggccttaaccacataaacaaaaaaacattgtcttttaatataaagggggaaaacattgtcttgtgttgtctttcccccctctcatctattttctttaacttcgttatgttatattttgaagcaccacccattgaaagggattgtgtccatgttttttccaaaattttaatggtgaagtgacatttccttgtaacaacagtttttcttacaatttcttcacctctttttttctttcttcatttgatgttgacgataacgtctctctctctctgcttttttgcacattcactgttgtatgtgacccttgatgaaaataatattactcaaacactgaatttctttttctcttctaacttgtttgttgttaa

SEQ ID NO: 1002 - DNA, 1450 bp, Triticum aestivum
ccttctataaacgggacccaagggacgcagtttctcatcgccccgtccagaacctttctccttctgtcccgcaaacccccgagagatcacagcatgttcggcttcggtcaccacggccaccatggccagaaccccccggcccacgctccggccgccgccggcggcaaccagcccaccttcaagatcttctgcaaggccgacgagggctactgcctctccgtccgcgacggcaacgtcgtcctcgccccctccaacccccgcgacgagcaccagcactggttcaaggacatgcgcttcagcacccagatcaaggacgaggagggtaaccccgccttcgccatcgtcaacaaggccactggcctcgccgtcaagcactccctcggccagtcccacccggtgaagctcgtgccattcaacccggagtacctcgacgagtccgtgatgtggacggagagcggcgacgtcggcaagggcttccgctgcattcgcatggtgaacaacatccgcctcaacttcgacgccctcaacggcgacaaggaccacggcggcgtgcacgacggcaccaccgtcgtcctctgggagtgggccaagggcgacaaccagagctggaagatcctcccctggggcgaagaggcctacgccggaggcagcgccaacgccccccgcggcggctcctcagagcccaccgtgcgcatcttctgcaaggccgacgacggcttcagcgccaccgtccgcaacggcgctgtggtcctcgcgcccaccaacccccgcgacgagtaccagcactggttcaaggacatgaggcacagcaaccgcatcaaggatgaggaaggctacccggccttcgccctcgtcaacaaggtgacaggcgaggccatcaagcactcccaaggcgagggccaccctgtgaagctggtgccatacaacgccaactaccaggacgagtcagtgttgtggactgagagccgcgacgtgggcgccggcttccggtgcatccgcatggtgaacaacatctacctcaactttgacgctctccacggcgacaaggagcacggcggcgtgcgcgacggcacctccctcgtgctgtggaagtggtgcgagggcgacaaccagcgctggaagatcctcccctggtaaacgtgtcatgctgctgaagctgagttgatcgccaccgtgacccggagttggtagagatcggcctgtgatctgttgccgtgtcggtagaataaaagtcgtgtgcggtcggcggtggtgatgtgtccgtgagtgtgtgtgcttagtttctgtcctgtcgttgtgtcctgctatggcgagctatccgatgtaataagcatttggcacttgtgcttgtttttcaaaccatggatccgtgatgagaacctctgtactgtggtgcaatcctttcatctatgcgaatggtctttactgtctaaaaaaaaaaaaaacaaac

SEQ ID NO: 1003 - DNA, 1379 bp, Pseudoroegneria spicata
aaacctttctctttctcccccgagacatcacagcatgttcggcttcggtcaccacggccaccatgaccagaaccccccggcccacgctccggccgccgccggcggcaaccagcccaccttcaagatcttctgcaaggccgacgagggctactgcctctccgtccgcgacggcaacgtcgtcctcgccccctccaacccccgcgacgagcaccagcactggttcaaggacatgcgcttcagcacccagatcaaggacgaggaaggtaaccccgccttcgccatcgtcaacaaggccactggcctcgccgtcaagcactccctcggccagtcccacccggtgaagctcgtgccattcaacccggagttcctcgacgagtccgtgatgtggacggagagcggcgacgtcggcaagggcttccggtgcattcgcatggtgaacaacatccgcctcaacttcgacgccctcaacggcgacaaggaccacggcggcgtgcacgacggcaccaccgtcgtcctctgggagtgggccaagggcgacaaccagagctggaagatcctcccctggggcgaagaggcctacaccggaggcagcgccaacgccccccgcggcggctcctcagagcccaccgtgcgcatcttctgcaaggccgacgacggcttcagcgccaccgtccgcaacggcactgtcgtcctcgcgcccaccaacccccgcgacgagtaccagcactggttcaaggacatgaggcacagcaaccgcatcaaggatgaggaaggctacccggccttcgccctcgtcaataaggtgacaggcgaggccatcaagcactcccaaggcgagggccaccctgtgaagctggtgccatacaacgcgaactacgaggacgagtcagtgttatggactgagagccgcgacgtcggcgctggcttccgctgcatccgcatggtgaacaacatctacctcaactttgacgctctgcacggcgataaggagcacggcggcgtgcgcgacggcacctccctcgtgctgtggaagtggtgcgagggcgacaaccagcgctggaagatcctcccctggtaaacgtgtcatgctgctgaagctgccttgatcgccaccgtgacccggagttggtagagatcggcctgtgatctgttgccgtgtcggtagaataaaagtcgtgtgcggtcggtggtggtgatgtgtccgtgagtgtgtgtgtgtttagtttctgtcctgtcgttgtgtcctgctatggtgagctatccgatgtaagcatttggcacttgtgcttgtttttcaaaccacggatccgtgatgagaacctctgtactgtgtgcaatcctttcatccatctatgcgaatggtctttattgtctataaa

SEQ ID NO: 1004 - DNA, 1407 bp, Leymus cinereus x Leymus triticoides
aaaacctttctccttccggacagttcaaccctctccccgcaaacccccgagagatcacaggatgttcggcttcggtcaccacggccaccatggccagaaccccccggcccacgctccgtccgccggcggcggcaaccagcccaccttcaagatcttctgtaaggccgacgagggctactgcctctccgtccgcgacggcaacgtcgtcctcgccccctccaacccccgcgacgagcaccagcactggttcaaggacatgcgcttcagcacccagatcaaggacgaggagggtaaccccgccttcgccatcgtcaacaaggccactggcctcgccgtcaagcactccctcggccagtcccacccggtgaagctcgtgccatttaacccggagtacctcgacgagtccgtgatgtggacggagagcggcgacgtcggcaagggcttccggtgcattcgcatggtgaacaacattcgcctcaatttcgacgccctcaacggcgacaaggaccacggcggcgtgcacgacggcaccaccgtcgtcctctgggagtgggcaaagggcgacaaccagagctggaagatcctcccctggggcgaagaggcctacgccggaggcagcgccaacgccccacgcggcggctcctcagagcccaccgtgcgcatcttctgcaaggccgacgagggcttcagcgccaccgtccgcaacggcgctgtcgtcctcgcgcccaccaacccccgcgacgagtaccagcactggttcaaggacatgaggcacagcaaccgcatcaaggatgaggaaggttacccggccttcgccctcgtcaacaaggtgacaggcgaggccatcaagcactcccaaggcgagggtcaccctgtgaagctggtgccatacaacccgaactaccaggacgagtcggtgatgtggactgagagccgcgacgtgggcgccagcttccggtgcatccgcatggtgaacaacatctacctcaactttgacgctctgcacggcgacaaggagcacggcggcgtgcgcgacggcacctccctcgtgctgtggaagtggtgcgagggcgacaaccagcgctggaagatcctcccctggtagacgtgtcatgctgctgaagctgcattgatcgccaccgtgacccggagttggtagagaccagcctgtgatctgttgccgtgtcggtagaataaaagtcctgtgcggtcagtggtggtgatgtgtccgtgagtgtgtgtttgtgtgtttagtttctgtcctgtcgttatgtcctgctatggtgagctatccgatgtaagcatttggcacttgtgcttgtttttcagaccatggatccgtgatgagaacccctctactgtggtgcaatcctttcatatatgcgaatggtctttattgtctatgta

SEQ ID NO: 1005 - DNA, 1399 bp, Leymus cinereus x Leymus triticoides
ctgtccccgcaaacccccgagagatcacaggatgttcggcctcggtcaccacggccaccatggccagaaccccccggcccacgctccgcccgccgccggcggcaaccagcccaccttcaagatcttctgcaaggccgacgagggctactgcctctccgtccgcgacggcaacgtcgtcctcgccccctccaacccccgcgacgagcatcagcactggttcaaggacatgcgcttcagcacccagatgaaggacgaggagggtaaccccgccttcgccatcgtcaacaaggccactggcctcgccgtcaagcactccctcggccagtcccacccggtgaagctcgtgccattcaacccggagtacctggacgagtccgtgatgtggacggagagcggcgacgtcggcaagggcttccgctgcattcgtatggtgaacaacatccgcctcaatttcgacgccctcaacggcgacaaggaccacggcggcgtgcacgacggcaccaccgtcgtcctctgggagtgggccaagggcgataaccagagctggaagatcctcccctggggcgaagaggcctacgccggaggcagcgccaacgccccccgcggcggctcctcagagcccaccgtgcgcatcttctgcaaggccgacgagggcttcagcgccaccgtccggaacggcactgtcgtcctcgcgcccaccaacccccgcgacgagcaccagcactggttcaaggacatgaggcacagcaaccgcatcaaggatgaggaaggctacccggccttcgccctcgtcaacaaggtgacaggcgaggccatcaagcactcccaaggcgagggtcaccctgtgaagctggtgccatacaacccgaactaccaggacgagtcggtgatgtggactgagagccgcgacgtcggcgccggcttccggtgcatccgcatggtgaacaacatctacctcaactttgacgctcaccacggcgacaaggaccacggcggcgtgcgcgacggcacctccctcgtgctgtggaagtggtgcgagggcgacaaccagcgctggaagatcctcccctggtaaacgtgtcatgcagctgaagctgcattgatcgccaccgtgacccggagttggtagagatcggcctgtgatctgttgccgtgtcggtagaataaaagtcctgtgcggtcagtggcggtgatgtgtccgtgagtgtgtgtttagtttctgtcctgtcgttgtgtcctgctaatgcgagagtgaggagaggtaaagttccccgttatggtgagctatccgatgtaagcatttggcacttgtgcttgtttttcagaccatggatccgtgataagaacctctgtactgtggtgcaaacctttcatctatgcgaatggtctttattgtcta

SEQ ID NO: 1006 - DNA, 1516 bp, Brachypodium distachyon
cgcagtttctcatcgccccgtccaaaaccttccttcttcctgacttcacacaatccaaccctcccccaaaaccccgagaagatcgaagatgttcggcttcggtcaccacggccaccatggccagaacccaccggcccacgccccaactaccgccggcggccaccagcccaccttcaagatcttctgcaaggccgacgagggttactgcctctccgtccgcgacggcaacgtcgtcctcgcccccaccaacccccgcgacgagcaccagcactggttcaaggacatgcgcttcagcaccaacatcaaggacgaggagaacaaccccgccttcgcgctcgtcaacaaggccactggtctcgccgtgaagcactccctgggccagagccacccggtgaagctggtgccgttcaacccggatttccaagatgagtccgtgctgtggacggagagcggcgacgtcggcaagggcttccgctgcatccgcatggtgaacaacatccgcctcaacttcgacgccctcaacggcgacaaggaccacggcggtgtgcacgacggcaccaccgttgtcctctgggagtgggccaagggcgacaaccagagctggaagatcctcccctggggcgacgaggcctacgccggcggcagcgccaacgcgccccgcggcggcccctctgagcccaccgtccgcatcttctgcaaggctgacgagggcttcagcgccaccgtccgcaacggcaccgtctgcctcgcgcccaccaacccccgcgacgaccaccagcactggatcaaggacatgaggcacagcaaccgcatcaaggacgaggaaggctaccccgccttcgccctcgtcaacaaggtcactggcgaggccatcaagcactcccagggggagggtcaccctgtgaagctggtgccgtacaacccgaactaccaggacgagtcggtgctgtggaccgagagccgcgacgtgggtgccggcttccggtgcatccgcatggtgaacaacatctacctcaacttcgacgccctccacggcgacaaggaccacggcggcgtgcgcgacggcacctccctcgtgctctggaagtggtgcgagggcgacaaccagcgctggaagatcctcccctggtaaacgtgtcgctgcattggtcaccaccgtgatctggatggagttggtagagatcagcctacgatctgctgccgtgtcgctagaataaaagtcccgatcgatcagcggtggcggcggtctgtccgtgtctgcgtgtgatttagtttcagtctttgtcgtcgagtcctgctttctgtgagagaaaggagagaggagttgtgtgtttcggtgagctctctgctgtgagcatttggcatttgtactgcttgttcttcggaacccggatccgtgatgagtgccatcctttcatctatgcgaatggtctttgtcatgtgtttccttttcctaaatacttatctaagatggtgacaggtatttagaaatggaatgaatatgtttttgctctgc

SEQ ID NO: 1007 - DNA, 1404 bp, Saccharum officinarum
cctccatctgctagttcgtctgatcaagcgatccacccaaccctccccaaaaccccgaggagagaagagctcgagaagatgttcggcttcgggcaccacggccaccacggccagaacccgccggcgcaccccccggcccacggcggcgtgcaccagcccaccttcaagatcttctgcaaggccgacgaggggtactgcctcaccgtccgcgacggcaacgtggtgctggcccccgccaacccgcgcgacgagcatcagcactggtacaaggacatgcgcttcagcaaccagatcaaggacgaggagggcaaccctgcgttcgccctcgtcaacaaggccacggggctcgccatcaagcactcactcggccagtcccatccggtgaagctggtgccgttcaacccggagtaccaggacgagtcggtgctgtggacggagagcggcgacgtgggcaagggcttccgctgcatccgcatggtgaacaacatccgcctcaacttcgacgccttccacggcgacaagggccacggcggcgtgcacgacggcaccaccgtcgtgctctgggagtgggccaagggcgacaaccagagctggaagatcctgccctggggcgacgaggcctacgccgcgggcggcagcgccgccgccaacgcgccctacggccacggcgggggcgagcccacggtccgcatctactgcaaggcggacgacgggttcagcgtcaccgtccgcaacggcaccgtctgcctggcgcccaccaacccgcgcgacgagtaccagcactgggtcaaggacatgcgccacagcaacagcatcaaggacgaggaagggtacccggcgttcgcgctcgtgaaccgggtcaccggcgaggccatcaagcactcccagggcgagggccacccggtgaagctggtgccgtacaaccccaactaccaggacgagtcggtgctgtggacggagagccgcgacgtcgggcacggcttccgctgcatccgcatggtgaacaacatctacctcaacttcgacgccttccatggcgacaaggaccacggcggggtgcgcgacggcaccgccgtcgtgctctggaagtggtgcgagggcgacaaccagcgctggaagatcgtcccctggtaaatgtgctgtgctggggctgcattggtcatcacccggatctggagttggagttggagagcacagccacctgtggtcagcatttgctgccgtgtttctataataaaattgggtgcaatcgaatctgggtgaaggactgattgtgtggctggtgtttaaattcaatcctgtgttcttgcttcctgtgtgaaggaaaaaaaaagggtcctccttcttggtgagctgatctcaataagctattctcccatattagcttgtattgcagagtgagaa

SEQ ID NO: 1008 - DNA, 1471 bp, Saccharum officinarum
cccaaatcctccatctgctagttcgtctgatcaagcgatccacccaaccctccccaaaaccccgaggagagaagagctcgagaagatgttcggcttcgggcaccacggccaccacggccagaacccgccggcgcaccccccggcccacggcggcgtgcaccagcccaccttcaagatcttctgcaaggccgacgaggggtactgcctcaccgtccgcgacggcaacgtggtgctggcccccgccaacccgcgcgacgagcaccagcactggtacaaggacatgcgcttcagcaaccagatcaaggacgaggagggcaaccctgcgttcgccctcgtcaacaaggccacggggctcgccatcaagcactcactcggccagtcccatccggtgaagctggtgccgttcaacccggagtaccaggacgagtcggtgctgtggacggagagcggcgacgtgggcaagggcttccgctgcatccgcatggtgaacaacatccgcctcaacttcgacgccttccacggcgacaagggccacggcggcgtgcacgacggcaccaccgtcgtgctctgggagtgggccaagggcgacaaccagagctggaagatcctgccctggggcgacgaggcctacgccgcgggcggcagcgccgccgccaacgcgccctacggccacggcgggggcgagcccacggtccgcatctactgcaaggcggacgacgggttcagcgtcaccgtccgcaacggcaccgtctgcctggcgcccaccaacccgcgcgacgagtaccagcactgggtcaaggacatgcgccacagcaacagcatcaaggacgaggaagggtacccggcgttcgcgctcgtgaaccgggtcaccggcgaggccatcaagcactcccagggcgagggccacccggtgaagctggtgccgtacaaccccaactaccaggacgagtcggtgctgtggacggagagccgcgacgtcgggcacggcttccgctgcatccgcatggtgaacaacatctacctcaacttcgacgccttccatggcgacaaggaccacggcggggtgcgcgacggcaccgccgtcgtgctctggaagtggtgcgagggcgacaaccagcgctggaagatcgtcccctggtaaatgtgtggtgctggggctgcattggtcatcacccggatctggagttggagttggagagcacagccacccgtggtcggcagctgctgccgtgtttttagaataaagctggtgtgcgatcgatctgcggtgattgtgtgtctgtgtctgtgtgtttagttccaatcgtgtgttctgcttccgtgagagaggagagtgagagggggtacttcctcggtgagcttatctcaccaagcattcccccatctgagcttgttatgcagagttttcagtcctggagtgtaactctgtactgtactcggaaccttcccttttatcttaagtgggttttat

SEQ ID NO: 1009 - DNA, 1488 bp, Saccharum officinarum
cccaaatcctccatctgctagttcgtctgatcaagcgatccacccaaccctccccaaaaccccgaggagagaagagctcgagaagatgttcggcttcgggcaccacggccaccacggccagaacccgccggcgcaccccccggcccacggtggcgtgcaccagcccaccttcaagatcttctgcaaggccgacgaggggtactgcctcaccgtccgcgacggcaacgtggtgctggcccccgccaacccgcgcgacgagcaccagcactggtacaaggacatgcgcttcagcaaccagatcaaggacgaggagggcaaccctgcgttcgccctcgtcaacaaggccacggggctcgccatcaagcactcactcggccagtcccatccggtgaagctggtgccgttcaacccggagtaccaagacgagtctgtgctgtggacggagagcggcgacgtgggcaagggcttccgctgcatccgcatggtgaacaacatccgcctcaacttcgacgccttccacggcgacaagggccacggcggcgtgcacgacggcaccaccgtcgtgctctgggagtgggccaagggcgacaaccagagctggaagatcctgccctggggcgacgaggcctacgccgcgggcggcagcgccgccgccaacgcgccctacggccacggcgggggcgagcccacggtccgcatctactgcaaggcggacgacgggttcagcgtcaccgtccgcaacggcaccgtctgcctggcgcccaccaacccgcgcgatgagtaccagcactgggtcaaggacatgcgccacagcaacagcatcaaggacgaggaagggtacccggcgttcgcgctcgtgaacagggtcaccggcgaggccatcaagcactcccagggcgagggccacccggtgaagctggtgccgtacaaccccagctaccaggacgagtcggtgctgtggaccgagagccgcgacgtcgggcacggcttccgctgcatccgcatggtgaacaacatctacctcaacttcgacgccttccacggcgacaaggaccacggcggggtgcgcgacggcaccgccgtcgtgctctggaagtggtgcgagggcgacaaccagcgctggaagatcgtcccctggtaaatgtgctgtgctggggctgcattggtcatcaccgggatctggagttggagttggagagcacagccacctgtggtcagcagctgctgccgtgttgctagaataaagttggtggcgatcgatctgtggtgatggactgatggtgtgtctgtgtctgtgttttagttcaatcgtgtgttctgcttccgtgtgtgaggagagtgagaggggtactccttcctcggtgagcttatctcactaagcattcccccatctgagcttgttatgcagagtgagagagtaatcagacctggagtgtaactctgtactgtactcggatctttcctttttatccaagtgggttttatttt

SEQ ID NO: 1010 - DNA, 1536 bp, Sorghum bicolor
ggctcacagtttctcatcgccccgtcccaaatcctccacactgttcgatccacccaaccctccccaaaacccccgaccgaggagagtagagcgcgagaagatgttcggcttcgggcaccacggccaccaccacggcgagaacccgccggcgcaccctcctgcccacggcggcgtgcacccgcccaccttcaagatcttctgcaaggccgacgaggggtactgcctcaccgtccgcgacggcaacgtggtgctggccccctccaacccgcgcgacgagcaccagcactggtacaaggacatgcgcttcagcaaccagatcaaggacgaggaaggcaaccctgcgttcgccctcgtcaacaaggccacgggcctcgccatcaagcactccctcggccagtcccacccggtgaagctggtgccgttcaacccggagtaccaggacgagtcggtgctgtggacggagagcggcgacgttggcaagggcttccgctgcatccgcatggtgaacaacatccggctcaacttcgacgccttccacggcgacaaggaccacggcggcgtgcacgacggcaccaccgtggtgctgtgggagtgggccaagggcgacaaccagagctggaagatcctcccctggggcgacgaggcctacgccggcggcagcggcggcgccgccgccaacgcgccgtacggccacggcgagccgacggtccgcatctactgcaaggcggacgacgggttcagcgtgaccgtccgcaacggcagcgtgtgcctggcgccgacgaacccgcgcgacgagtaccagcactgggtcaaggacatgcggcacagcaaccgcatcaaggacgaggaagggtacccggcgttcgcgctcgtgaacagggtcaccggcgaggccatcaagcactcgcagggcgagggccacccggtgaagctggtgccgtacaacccaaactaccaggacgagtcggtgctgtggaccgagagccgcgacgtcggccacgggttccgctgcatccgcatggtgaacaacatctacctcaacttcgacgccttccacggcgacaaggaccacggcggggtgcgcgacggcaccgccgtcgtgctctggaagtggtgcgagggcgacaaccagcgctggaagatcgtcccctggtaaatgtgcggtgctggggctgcattggtcatcacccaagatctggagatggagttggagagcacagccacctgtggtcagcagctgctgctgctgccgtgttgttagaataaagctggtgtgcgatcgatccgtggtgatggtgtgtctttgtgtgtgttcagtcgtgtgtcctcggagccagtcctgcttccgtgagagaggggtacttcctcggtgagcttatctcacaaagccttaccccatctgaagcttgttatgcagagagagttttcagaccttgagtgttaactctgtgttgtactcggttccttccctttttatctaagtgggttttatcaaccatatctgctcgcggtttagctttgacgttacttgctccc

SEQ ID NO: 1011 - DNA, 1572 bp, Cenchrus ciliaris
tcccaaaccatcctttcgttttcctgtacctgatcaagcgatcaattgcaaaaccctccgacgaccgttgagcgcaagatgttcggcttcgggcaccaccaccacggccaccacggccagaaccccccggctcccggcggccaccacggcggcggcgcccagcagcccaccttcaagatcttctgcaaggccgatgagggctactgcctcaccgtccgcgacggcaacgtggtgcttgcccccgccaacccgcgcgacgcgcaccagcactggtacaaggacatgcgcttcagcacccagatcaaggacgaggagggcaacccggccttcgccctcgtcaaccaggccaccggactcgccatcaagcactccctcggccagtcccacccggtgaagctggtgctgttcaacccggagtacccggatgagtccgtgctgtggacggagagcggcgacgtgggcaagggcttccgctgcatccgcatggtgaacaacatccggctcaacttcgacgccttccacggcgacaaggaccacggcggcgtgcacgacggcaccaccgtcgtgctctgggagtgggccaagggcgacaaccagagctggaagatcctgccgtggggcgacgaggcctacgccggcggcagcgccggcaacgcgtacggccacggcgagcccaccgttcgcatctactgcaaggccgacgaggggttcagtgtcaccgtccgccacggcaccgtctgcctcgcgcccaccaacccgcgcgacgagtaccagcactggatcaaggacatgcgccacagcaacagcatcaaggacgaggagggctacccggccttcgcgctcgtcaacaaggtcaccggcgaggccatcaagcactcccagggcgagggtcaccaggtgaagctggtgccgtacaaccccaactaccaggacgagtcggtgctgtggacggagagccgcgacgtcgggcacggcttccgctgcatccgcatggtgaacaacatctacctcaacttcgacgccttccacggcgacaaggaccacggcggcgtccgcgacggcaccaacatcgtgctctggaagtggtgcgagggcgacaaccagcgctggaagatcgtcccctggtaaacgtgcgggtcccccggcgctgcattggtcatcaccacgacccggagtctgagagatcagccagccacctgcgttctccagctgccatgttgctagaataaagtcgtgtgtgatcgccgatctgtggtgaatggtgatggtgtgtctctgtccgtgtctagtttccagtcgtttccgttgtcgtgcgtcctgcttcagtgcttcgttccgtgagtgagtgagtgaggagggtgagcggggtcttcttccgcggtgagcttgtctgattcagcatccgccgtgcgtgcttgatgtgcagagagtttgagaccagcagtgtttatgtctgtaccgtgctcggatcattttcttatatccaagtgggttttatcatccgtatatcttgtaaccttgctccgctaaagatgtgttgttgctccttaaaatttgttggacttgcggtga

SEQ ID NO: 1012 - DNA, 1555 bp, Zea mays
gccccgtcccaaatcccctgtcccgctagcggctagtccgaccaggcgatccccccccaaaccctcccccaaaaccccagagcggagaagagcgcaagatgttcggcttcgggcaccacggccagaacccgccggctcacggcggcgtgcaccagcccaccttcaagatcttctgcaaggccgacgaggggtactgcctcaccgtccgcgacggcaacgtggtgctggcccccgccaacccgcgcgacgagcaccagcactggtacaaggacatgcgcttcagcacccaggtcaaggacgaggagggcaaccctgcgttcgccctggtcaacaaggccactgggctcgccatcaagcactccctcggccagtcccacccggtgaagctggtgccgttcaacccggagtaccaggacgagtcggtgctgtggacggagagcggcgacgtgggcaagggcttccgctgcatccgcatggtgaacaacatccgcctcaacttcgacgccttccacggcgacaagggccacggcggcgtgcacgacggcaccaccgtggtgctgtgggagtgggccaagggcgacaaccagagctggaagatcctgccctggggcgacgaggcctacgccgcgggaggcagcagcgccgccaacgcgccccgcttcggcggcggcggcgagcccaccgtccgcatctactgcaaggccgacgaggggttcagcgccacggtccgcaacggcgccgtgtgcctcgcgcccaccaacccgcgcgacgagtaccagcactggatcaaggacatgcgccacagcaacagcgtcaaggacgaggaagggtacccggccttcgcgctcgtcaacagggtcaccggcgaggccatcaagcactcccagggcgagggccacccggtcaagctggtgccctacaaccccggctaccaggacgagtcggtgctgtggacggagagccgcgacgtcggccacggcttccgctgcgtccgcatggtcaacaacatctacctcaacttcgacgccttccacggcgacaaggaccacggcggcgtgcgcgacggcaccaacatcgtgctctggaagtggtgcgagggcgacaaccagcgctggaagatcgtcccctggtaaatgtgctgttctgtggctgcactggtcatcaccatgatctggagctttgaaggcatagccacctgtggtcagcagctgctgccgtgttgttagaataaagttggtggcgatcgatcgatcgatctgtggtgatgggtgtccctctctgtgtgtttgtgtttagttcccagtcgtttgtgaggaagtcagttatgtttgagtgaggggggggggggggaggggtacttcgctcttcggttaactctgtacttgtcatgaggagagttttcatacccggagtgtagaactctgtactgtactcggatccttcctttttcatcgaagtgggttttattttatcaaccgtatctatactcgtggttttgctattacgttgcttgcttccagtcgttccagccaaagattaccacgcactctggtca

SEQ ID NO: 1013 - DNA, 1541 bp, Zea mays
gccccgtcccaaatcccctgtcccgctagcggctagtccgaccaggcgatccccccccaaaccctcccccaaaaccccagagcggagaagagcgcaagatgttcggcttcgggcaccacggccagaacccgccggctcacggcggcgtgcaccagcccaccttcaagatcttctgcaaggccgacgaggggtactgcctcaccgtccgcgacggcaacgtggtgctggcccccgccaacccgcgcgacgagcaccagcactggtacaaggacatgcgcttcagcacccaggtcaaggacgaggagggcaaccctgcgttcgccctggtcaacaaggccactgggctcgccatcaagcactccctcggccagtcccacccggtgaagctggtgccgttcaacccggagtaccaggacgagtcggtgctgtggacggagagcggcgacgtgggcaagggcttccgctgcatccgcatggtgaacaacatccgcctcaacttcgacgccttccacggcgacaagggccacggcggcgtgcacgacggcaccaccgtggtgctgtgggagtgggccaagggcgacaaccagagctggaagatcctgccctggggcgacgaggcctacgccgcgggaggcagcagcgccgccaacgcgccccgcttcggcggcggcggcgagcccaccgtccgcatctactgcaaggccgacgaggggttcagcgccacggtccgcaacggcgccgtgtgcctcgcgcccaccaacccgcgcgacgagtaccagcactggatcaaggacatgcgccacagcaacagcgtcaaggacgaggaagggtacccggccttcgcgctcgtcaacagggtcaccggcgaggccatcaagcactcccagggcgagggccacccggtcaagctggtgccctacaaccccggctaccaggacgagtcggtgctgtggacggagagccgcgacgtcggccacggcttccgctgcgtccgcatggtcaacaacatctacctcaacttcgacgccttccacggcgacaaggaccacggcggcgtgcgcgacggcaccaacatcgtgctctggaagtggtgcgagggcgacaaccagcgctggaagatcgtcccctggtaaatgtgctgttctgtggctgcactggtcatcaccatgatctggagctttgaaggcatagccacctgtggtcagcagctgctgccgtgttgttagaataaagttggtggcgatcgatcgatcgatctgtggtgatgggtgtccctatctgtgtgtttgtgtttagttccagtcgtttgtgaggaagtcagttatgtttgagtgagaggggtacttcgctcttcggttaactctgtacttgtcatgaggagagttttcatacccggagtgtagaactctgtactgtactcggatccttcctttttcatcgaagtgggttttattttatcaaccgtatctatactcgtggttttgctattacgttgcttgcttccagtcgttccagccaaagattaccacgcactctggtca

SEQ ID NO: 1014 - DNA, 1539 bp, Panicum virgatum
atcctctgttctctcttgtccccgatcaggcgattcacccacccaaccctcccaaacccccccgacgagcgagatgttcggcttcgggcaccacggccaccacggccagaacccgccggcgcacccgccggcacccggcccccacggcggcgccgcgcaccagcccaccttcaagatcttctgcaaggccgatgagggctactgcctcaccgtccgcgacggcaacgtggtgctcgcccccgccaacccgcgcgacgagcaccagcactggtacaaggacatgcgcttcagcgcccaggtcaaggacgaggagggcaacccggccttcgccctcgtcaacaaggccacggggctcgccatcaagcactccctcggccagtcccacccggtgaagctggtgcccttcaacccggagtaccaggacgagtccgtgctgtggaccgagagcggcgacgtcggcaagggcttccgctgcatccgcatggtgaacaacatccgcctcaacttcgacgccttccacggcgacaaggaccacggcggcgtgcacgacggcaccgccgtcgtgctctgggagtgggccaagggcgccaaccagagctggaagatcctgccgtggggcgacgaggcctacgccggcggcagcagcgccgccaacgcgccccgtggcggtggctacggccacggcgagcccaccgtccgcatctactgcaaggccgacgaggggttcagcgtcaccgtccgcaacggcgccgtgtgcctggcgcccaccaacccgcgcgacgagttccagcactggattaaggacatgcgccacagcaacagcatcaaggacgaggagggctacccggccttcgcgctcgtcaacagggtcaccggcgaggccatcaagcactcccagggcgagggccaccaggtgaagctggtgccgtacaaccccaactaccaggacgagtcggtgctgtggacggagagccgcgacgtcgggcacggcttccgctgcatccgcatggtgaacaacatctacctcaacttcgacgccttccacggcgacaaggaccacggcggggtgcgcgacggcaccaacatcgtgctctggaagtggtgcgagggcgacaaccagcgctggaagatcgtcccctggtaaatgcgctgtgccggggctgcattggtcatcaccatgatctggtggagttggagagatcaccctgccagccggccacctgtggtctcccgctgcctgccatgtcgctagaataaagtcgtgtgtgatcgatctgcggtgatggtgtgtctgtgtccgcgtttagtcttcggtcgtgtcgtgtcgttcgtcgccggtcctgcttccatcattccgtgaggggagtgagagtggttgttcctcggtgagcttgtctgatcgagcgtccgccatgtgtggttgctgtgcagagtgtggttgctgtgcagagagtttcagacccggagtgagtgttcaactctgtaatgtactcggatcctttgcttctatcccagtgggttctaccatccatttctagc

SEQ ID NO: 1015 - DNA, 1517 bp, Panicum virgatum
ccaaatcctctgttctcttgtccccgatcaggccaggcgattcatccacccaaccctcccaaaaccccccgacgagcgagatgttcggcttcgggcaccacggccaccacggccagaacccgccgccccccggcccccacggcggcggcgcgcaccagcccaccttcaagatcctctgcaaggccgatgagggctactgcctcaccgtccgcgacggcaacgtggtgctcgcccccgccaacccgcgcgacgagcaccagcactggtacaaggacatgcgcttcagcacccaggtcaaggacgaggagggcaacccggccttcgccctcgtcaacaaggccacggggctcgccatcaagcactccctcggccagtcccacccggtgaagctggtgcccttcaacccgcagtaccaggacgagtccgtgctgtggaccgagagcggcgacgtcggcaagggcttccgctgcatccgcatggtgaacaacatccgcctcaacttcgacgccttccacggcgacaaggaccacggcggcgtgcacgacggcaccggcgtcgtgctctgggagtgggccaagggcgacaaccagcgctggaagatcctgccgtggggcgacgaggcctacgccggcggcagcgccgccaacgcgccccacggcggccacggccacggcgagcccaccgtccgcatctactgcaaggccgacgaggggttcagcgtcaccgtccgcaacggcgccgtgtgcctggcgcccaccaacccgcgcgacgagttccagcactggatcaaggacatgcgccacagcaacagcatcaaggacgaggagggctacccggccttcgcgctcgtcaacagggtcaccggcgaggccatcaagcactccctgggcgagggccaccaggtgaagctggtgccgtacaaccccaactaccaggacgagtcggtgctgtggacggagagccgcgacgtcgggcacggcttccgctgcatccgcatggtgaacaacatctacctcaacttcgacgccttccacggcgacaaggaccacggcggggtgcgcgacggcaccaacatcgtgctctggaagtggtgcgagggcgacaaccagcgctggaagatcgtcccctggtaaatgcgctgtgccggggctgcattggtcatcaccatgatctggagttggagagatcaccctaccagccagccacctgtggtctcccgctgccatgtcactagaataaagtcgtgtgtgagatcgatctgcggtgatggtgtgtctatgtccgcgtttagtctttcggtcgtgtcgtttcgtgcgtcgtcggtcctggttccttcattccgtgaggggagtgagagtggttcttcctcggcgagcttgtctgatcgagcgtccgccatgcgtgcttgctgtgcagagagtttcagacccggagtcttcatctctgcaatgtactcggatcctttgcttctatccaagtgggctctgccatccatgtctaaaaaaaaaagatcgcga

SEQ ID NO: 1016 - DNA, 2050 bp, Oryza sativa
agctcatccgtaatcacgtaatcacgcccagcatccagaacgttcctccggtctggaccccacacgccatggacacgaggcaccccacaccacaccacgcgtttcgtctcacccgggattttttttttccttcactccaagcagtaaatcagtaacaaatgggcagtaaatcccttctataaatggggacccccaaggaggcgcagcttctcatcgcctcgtctcacgtttgatccatcacactcacacaacacaaccctccccaaaacctcccgaagcgagcaagatgttcggcttcgggcaccacggccaccatggccaagaccagccgccccagcaccacggcggcggcggcggcggcgcgcaccagcccaccttcaagatcttctgccgcgccgacgaggggtactgcgtcgccgtgcgcgaggggaacgtcgtcctcgccccgaccaacccgcgcgacgagcaccagcactggtacaaggacatgcgcttcagcgccaagatcaaggacgaggagggcaacccggcgttcgcgctcgtcaacaaggccaccggcctcgccatcaagcactccctcggccagggccacccggtgaagctggcgccgttcaacccggagtacccggacgagtcggtgctgtggacggagagcggcgacgtgggcaagagcttccgctgcattcgcatgctgaacaacatccgcctcaacttcgacgcgttccacggcgacaaggaccacggcggcgtgcacgacggcaccaccatcgtgctctgggagtgggccaagggcgacaaccagtgctggaagatcctcccctggggcgacgaggcctacgccggcggcagcgccaacgcaccccgcggcggcaacgagcccaccgtccgcatcttctgcaaggccgacgagggcttcagcgtcaccgtccgcggcggctccgtctgcctcgcccccaccaaccctcgcgacgagtaccagcactggatcaaggacatgaggcacagcaacagcatcaaggacgaggaaggctaccccgccttcgccctcgtcaacagggtcaccggcgaggccatcaagcactcccaaggcgaaggccaccctgtgaagctggtgccgtacaaccccggataccaggacgagtcggtgctgtggacggagagccgcgacgtcgggcacggcttccgctgcatccgcatggtgaacaacatctacctcaacttcgacgccctccacggcgacaaggaccacggcggcgtccgcgacggcaccaccgtcgcgctctggaagtggtgcgagggcgacaaccagcgctggaagatcgtcccctggtaaatgcggtgtgctggagctgcattggtcgtcgccgtgatctgtggagttgggagagtttgcgcccgtggcctgctgccctctgcctttgttgctagaataaaagtcgtgtgcgatgatcagtggtgatggtcttgtgtctgtgtccgtgtgtaatgcttttagtcgttttctcgagtcctgcttttgtgacaaaatgggggtgagaggagaggtgtcgtttccgtgaactatctcgaaggcgtttggccttgcagcttgttcttcagatgttcggagtttcagaccttttgatgagtaccctgctttatcatttatcagccatgtgtctagttcgatcaatatgcatcctttgaagtggcattggtttgtctttgaggatcaagatcctgtgcagttgttattgtaactgtaacttaagcagttacatgtgcatcacatgatctagaatggaaggccaggatgtgaagtggtactgtagcagagatgtactattatacctgtactgtagcagtcatctagagccactggatctgaaaacggatggccatgattgagtgcagttgctattgtgcagttacaatagcaactgcatttgatctcaatccgtcttggaggattaaggatttgattgctgtctgatgctcgttgctcgttcggaggtgctctggtgaatctttgaggattggctggacgaaatgcacccttgtttagtgcgaa

SEQ ID NO: 1017 - DNA, 1249 bp, Setaria italica
cccaaatcatccattctcctgtccccgatcaagcgatcaacccaaccttcccaaaacccccgacgcccgtagagagcaagatgttcggcttcggccaccacggccaccacggccagaaccccccggctcccggcggccaccacggcggcggcgcccaccagcccaccttcaagatcttctgcaaggccgatgagggctactgcctcaccgtccgcgacggcaacgtggtgctggccccggccagcactggtacaaggacatgcgcttcagctcccaggtcaaggacgaggagggcaacccggccttcgccctcgtcaaccaagccaccggactcgccatcaagcactccctcggccagtcccacccggtgaagctggtgccgttcaacccggagtaccaggacgagtccgtgctgtggactgagagcggcgacgtcggcaagggcttccgctgcatccgcatggtgaacaacatccgcctcaacttcgacgccctccacggcgacaaggaccacggcggcgtgcacgacggcaccaccgtcgtgctctgggagtgggccaagggagacaaccagagctggaagatcctgccgtggggcgacgaggccggcagcgccggcgcgccccgcggcggctacggccacggcgagcccaccgtgcgcatctactgcaaggccgacgaggggttcagcgtcaccgtccgccacggcgccgtctgcctcgcgcccaccaacccgcgcgacgagtaccagcactggatcaaggacatgcgccacagcaacagcatcaaggacgaggagggctacccggccttcgcgctcgtcaacaaggtcaccggcgaggccatcaagcactcccagggcgagggtcaccaggtgaagctggtgccgtacaaccccagctaccaggacgagtccgtgctgtggacggagagccgcgacgtcgggcacggcttccgctgcatccgcatggtgaacaacatctacctcaacttcgacgccttccacggcgacaaggaccacggcggggtgcgcgacggcaccaacatcgtgctctggaagtggtgcgagggcgacaaccagcgctggaagatcgttccctggtgtaaggagtctcaccagtcttactagctgccactgcttttttcctgaatcttgatttcagagagtagaaaatctctgaacatcttaccaacccgcactagaagtttcacaaagcgagtgtcggtagacactgatagcttatctcct

SEQ ID NO: 1018 - DNA, 1458 bp, Saccharum officinarum
  misc_feature (45)..(45): n is a, c, g, or t
  misc_feature (78)..(78): n is a, c, g, or t
  misc_feature (82)..(84): n is a, c, g, or t
  misc_feature (86)..(87): n is a, c, g, or t
  misc_feature (97)..(97): n is a, c, g, or t
  misc_feature (100)..(100): n is a, c, g, or t
  misc_feature (124)..(124): n is a, c, g, or t
  misc_feature (132)..(132): n is a, c, g, or t
  misc_feature (648)..(648): n is a, c, g, or t
  misc_feature (661)..(661): n is a, c, g, or t
  misc_feature (724)..(724): n is a, c, g, or t
  misc_feature (739)..(739): n is a, c, g, or t
  misc_feature (796)..(796): n is a, c, g, or t
  misc_feature (799)..(799): n is a, c, g, or t
  misc_feature (931)..(931): n is a, c, g, or t
  misc_feature (972)..(972): n is a, c, g, or t
  misc_feature (983)..(983): n is a, c, g, or t
atctgatagttcgtctgatcggtcgatccacccaaccctccccanaaccccgaggagagaagagctcgagaagatgtncggnnncnngcaccacggncancacggccagaacccgccggtgcancccccggnccacggcggcgtgcaccagcccaccttcaagatcttctgcaaggccgacgaggggtactgcctcaccgtccgcgacggcaacgtggtgctggcccccgccaacccgcgcgacgagcaccagcactggtacaaggacatgcgcttcagcaaccagatcaaggacgaggagggcaaccctgcgttcgccctcgtcaacaaggccacggggctcgccatcaagcactcactcggccagtcccatccggtgaagctggtgccgttcaacccggagtaccaggacgagtcggtgctgtggacggagagcggcgacgtgggcaagggcttccgctgcatccgcatggtgaacaacatccgcctcaacttcgacgccttccacggcgacaagggccacggcggcgtgcacgacggcaccaccgtcgtgctctgggagtgggccaagggcgacaaccagagctggaagatcctgccctggggccccgaggcgaacgccgcggcgggggcccacgccgccaacgncggcgtgcacccngtgcgcgtcttctgcaaggccggcggcgaggactacagcctgacggtgcgcaacgggacggcntgcctggcgcccacnaacccgcgggacgagtaccagcactggatcaaggacatgcggcacagcacccgggtncgngacgaggaagggtacccggccttcgcgctggtgaacaaggtcaccggcgaggcgctcaagcactccacggggcagggccaccccgtgaagctggtgccctacaacccggagtaccaggacgagtcggtgctntggacggagagccgcgacgtcgggcaacggcttccgctgcntccgcatggtnaacaacatctacctcaacttcgacgccttccatggcgacaaggaccacggcggggtgcgcgacggcaccgccgtcgtgctctggaagtggtgcgagggcgacaaccagcgctggaagatcgtcccctggtaaatgtgttgtgctggggctgcattggtcatcaccgggatctggagttggagttggagagcacagccacctgtggtcagcatctgctgccgtgttgctagaataaagttggtggcgatcgatctgtggtgatggactgatggtgtgtctgtctgtgttttagttcaatcgtgtgttctgcttctgtgtgcgaggagagtgagaggggtactccttccccggtgagcttatctcactaagcattcccccatctgagcttgttatgcagagtgagagtaatcagacctggagtgtaactctgtactgtactcggatccttcctttttatccaagtgggttttatttt

SEQ ID NO: 1019 - DNA, 1791 bp, Triticum aestivum
aaggaacaaagcagaaggctcctccgcacccaagcttcggcaccaattctccgcactctccccttgccgccgggatggacgtgcagatgggcgagccgcaggcggcccctcctcccgccgccgcagcggcggcgccggccccctccaccatccaacatctgaaggagatcgccgcggtgatcgaggcggggtcggtcaccaaggaggtccgccggatctcccgcgccgtccgcctcaccgtcgccctgcgccgccgcctcgccgcccgcgacgtctcggccttcctcgccttcgccctcccggccaacagcgacgcatacgcccgcctcactcccctcctccccaaggaagatgaagctgagatggatattgatgcagcagctccagcaactcagatttctatcaagcatggccttcctgagattgaaatatattgttctttgcttgttctgattttcctcattgatcagaagaaatacgacgaggctaaagcatgcgcaactggaagcattgctcgtctgaagaacttgaacaggagaactgttgatgttttggcttctagactatacttttattattcatatgtgtatgaacttacaaacacccttgctgaaattcgtggtaatctccttgggttacatagaatggcaactttacatcacgatgagcttggtcaggaaaccctgctcaacctgcttctccgcaattacctccactataacttgtatgaccaggcagagaaacttaggtcgaaggcaccacgttttgaagcccattccaaccagcaattctgccggtacctcttctacttggggaaaatcagaacaattcagttggagtacactgatgctaaagaaagcctcctgcaagctgctaggaaggcaccggctgcagctcgtggttttaggattcagtgcaataaatgggctatcatagtaaggctgcttcttggggagatcccagagaggactgttttcatgcagaaaggaatgaaggaagctttggcaccatattttgagcttacaaatgccgtcaggattggcgatttggaactgtttagagctgttgcagacaaatttgcaagcacattcagtgcagacaggactcacaatttgattgtgaggctccgccacaatgtcattcgaactggactacgcaacatcagcatttcatactcgcggatctcccttgctgatattgcgaagaagctaaggctagacactgagaatcctgttgctgatgcggagtgcatcgtagccaaggccataagagatggtgcaattgatgccaccatagaccatgcaaatggctggatggtgtcgaaagaaactggtgatgtctactcgacaaatgaaccccaggctgcattcaactccagaatcgctttctgcctcaacatgcataatgaagcggtcaaggccatgaggttccccccgaattcgcataaggagaaggagagcgctgagaagcgccgagaaaggctccagcaggaggaagagctggcaaagcacatggccgaggaggatgacgatgatttttaagttggtctgttttttgaattgttgattttagatccctgaaatcactgaattctcccctcgagggagatttgaatcatgtaaactttttacatcttctgtaattctatgttgatcagcacttcattggaccgtaaatgtgttttgagtttatcttttctcttcctcgtcgaaactgggttcgaggatctctgtaccatttgaaatccaccttgtccattcaagacttttggtatgtctgtgcttcctgaca

SEQ ID NO: 1020 - DNA, 1721 bp, Triticum aestivum
caagcttcggcaccaattctccgcactctccccttaccgccgggatggacgtgcagatgggcgagccgcaggcggcccctcctcccgccgccgcagcggcggcgccggcgccggccccttccaccatccaacatctgaaggagatcgccgcggtgatcgaggcggggtcggtcaccaaggaggtccgccggatctcccgcgccgtccgcctcaccgtcgccctgcgccgccgcctcgccgcccgcgacgtctcggccttcctcgccttcgccctcccggccaacagcgacgcatacgcccgcctcactcccctcctccccaaggaagatgaagctgagatggatattgatgcagcagctccagcaactcagatttctatcaagcatggccttcctgagattgaaatatattgttctttgcttgttctgattttcctcattgatcagaagaaatacgacgaggctaaagcatgcgcaactggaagcattgctcgtctgaagaacttgaacaggagaactgttgatgttttggcttctagactatacttttattattcgtatgtgtatgaacttacaaacacccttgctgaaattcgtggtaatctccttgggttacatagaatggcaactttacatcacgatgagcttggtcaggaaaccctgctcaacctgcttctccgcaattacctccactataacttgtatgaccaggcagagaaacttaggtcgaaggcaccacgttttgaagcccattccaaccagcaattctgccggtacctcttctacttggggaaaatcagaacaattcagttggagtacactgatgctaaagaaagcctcctgcaagctgctaggaaggcaccggctgcagctcgtggttttaggattcagtgcaataaatgggctatcatagtaaggctgcttcttggggagatcccagagaggactgttttcatgcagaaaggaatgaaggaagctttggcaccatattttgagcttacaaatgccgtcaggattggcgatttggaactgtttagagctgttgcagacaaatttgcaagcacattcagtgcagacaggactcacaatttgattgtgaggctccgccacaatgtcattcgaactggactacgcaacatcagcatttcatactcgcggatctcccttgctgatattgcgaagaagcttaggctagacactgagaatcctgttgctgatgcggagtgcatcgtagccaaggccataagagatggtgcaattgatgccaccatagaccatgcaaatggctggatggtgtcgaaagaaactggtgatgtctactcgacaaatgaaccccaggctgcattcaactccagaatcgctttctgcctcaacatgcataatgaagcggtcaaggccatgaggttccccccgaattctcataaggagaaggagagtgctgagaagcgtcgagaaaggctccagcaggaggaagagctggcaaagcacatggccgaggaggatgacgatgatttttaagttggtctgttttttgaattgttggttttagatccctgaaatcactgagttctcccctcgagggagatttgaatcatgtaaacttttaacatcttctgtaattctatgttgatcagcacttcattggaccgtaaatgtgttttaagttatcttttctcttcctcgtcgaaactgggttgaggatctctgtaccatttgaaatcc

SEQ ID NO: 1021 - DNA, 1827 bp, Panicum virgatum
agaaaagcactcctcgcactcgcctcaccgatccgccaccacaccacatcctctgcgtcggctcctcctcctcctcctcctcctcgccgccgccgccacgatgccggaagacgtgcagatgaacgactcggagccccagccggcggcccctcctcccgccgcggcgccggcgctctccaccctccaccatctgaaggagatcgcgtccgtgatcgaggccggctccctgtccaaggaggtccgccggatctcccgcgccgtccgcctcaccatcgcgctccgccgccgcctcgccgcgcgggacgtctccgccttcctcgccttcgcgctccccgcgtcctctgaggcctacgctcgcctcaccgccctggtgcccaaggaagatgatactgagatggatgttgatgctgcagctccaacaactcagatttcaatcaagcatggtctccctgaaattgaaatatattgctacttgctagtcctgattttccttattgatcaaaagaaatacgatgaggctaaagcatgcgcaactgcgagcattgctcgtctgaagaacttgaaccggagaactgttgatgttttggcttcgcgtctgtacttttattactcctatgtgtatgagcttaccaacagccttgctgaaatccgtgggaatctgctcgcattgcacaggatggcaactttgcaccatgatgagcttggccaggaaactctgctcaatctcctcctccgcaattacctccactacaacttgtatgaccaggcagaaaagcttagatcaaaggcgcctcgttttgaagcgcattccaaccaacaattctgccgatatctgttctacttgggtaaaattaggacaattcagttggagtacactgatgctaaagaaagccttctgcaagctgctcggaaggcacccacaacagctcgtggttttcgtattcagtgcaacaaatgggctatcattgtgaggctacttcttggagagattccagagagaactgttttcatgcagaaaggaatgaagaaagctttgacaccttattttgagctcacaaatgctgttagggtgggggacctggagctgttcagggccgttgcagacaaattcgcaagcacattcagtgcagacaggacccgaaacctgattgtgaggctgcgccacaatgtcattcgaactggacttcgcaacatcagcatttcatactcaaggatctcccttgctgatattgccaagaagctcagactagactccgagaatcctgttgctgatgccgagagcattgtagccaaggccataagagatggtgcaattgacgccaccatagatcatgcgaatggctggatggtgtcaaaggaaactggcgatgtctactcgacgaatgagccgcagatcgcattcaactcaaggattgctttctgcctgaacatgcacaatgaggcggtcaaggcgatgaggttcccccctaattctcacaaggaaaaggagagcgcggagaagcgtcgtgagaggcttcagcaggaggaagaattggcaaaacacatggccgaggaggatgatgacgatttctaagttagctgcctttgagcagacaatgtgtggctgctcgattagggatggccaaggttgaaagcatttcctccgactccagtcatgcagacattaaagtttgaattcatctgctgtaacttttatggtgaccagattttgtattaactccatgaatgcctctgctaggccatttacgtttcgccctcccagaactgttggaatggagaatttgcctacaatgcaaggatttttattcttgttctttactcagcttc

SEQ ID NO: 1022 - DNA, 2008 bp, Setaria italica
ctgggacacagaccggagaggagagaataacccaagccggaagcgaccttcttgaggcggaagcaaaaggactcgcactcgcctcaccgatccgccaccacaccacacatcctcctcgtcggctcctcctcctcctcgccgccgccgccgccgccacgatgccggaagacgtgcagatgaacgactcggagccccagccggcggccccaactcccgccgccgcggcgccggcgctctccaccctccaccatctgaaggagatcgcgtccgtcatcgaggccggctccctgtccaaggaggtccgccggatctcccgcgccgtccgcctcaccgtcgcgctccgccgccgcctcgccgcgcgggacgtctccgccttcctcggcttcgcgctccccgcgtcctctgaagcctacgctcgcctcaccgccctggtgcccaaggaagatgatactgagatggatgttgatgctgcggctccggcaacacagatttcaatcaagcatggtctccctgaaattgaaatatattgctacttgcttgtcctgattttccttattgatcaaaagaaatatgacgaggctaaagcatgtgcaacttcgagcattgctcgtctgaagaacttgaaccggagaactgttgatgttttggcttctcgtctgtacttttattactcctatgtgtatgagcttaccaacagtcttgctgaaatccgtgggaatctgctcgcattacacaggatggcaactttgcaccgtgacgagcttggccaggaaactctgctcaatctcctcctccgcaattacctccactacaacctgtatgatcaggcagaaaaacttagatcaaaggcacctcgttttgaagctcattccaaccaacaattctgccgatacttgttctacttgggtaagattaggacaattcagttggagtacactgatgctaaagaaagcctcctccaagctgctcggaaggcacccacatcagctcgtggttttcgtattcagtgcaacaaatgggctatcattgtgaggctacttcttggagagattccagagaggactgttttcatgcagaaaggaatgaagaaagctttgacaccttattttgagctcacaaatgctgtcagggtgggggacctggaactgttcagggctgttgcagacaaatttgcaagcacattcagtgcagacaggactcgcaacctcattgtgaggctgcgccacaatgtcatccgaactggtctgcgcaacatcagcatttcatactcaaggatctcccttgctgatattgctaagaagctaagactagactccgagaaccctgttgctgatgccgagagcattgtagccaaggccatcagagatggtgcaatcgacgccaccatagatcatgcaaatggctggatggtgtcaaaggaaactggcgatgtctactcaacaaacgagccgcagattgcattcaactccaggattgctttctgcctcaacatgcacaatgaagcggtcaaggctatgaggttcccccctaactctcacaaggagaaggagagtgctgagaagcgccgtgagaggcttcaacaggaggaagaattggctaagcacatggccgaagaggatgatgacgacttctaaattagctggcctttgcgcagccacttgcaatgtggagttgttcaatttgagatcggttccaaaagcaattcctccgcctctgggtctactcgagtcatgcagacattaaagtttgaattcgtccgctgtaactttatgttgtattaactccatgtgcaccaggtactggtaggctcattacgtttcgcccaccctgaattgttggaaatggtgagaatttgccaacaatgcgcaagaaccggctatgtttatttcatgattccttttggtccaattcgggctctgtgacttgtgtgtgttgtattttgagtaggttacctctgtctcgtcttgtggtatgtttcgttacgatagcactcaaagtcatgttcgcg

SEQ ID NO: 1023 - DNA, 1991 bp, Pennisetum glaucum
tggggacacggaagaggaaccccaagcagcacaggttggtaacccaagccggaagctaccttcttgaggcggaagcaaaaggactcgcactcgcctcaccgatccgccaccacaccacacatcctcctcgtcggctcctcctcgccgccgccgccaccacgatgccggaagacgtgcagatgaacgactcggagccccagccggcggctcctgctcccgccgccgcccccgccgccgaggcgccgacgctctccaccctccaccatctgaaggagatcgcgtccgtcatcgaggccggctccctgtccaaggaggttcgccggatctcccgcgccgtccgcctcaccgtcgcgctccgccgccgcctcgccgcgcgggacgtctccgccttcctcgccttcgcgctccccgcgtcctctgaagcctacgctcgcctcaccgccctcgtgcccaaggaagatgatactgagatggatgttgatgctgcggctccggcaacacagatttcaatcaagcatggtcttcctgaaattgaaatatattgctacttgcttgtcctgattttccttattgatcaaaagaaatatgacgaggctaaagcatgtgcaattgcgagcattgctcgtctgaagagcttgaaccggagaactgttgatgttttggcttctcgtctgtacttttattactcttatgtgtatgagcttaccaacagccttgctgaaatccgtgggaatctgctcgcattacacaggatggcaactttgcaccgtgacgagcttggccaggaaactctgctcaatctcctcctccgcaattatctccattacaacctgtatgatcaggcagagaagctcagatcaaaggcacctcgttttgaagctcattccaaccaacaattctgccgatacttgttctacttgggtaagattaggacaattcagttggagtacactgatgctaaagaaagcctcctgcaagctgctcggaaggcacccactgcagctcgtggttttcgtattcagtgcaacaaatgggctatcattgtcaggctacttctcggagagattccagagaggactgttttcatgcagaaaggaatgaagaaggctttgacaccttattttgagctcacaaatgctgtcagggtgggggacctggaattgttcagggctgtcgctgacaaatttgcaagcaccttcagtgcagacaggactcgcaacctgattgtgaggctgcgtcacaatgtcatccgaactggtctgcgcaacatcagcatttcatactcaaggatctcccttgctgatattgctaagaagctaagactagactccgagaaccctgttgctgatgccgagagcatcgtagccaaggccatacgggatggtgcaatcgacgccaccatagatcatgcgaatggctggatggtgtcgaaggaaaccggcgacgtctactcgacaaacgagccgcagatcgcgttcaactcgaggattgctttctgcctcaacatgcacaacgaagcggtcaaggcgatgaggttccccccaaactctcacaaggagaaggagagtgctgagaagcgccgtgagaggcttcaacaggaggaggaattggctaagcacatggctgaagaggacgacgatgacttctaaatttgctggcctttgggcaagccatttgcaacgtggagttgttcagtttgagatcggttccaaaagcaattcctccctcctctgggtctagacaatctgagtcatgcagacattaaagtttgaattcatctgctgtaactttatgttgatcaggattttgtattaactccatgtgcgactggtagtctgcttacgtttcaccctccctgaattgttgaaatggagagaatttgccagatgctagaaccggctatgtttatttcatgatttcttttgctccaagctcgggctttgtgacttgtgtgtgctgtgctgtaaatcttacattacttccatagttcc

SEQ ID NO: 1024 - DNA, 1809 bp, Panicum virgatum
ctcgcacttgcctcaccgatccgccaccacaccacaccacatcctccgcgtcggctcctcctactcctcgccgccgccgccgccacgatgccggaagacgtgcagatgaacgaatcggagccccagccggcggcccctcctcccgccgcggcgccggcgctctccaccctccaccatctgaaggagatcgcgtccgtgatcgaggccggctccctgtccaaggaggtccgccggatctcccgcgccttccgcctcaccgtcgcgctccgccgccgcctcgccgcgcgggacgtctccgccttcctcggcttcgcgctccccgcgtcctctgaggcctacgctcgcctcaccgccctggtgcccaaggaagatgatactgagatggatgttgatgctgcggctccaacaacacagatttcaatcaagcatggtctccctgaaattgaaatatattgctacttgcttgtcctgattttccttattgatcaaaataagtatgatgaggctaaagcatgcgcaactgcgagcattgctcgtctgaagaacttgaaccggagaactgttgatgttttggcttctcgtctgtacttttattactccaatgtgtatgagcttaccaacagccttgctgaaatccgtgggaatcttctcgcattgcacaggatggcaactttgcaccgtgatgagcttggccaggaaactctgctcaatctcctcctccgcaattacctccactacaacttgtatgaccaggcagaaaagcttagatcaaaggcgcctcgttttgaagcgcattccaaccaacaattctgccgatacctgttctacttgggtaaaattaggacaattcagttggagtacactgatgctaaagaaagccttctgcaagctgctcggaaggcacccacaacagctcgtggttttcgtattcagtgcaacaagtgggctatcattgtgaggctacttcttggagagattccagagagaactgttttcatgcagaaaggaatgaagaaagctttgacaccttattttgagctcacaaatgctgtcagggtgggggacctggaactgttcagggccgttgcagacaaatttgcaagcacattcagtgcagacaggactcgcaacctgattgtgaggctgcgccacaatgtcattcgaactggactgcgcaacatcagcatttcatactcaaggatctcccttgctgatattgccaagaagctcagactagactccgagaatcctgttgccgatgccgagagcattgtagccaaggccataagagatggtgcaattgacgccaccatagatcatgcgaatggctggatggtgtcaaaggaaactggtgatgtctactcgacaaatgagccacagatcgcattcaactcaaggattgctttctgcctgaacatgcacaatgaggcggtcaaggcgatgagattcccccctaattctcacaaggaaaaggagagcgcggagaagcgccgtgagaggcttcagcaggaggaagaattggcaaaacacatggccgaggaggatgatgatgatttctaagttagctgcctttgagcagacacttgcaatgtgtagttgctcgatttgggatggccaaggttgaaagcatttcctccgactcgagtcatgcagacattaaagtttgaattcatctgctgtaacttttatgttgatcagattttgtattaactccatgagtgcctggtaggccacctacgtttcgccttccctgaactgttggaatggagaatttgcctacaatgcaatggtttttattcttgtttttta

SEQ ID NO: 1025 - DNA, 2016 bp, Brachypodium distachyon
ccgtgctcaccgccgccggcatgccagaggacgtgcagatgagcgagcagcaggcggcacctcctgccgccgccacagcggccgcgccggcgccttctaccctccaccatctgaaggagatcgcatcggtgatcgaggcggggtcgctgaccaaggaggtccgccggatctcccgcgccgtccgcctcaccgtcgccctacgtcgccgcctcggacatcgcgatgtttccgccttcctcgccttcgcgctccccgcctccactgaagcatacgcccgcctcacctccctccttcccaaggaagatgacactgagatggatcttgatgcaacggctcaagcaactcagatttcaatcaagcatggccttcctgagattgaaatatattgctatttgcttgttctgattttcctcattgatcagaagaaatacgacgaggctaaagcatgtgcaactacaagcattgctcgtctgaagaatatgaacaggagaactgttgatgttctggcttctagactgtatttctattattcatatgtgcatgaactaaccaacagccttgctgaaattcgtgggaatctccttgcattacatagaaaggcaactctacaccgtgatgaacttgggcagggagaaactctgctcaacctgcttctccgcaattacctccactataacttgtatgaccaggcagaaaaacttaggtcgaaggcaccgcgttttgaagcgcattccaaccagcaattctgccgctacctcttctacttggggaaaatcagaacaattcagttggagtacactgatgctaaagagagcctcctgcaagctgctcggaaggcaccaacggcagctcgtggttttcggattcaatgcaataaatgggctatcatagttaggctgcttcttggggagatcccggaaaggactgttttcatgcagaaaggaatgaagaaagcgctgacaccgtattttgagcttacaaatgcggtcaggattggggatttggaattgttcagaactgttgctgacaaatttgcaagcactttcagtgcagacaggactcgcaatttgattgtgaggttgcgccacaatgttattcgaactggattacgcaatattagcatttcatactcacggatctcccttgctgatattgcaaagaagctaaggctagactctcagaatcctgttgccgatgcagagtgcattgtatccaaggccataagagatggtgcaattgatgccaccatagatcatgccaatggctggatggtgtcgaaagaaactggggatgtctactcaacaaatgagccccaggttgcattcaactccaggattgcattctgcctcaacatgcataatgaagcggtaaaggcgatgaggttcccaccaaattctcacaaggaaaaggagagtgctgagaagcgtcgtgagaggctccagcaggaggaggagctggcaaaacacatggctgaggaggatgatgatgatttttaagctggactttttcttttcttctggaatggtcgactttggagcccgaaatcatcaatgttctcttgcggggatgtttgaatcatgtatactttttcctgtgtcttctgtaactttatgttgatcagagttttattgaactccaaatgtgcctagattttaatttgcttttatccacacctcgaatgtttcgaggattactgtaccatgcaaaaagtgcgccttaatcacttgtgacttttggagacgcattctcggaaattaatccttctgaagatgaaagcattttacggtgtgcaactctaagcacacaaatagtcgaatgtagaggcagtatcacaaaattgcccccatttaagttttacagtactagctaaatacagacagattaaactactaactgtagatatattagactaaaaattctctattatattattagcggcgctggttactaattttattgtaactttgcaaacatcagtaccatctcagtcttttgcaataaaattagtgtacattg

SEQ ID NO: 1026 - DNA, 1807 bp, Zea mays
aagtggagcgggacacaacgaagcggtgacgaagaacaagttaacccaacctggaagcgagtaagcgaccttcttgagcgtgaagccaaaggttggacctcaccgatccgccaccacgccacgaaatcatctcctactccagcagttccgctcctcgcgccgccaccgccaccgccacgatgccggaagacgtgcagatgaacgactcggagccccagtctgcggccccagctcccgccgccgccgcggcgccggcgctctccacactacaccatctgaaggagatcgcgtccgtgatcgaggctggttctctgtccaaggaggtccgccggatctcccgcgccttccgcctcaccgtcgcgctccgccgccgccttgccgcacgggacgtctccgccttcctcgccttcgcgctacccgcgtcctccgaagcctacgggcgcctcatcgccctggtgcccaaggaagatgatactgagatggacgttgatgctgtggctccagcaactcagatttcaatcaaacatggtctccctgagattgaaatatattgctacttgcttgcactgatttttcttattgatcagaagaaatacgatgaggctaaagtatgtgcaagtgtgagcattgctcgcctgaagaatctaaaccggagaactgttgatgtcttggcatctcgtctgtacttttattactcttatgtgtatgagcttaccaacagccttgctgaaatccgcgggaatctgcttgctctacacagaatggcaactttgcatcgtgacgagctcggccaggaaactctgctgaatcttctcctccgcaattacctccactacaacttgtatgatcaggcagaaaagcttagatcaaaggcacctcgttttgaagcacattccaaccaacaattctgccgatacttgttctacttgggcaaaattaggacaattcagttggagtacactgatgctaaagaaagcctcctgcaagctgctcgtaaggcaccaacaactgcccgtggttttcggatccagtgcaacaaatgggctatcatagtgaggctgctgcttggtgagattccagagaggactgttttcatgcagaaaggaatgaagaaagctctgacaccttattttgagctcacaaatgctgtcagggttggggaccttgaactgttcaggactgtcgctgacaaatttgcaagcacattcagcgcagacaggactcgcaacttgattgtgaggctgcgccacaatgtcattcgaactggactgcgcaacatcagcatttcttactcaaggatctcccttgctgacattgctaagaagctaagactagactctgagaaccctgttgctgatgcggagagcattgtagccaaggccataagagatggcgcaattgacgccaccatagatcatgcaaatggctggatggtatcgaaggaaaccggtgatgtctactctacaaatgagccacaaattgcattcaactccaggattgcgttctgcctcaacatgcacaatgaggcggtcaaggcgatgagattcccccctaattctcataaggaaaaggagagcgccgagaagcgccgagagaggcttcaacaggaggaagaactggctaagcacatggctgaggaggaggatgacgacttctaaattagctgccttttgagcaaccacttgcaattgtggacttgttggaacgcctggttaaaccctgcctctagctactcgagtcatgcaaacactgtaatgttatgttgatcagggtttttctttaaattcaatacttgagttttaatctc

SEQ ID NO: 1027 - DNA, 2021 bp, Oryza sativa
gaaaagcagaggagaggtagcccaagctcggaagggaaggggagcgaccttcttgaggcagaagtcacgaaccaaccagcgccgccgccgcgatgacggacgtgcagatgagcgactccgagccgcaggcggcgcctcccgcggcgccggcggcctccgccctccaccatctgaaggagatcgcctcggtgatcgaggccggctcgctgtccaaggaggtgcgccggatctcccgcgccgtccgcctcaccgtcgccctccgccgccgcctcgccgcccgcgacgtctccgccttcctcgccttcgcgctcccgccttcctccgaggcctacacccgcctcacctccctcgtccccaaggaagatgacactgagatggacattgacatggcagctccagcaactcagatttcgatcaagcatggcctccctgagattgaaatatattgctatttgcttgtcctgatttttcttattgaccagaagaaatacgacgatgctaaagcatgtgcaaatgcaagcattgctcgtctgaaaaacttgaacaggagaactgttgatgttctggcatctagactgtacttctattactcatatgtgcatgaactcaccaacagccttgctgaaatccgtgggaatctgctagccttacacagaatggcaactcttcaccgcgatgaacttggccaggaaactttgctcaacctgcttcttcgcaattacctccattataatttgtatgatcaagcagagaaacttaggtcaaaagctcctcgttttgaagcccactccaatcaacaattctgtcgatacctgttctacttgggtaaaatcaggacaattcagttggagtacactgatgctaaggaaagccttctgcaagctgctcggaaggcacccattacagctcgtggctttcgtattcagtgcaacaaatgggctattatagtgagactacttctcggagagattccagagaggactgtgttcatgcagaagggaatgaaggaagcactgacaccctacttcgagcttacaaatgctgtcaggatcggtgatcttgaattgtttagggctgtcgccgacaaatttgtgagcacttttagtgctgacaggactcgcaatttgattgtgagattgcgccacaatgttattcgaaccggactgcgcaatattagcatttcatactcacggatctcccttgctgatattgccaagaagctaaggctcgactctgataatcctgttgctgatgcggagagcattgtagccaaggcaataagggatggcgcaattgatgccaccatagatcatgccaacggctggatggtgtcgaaagaaactggcgatgtctactcgacaaatgaaccacagattgcattcaactctcggattgcattttgcctcaacatgcacaatgaagctgtgaaagcaatgcggttccccccgaactctcacaaggaaaaggaaagtgcggagaagcgccgtgagaggctccaacaggaggaggagctggcaaaacacatggctgaggaagatgacgatgatttttagactggctggccacttctttggcactttgggctgccaaattgcaatgttgagttggttgatctgagagaccgtaacacacctatacatgccactcacaaatgatatttgagtcatgcaaaaaccctttgcttcatctgccggaaatttatgtcgatgagaaatttatgactccaaatgtgtctagttggataacttacttttaccttcaccttgtatcatggattcgagaatttcttttgtaccatgcgaaattcggctgcttcattcatgtattgtggttcatgtgtgcgcgtgcgctttatgcatcctgtacttatgtagtagtggtagtagtaattttgtcatgtttgatcgtgcgcgtctcttggtttttcttccaggaagtgacccaagaacgttaattttagttgaaacctaaaagctatattaaggagaagtcatgatggagtagaatattttgtgttgccc

SEQ ID NO: 1028 - DNA, 2009 bp, Sorghum bicolor
acccaacccggaagcgacctgaccttcttgagcccgaagcaaaaaaaggctccatattgctctcctcaccgatccgccaccacgccacaaaatcctctcctactcgagcagttccgctcctcgccgccgccacgatgccggaagacgtgcagatgaacgactcggagccccagcctgcggcgccagttcccgtcgccgccgccgccgccgcggcggcgccggcgctctccacactgcaccatctgaaggagatcgcgaccgtgatcgaggctggttccctgtccaaggaggtccgccggatctcccgcgccttccgcctcaccgtcgcgctccgccgccgcctcgccgcgcgggacgtctccgccttcctcgccttcgcgctacccgcgtcctctgaagcctacggacgcctcaccgcgctggtgcccaaggaagatgatactgagatggatgttgatgctgcggctccggcaactcagatttcaatcaaacatggtctccctgagattgaaatattttgctacttgcttgtactgattttccttattgatcagaagaaatatgatgaggctaaagcatgcgcaaatgtgagcattgctcgcctgaagaacctaaaccgtagaacggttgatgtcctggcatctcgtctgtacttttattactcttatgtgtatgagcttaccaacagccttgctgaaatacgtgggactctgcttgctctacacagaatggcaactttgcatcgcgacgagcttggccaggaaacactgctcaatctcctcctccgcaattacctccactacaacttgtatgatcaggcagagaagcttagatcaaaggcacctcgttttgaggcacattccaatcaacaattctgccgatacttgttctacttgggcaaaattaggacaattcagttggagtacactgatgctaaagaaagcctcctgcaagctgctcgtaaggcaccaacaacagcccgtggttttcggattcagtgcaacaaatgggctatcatagtgaggctgctgcttggagagattccagagaggactgttttcatgcagaaaggaatgaagaaagctctgacaccttattttgagctcacaaatgctgtcagggttggggaccttgaactgttcagggccgtcgcagacaaatttgcaagcacattcagcgcagacaggactcgcaacttgattgtgaggctgcgccacaatgtcattcgaactggactgcgcaacatcagcatttcttactcaaggatctcccttgctgacattgctaagaagctcagattagactctgagaaccctattgctgacgcggagagcattgtagccaaggccataagagatggcgcaattgacgccaccatagatcatgcaaatggctggatggtttcaaaggaaactggtgatgtctactcgacaaatgagccacaaattgcattcaactccaggattgcgttctgcctcaacatgcacaatgaggcggtcaaggcgatgaggttcccccctaattctcacaaggaaaaggagagtgctgagaagcgccgagagaggcttcagcaggaggaagaactggctaagcacatggctgaggaggatgacgatgacttctaaattagctgcctttttgagcaaccacttgcaatgcaagtggagttgttcgatttgtgaacgcctggttcaaagcaattcccctgcctctagccactcgagtcatgcaaacactgaagtttgaaattcatcttctgtaatgttatgttgatcaggattttgtattaattccatacttgagttttagtctccctgatgaattgttgaaccagggaatttacccgccatgccagatacggatttgtttatttcatgagttctccgctcccggcttttctgaaatgctgtattttgtgttcattgttttcttgtattaatttaatgaactattattggttaaagtttgattctaaagtaattgatgttgaatactccctctatttcaaa

SEQ ID NO: 1029 - DNA, 1863 bp, Saccharum officinarum
  misc_feature (1725)..(1725): n is a, c, g, or t
cgaccttcttgagccggaaccaaaaggctccatattgctctcaccgatccgccaccacgccacaaaaatcctctcctactccagcagttccgctcctcgccgccgcagccgccgccaccgccacgatgccggaagacgtgcagatgaacgactcggagccccagcctgcggccccagctcccgccgccgcggcgccggcgctctccacactgcaccatctgaaggagatcgcgaccgtgatcgaggccggctctctgtccaaggaggtccgccggatctcccgcgccttccgcctcaccgtcgcgctccgccgccgcctcaccgcgcgggacgtctccgccttcctcgccttcgcgcttcccgcatcctccgaagcctacggacgcctcaccgccctcgtgcccaaggaagatgatactgagatggatgttgatgctgtagctccggcaactcagatttcaataaaacatggtctccctgagattgaaatattttgctacttgcttgtactgattttccttattgatcagaagaaatacgatgaggctaaagcatgcgcaaatgtgagcatttttcgcctgaagaacctaaaccggagaacggttgatgtcctggcatctcgtctgtacttttattactcttatgtgtatgagcttaccaacagccttgctgaaatacgtgggaatctgcttgctctacacagaatggcaactttgcatcgcgacgagcttggccaggaaacactgctcaatctcctcctccgcaattacctccactacaacttgtatgatcaggcagaaaagcttagatcaaaggcacctcgttttgaagcgcattccaatcaacaattctgccgatacttgttctacttgggcaaaattaggacaattcagttggagtacaccgatgctaaagaaagcctcctgcaagctgctcgtaaggcaccaacaacagcccgtggttttcggattcagtgcaacaaatgggctatcatagtgaggctgttgcttggagagattccagagaggactgttttcatgcagaaaggaatgaagaaagctctgacaccttattttgagctcacaaatgctgtcagggttggggaccttgaactgttcagggccgttgcagacaaatttgcaagcacattcagcgcagacagtactcgcaacttgattgtgaggctgcgccacaatgtcatccgaactggactgcgcaacatcagcatttcttactcaaggatctcccttgctgacattgctaagaagctcagactagactctgagaaccctattgctgatgcggagagcattgtagccaaggccataagagatggcgcaattgacgccaccatagatcatgcaaatggctggatggtatcaaaggaaactggtgatgtctactcgacaaatgagccacaaattgcattcaattccaggattgcgttctgcctcaacatgcacaatgaggcagtaaaggcgatgagattcccccctaattctcacaaggaaaaggagagcgccgagaagcgccgagagaggcttcagcaggaggaagaactggctaagcacatggctgaggaggatgacgacgacttctaaattagctgccttttgagcaaaccacttgcaaatgaggaggatgacgacgacttctaaattagctgccttttgagcaaccacttgcaatgtggacttgtttgatttgtgaacgcctggttcaaancaattcccctggagtcatgcaaacactgaagtttgaaattcatctgctgtaatggtatgttgaaacagaattttgctttaattccaaatttggagtttgttccccctgataaattggtgaaaccagggaattttaccc

SEQ ID NO: 1030 - DNA, 1941 bp, Zea mays
acgacgaatatcaggcagcccagaaatgtctgctgcagggctgctgggtttctgatgccaagtggagcgggacacgaggacaccacaaagcggtgaaggagaaccaaggtaatcgaacccggaagcgaccttcttgagcccgaagcaaaaggcactgctcatcgatccgccaccacgccacaaaatcctctcctactccggcagttctgctcgccgccgcctccacgatgacggaagacgtgcagatgaacgactcggagccccagcctgcggcctcagctcccgccgtcggggcgccggcgctctccacactacaccatctgaaggagatcgcgtccgtgatcgaggccggttctctgtccaaggaggtccgccggatctcccgcgccttccgcctcaccgtcgcgctccgtcgccgcctcgccgcgcgggacgtctccgccttcctcgccttcgcgctacccgcgtcctccgaagcctacggacgcctcactgccctggtgcccaaggaagatgatactgagatggatgttgatgctgcagctccagcaactcagatttcaatcaaacatggtctccctgagattgaaatatattgctacttgctcgtactgattttccttattgatcataagaaatatgatgaggctaaggcatgcgcaagtgtgagcattgctcgcctgaagaatctaaaccggagaactgttgatgttttggcatcacgactgtacttctattactcttatgtgtatgagcttaccaacagccttgctgaaatccgtgggaatttgcttgctctacacagaatggcaactttgcatcgtgacgagcttggccaggaaacactgctcaatctcctccttcgcaattacctccactacaatttgtatgatcaggcagaaaagcttagatcaaaggcacctcgttttgaagcacactccaatcaacaattctgccgatacttgttctacttgggtaaaatcaggacaatccagttggagtacaccgatgctaaagaaagcctcctgcaagctgctcgtaaggcaccaataacagcctgtggttttcggattcagtgcaacaaatgggctatcatagtgaggctgctgcttggagagattcctgagaggactgttttcatgcagaaaggaatgaagaaagctctgataccttattttgagctcacaaatgctgtcagggttggggaccttgaactgttcagggctgttgcagacaaatttgcaagcacattcagcgcagacaggactcgtaatttgattgtgaggctgcgccataatgtcattcgaactggactgcgcaacatcagcatttcttactcaaggatctcccttgctgacattgctaagaagctaagactagactctgagaaccctattgctgatgcggagagcattgtagccaaggccataagagatggcgccattgacgccaccatagatcatgcaaatggctggatggtatccaaggaaactggtgatgtctactcaacaaatgagccacaaattgcattcaactccaggattgcgttctgcctcaacatgcacaatgaggcggtcaaggcgatgagattcccccctaattctcacaaggaaaaggagagtgctgagaagcgccgagagaggcttcagcaggaggaagaactggctaagcacatggctgaggatgatgacgacgacttctaagttagctgccttttgagcaactacttgcaatgtggagtttgttcgatttgtgaacgcctggttcaaagcaattcccctacctctagttactccagtcatgcaaacactgaagttcatccactgtaatgttgtgtcgatcaggattttgtattaattctatacttgagttttagtccccctgaattgttgaaccagggaatttactcaccattaaacggctttgtttatttctttaatc

SEQ ID NO: 1031 - DNA, 1941 bp, Zea mays
acgacgaatatcaggcagcccagaaacgtctgctgcagggctgctgggtttctgatgccaagtggagcgggacacgaggacaccacaaagcggtgaaggagaaccaaggtaatcgaacccggaagcgaccttcttgagcccgaagcaaaaggcactgctcatcgatccgccactacgccacaaaatcctctcctactccggcagttctgctcgccgccgcctccacgatgacggaagacgtgcagatgaacgactcggagccccagcctgcggcctcagctcccgccgtcggggcgccggcgctctccacactacaccatctgaaggagatcgcgtccgtgatcgaggccggttctctgtccaaggaggtccgccggatctcccgcgccttccgcctcaccgtcgcgctccgtcgccgcctcgccgcgcgggacgtctccgccttcctcgccttcgcgctacccgcgtcctccgaagcctacggacgcctcactgccctggtgcccaaggaagatgatactgagatggatgttgatgctgcagctccagcaactcagatttcaatcaaacatggtctccctgagattgaaatatattgctacttgctcgtactgattttccttattgatcataagaaatatgatgaggctaaggcatgcgcaagtgtgagcattgctcgcctgaagaatctaaaccggagaactgttgatgttttggcatcacgactgtacttctattactcttatgtgtatgagcttaccaacagccttgctgaaatccgtgggaatttgcttgctctacacagaatggcaactttgcatcgtgacgagcttggccaggaaacactgctcaatctcctccttcgcaattacctccactacaatttgtatgatcaggcagaaaagcttagatcaaaggcacctcgttttgaagcacactccaatcaacaattctgccgatacttgttctacttgggtaaaatcaggacaatccagttggagtacaccgatgctaaagaaagcctcctgcaagctgctcgtaaggcaccaataacagcctgtggttttcggattcagtgcaacaaatgggctatcatagtgaggctgctgcttggagagattcctgagaggactgttttcatgcagaaaggaatgaagaaagctctgataccttattttgagctcacaaatgctgtcagggttggggaccttgaactgttcagggctgttgcagacaaatttgcaagcacattcagcgcagacaggactcgtaatttgattgtgaggctgcgccataatgtcattcgaactggactgcgcaacatcagcatttcttactcaaggatctcccttgctgacattgctaagaagctaagactagactctgagaaccctattgctgatgcggagagcattgtagccaaggccataagagatggcgccattgacgccaccatagatcatgcaaatggctggatggtatccaaggaaactggtgatgtctactcaacaaatgagccacaaattgcattcaactccaggattgcgttctgcctcaacatgcacaatgaggcggtcaaggcgatgagattcccccctaattctcacaaggaaaaggagagtgctgagaagcgccgagagaggcttcagcaggaggaagaactggctaagcacatggctgaggatgatgacgacgacttctaagttagctgccttttgagcaactacttgcaatgtggagtttgttcgatttgtgaacgcctggttcaaagcaattcccctacctctagttactccagtcatgcaaacactgaagttcatccactgtaatgttgtgtcgatcaggattttgtattaattctatacttgagttttagtccccctgaattgttgaaccagggaatttactcaccattaaacggctttgtttatttctttaatc

SEQ ID NO: 1032 - DNA, 1908 bp, Oryza sativa
gcagtgaaccggaataggccacacttgtcgcgatattatcctttgctcttctcttcttctcttcccccgcacgcatcgcacccgacctcgtcgccgtcgccgacgccgccagccatgccggaggacgtcgagatgaacgactcccagccccagcccgccgccgcgccaccgcccgcggcctccaccttgcagcatctgaaggagatcgcgtcggtgatcgaggccgggtcgctgaccaaggaggttcgccggatctcccgcgccgtgcgcctcaccgtcgcgctccgccgccgcctcgccgcccgtgacgtcgccgccttcctcgccttcgcgctgccgcattcctcggaagccttcgcccgcctttcctccctcctgcccaaggaagatgggagtgaaatggatgttgatttggcagctccagcggctcaagtgtcaattaagcatggtctcccagagattgaaatatactgttacttgcttgtgctgattttccttattgataataagaaatatgatgaggctaaagcatgtgcttctgcaagcattactcgtttgaagaatcttaacaggagaacagtcgatgttttagcttctagggttttcacctattactcttatgtccacgaactcaccagcagccttgctgaaattcgtggaactcttctggcattgcacagaatggcaactttacatcgtgatgagcttggtcaggaaactctactcaacctgcttcttcgcaactacctgcactacaacttgtatgaccaagcagaaaagcttaggtccaaggcaccgcgttttgaagcacattctaatcagcagttctgcaggtatctgttctacttgggaaaaattaggacaattcagttggagtacactgatgcaaaggaaagcctactgcaagctgctcgaaaggcacccactacagctcgtgggttccgagttcagtgcaacaagtgggctatcatagtgagattacttttaggagaaataccagagagaactgtttttatgcagaaaggaatgaaggctgctttggcaccatattttgagcttacaaatgctgttcgagttggggaccttgaattgttcagagcagtggcagaaaaatttgctagcactttcagcgcggataggacgcgcaatttgatagtgaggctgcgccacaatgtcattcggactggattgcgcaacataagcatttcatactcacggatctcccttgctgacattgccaagaagctgaggttggactcagagaaccctgttgctgatgctgaaagtattgtagccaaagcaatcagggatggggcaattgatgccaccattgatcatgccaatggttggatggtgtcaaaagagactggtgatgtctactcaacgaatgagccacagattgctttcaattcaaggattgcattttgcttgaacatgcacaacgaagcggtcaaagcactgaggttccctccgaattctcacaaggaaaaggagagtgctgagaagaggcgcgagaggctccaacaggaggaagaactagcaaaacacatggctgaggaggacgatgacgacttttagattggtgatttcttttcatgctttcagttgctgcctcaagggtttcattttgaagcatgggcatccattcagttttaagagacggaagatctcgaaatgccaaccctgcttttctgggatagttgaaaccatggaaccgttgacatttaattcagtgtgttttatgtttttaacaatttttttatcactcaaaccgcttagaaggcaatgtattctttcctgaaatactgtaccgttcaatccttggggcacaatgttttgaacatgacaagttcagttcgctctcatttgttcgtaaatggcatttgcgcccgtgtgactttcattcga

SEQ ID NO: 1033 - DNA, 1736 bp, Panicum virgatum
gcatcctgtatctacccccgcgacctcgtcggcgacgccacgatgccggaggacgtcgagatgaacgactcccaggccccgcccgctgccgccccagccgttagcgacgccccggcgcccgcgcagtccactctccaccatctgaaggagatcgcgtcggtgatcgaggccgggtcgctgagcaaggaggtccgccggatctcacgcgccgtccgcctgaccatcgccctacgccgccgcctcgccgcccgcgacgttgctgccttcctggccttcgcgctgcctccttcctcggaggccttcgcccgcctctccgccctcgtgcccaaggaagatgggagtgaaatggatgttgatacggcagctccagcagctcaagtttcaatcaagcatggtcttcctgagattgaaatttattgttacttgcttgtgcttattttcctttttgataataagaaatatgatgaggctaaaacatgtgccgccgcaagcattgctcgtctgaagagtcttaacaggagaacagttgatgttttagcttctaggctgtactcctattactcatatgtccatgagcttaccaacacccttgctgagattcgtgggactctcctggcattgcacagaatggcaactttacaccatgatgagcttggtcaggaaactcttctcaatctgcttcttcgcaattacctgcactacaacttgtatgaccaggcagaaaagctaaggtcaaaggcgcctcgttttgaagcacattccaatcaacagttctgccggtatctcttttacttgggcaaaataaggacaattcagttggagtacactgatgctaaagaaagcctcttgcaagctgctagaaaggcacccactacagctcgaggatttcagatccagtgcaacaaatgggctattattgtaaggctgctcttaggagagattccagagagaactgttttcatgcagaaaggaatgaaagctgctttgacaccctattttgagcttacaaatgctgtccgagttggtgacctagagctattcagatctgtggcagataaattttcaagcactttcagtgcagataggacccggaatttgatagtgaggctgcgccacaatgttatccggactggattgcgtaacatcagcatctcatactcaaggatttcccttgctgatattgccaagaagctgaggttgaactctgagaaccctgtcgctgatgctgaaagcattgtagccaaggccatcagggatggggcaattgatgccaccattgatcatgccaacagctgtatggtgtcgaaggagactggtgatgtctactcaactaatgagccacagatagctttcaactcaaggatcgctttttgcctgaacatgcataacgaggcggtcaaggcgctaagattccctccgaactctcacaaggaaaaggagagtgctgagaagaggcgtgagaggctccagcaggaggaagaactggcaaaacatatggccgaggaagatgatgatgatttctagactggtgcaaatcgtttcagttgctgcttcatggtttcattttaagagcaaacgactaatttagttgattaaagctgcacacgaactcttgccccccggttgtatttggaatggtgtttcgaatttagagttctttattgtaacattttatataattacatatgacttcgaaaaaacaacagtttttttcctgaaatggtacctaagcatcc

SEQ ID NO: 1034 - DNA, 1867 bp, Brachypodium distachyon
ctgacaccacctcctcgacctcgtcgctgacgccgcgatgccggaggacgtcgagatgaacgacacccccgcaccagcgcctgcgcccgccgctactgcggtcgccgacgcgcccgcgtccgcgcctgccccctccactttgcagcatctgaaggagatcgcgttggtggtcgaggcagggtcgctgaccaaggaggtacgccggatctcccgcgccgtccgcctcaccgtcgccctccgccgccgcctcgccgcccgcgacgtcgcggccttccttgcctttgcgctagccccttcctccgaagccttcacccgcctctcccccctcctgcccaaggaagatgggagtgaaatggatgttgatgcagcagctctggcggctcaagtttcaatcaagcatggtctcccagagattgaaatatactgctacctgcttgtgttgattttccttattgatcataagaaatatgatgaggctaaagcatgtgcgaatgcaagcattgcccgtctgaagaatatcaacaggagaacggttgatgttttagcttctaggctgtactcgtattactcatatgcccatgaactcaccaacagtcttgccgaaattcgtggaactctcctggggttgcacaggatggcaactttacaccgtgatgaacttggccaggaaacgcttcttaacctgcttcttcgcaattatctgcactacaacttgtacgaccaggcagaaaaacttaggtcaaaggcaccacgttttgaagcacattccaatcagcagttctgccggtatctgttctacttgggcaaaattagaacaattcagctggagtacactgatgctaaagaaagcctattgcaagctgcaaggaaggcacccactgcagctcgtggatttcgcattcagtgcaacaaatgggctataatagtgaggctacttttaggagagatacctgagagaactgttttcatgcagaaaggaatgaaggctgctttgacaccatacttcgaacttacaaatgctgttcgagttggggacctggaattgttcagagctgttgcagagaaatttgcgagtactttcagtgcagacaggacatccaatttgattgtgaggctgcgccacaatgtcatacggactggactgcgcaacattagcatttcatactcgcggatctcccttgttgacattgccaagaagttgaggttagattcggagaaccctgttgctgatgctgagagcattgttgccaaggccataagagatggggcagttgatgccatcattgatcatgccaatggttgggtggtgtcgaaggagactggtgacgtctactcaacaaatgagccacaggctgcattcaattccaggattgcattttgcctgaacatgcacaacgaagcagtcaaggctctgaggttccccccgaattctcacaaggaaaaagagagtgctgagaagaggcgagagagactccagcaggaggaagagcttgcgaaacatatggccgaggaggatgatgatgacttctagatccgcacggcaacccctgttgatgccttcagctgctgcctgttccatatcgaagaaaccatgactccagtctattcggggataatttgaatcatgcaactgttaaaattatactccgtgtgttttattgtgttcctaacaattatttttcacctcactacaaattctgagaaagcaccttatttattttcctgagatactgtagtcgaggaagcgagagctgcaacagaaggctgtattttgcacttcatcccatgtttgctttccaggaaattcgttcgagtacaagttcagtttgcttactcggttactccattgtggacgttgattcatctt

SEQ ID NO: 1035 - DNA, 1903 bp, Triticum aestivum
  misc_feature (208)..(208): n is a, c, g, or t
  misc_feature (339)..(339): n is a, c, g, or t
  misc_feature (352)..(352): n is a, c, g, or t
  misc_feature (354)..(354): n is a, c, g, or t
  misc_feature (358)..(358): n is a, c, g, or t
  misc_feature (362)..(362): n is a, c, g, or t
  misc_feature (397)..(397): n is a, c, g, or t
  misc_feature (471)..(471): n is a, c, g, or t
  misc_feature (473)..(473): n is a, c, g, or t
  misc_feature (476)..(477): n is a, c, g, or t
  misc_feature (485)..(486): n is a, c, g, or t
  misc_feature (565)..(565): n is a, c, g, or t
  misc_feature (592)..(592): n is a, c, g, or t
  misc_feature (617)..(618): n is a, c, g, or t
  misc_feature (633)..(633): n is a, c, g, or t
  misc_feature (641)..(641): n is a, c, g, or t
  misc_feature (740)..(740): n is a, c, g, or t
  misc_feature (770)..(770): n is a, c, g, or t
gccttccctttcactcccccctcttgcgccgcacgcactacccctcccccccgacctcgtcgccgacgccgcgatgccggaggacgtcgagatgaatgactccgcccagcccgcccccgtcgccgctcctgcggccgccgacgcgcccgcgcccgcgcccgctctctccaccctgcagcatctgaaggagatcgcgtccgtggtcgangcggggtcgctgaccaaggaggtccgccggatctcccgcgccgtccgcctcaccgtcgccctgcgccgccgcctcgccgcccccgacgtcgcggccttcctcgccttcgcgctgcccgcttcctccgaggncttcacccgcctntncccnctcntccccaaggaagatggaagtgagatggatgttgangctgcagctccagctgctcaagtttcaatcaagcatggactcccagagattgaaatatactgctacctgcttgngntgnntttccttnntgatcacaagaaatatgatgaggctaaagcatgtgcaaactctagcattgctcgtttgagaatctcaacggaggactgntgatgttttggctctaggctgattcgnatactcgatgtcatgactcacacannctgctgaaatcgggnactctctngggttgcacaggatggcaactcttcaccatgatgagcttgggcaggaaactcttcttaacctgcttcttcgcaattacctgcactacaacctatatgancaggcagaaaaacttaggtcaaaggcaccncgttttgaagcacattccaatcagcagttctgccgctatctgttctacttgggaaaaattagaacaattcagctcgaatacactgatgctaaagagagcctcttgcaagcagcacggaaagcacccactgcagctcgtggattccgcatccaatgcaacaaatgggctatactagtaaggctacttttaggggagataccagagagaactgttttcatgcagaaaggaatgaaggcggctttgacaccatattttgagcttacaaatgctgttcgagttggggacttagaagtgtttagagctgttgcagagaaatttgggagcattttcagtgccgacaggacatccaatttgattgtgaggctgcgccacaacgtcatccggactggactgcgcaacattagcatttcctactcacgtatctcccttgctgacattgccaagaaactgaggctagatactaagactgctgttgctgatgctgagagcattgtagccaaggccatcagagatggggcaattgatgccaccatcgatcatgccaatggttgggtggtgtcgaaagagactggcgacgtgtactcaacaaacgagccacaggctgcgttcaactccaggattgcgttctgcctgaacatgcacaacgaggcagtcaaggctctgaggttccccccgaattctcacaaggaaaaggagagtgcagagaagaggcgtgagagactccagcaggaggaagaacttgcaaaacacatggccgaggaggacgatgatgacttctagattccctctccatgctttcaggtgctgcctgttctttacgaagaagctggtactactctgtcaatttcaggggccgcagtccaatatccttgcagggacaatctgaatgattactcggtgcggttttttatgttcgtaggaagcaccttatttttcactgcaaattcttatatcactacaaattggtaggaagtgccttatttttccatgagatactgtaatcgaggaactgagagagcttgtcggaaactgttttgcactgcatcctgtgtttgctttgtgggaagctgattgaggactagttccatgtgttgcttcattttcgatgtacgtgattcatcataaaaaaaaaa

SEQ ID NO: 1036 - DNA, 1458 bp, Avena sativa
ccgctggcgacgtgtcagccttcctcgccttcgccctccccgcctccagcgacgcatacgcccgactaacctccctgctccccaaggaagatgaaacggagatggatgttgatgcgacggctccagcaactcagatttctatcaagcaaggccttcctgagattgaaatatattgctctctgcttgtcctgattttcctcattgatcagaagaaatatgatgaggctaaatcatgtgcaactgcaagcattgctcgtctgaagaccttgaacaggagaactgttgatgttttggcttctaggctgtacttctattattcgtatgtgcatgaactcaccaacagccttgctgaaattcgtgggaatctccttgggttacatagaatggcaactttacatcatgatgagcttggtcaggaaactctgctcaacctgcttcttcgcaattacctccactataacctgtatgaccaggcagaaaaactgaggtcaaaggcaccacgttttgaagcgcattccaaccagcaattctgccggtacctcttctacttgggaaaaatcagaacaattcagctggagtacaccgatgctaaagaaagcctcctgcaagctgctcggaaggcaccactagcagctcgtggctttcgtattcagtgcaataaatgggctatcatagtaaggctgcttcttggggagatccctgagagaaccgttttcatgcagaaaggaatgaaggaagcgttgacaccatattttgagcttacaaatgctgtcaggattggggatttggaattgtttagagctgttgcagccaaatttgcaagcactttcagtgcagacaggactcacaatttgattgtgaggctgcgccacaatgtgattcgaactggactaaggaacatcagcatttcatactcgcgtatctcccttgctgatattgccaagaagctaaggctagattctgtcaatcctgttgccgatgcggagtgcatcgtatccaaggccataagagatggtgcaattgatgccaccatagaccattcaaatggctggatggtatcgaaagaaactggtgatgtctactcgacgaatgaaccccaggctgcattcaactccaggattgcattctgcctcaacatgcataatgaagcggtcaaggcaatgcggtttcccccgaattctcacaaggaaaaggagagcgctgagaagcgccgagaaagactccagcaggaggaagagctggcaaaacacatggccgaggaggatgacgatgatttttaagttgatcgttttttttttgaattgttgattttgtatcttttgtaattctgtgttgatcagcactttattggaccccagatgtgtctagagtttatctctcttttgtcatcatcaaaaactgatttcgaggatcactgtaccatgcaaagtgacttttggtatgtctgcttcctgactg

SEQ ID NO: 1037 - DNA, 1546 bp, Pennisetum glaucum
gtctccgccttcctcgccttcgcgctccccgcgtcctctgaagcctacgctcgcctcaccgccctcgtgcccaaggaagatgatactgagatggatgttgatgctgcggctccggcaacacagatttcaatcaagcatggtcttcctgaaattgaaatatattgctacttgcttgtcctgattttccttattgatcaaaagaatatgacgaggctaaagcatgtgcaattgcgagcattgctcgtctgaagagcttgaaccggagaactgttgatgttttggcttctcgtctgtacttttattactcttatgtgtatgagcttaccaacagccttgctgaaatccgtgggaatctgctcgcattacacaggatggcaactttgcaccgtgacgagcttggccaggaaactctgctcaatctcctcctccgcaattatctccattacaacctgtatgatcaggcagagaagctcagatcaaaggcacctcgttttgaagctcattccaaccaacaattctgccgatacttgttctacttgggtaagattaggacaattcagttggagtacactgatgctaaagaaagcctcctgcaagctgctcggaaggcacccactgcagctcgtggttttcgtattcagtgcaacaaatgggctatcattgtcaggctacttctcggagagattccagagaggactgttttcatgcagaaaggaatgaagaaggctttgacaccttattttgagctcacaaatgctgtcagggtgggggacctggaattgttcagggctgtcgctgacaaatttgcaagcaccttcagtgcagacaggactcgcaacctgattgtgaggctgcgtcacaatgtcatccgaactggtctgcgcaacatcagcatttcatactcaaggatctcccttgctgatattgctaagaagctaagactagactccgagaaccctgttgctgatgccgagagcatcgtagccaaggccatacgggatggtgcaatcgacgccaccatagatcatgcgaatggctggatggtgtcgaaggaaaccggcgacgtctactcgacaaacgagccgcagatcgcgttcaactcgaggattgctttctgcctcaacatgcacaacgaagcggtcaaggcgatgaggttccccccaaactctcacaaggagaaggagagtgctgagaagcgccgtgagaggcttcaacaggaggaggaattggctaagcacatggctgaagaggacgacgatgacttctaaatttgctggcctttgggcaagccatttgcaacgtggagttgttcagtttgagatcggttccaaaagcaattcctccctcctctgggtctagacaatctgagtcatgcagacattaaagtttgaattcatctgctgtaactttatgttgatcaggattttgtattaactccatgtgcgactggtagtctgcttacgtttcaccctccctgaattgttgaaatggagagaatttgccagatgctagaaccggctatgtttatttcatgatttcttttgct

SEQ ID NO: 1038 - DNA, 2059 bp, Quercus alba
agagaaacaagttaccctagctcaaagcaacttccccaacactttcaagcttcttcaacatgacccaagatgtagagatgaaggagctcccagctccctccaattcagcttcctcctctcctccctcaactctccagcatttgaaggagattgcgtctctcattgagactggcgcatatgctcgagaggttcgacgaattatgcgtgtagtccggcttaccatggcgttgaggcggaagctgaatgcaactgtgcttgcctcattcctcaatttcgctctcaccccaggatctgagttgcacggccggttgttctcgtatcttcctaaggaggatgaacatgacatggatgttgacactgcaacatctgggactcaaattgttgcaaagcactccttgccagagctagagatttactgctatttgcttgtgctaatatttctgattgatcagaagagatacaatgaggctaaagcttgtgcctcggcaagcattgcccgattgaagaacctgaataggagaactgttgatgttttagcatccaggctctatttttattattctcttagctatgaactcactggggatcttgctgaaattagaggcaacctcctttccctgcaccgaattgcaaccctgcgccgtgatgagttgggtcaggaaacacttcttaacctactacttcgcaactaccttcattacaacttatacgatcaggcagagaaacttaggtcaaaggcacctcgatttgaagcccattcaaatcagcagttctgccgctaccttttctacctaggaaagatcaggacgattcagttggagtatacagatgcaaaggaatccctcctgcaagctgctcggaaagcccctgttgcagcacttggttttcgagttcaatgtaacaagtgggcaatcattgttcgtttactgctaggagaaattcctgagaggactgtttttatgcagaaaggcatggagaatgctttgagaccatattttgaattgacaaatgcagtacgaattggtgatctggagctcttcaggaatgttgctgagaagttttcagatactttcaattcagaccggacccataatttgattgttaggctgcggcacaatgtcataaggactgggctacgcaacatcagcatatcttattcccgtatctctctggttgatgttgcaaagaagctgagactggactctgcgaaccctgttgctgatgctgagagtattgtatcaaaggcaatcagagatggtgcaattgatgccacaatagatcatgcaaatggatggatggtatcaaaggagactggggatatctactctacaaatgagcctcaattcgcatttaactcaaggattgctttttgcctcaatatgcataatgaggcagtgcgtgcacttcgatttccaccaaattctcataaagagaaagaaagtgctgaaaagaggagggagagacaacagcaggagcaagagcttgcaaagcacattgctgaggaggatgacgatgagttttgattgcaaagtaatacgcaaaaggcactttaatgctttgtgcaatgttttccatcaagttttcatctctttggaattctctggcaacgtgctttcatttactggtttttagatcattattagacctttcgtttaatttattttatatcttaggttcattgtttaaaatctgactgacttttcttttgccatgctgaattataatctgaagtttcatcttttcctttgaatggtatgttgatgatggcagtttcctaggttaactgttaaaaatctgaccaacttatgtgtcaccatattgaagtataatctgaaatttcatctattcctcttagtattttgttctggatggcagttacaaagggaatgttctaaattttctcaaggcggaaattgagcatttttgctttacccatcctagggtgtgggttggttggtcaatgcctgtaatttgcaaattggtgattggtatattgctgtaatgtaattcatggtatatggtccttaattttttgctgggaggacatttgaagtttttt

SEQ ID NO: 1039 - DNA, 2012 bp, Theobroma cacao
ttattaatggaattataaggtttaatttgatttatcgattacgggaactttgtctgaattaattttaattaaagtaataaaaaaaggttactatatatagcgaattgtcatttgtttatagggaagttcttggcttgaggggaaagaaaagatcttaaaagggaagggagctctgctatctttacgaaaagcaaagaattcacagcaactaccgaaccctagagatcgagctcctccatccagatttaatttcattgcgatcctcgacagagcttttggcagagatgactcaagatgtggagatgaaagatcaccaaactcctcctcattctgtttcctctgccgttccctccaccctgcaccatttgaaggagattgcttcgcttattgagactggttcctacactaaggaggttcgccgtatagtccgtgcggttcgcctcacgttcgggctgaggcggaagctcacggcgcccgtgctctctgcatttctcgattttgcactgcagcctgggtccgaggctcttgctagattgtcttcgtttcttcctaaggaagatgagcatgaaatggaagtcgatactgcaacatctgctgttcagacttcaggaaaacacttgttaccggagctcgagatttactgctatttgcttgtactcctttatcttattgatcagaagaaatacaatgaggctaaagcttgttcctcagcaagtgttaatcggctcaagagcctaaacagaagaactcttgatgtcctagcatcaaggctttacttctattactcatatagctatgagctcactggcgattttgctgaaattcgtggcaacctccttgccttgcatcgtattgctacactacaccatgatgagcttgggcaggaaacacttctaaacttgttgttgcgtaattacctccattataacctctatgatcaagcagagaagctgaggtctaaggcaccacgatttgaagcacactcaaatcagcagttttgtcgatatctcttctacctagggaagatcagaacaattcagttggagtataccgatgcaaaagagagtctgctacaggctgctcgtaaagcccctgttgcagctcggggcttcagaattcagtgtaacaagtgggctatattagtccgtctgctgttgggtgaaatacctgagaggacaatgtttatgcagaaaggaatggagaaagctttgaggccttactttgagctgacaaatgctgtacggattggtgacttggagctctttaggactgttgcagagaagtttgctagcactttcagtactgacaagacacacaatctcattgtccggctgcgacataatgtcattaggactggattacgcaacatcagtatctcttattcacgcatttcactggctgatgttgctgaaaaattaaggttgaactccaaaactccggttgcagatgctgaaagcattgtagctaaggctattcgtgatggtgcaatagatgctacattagaccatgcaaatggttggatggtatcaaaagagactggtgatatatattctaccaatgagcctcaaatagccttccactcaaggattgctttctgccttaacatgcacaatgaagcagttcgagccttacgatttccaccgaacacacacaaggagaaggaaagtgcagaaaaaaggagagagcggcaacagcaagaacaggaactagcaaagcatattgccgaggaggatgatgatgatttttaaggaattttttttccttctgtgattttgaactgaaatatgcttctcaacttcctttattgttctcatttgaaaggctagttcatactttccaattttatggatagtaaccatttttacttggacgaattcaccagtgttgttatcaatacaaaattttaatgtctgatctggtgctgggcagtaggtcgattgtcccagagaataattcgggttggtctctgctggtttggtattagtttctcataagaaattgctacaaggatt

SEQ ID NO: 1040 - DNA, 1601 bp, Castanea mollissima
tctctctctctctctgtgtgtgagacttgtagagaaacaagttaccctagctcaaagcaacttcaccaacactttcaagcttcttcaacatgacccaagatgtagagatgaaggagctcccagctccctccaattcagcttcttcctctcctccctcaactctccatcatttgaaggagattgcggctctcattgagactggtgcatatgcccgagaggttcgacgaattatgcgtgtagtccggcttaccatggcgttgaggcggaagctgaatgcaactgtgcttgcctcattcctcaatttcgctctcacgccaggatctgagttgcacggccggttgttctcgtatcttcccaaggaggatgaacatgacatggatgttgacactgcaacatctgggactcaaattgttgcaaagcactccttgccagagctagagatttactgctatttgctcgtgctaatatttctgattgatcagaagagatacaatgaggctaaagcttgtgcctcagcaagcattacccgattgaagaacctgaataggagaactgttgatgttttagcatccaggctctatttttattattctcttagctatgaactcactggggatcttgctgaaattagaggcaacctcctttccctgcaccgaattgcaaccctgcgccgtgatgagttgggtcaggaaacacttcttaacctactacttcgcaactaccttcattacaacttatatgatcaggcagagaaacttaggtcaaaggcacctcgatttgaagcccattcaaatcagcagttctgccgctacctattctacctaggaaagatcaggacgattcagttggagtatacagatgcaaaggaatccctcctgcaagctgctcggaaagcccctgttgcagcacttggttttcgagttcaatgtaacaagtgggcaatcattgttcgtttactgctaggagaaattcctgagaggactgtttttatgcagaaaggcatggagaatgctttgagaccatattttgaattgacaaatgcagtacgaattggtgatctggagctcttcaggaatgttgctgagaagttttcagatactttcaattcagaccggacccataacttgattgttaggctgcggcacaatgtcataaggactgggctacgcaacatcagcatatcttattcccgtgtctctctggttgatgttgcaaagaagctgagactggactctgcaaaccctgttgctgatgctgagagtattgtatcaaaggcaatccgagatggtgcaattgatgccacaatagatcatgcaaatggatggatggtatcaaaggagactggggatatctactctacaaatgagcctcaatttgcatttaactcaaggattgctttttgcctcaatatgcataatgaggcagtgcgtgcacttcgatttccaccaaattctcataaagagaaagaatgtgctgaaaagaggagggagagacaacagcaggagcaagagcttgcaaagcacattgctgaggaggatgatgatgagttttgattgcaaagtaatacgcaaaaggcactttaattcttcgtgctatgtttt

SEQ ID NO: 1041 - DNA, 1968 bp, Glycine max
atagaggacatgtgccagctgttcgaccatattggtttcactttggtcttcttcaccctgttagggtttgcatcagattcccccaattcttgtttgattttgcgctttcactagtttttcttcgacatgactcaagatctcgagatgagggatcgctcaacgccttccaactctgtttctttgcctgctccatctactttgcagcatttgaaggagatagcgtctcttatcgagaccggttcgtactcgaaggaagttcgtagaattgctcgcgctgttcgccttacaattgcgttgaggcggaaattgacagcatccgctatctcttcttttctcgaccttgttctcactccaggctctgaagttcacgccaaattgtctgcgtatcttcccaaggaggatgatcatgagatggaagtggacgccgcaacatctgctattcaaaccccagccaaacacttgttgcctgagctagaaatctactgttacctgcttgtactactttttctgattgatcagaaaaaatacaatgaggccaaagcttgttcctcggctagcattgtttggcttaagaacacaaacaggagaactgttgatgttattgcatccagactgtatttttactattcgtatagctatgagcttacaggagatcttgctgaaattcggggcaacctccttgcattgcaccgatttgcgactctccgccatgatgagctgggacaggaaacacttcttaatttgttacttcgaaactaccttcactacaacctatatgatcaggctgagaagttgaggtccaaggctcctcgatttgaagcacattcaaaccagcagttttgtcgttatctcttctaccttgggaaaattcggacaattcagctggagtatacagatgcaaaagagtctctcctgcaggccgcccggaaagctcctgttgctgcaaggggttttcgaattcaatgtaacaagtgggctgtgatagtgcgtttactgttgggagaaatacctgagcggactgtcttcatgcagaaaggaatggagaaagctttaaggccttactttgagcttacaaatgctgtgcggattggagacttggaactgtttaggaatattgcagacaagtttgccactacctttaatgcagacagaacccataatttgattgttcgtttgcggcataatgtcatcaggactggtttacgcaacatcagcatctcctattctcgcatctctctagctgatgttgctaaaaaactgaggctgaactctgcaaatcctgttgcagatgctgagagcattgtatcaaaggctattcgtgatggtgcaattgatgctacattggatcatgccaatggttggatggtgtccaaagaaactggagatatttactccacaaatgagccacagtcagccttcaattctcggattgctttctgtcttaacatgcacaatgaggcggttcgagctcttcgttttccaccaaacacacacaaagagaaggaaagtgctgaaaagagaagagagagacaacagcaagagcaagagctggctaagcatattgcagaggaggatgacgatgatttttgataattgtcttatttcaccctatgaattgctatgaggataccttcgtttccaacctttgctcatcttttccttttgaagaatttccattattatttccttttcaaaaggtgaatttttcattttctaagtggaagatctctgaaagtcagtttaacatatcgaaagatttactatttatttccatccatgatgactgctatggtttgttccttgtttggagaattatgttgtaggacctgaagaaaaaaatcaattatttaggaccaagcgaattctcttcagaagttttattattaaaaactattatcctgagattgtgtttggatgggataatttaattagggaatgtattttttatagggaattaattttttttat

SEQ ID NO: 1042 - DNA, 1902 bp, Glycine max
atagaggacatgtgccagctgttcgaccatattggtttcactttggtcttcttcaccctgttagggtttgcatcagattcccccaattcttgtttgattttgcgctttcactagtttttcttcgacatgactcaagatctcgagatgagggatcgctcaacgccttccaactctgtttctttgcctgctccatctactttgcagcatttgaaggagatagcgtctcttatcgagaccggttcgtactcgaaggaagttcgtagaattgctcgcgctgttcgccttacaattgcgttgaggcggaaattgacagcatccgctatctcttcttttctcgaccttgttctcactccaggctctgaagttcacgccaaattgtctgcgtatcttcccaaggaggatgatcatgagatggaagtggacgccgcaacatctgctattcaaaccccagccaaacacttgttgcctgagctagaaatctactgttacctgcttgtactactttttctgattgatcagaaaaaatacaatgaggccaaagcttgttcctcggctagcattgtttggcttaagaacacaaacaggagaactgttgatgttattgcatccagactgtatttttactattcgtatagctatgagcttacaggagatcttgctgaaattcggggcaacctccttgcattgcaccgatttgcgactctccgccatgatgagctgggacaggaaacacttcttaatttgttacttcgaaactaccttcactacaacctatatgatcaggctgagaagttgaggtccaaggctcctcgatttgaagcacattcaaaccagcagttttgtcgttatctcttctaccttgggaaaattcggacaattcagctggagtatacagatgcaaaagagtctctcctgcaggccgcccggaaagctcctgttgctgcaaggggttttcgaattcaatgtaacaagtgggctgtgatagtgcgtttactgttgggagaaatacctgagcggactgtcttcatgcagaaaggaatggagaaagctttaaggccttactttgagcttacaaatgctgtgcggattggagacttggaactgtttaggaatattgcagacaagtttgccactacctttaatgcagacagaacccataatttgattgttcgtttgcggcataatgtcatcaggactggtttacgcaacatcagcatctcctattctcgcatctctctagctgatgttgctaaaaaactgaggctgaactctgcaaatcctgttgcagatgctgagagcattgtatcaaaggctattcgtgatggtgcaattgatgctacattggatcatgccaatggttggatggtgtccaaagaaactggagatatttactccacaaatgagccacagtcagccttcaattctcggattgctttctgtcttaacatgcacaatgaggcggttcgagctcttcgttttccaccaaacacacacaaagagaaggaaagtgctgaaaagagaagagagagacaacagcaagagcaagagctggctaagcatattgcagaggaggatgacgatgatttttgataattgtcttatttcaccctatgaattgctatgaggataccttcgtttccaacctttgctcatcttttccttttgaagaatttccattattatttccttttcaaaaggtgaatttttcattttctaagtggaagatctctgaaagtcagtttaacatatcgaaagatttactatttatttccatccatgatgactgctatggtttgttccttgtttggagaattatgttgtaggacctgaagaaaaaaatcaattatttaggaccaagcgaattctcttcagaagttttattattaaaaactattatcctga

SEQ ID NO: 1043 - DNA, 1762 bp, Momordica charantia
cctcttcttcttctcctcctcctctcatcgcttttcactgcaagatcctgtgctttatctctaattgagaagttgtagcgaagatgacccaagacgctgagatgaatgagcttcctgctccattgtcttcttcttcttcttcaacttctccctctactctacagcatttgaaagagattgtgtcgcttcttgagactggtgcttatgcccgagaagttcggcgcattgttcgtgccattcgtctgactatggcgttgaggcggaagttgaaggcttcagttctttctcaatttctgaatcttgttctcccgccaggatccgaggttcactcaaggttatcgtcatttcttcctaaggatgatggctacgaaatggatgttgactcggcaacacaggctcctgccaaacaccccttgcccgagatagagatattctgctatttgattgtgctaatatttttgattgatcagaagaaatatgatgaggctaaggcttgtgcttccgcgagcattgcccggctgaagaatctgaataggagaacggttgatgtgctagcatccaggctctacttctattactccctcagctatgaactcactggtgatcttgctgaaataaggggtaacctcctagccctgcatcgcattgcaaccttgcgccatgatgaattgggtcaggaaactcttctcaaccttctacttcgtaattacctccactacaacctttatgatcaagcagagaagttgagatccaaggcaccccgatttgaagctcactcaaatcagcagttctgtaggtacctgttttaccttggcaagattaggaccattcagctggagtatacagatgcaaaggagtctcttctacaagccgctcggaaagcacccattgcagcccttggtttccgagtgcaatgcaacaaatgggcaatcattgttcgcttgttgctgggagaaattcctgagaggacggttttcatgcagaaaggcatggagacagctctgaggccatactttgaacttactaatgctgtgagaattggtgacttggagcttttcagaaccgttgctgagaaattctctagtactttcagcacagatcgaaccaacaatttgattgtgaggctgcgacataacgttattaggacagggcttcgcaacattagcatttcttattcacgtatctctctggctgatgttgctaaaaagctgagactggactgtgcaaatcctgttgctgatgcggagagtatcgtctccaaggcaatccgagatggagcaatcgatgccacagttgaccatgcgaatggatggatggtatccaaggagactggcgacatctacttgaccaacgaacctcaaatagccttcaactcgaggattgcattttgcctgaatatgcataacgaggctgttcgcgctctccggttcccaccaaattcacataaagaaaaagaaagtgccgagaaaaggagagaaagacaacagcaggagcaagaactcgcgaagcatatagctgaagaggatgacgacgacttttaggtgactgaatctgtgggagacaggtacgagtttttgatgcatcaatcaaataatacagttgtattgaaaattgcttagcagaaaatttttgatgcattgattcagatggctctagccctgattttcttttatcatggaatcatttgtgtttgtaattgccggctgaaactatttcatggaatgttcttgaggtgcccattttatatacccttctgaattgt

SEQ ID NO: 1044 - DNA, 1692 bp, Tropaeolum majus
tcacaggcaccctagagagctccagtgtatgaacaatcgaacctctccagatttagcttctgcaaagatgactcaagacgtggaaatgaaagaccaccaaactccttcgcaatctgtttcatcggctgttccatctactttgcagagcttgaaggagatagcggctcttattgacactggttcttacaccaaggaagttcgccgaatcgctcgcgctgttcgtctcaccatgtgtctgaggcggaagctgacggttgcggtgctatctgcgttccttgattttgctctcgtgcaaggttctgagatacatgcccggttatccgcgtatcttcctaaggataatgagcacgagatggaagttgacactgcaacatctgctacccaaactgcagcaaaacacccatcacctgagctcgagatacactgctatctacttgtgcttctatttcttattgatcataagaagtacagtgaggctaaggcttgttcttcagcaagtattgttcgtctcaagaacctgaacagaagaactgttgatgtcctagcatctagactctacttctattactcttatagctatgagctcatgggtgatctggctgaaatacgtggcaaccttcttgcgttgcatcgtatagcaaccttacgccatgatgagcttggtcaggagacacttttgaaccttttacttcgtaattatctccactataacctgtatgatcaggcagagaagctgaggtcaaaggcaccacggttcgaagcacactcaaaccagcagttctgccgatatctgttttaccttggtaagattcggactattcagctggaatatactgatgcaaaggagagtctcttacaggctgctcggaaagcccctattgctgcaaggggcttccgaattcaatgtaataagtgggcaatattagtgcgtttgctgttgggagaaatacctgagaggacagtttttatgcagaaaggaatggagaaggctttgaggccatactttgagcttacaaatgctgtgcggattggtgacttggagctctttaggagtattgcagacaagtttgcggccacttttagtgctgaccgaacacacaatctgattgttcgactgagacataatgtgatacggactgggttacgcaacattagtatatcttactctcgtatctcacttgctgatgttgcaaagaaactgagattgaactctgcaaacccagttgcagatgccgaaagcatcgtcgcaaaggctatccgtgatggtgcaattgatgccacattggatcacgcaaacggatggatggtttccaaggagactggagacatttattctacaaatgagccacaagttgctttcaactccaggattgccttttgtcttaacatgcacaacgaagcagttcgtgccttgcgatatccaccaaatacccacaaagagaaggaaagtgctgagaagaggagagaaaggcaacaacaagagcaagaacttgcacaacacattgctgaggaggatgacgacgacttttaagagtggtatttgattttagacatgcaactcctcattttatctacttcctgaatatcatatcatgaacactccttatatttttgtagaattaactgcttttctgtatttaagtgtctaccgattcaatgctcatgagactgagccaattaaatttattttgt

SEQ ID NO: 1045 - DNA, 1981 bp, Populus trichocarpa
cttcactccactttgttagacttgtagtgaacgaaaaggtctaaataacccccatctccacctccatctccatcccagtttctcccaagtcaaattgtcctctttcagaaaccctaatttcaccccaaaaaagtccctcatttctctctcagtctctctcttcaatcatgactcaagatgttgagatgaaagagcagcatcaaccttccaattccaccacctcctctccatccacactccaccatttgaaggagattgcatcgttaattgagactggagcgtatgcgaaggaaacgaggaggattcagagagctgtgagactgactaatactttaaggagaaagttgaaagcttctgtgctttatgcttttcttaattttgctctttcggcgggatccgagtcgtttaatcgtttaatctcttatcttcctaaggaagatgagtatgaaatggaggttgatactgcgacatctgtgactcaagcacctgcaaaacatcccttgccagagctggagatatattgctacttgttggtgctgatttttctgattgatcagaagaaacacattgaggctaaagcttgctcatcggcaagcattgctcgcctgaagaatctgaataggaggactgttgatgttctggcatcaaggctgtattcctactactcacttagctatgaactcactggtgatcttgctgaaatcagaggtagcctccttgctcttcatcggattgcaacactgcgccatgatgagctgggccaggaaacacttctcaacctgctactccgcaattacctccattacaatttatatgatcaggcagagaagctgaggtcgaaggcccctcgatttgaggctcactcaaatcagcagttttgtcggtatctcttttacttgggaaagattaggacaattcagttggagtatactgatgcaaaagaatctctccttcaagctgcacgtaaagcccctgctgcagcccttgcttttcgagttcaatgcaacaagtgggcagttattgtcagattgctgctaggagaaatccctgagaggactgtttttatgcaaaaaggcatggagagtgctttgaggccatactttgagctcacaaatgctgtgcgaataggggacttggagctctttaagtccgttgctgagaagttctcatctactttcagcaaagacaggacccacaacttaattgttagactgcggcacaatgtcataaggactggacttcgcaacatcagtatctcttattctcgtatttcactggctgatgtagccaagaagctgaggttggactctgcaaaccctgttgctgatgctgagagtattgtggctaaggcaatacgagatggtgctattgatgctactttagatcgtgcaaatgggtggatggtatccaaggaaacaggggacatatactccacaaatgagcctcagctggcatttaactctaggattgccttctgcctcaacatgcataatgaggcagtacgtgcccttaggtttccacctaattcccacaaggagaaagaaagtgctgagaaaaggagggagagacaacagcaggagcaagagcttgcaaagcacatagctgaggaggatgatgatgagttttgatctagtgtctgcaaagatacttgtctgttttcctgatggaattctctccagctccgtgattctctatatgaactccccagcagaaatgaggacctttatgggtatatttgtcacggttatttatgttgtgatttaggattctgtcttgtaatcgagctacctccgttcaactattttgatttgaattgttgggttgctcctttcttccccttgaacttatcttatttcccttttctatcatttgattttgctgcattattatcaaattgatgaatctgtgatgagtgtgcctattgatttcatttcataacagatggatatattagtgataataaagtaaatatccattatta

SEQ ID NO: 1046 - DNA, 1886 bp, Medicago truncatula
gttttagcttcggaaaaagctctcagtgagtttgtgaccacgttgcttcttgtttggtcttcttcacttgttagggtttttttaatcaaaatctcccaattttcgcccaatttcgctcaatttcgttcacaatgactcaagatcttgagatgaaagatcgttcaactccttcgaattccgtttctccaccagttccatctactttgcagcatttgaaggagatagcgtccgttatcgagaccggttcgtactcgaaggaagttcgtagaattgctcgtgctgttcgtcttacaattgcattgaggaagaaattaacagcttctgttatatcttcttttctcgatcatgttcttactcctggttctgaacctcatgctaaattgtctgcgtatcttcccaaggaggatgatcatgagatggaggtggacgctgcaacatctgccattcaaacccctatccctacagctaaacacttgttgcctgagctagaaatttactgttacctgcttgtactactttttctgattgatcagaaaaaatacaatgaggccaaagcttgttcttcagctagtgttgcttggctgaagaatgtgaacagaagaactgttgatgttattgcatctaggctatttttttactattcatatagccatgaacttactggagatctggctgaaattcggggaaacctacttgcattgcatcggattgccacccttcgccatgatgagttgggtcaggaaacccttcttaatttgctgcttcgcaactatcttcactacaacctatatgaccaggcagagaagttgaggtcaaaggctccacgatttgaagcacattcaaaccagcagttttgtcgttatctcttctacctcgggaaaatccggactattcaattggagtatacagatgcaaaagagtctctcctgcaagctgctcgtaaagctccagttgcagctcggggttttcgaattcaatgtaacaagtgggctatcatagtgcgtttactgttgggagagatacctgagcgaaccgtctttatgcagaaaggaatggagaaagcgctaagaccttactttgagcttacaaatgctgtccgtattggagatttggagctgtttaggaacattgcagataagtttgcaaccaccttcagtgcagatggaactcataatttgattgttcgtctccgacataatgtcatcaggactggtttacgtaacatcagcatctcctattctcgcatctcactagctgatgttgctaaaaagttgaggttggactcgccaaatcctgttgctgatgctgagagcattgtctcgaaggctattcgtgatggagcaattgatgctacattggatcatgcaaatgggtggatggtgtctaaggaaacaggagatatttactccacaaatgagcctcagctggctttcaattctcgaattgccttctgtcttaacatgcacaatgaagctgttagagcacttcgttttccaccaaacacacacaaagaaaaagaaagtgctgagaagagaagagagagacaacagcaagagcaggaactggccaaacatattgcagaggaggatgatgatgatttctgataagattgtcttttttcaccctactagttgcaatcgggatctgtttacttccgacatttgcttatatttccattatgaagaacttccattagcatttccctttcaaaagttgaaaatttcattttctacatggaagacctcttacagtcctttaccatatggaaatctctacagtctgcagtctgtttttattcatgatgatgacttctatggtttgtttcttttggcataattgtgtttttggatcttgaaaaaaagtcaattaattaggaccttgctagt

SEQ ID NO: 1047 - DNA, 1810 bp, Cucumis melo
cttgccgaagaagaaatttgaggaaaacccttaccttcttcgtctcttatccgttttactcaaactctcaaagatgactcaagacgccgagatgaaagagcttcctgctccattatcgtcttcttcctcttcagcgtctccctcagctctacagaatttgaaagaaattgtgtcgctcattgagaccggggcctatgctcgggaggttcggcggattgttcgtgccattcgtctgactatggcgttgaggcggaagttgaaggcttctgttctttctcaatttctgaatcttgtactccccacagggtctgaggtgcacactaggttatcctcatttcttccgaaggaggatgactgtgaaatggatgttgacacggcaactcaagctcctgccaaacaccctttgcccgagatagagatatattcgtacttgattgtgctaatatttttgattgatcacaagaaatatgacgatgctaaggcttgtgcctcagcaagcattgcacggcttaagaaccttaataggagaacagtcgatgttttagcatccaggctctacttctattactccctcagctacgaactcactggcgatcttgctgaaataaggggtaacctcctagccctgcatcgcattgcaaccttgcgccatgatgaattgggtcaggaaaccctacttaaccttctacttcgtaattacctccactacaacctatatgatcaagctgagaagttgaggtccaaggcaccccggtttgaagctcactcaaatcagcagttctgtaggtacctgttttaccttggtaagatcaggaccattcagctggagtatacagatgcaaaggaatctcttctacaagctgctaggaaagcacccattgctgctcttggttttcgagtgcaatgcaacaaatgggcaatcattgttcgcttgttgctaggagaaatccctgagagaaccgttttcatgcagaaaggcatggagacagctctgaggccatactttgaactcacaaatgctgtgagaattggtgacttggagctcttcaggactgttgctgaaaagttctctagtactttcagctcagatcgaactaacaacttgatcgtgaggctgcgacataatgtcatcaggactgggcttcgcaacattagcatttcctattcacgcatttctctggttgatgttgctaagaagcttaggttggactcggcaaatcctgttgctgatgctgagagtattgtctccaaggcaattcgagatggagcaattgatgcgacagtcgatcatgcaaatgggtggatggtatcaaaggagactggtgatatttactcgaccaatgaacctcagattgctttcaattcgaggattgcattttgcctgaatatgcataacgaagcagtgcgtgctcttcggtttccgccaaattcacacaaggaaaaagagagcgctgagaaaaggagagaaagacaacagcaggaacaagaacttgcaaaacacatagccgaagaggatgacgacgacttttagcttatttaatatggaggagatggtatggatcttttgtgcatgaatgaaataaatacagttttattcagaaattctagggagaaaatttttgatccattggtggttcagatggccctttgccgttttctttattgtcaattatttgtgtttgtaatgccggctgcttgcaacttcttcatttatggaatgtccttgagatttccatcttatacctttacctttctgaattgcaactccagctttgtgattgtgttatccgcaagtagaagattttgttct

SEQ ID NO: 1048 - DNA, 1919 bp, Arachis hypogaea
agactttggaagaacaagtgccagatgtggacacacttcttctgctttagtcttgttgcttgttccttccttttcctgcaccgtgttagggtttggatcagaatctctcgtttcttgccttgatttcaaagttagaagtagattccataaaagatgactcaagatcttgagatgaaggatcgttcaacgccttccaactctgtctcctcagctgttccatctactttgcagcatttgaaagagatagcgtctcttattgagaccggttcgtactcgaaggaagttcgcagaattgctcgtgctgttcgccttacaatcgcattgaggcgcaaattgacagcttccgttatatcatcttttctcgattatgtcctcactaccggttctgaggctcacgccaaattatctgcctatattcccaaggatgaggatcatgagatggaagtggatgctgctacgtctgcaattcaaactccagctaaacatttgttgccggagatagaaatatattgttacctgcttgtactactttttctgattgatcagaaaaggtacaatgaggccaaagcttgttcgtctgcaagcattgttttgttgaagaatctgaacagaagaactgttgatgttattgcatcaagactgtacttctattattcttacagctatgagcttacaggagatcttgctgaaattcggggaaaccttctggctttgcaccgtattgctactctgcgccatgatgagctgggtcaggaaacacttctaaatctgttgcttcgtaactaccttcactacaatctgtacgatcaggccgagaagctgaggtccaaggctccacgatttgaagcacattcaaaccagcagttctgccgttatctcttctacctaggaaagattcgtacaattcagttggagtatactgatgcaaaagagtctctcctccaagctgcccgaaaagctccagttgcagcacgtggttttcgaattcaatgtaacaagtgggctgtgatagtgcgtttactgttgggagaaatacctgagcgaactgtgtttatgcagagagggatggagaaagctttgaggccttactttgaacttacaaatgctgtccggattggtgacttggagctgtttaggaatattgcagacaagttcgctaccacctttagtaccgacagaacccataatttgatagttcgtctgcggcataatgtcatcaggactggtttacgcaacatcagcatctcctattcccgcatctcactagctgatgttgctaagaaattgaggttgaactcagcaaatcccgttgctgatgctgagagcattgtctcaaaggctatccgcgatggggcgattgatgctacgttggatcatgcaaatgggtggatggtttctaaagaaactggggatatctactcgacaaatgagcctcaactggcttttaattctcggattgccttctgtcttaatatgcacaatgaagctgttcgagcccttcgatttcctccaaacacgcacaaggaaaaggaaagtgctgaaaagaggagagagagacaacagcaagaacaagaattagctaagcatattgcggaggaagatgatgatgaattctgatatccattgtcccgttaaacttatccagctgcagtcaggatctctttattttcaatcttctctcatatttttcgttctaagaacttccattgccattttattttgaaaagaatgatttattcaattgctaagtggaagatatctggaaatcttttaacaaattgaaatcgttactatgcttttcatccttgatgacgactgtggtttttagtagtattgtttggagatgtatgccttaagttatgaaagagaaaaatcaactatttagtattatcatattgattttatccaaaatgttaatc

SEQ ID NO: 1049 - DNA, 1905 bp, Nicotiana tabacum
  misc_feature (125)..(126): n is a, c, g, or t
  misc_feature (130)..(130): n is a, c, g, or t
ccgggacacttaaaacgaaaaaagaaaagaaaagaaaaggagcaaggacgaaatggtcaaaaagagcgtttgcagtgtgtgaggtttatcacagagcatcgactcttgagaagctcggaatcacnnacantgttagactcgtttctgtttctttctggaattgatcttttcagacaagatgactcaagacgtggagatgaaggagcaagcagctcctccttctaattctctttcatccactgccccctcaatcttccatcatttgaaagagatagcatcgttgattgagactggggcatatgctcgtgaggttcggaggatttcaagagccgtgaggctgactatggcactgaggaagaagctaaaggcttcttcactatctgctttcctcaattatgttctagtgcctggatctgaggtgcattcccggctatcttctttcctaccaaaggaagacgagcaggatatggaagttgatactgcaacatctggagctcaggcaccgattaagaatcctttgccagagcttgagatctattgctacttgcttgtattgatatttctaattgaccagaagaaatacaatgaggctaaggcgtgctcctcagcaagtattgctcgtttgaaaactgtcaacaggaggactgttgatgtactagcttctaggctttacttctactactctctgtgttatgaacttactggtgatcttgctgaaattcgaggtaatctccttgcattgcaccggattgcaacattacgccatgatgagttgggtcaggaaacactccttaatctgctgctgcggaattatcttcactacaacttgtacgatcaagcagagaaattgaggtcaaaggccccccggtttgaagctcattcaaatcagcagttcagccgatacctcttttaccttggaaagatcaggacaatccagctggagtacactgatgctaaagaatctcttcttcaagctgctcgtaaagctcctcaggctgctcttggtttccgagttcaatgtaataaatgggctattattgtccggttattgcttggagagattccagaaaggactgtttttatgcagaaaggcatggagaaagcattaaggccatactttgagctgacaaatgctgttcgcataggagatctggagttatttaggaaagttgctgagaagttctccagcacttttagttcagatggaacaaacaatttgattgtgagactccgacataatgtcattaggactgggctacgaaacatcagtatctcatactctcgaatctcgctggttgatgttgcaaaaaagctgaggttggattctccaaaccctgttgctgatgctgagagtatcgtgtccaaagcaattcgagatggtgcaattgatgcgacgttggatcatgcgaatggatggatggtatcaaaggagactggtgacatctactctacaaatgagcctcaaattgcttttaactcgagaattgccttctgtctgaatatgcataatgaggctgtgcgtgctcttcgatttcctccaaattcccacaaggagaaagaaagtgctgagaagaggagagagagacaacagcaagaacaagagcttgctaagcacatagctgaagaggatgatgatgatttctgattgggtctattatcatgagatgaacaaggaagatgctgtgtttaagatttccctgccatttgagatttggatatttagcttattccttggattaaacaaatatgcctcatctgcaatttcttttggccttctatttctcctattatgaagtaccagatttcataattaatgtttttactgttagcaaaaatttattgtggaattctctcatatgtttttctccaactatttctttttgtagccaaacacttccttttggc

SEQ ID NO: 1050 - DNA, 1938 bp, Populus trichocarpa
ttagacttgtactgaaagaaaactaggtttaaacaccaacctctctccatctccaatttctcccaaatcaaaatctctttcagaaaccctaatttctctcccatcctctctctttaatcatgactcaagacgtcgagatgaaagagcagcagcagcaaccctctaattccaccacatcatcctctccttccactctccaccatttgaaggagattgcgtcgttaattgagactggagcgtatgcgaaggaagcgaggaggattgtgagagctgtgagactaactatgactctgaggagaaagttgaaagcttctgtgctctctgcttttcttaattttgctctttcggcgggatccgagccgtttaatcggttaatttcctatcttcctaaggaagatgcgcatgaaatggaggttgattctgtgacatctgtgactcaagctcctgcaaaatatcccttaccggaactggagatatattgctacctgttggtgttgatatttctgattgatcagaagaaatataatgaggctaaaacttgttcatcagctagcattgctcgcttgaagaatctaaataggaggactgttgatgttctggcatcaaggctgtattcttactactcacttagctatgaactcactggtgatcttgctgaaatcagaggtaacctccttgctcttcaccgggttgcaacattgcgccatgatgagctgggccaggaaacgcttctcaacctactgctccgaaattacctccattacaatttatatgatcaggcagagaagttgaggtcaaaggccccgcgatttgaggctcattcaaatcagcagttctgtcggtatctcttctacttgggaaagattaggacaattcagttggagtatactgatgcaaaagagtctctccttcaagctgcacgtaaagcccctgccgcagcccttggttttcgagttctatgcaacaagtgggcagttattgtcagattgctgctaggagaaatccctgagaggactgtttttatgcagaaaggcatggaaaatgctttgaggccatactttgagctcacaaatgctgtgcgaataggggacttggagctctttaagtccatcgctgagaagttctcatccacttttaacgcagacaggaccctcaacttaattgttagactgcggcacaatgttataaggactggacttcgcaacatcagtatctcttattctcgtatttcactggctgatgtagccaagaagttgaggttggactctgcaaatcctgttgcagaggctgagagcatcgtggccaaggcaatacgagatggtgctattgatgctacattggatcatgccaatggatggatggtatctaaggaaacaggggacatatattccacaaatgaacctcaaattgcatttaactctaggattgccttctgccttaacatgcataatgaggcagtacgtgcccttaggtttccaccgaattcccacaaggagaaagaaagtgctgagaaaaggagagagaggcaacaacaagagcaagagcttgcgaagcacatagctgaggaggacgatgatgagttttgatttagcatctgtgaaggggcctgtcagttcatcatggaactctctcctccagctctttgcctttataatctgaactccatggcaggaatctagacctttttgagtctatctgtctcggtaattttttttttttgtgatttaggattctttctcatagtcgagcaaccacttttaaactatattgaattgtatggtgggttgctcttttccttccccagaatttattctctcattgctgtcatttgattttactgcattattgtcaaattgatgcacccgtgcccagagtgtgcctagtgacttaaattcataagaaatggatacattagataataaggtaatatctaatatt

SEQ ID NO: 1051 - DNA, 1938 bp, Populus trichocarpa
ttagacttgtactgaaagaaaactaggtttaaacaccaacctctctccatctccaatttctcccaaatcaaaatctctttcagaaaccctaatttctctcccatcctctctctttaatcatgactcaagacgtcgagatgaaagagcagcagcagcaaccctctaattccaccacatcatcctctccttccactctccaccatttgaaggagattgcgtcgttaattgagactggagcgtatgcgaaggaagcgaggaggattgtgagagctgtgagactaactatgactctgaggagaaagttgaaagcttctgtgctctctgcttttcttaattttgctctttcggcgggatccgagccgtttaatcggttaatttcctatcttcctaaggaagatgcgcatgaaatggaggttgattctgtgacatctgtgactcaagctcctgcaaaatatcccttaccggaactggagatatattgctacctgttggtgttgatatttctgattgatcagaagaaatataatgaggctaaaacttgttcatcagctagcattgctcgcttgaagaatctaaataggaggactgttgatgttctggcatcaaggctgtattcttactactcacttagctatgaactcactggtgatcttgctgaaatcagaggtaacctccttgctcttcaccgggttgcaacattgcgccatgatgagctgggccaggaaacgcttctcaacctactgctccgaaattacctccattacaatttatatgatcaggcagagaagttgaggtcaaaggccccgcgatttgaggctcattcaaatcagcagttctgtcggtatctcttctacttgggaaagattaggacaattcagttggagtatactgatgcaaaagagtctctccttcaagctgcacgtaaagcccctgccgcagcccttggttttcgagttctatgcaacaagtgggcagttattgtcagattgctgctaggagaaatccctgagaggactgtttttatgcagaaaggcatggaaaatgctttgaggccatactttgagctcacaaatgctgtgcgaataggggacttggagctctttaagtccatcgctgagaagttctcatccacttttaacgcagacaggaccctcaacttaattgttagactgcggcacaatgttataaggactggacttcgcaacatcagtatctcttattctcgtatttcactggctgatgtagccaagaagttgaggttggactctgcaaatcctgttgcagaggctgagagcatcgtggccaaggcaatacgagatggtgctattgatgctacattggatcatgccaatggatggatggtatctaaggaaacaggggacatatattccacaaatgaacctcaaattgcatttaactctaggattgccttctgccttaacatgcataatgaggcagtacgtgcccttaggtttccaccgaattcccacaaggagaaagaaagtgctgagaaaaggagagagaggcaacaacaagagcaagagcttgcgaagcacatagctgaggaggacgatgatgagttttgatttagcatctgtgaaggggcctgtcagttcatcatggaactctctcctccagctctttgcctttataatctgaactccatggcaggaatctagacctttttgagtctatctgtctcggtaattttttttttttgtgatttaggattctttctcatagtcgagcaaccacttttaaactatattgaattgtatggtgggttgctcttttccttccccagaatttattctctcattgctgtcatttgattttactgcattattgtcaaattgatgcacccgtgcccatagtgtgcctagtgacttaaattcataagaaatggatacattagataataaagtaatatctaatatt

SEQ ID NO: 1052 - DNA, 1849 bp, Helianthus annuus
aaaaaaaatgactcaggatgttgagatgaaagaacagcaagtcgttgcagcagctccttcgaattctacgtcatccgccactcctgtgttacagcatttgaaagaaattgctgcactgattgagacgggagcttatgctcgtgaagttcgtcggattttgagggcggttaggctgacgattgcgttgaggaggaagttgaaggcttcggttatttcttcgttcctcggttttgctcttgctcctggatcggaagcacactcgcggctaacttcatatctccctaaggatgatcaaagtgatatggaagtggataccgcggcatctgctactcaggctactgtgaagcactcgtcagagctcgagatctattgctacttgcttgtgctcatattcctcattgaccagaaaaagtacagtgaggctaaggcttgttcttcagcaagcattgcccgtttaaagaacttgaacaggagaaccattgatgttctggcttctaggctgtacttctattactctcttagctatgaacttactgatgatctcgctgaaatcaggggtaatcttcttgctctgcaccgggttgctacattgcgtcatgatgaattagggcaggaaacacttctcaacctgctgcttcgcaactaccttcattacaatctgtatgatcaagctgaaaagctgaggtcaaaggcaccacgttttgaagctcattcgaatcagcagttttgccggtacttgttttaccttgggaagataaggacgatacagctagagtacactgacgcgaaggaatcccttcttcaagctgctcgtaaagcacctgtagctgcccttggttttagagttcaatgcaacaagtgggctgtgattgtccgcttacttcttggggaaatccctgaacgaaccgtttttatgcaaaaaggcatggaaaaggccttgagaccgtactttgagctgactaacgctgttaggatcggagacctagagctgtttaaaaccgtagcagagaaattctccactactttcagctcagacaggactaacaatttgattgtgaggctgcgccacaatgtgataaggaccgggctccgcaacatcagcatctcctactcgcgtatctccctcgctgacgtggcaaagaagctgagactggactcgcctaaccctgtggcggatgcggagagcattgtgtcaaaagcaatccgtgatggcgcgattgatgcaacactagatcacgcaaacggatggatggtatcaaaggaaactggtgacatttactcgacaaatgagcctcagcaggcgtttaattcgagaattgctttctgcctgaatatgcataatgaggcggtccgggcccttcggtttcctcctaattcccataaggaaaaagaaagtgctgaaaagaggagagagaggcaacagcaggaacaagagcttgctaagcatattgctgaggaagatgaagacgacttttgattctatcaattaaccaggtaagcgcttttgctttgtgttcttgtcaccactgtttgaatatgttaaatccaaattctggtatttgtgtttcctgtcagactctttcagtttggatgaagtagactatgtttttacttgttatgatcatcttactagaatatgttttttgttgatgttttataacattaatacttcaaaacctatatgagttacactatgtgaccattctatcccgtacaatccttgctctcaactcgaactaagtccgcttcatttcaataaatgtagagaaaacccaagcgatacatgtggacaccacgtacaaccaaaccattagtcattaacataccatacagcattaaactatctaaa

SEQ ID NO: 1053 - DNA, 1715 bp, Helianthus annuus
  misc_feature (1216)..(1216): n is a, c, g, or t
  misc_feature (1624)..(1624): n is a, c, g, or t
tctaagctttatatcatcgatcgattccaacacgatcttcctccgttcagaaaaaaaaatgactcaggatgttgagatgaaagaacagcaagtcgttgcagcagctccttcgaattctacgtcatccgccactcctgtgttacagcatttgaaagaaattgctgcactgattgagacgggagcttatgctcgtgaagttcgtcggattttgagggcggttaggctgacgattgcgttgaggaggaagttgaaggcttcggtgatttcttcgttcctcggttttgctcttgctcctggatcggaagcacactcgcggctaacttcatatctccctaaggatgatcaaagtgatatggaagtggataccgcagcatctgctactcaagctactgtgaagcactcgtcagagctcgagatctattgctacttgcttgtgctcatattcctcattgaccagaaaaagtacagtgaggctaaggcttgttcttcagcaagcattgcccgtttaaagaacttgaacaggagaaccattgatgttctggcttccaggctgtacttctattactctcttagctatgaacttactgatgatctcgctgaaatcaggggtaatcttcttgctctgcaccgggttgctacattgcgtcatgatgaattagggcaggaaacacttctcaacctgctgcttcgcaactaccttcattacaatctgtatgatcaagctgaaaagctgaggtcaaaggcaccacgttttgaagctcattcgaatcagcagttttgccggtacttgttttaccttgggaagataaggacgatacagctggagtacactgacgcgaaggaatcccttcttcaagctgctcgtaaagcacctgtagctgcccttggttttagagttcaatgcaacaagtgggctgtgattgtccgcttacttcttggggagatccctgaacgaaccgtttttatgcaaaaaggcatggaaaaggccttgagaccgtactttgagctgactaacgctgttaggatcggagacctagagctgtttaaaaccgtagcagagaaattctccactactttcagctcagacaggactaacaatttgattgtgaggctgcgccacaatgtgataaggaccgggctccgcaacatcagcatctcctactcgcgtatctcccttgctgacgtggcaaagaagctgagactggactcgcctaancctgtggcggatgcggagagcattgtgtcaaaagcaatccgtgatggcgcgattgatgcaacactagatcacgcaaacggatggatggtatccaaggaaactggtgacatttactcgacaaatgagcctcagcaggcgtttaattcgagaattgctttctgcctgaatatgcataatgaggcggtgcgggcccttcggtttcctcctaattcccataaggaaaaagaaagtgctgaaaagaggagagagaggcaacaacaggaacaagagcttgctaagcatattgctgaggaagatgaagacgacttttaattctatcaaattaacaaggtaagcacttttgctttgtgttcttgtcaccactgtttgaatatgttaaatccaaattctggtatttgtgtttcctgncagactctttcagtttggatgaagtagactatgtttttacttgttatgatcatcttactagaatatgttttttgttgatgtttttgtcgcc

SEQ ID NO: 1054 - DNA, 1720 bp, Manihot esculenta
atgaccgaagacgtcgagatgaaagagctcccagctccctccaattccaccaccaccacttccccttccactcttaatcatttgaaggagattgcttcactgattgagaccggtgcctatgcccgggaagtgcggcggatagtacgggctgtgcgcttgacaatggccttaaggcgaaagctcaaggctcaggtgctctctgccttcctgaatttcgctcttactccgggatccgagcctcataatcggctagtctcctatcttcccaaggaggatgtgcatgaaatggagtgtgatactgcatcatctgtctctcaaactcctatgaaacaccccttaccagagctagagatatactgctacttgctggtgttaatatatctgattgatcagaagaaatacaatgaggctaaagcttgttcatcagcaagcgttgcccgtctgaagaacgtgaataggaggactgttgatgttctggcatccaggctctacttctattactctcttagctatgaactcactggtgatcttgctgaaatcagaggtaaccttcttgctcttcaccgcattgcaacattgcgccatgatgagcttggccaggaaacacttctcaacctgctacttcgcaactacctacactacaatttatatgatcaagcagagaagctgaggtcaaaggccccccgatttgaagctcactcaaaccagcagttctgtcgctacctcttttacctgggaaagatcaggacaattcagttggagtacactgatgcaaaggagtccctccttcaagctgctcggaaagctcctgttgcagcccttggttttcgagttcaatgcaataaatgggcaattattgtcagattactcctaggagaaatccctgagaggactgtttttatgcagaagggaatggagaatgctttaaagccatactttgagttgacaaatgctgttcggataggggatttggagctctttaaatctgttgctgagaagttctcaaccattttcagttcagacaggactcataatttaattgttaggctgcggcacaatgtcataaggactggacttcgcaacattagtatttcttattctcgaatttcacttgctgatgtggccaagaagctaaggttggacagtgcaaaccctgttgctgatgctgagagtattgtagctaaggcaatacgagatggtgcaattgatgcaactcttgatcatgctaacgggtggatggtttcaaaggaaacaggagatatctactctacaaacgagcctcaaatagcattcaactcaaggattgctttctgcctaaacatgcataatgaggcagttcgtgcacttagatttccgccaaattcccacaaagagaaagaaagcgctgaaaagagaagggagagacaacagcaagaacaggagctagcaaagcatatagccgaggaggatgatgatgagttctaatttggcttctgcaaaaggttaactgttttcaccattgaatgctttcttttctggctgtgtaagtctctctgaaaacatccccacaacaattttctgactatctgcttttcaaaattttttttttaattgttctcatctaggattctatcccatatccaagcaaatctctgttcaactattttgaatagtattggtcattttttttattttgctgcaaaatgaattcagtttgtcaagtttcaaaatacttgggagc

SEQ ID NO: 1055 - DNA, 1771 bp, Artemisia annua
  misc_feature (39)..(40): n is a, c, g, or t
  misc_feature (57)..(59): n is a, c, g, or t
  misc_feature (61)..(62): n is a, c, g, or t
  misc_feature (65)..(65): n is a, c, g, or t
  misc_feature (77)..(77): n is a, c, g, or t
  misc_feature (125)..(125): n is a, c, g, or t
  misc_feature (134)..(134): n is a, c, g, or t
  misc_feature (185)..(185): n is a, c, g, or t
  misc_feature (203)..(203): n is a, c, g, or t
  misc_feature (314)..(314): n is a, c, g, or t
  misc_feature (350)..(350): n is a, c, g, or t
  misc_feature (446)..(446): n is a, c, g, or t
  misc_feature (746)..(746): n is a, c, g, or t
  misc_feature (959)..(959): n is a, c, g, or t
  misc_feature (1770)..(1770): n is a, c, g, or t
ctaattctaattctaattcccttccgattgcaatcttcnncatcttcattcattcannnannaanaaaaaaatgacncaagacgttgagatgaaagaacaaccacaagttccagcaacagcagcngctgtctcnaattcagtctcatctcccacacctgttttacaacatttgaaggagattgcngcgttgattgagacgggngcgtatgcgcgtgaagttaggaggattttgagggctgttaggttgactattgctttgaggaggaagctgaaggcgggtgttgtttcgacttttcttcagtttgcgcttgtngctggatccgaggcgcatacgcgcttgtctgcgtanttgcccaaggatgatgaaaatgacatggaagtcgatactgcatcatccgcccctcaagctactgtgaagcattccccagaacttgagatctattgntacttgcttgtgctaattttcctcatagatcagaaaaagtacactgaggctaaggcttgttcatcagcaagtattgcccgtttaaagaacctgaacaggagaacagttgatgttttggcatccagactctacttctattactctcttagctatgaacttaccgacagcctttccgaaatcaggggtaatctcctcgctttgcaccgagttgctacattgcggcatgatgagttgggacaggaaacactcctgaacctgctacttcgcaattacctgcattacaatttgtatgatcaagcngaaaagttgaggtcaaaggcaccacgtttcgaagctcattcaaatcagcagttttgccggtacctgttttaccttgggaagattaggacgattcagctggagtacactgatgcaaaggaatctcttcttcaagctgctcgtaaagcacctgtagctgctcttggatttcgagttcagtgcaacaagtgggctgtgattgttcgcttacttctnggagagatccctgaacgaaccgtttttatgcaaaaaggcatggagaaggccttgagaccatactttgagctgaccaatgctgttagaattggagatctagagctgttcaaaaccaaagcagagaaattctcctccactttcacctcagaccgaactaacaacttaatcgtgagacttcgccacaatgtgataagaactgggctccgcaacatcagcatctcctactcccgtatctcacttgccgacgtggcaaagaagctaagactggactcaccaaaccccgtggccgatgctgagagcatcgtatccaaagcaattcgtgatggtgccattgacgcaacgctagatcatgcaaacggatggatggtatctaaggaaactggtgacatatattccacaaacgagccccagctagctttcaattctcgaattgctttctgtttgaatatgcataatgaggcagttcgtgctcttcgtttccctccaaactctcacaaggaaaaagaaagtgctgaaaagaggagagagagacaacagcaagagcaagagcttgcgaagcatattgctgaagaagatgatgacgatttttgattggattgcgctagcaaatcattgaggtgtaagcacttttgctttgtgttcttgtcactgtttcagtatgttaaaatcaagttatgggatatcactcgatttaccccttgtatcagaaggtcagactgtgttttgcttgaggatcagttagactatgcattttattctgactttggcaattgttaaattctcgaaatgcttagatgcgttgttgcttttnt

SEQ ID NO: 1056 - DNA, 2005 bp, Vigna unguiculata
  misc_feature (913)..(913): n is a, c, g, or t
aaagtgaaagttttataattgggacgtgtcttgaatgttagggttcaagacccaaggcctctcatgtcaacaacgtccatccaaacaactgtgccactaaattgcaaaccaaatcgcaacttcttgggtcttcttcaccttcccttttcactagggtttgcatcagattcccccaattttttcttgtgtgtgctttcactagattttgttcaatatgactcaagatctagagatgaaggatcgctcaacgccttccaactccgtttcttcacctgctccgtctactctgcagcatttgagggagatagcttcgcttatcgagaccggttcgtactcgaaggaagtccgtagaattgctcgtgcggttcgccttacaattgcgttgaggcgtaaattaacatcgtcgattatctcgtcttttcttgatcatgtcctcactcctggttctgaagctcatgccaaattgtctgcgtatcttccgaaggaggatgatcacgagatggaagtggatgccgcaacatctgcaattcaaaccccagctaaacacttgttgcccgagctagaaatctattgttacctgcttgtactactttttctgattgataaaaaaaaatacaatgaggccaaagcttgttcctcagctagcattgtttggctgaagaacactaacaggagaactgttgatgttattgcatccagactgtatttttactattcatatagctatgagcttacgggagatcttgctgaaatccgtggcaacctccttgcattgcaccgaattgccaccctgcgccatgacgagttgggccaggaaacacttcttaatttgttactccgtaactaccttcactacaatctatatgatcaggcagaaaagttgaggtctaaggctcctcgatttgaagcgcantcaaaccaacagttctgtcgttacctcttctaccttgggaaaattcggactattcaattggagtatacagatgcaaaagagtctctcctgcaggctgcccggaaagctccagttgctgcacgggggtttcgaattcaatgtaacaagtgggctgtgatagttaggttactgttgggagaaataccagagcgcactgtttttatgcagaaaggaatggaaaaagctttaaggccttactttgagcttacaaatgctgtacggattggagacttggaactgtttaggaatattgcagacaagtttgccactacttttaatgcagatagaacccataatttgattgttcgattgcggcataatgttatcaggactggtctacgtaacatcagcatctcctattcccgcatctccctagctgatgttgctaaaaaactgaggttgaactctccgaatcctattgctgatgctgagagcattgtatcaaaggctattcgtgatggtgcaattgatgctacattggatcatgccaacgggtggatggtgtccaaggaaaccggagatatttactccacaaatgagcctcagttggcctttaattctcgaattgcattctgtcttaacatgcacaatgaggcagtacgagcacttcgttttccaccaaacacacacaaagagaaggagagtgctgaaaagagaagagagagacaacaacaggagcaggagctggccaagcatattgcagaggaagatgacgacgatttctgagaaatatcttttttcaccctaccaaatgctatcagggcaccttcatgtccaacccttgctgatgtttttcttttggagaacctccattatcctttccttctctagaggtgattttttttaattttcattgtggaagatatctgaaagtcagtttaacacattaaaatatgttctgtttgtattcacatccattaggactgctttgttttgttccttatccggagaattatgttttaggacctgaagaaaaaatcaattgttagttatcatatcaattctgttaagaagttcggaaaactgttgctctgaaggatgtattaatcatat

SEQ ID NO: 1057 - DNA, 1958 bp, Glycine max
gactgtagtctgtagaggacatgtgccagttgtgcgaccatattgcttccaatttggtcttcttcaccctcttagggtttgcatcagattcccctaattcttgcttgattttgcgctttcgctagattttcttcaaaatgactcaagatctagagatgaaggatcgctcaacgccttccaactccgtttcttcgcctgctccatctactctgcagcatttgaaggagatagcgtctcttatcgagaccggttcgtactcgaaggaagttcgtagaattgctcgcgctgttcgccttacaattgcgttgaggcggaaattgacagcatccgctatctcttcttttctcgatcatgttctcactcctggctctgaagttcacgccaaattgtctgcgtatcttcccaaggatgatgatcatgagatggaagtggacgctgcaacatctgcgattcaaaccccagccaaacacttgttgcccgagctagaaatctactgttacctgcttgtactcctttttctgattgatcagaaaaaatacagtgaggccaaagcttgttcctcagctagcattgtttggctgaagaacataaacaggagaactgttgatgttattgcatccagactgtatttttactattcgtatagctatgaacttatgggagatcttgctgaaattcggggcaaccttcttgcattgcaccgaattgccaccctccgccatgatgagctgggtcaggaaacacttcttaatttgttacttcgtaactaccttcactacaacctatatgatcaggctgagaagttgaggtcgaaggctcctcgatttgaagcacattcaaaccagcagttttgtcgttatctcttctacctagggaaaattcggacaattcagctggagtataccgatgcaaaagagtctctcctgcaggccgcccggaaagctcctgttgctgcacggggttttcgaattcaatgtaacaagtgggctgtgatagtgcgtttactgttgggagaaatacctgagcggactgtcttcatgcagaaaggaatggagaaagctctaaggccttactttgagcttacaaatgctgtgcggattggagacttggaactgtttaggaatattgcggacaagtttgccactacctttaatgcagacagaacccataatttgattgttcgtttgcggcataatgtcatcaggactggtttacgcaacatcagcatctcctattctcgcatctctctagctgatgttgctaaaaaactgaggctgaactctgcaagtcctgttgcagatgctgagagcattgtatcaaaggctattcgtgatggtgcaattgatgctacattggatcatgccaatggttggatggtgtccaaagaaactggagatatttactccacaaatgagcctcagttagcctttaattctcggattgctttctgtcttaacatgcacaatgaggcggttcgagcacttcgatttccaccaaacacacacaaagagaaggaaagtgctgaaaagagaagagagagacaacagcaagagcaagagctggctaagcatattgcagaggaggatgacgatgatttctgataattgttttttttcaccctatgaattgctatctggataccttcatttccaacgtttgctcatcttttccttttgaagaactttcattatcatttcctttttcaaaaagtgaatttttcatttcctaagtggaagatctctgaaagtcagtttaacatatcgaaatatttacttttttttttcatccatgatgactgctatggtttgttccttgttaggagaattatgttttaggacctgaagaaaaaaaaatcaaatatttaggacgatgcgaattctgttcagaagttttattattagaaactgttaccctggaggatttattgaattatagcatgacaatctatttttctgtca

SEQ ID NO: 1058 - DNA, 1957 bp, Glycine max
gactgtagtctgtagaggacatgtgccagttgtgcgaccatattgcttccaatttggtcttcttcaccctcttagggtttgcatcagattcccctaattcttgcttgattttgcgctttcgctagattttcttcaaaatgactcaagatctagagatgaaggatcgctcaacgccttccaactccgtttcttcgcctgctccatctactctgcagcatttgaaggagatagcgtctcttatcgagaccggttcgtactcgaaggaagttcgtagaattgctcgcgctgttcgccttacaattgcgttgaggcggaaattgacagcatccgctatctcttcttttctcgatcatgttctcactcctggctctgaagttcacgccaaattgtctgcgtatcttcccaaggatgatgatcatgagatggaagtggacgctgcaacatctgcgattcaaaccccagccaaacacttgttgcccgagctagaaatctactgttacctgcttgtactcctttttctgattgatcagaaaaaatacagtgaggccaaagcttgttcctcagctagcattgtttggctgaagaacataaacaggagaactgttgatgttattgcatccagactgtatttttactattcgtatagctatgaacttatgggagatcttgctgaaattcggggcaaccttcttgcattgcaccgaattgccaccctccgccatgatgagctgggtcaggaaacacttcttaatttgttacttcgtaactaccttcactacaacctatatgatcaggctgagaagttgaggtcgaaggctcctcgatttgaagcacattcaaaccagcagttttgtcgttatctcttctacctagggaaaattcggacaattcagctggagtataccgatgcaaaagagtctctcctgcaggccgcccggaaagctcctgttgctgcacggggttttcgaattcaatgtaacaagtgggctgtgatagtgcgtttactgttgggagaaatacctgagcggactgtcttcatgcagaaaggaatggagaaagctctaaggccttactttgagcttacaaatgctgtgcggattggagacttggaactgtttaggaatattgcggacaagtttgccactacctttaatgcagacagaacccataatttgattgttcgtttgcggcataatgtcatcaggactggtttacgcaacatcagcatctcctattctcgcatctctctagctgatgttgctaaaaaactgaggctgaactctgcaagtcctgttgcagatgctgagagcattgtatcaaaggctattcgtgatggtgcaattgatgctacattggatcatgccaatggttggatggtgtccaaagaaactggagatatttactccacaaatgagcctcagttagcctttaattctcggattgctttctgtcttaacatgcacaatgaggcggttcgagcacttcgatttccaccaaacacacacaaagagaaggaaagtgctgaaaagagaagagagagacaacagcaagagcaagagctggctaagcatattgcagaggaggatgacgatgatttctgataattgttttttttcaccctatgaattgctatctggataccttcatttccaacgtttgctcatcttttccttttgaagaactttcattatcatttcctttttcaaaaagtgaatttttcatttcctaagtggaagatctctgaaagtcagtttaacatatcgaaatatttacttttttttttcatccatgatgactgctatggtttgttccttgttaggagaattatgttttaggacctgaagaaaaaaaaatcaaatatttaggacgatgcgaattctgttcagaagttttattattagaaactgttaccctggaggatttattgaattatagcatgacaatctatttttctgtc

SEQ ID NO: 1059 - DNA, 1958 bp, Ricinus communis
cctcttgaaatcccttgtgctagacttgaagaaaaagaaaagtagctccctctctctctctctctctcttcccaaattcacagatcaattaacaatctctctctctctcgcccaattcaaaggtcactctcttttttctcccattcagttgtcaatcttttctcttaaaacccccaattttaacattaacattcaagatacttgtattctcttcttccgcttcttcttcttcttcttcttcttcagtaacatttccagtatgacccaagacgtagagatgaaagaggttccagctgccgctgcggctccttccaattccaccacttcttcgtctccttccactctccagcatttgaaagagattgcttcactcattgagaccggtgcttatgcccgtgaagtccgccggattgtgcgcgctgttcgccttaccatggctttaaggagaaagctcaaagctcaacttctctctgcttttctcaattccattcttacccctggatccgacccttatactcggttgtcctcttttctccccaaggaggatgatcatgaaatggaggttgatacagctacatctgtcactcaagctcctgctaaacacccgttaccagaactggagatgtattgctatttgttggtgctgatttatcttattgatcagaagaaatacaatgaggccaaagcatgttcaacagcatgcattgctcggttaaagaacttgaatcggaggactgttgatgttcttgcatccaggctctacttttattactctcttagctatgaactcaccggtgatcttgctgaaattagaggtaacctccttgctcttcaccggattgcaactttgcgccatgatgagcttggccaggaaacacttctaaacctgctgcttcgcaattacctccactacaatttatatgaccaagcagagaagctgaggtcaaaagctcctcgatttgaagcccactccaaccagcaggcaagtctttattctgtcggtacctcttttacttgggaaagattcggacaattcagttggagtacactgacgcaaaggaatccctcctacaagctgctcggaaatcccctgttgcagcactcggttttcgagttcagtgcaacaagtgggcaattattgtcagactactgctaggagaaatccctgagaggactgttttcatgcagaaaggcatggagaaagccttgaggccatactttgagttgacaaatgctgttcgaataggggacttggagctctttaaatctgttgcagagaagttctcaaccatctttagtgcagacaggactcacaatttaattgttagactgcggcacaatgtcataaggactggacttcgcaatattagtatttcttattctcgtatctcactggctgatgtggccaagaagttgagattggactctgcaaaccccgttgccgatgctgagagtatcgtagccaaggcaatacgagatggtgcaattgatgcgacactggaccatgcaaatgggtggatggtatctaaggaaacaggggatatctactccacaaacgagcctcaaattgcattcaactcaaggattgctttctgcctcaatatgcataatgaggcagtgcgggcactaaggtttccaccaaattcccacaaagagaaagaaagtgctgagaagagaagagagagacagcagcaagagcaggagcttgcaaagcacatagccgaggaggatgatgatgagttttaagttagcatctgcaagaaatcaactattttcaccattgaatcccctcttgtcaagttgtgtgactttctctaaaaactccccagcaagattgtttcaacttattttgtttagcatcaatttttcatgttctagttgaggattctgtcccatatccaagcaacctctgttcaactattttttattatattgtggggttgctcccatttggatta

SEQ ID NO: 1060 - DNA, 1815 bp, Triticum aestivum
  misc_feature (454)..(454): n is a, c, g, or t
  misc_feature (1802)..(1802): n is a, c, g, or t
gcccgcgctataaaggagctgcttggccctccagtcctcctccccgcctccatttcgcccactccgaccttcgtccacacaccttccaccagccaccgaaaaagcctcaatcccagcaaccacagaccactcacgtgagttcgagcgaggtaagaatagatccgagcgagttcttgcgtcgccaaggtaaagttctttgaatcccaagccctcttcccccctcccttgttcgtctccttgttcactcggcaggcagcgaggtctccaggacgttttagatccaggggctccagatctgttcgtttttcttctcttttagttgtagtaatcggccaggcgaggttctttttccacacctccttgctcgttgtgtctagatctgccaccaacgccatctctttttgccgtggctgttgttgattttctctgcctgttctaggttttggtttggaanccaggcagatttctttcttgttcatctttccaaaaaacaaaaatccaaaaaaaaaagttcttcctagctccttagatggctgccgctatagatctgtccggggaggatctggtgagagcactcgagccttttatccgagaagcctctgccccccctccactccactcccaccttagtcccacctcgccattctccttcccccacgctgcttacagtgggtacccgtacggggtgcaggcacaggcccagaccgagctcagcccggcccagatgcactacatccaggcacgcctccacctccagcgccagaccggccagccgggccacctcggcccacggccccagcccatgaagcctgcttcggtggcagcggcgaccccgccgcggccgcagaagctctaccgtggcgtgcggcagcgccactggggcaagtgggtggcggagatccgcctcccccgcaaccgcacccgcctctggctaggcaccttcgacaccgccgaggaggcggccctcgcctacgaccaggcagcctaccgcctccgcggcgacgcagcgcgcctcaacttccccgacaacgctgcctcccgcggcccgctccatgcctccgttgacgccaagctccagaccctctgccagaacatcaccgcctccaagaacgccaagaagtccgcctccgtctccgcgtccaccgccgcagccacgtcgtccacccccaccagcaactgctcctcgccgtcctccgacgaggcgtcgtcctcgctggagtccgcggagtcgtcaccgtcacccgccaccaccaccgcagcagaggttccagagatgcagcagctcgacttcagcgaggcgccatgggatgaggcagcctgcttcgccctcaccaagtacccgtcgtacgagatcgactgggactcgcttctcgccgccaattagcacccagtttgtgttcgtcagctactactactgtctttagcgtgtcatgatgttaggttaatgggtcgccgcgatgcagatggcattttagacattctgcacgggcttttagcggattagctctaagtctctaatccttgttcattgtgtagatctattatttgttctcttgtggtagggtttggttagtccgtcccggatgactataagccggcgtttttgtgcccggcgtctccggtggtcggtcactggtcagtgactccggccggttaagtcttgtgtccatggttctagctaggtgctgttccttccgctgctctgcagattgtaacagtgggagtcttgtcatgtaaaattagctcgtcaaaaatcatgtaatgtggaatattattttgttgttaatggttgttttgtcttngtaaattcatgaa

SEQ ID NO: 1061 - DNA, 1796 bp, Triticum aestivum
cccactccgaccttcgtccacacaccttccaccagccaccagccaccgaaaaagccccaatcccagcaaccacaaaccactcacgtgagttcaagcgaggtaagcatagatccgagcgagttcttgcgtcgccaaggtaaggttctttgaatcccaagccctcttcctccctcccctgttcgtctccttgttcacgcggcaggcagcgagttctccaggacgttttagatcccggggctccagatctgttcttttttcttctcttttagctgtagtaatcggccaggcgaggttctttttccacacctccttgctcgttgtgtctagatctaccaccaacgccatctctttttgccgtggctgttgttgattttctctgcctgttctaggttttggtttggaaaccaggcagatttctttcttgttcatctttccaagaaaacaaaaatccaaaaaaaagttcttcctagttccttagatggctgccgctatagatctgtccggggaggatctggtgagagcactcgagccttttatccgagaagcctctgccccccctccactccactcccaccttagtcccacctcgccattctccttcccccacgccgcctacagtgggtacccgtacggggtgcaggcacaggcccagaccgagctcagcccggcccagatgcactacatccaggcacgcctccacctccagcgccagaccggccagccgggccacctcggcccgcggccccagcccatgaagcccgcttcggtggcagcggcgaccccgccgcggccgcagaagctctaccgtggcgtgcggcagcgccactggggcaagtgggtggcggagatccgcctcccccgcaaccgcacccgcctctggctcggcaccttcgacaccgccgaggaggcggccctcgcctacgaccaggccgcctaccgcctccgtggcgacgcagcgcggctcaacttccccgacaacgccgcctcccgcggcccgctccatgcctccgttgatgccaagctccagaccctctgccagaacatcaccgcctccaagaacggcaagaagtccgcctccgtctccgcgtccaccgccgcagccacgtcgtccacccccaccagcaactgctcctcgccgtcctccgacgaggcgtcgtcctcgctggagtccgcggagtcgtcaccgtcacccgccaccaccaccgcagcagaggttccagagatgcagcagctcgacttcagcgaggcgccatgggacgaggcagcctgcttcgccctcaccaagtacccgtcgtacgagatcgactgggactcgcttctcgccaccaattagcacccagtttgtgttcgtcagctactactactaccgtctttagcgtttcatgatgctaggttaatgggtcgccgcgatgcagatggcattttagacattctgcacgggcttttagcggattagctctaagtctctaatccttgttcattgtgtagatctattatttgttctctttgtgggtagggtttggttagtccgtcccggatgactataagccggcgtttttgtgcccggcgtctccggtggtcggtcactggtcagtgactccggccggtgaagtctctgtgtccatggttctagctaggtgctgttccttccgctgctctgcagattgtaacagtgggagtctgtcatgtaaaattagctcgtaaaaaatcgtgtaatgtggaatattattttgttgttaatgttcgttttgtcttgtaaattcatgaaggcatgtttttgtgctgtaaaaaaaaaa

SEQ ID NO: 1062 - DNA, 1758 bp, Triticum aestivum
ccccgcctccatttcgcccactccgaccttcgtccacacaccttccaccagccaccagccaccgaaaaagccccaatcccagcaaccacaaaccactcacgtgagttcgagcgaggtaagaatagatccgagcgagttcttgcgtcgccaaggtaaagttctttgaatcccaagccctcttcccccctcccctgttcgtctccttgttcactcggcaggcagcgaggtctccaggacgttttagatccaggggctccagatctgttcttttttcttctcttttagctgtagtaatcggccaggcgaggttctttttccacacctccttgctcgttgtgtctagatctaccaccaacgccatctctttttgccgtggctgttgttgattttctctgcctgttctaggttttggtttggaaaccaggcagatttctttcttgttcatctttccaagaaaacaaaaatccaaaaaaaagttcttcctagttccttagatggctgccgctatagatctgtccggggaggatctggtgagagcactcgagccttttatccgagaagcctctgccccccctccactccactcccaccttagtcccacctcgccattctccttcccccacgctgcttacagtgggtacccgtacggggtgcaggcacaggcccagaccgagctcagcccggcccagatgcactacatccaggcacgcctccacctccagcgccagaccggccagccgggccacctcggcccgcggccccagcccatgaagcctgcttcggtggcagcggcgaccccgccgcggccgcagaagctctaccgtggcgtgcggcagcgccactggggcaagtgggtggcggagatccgcctcccccgcaaccgcacccgcctctggctcggcaccttcgacaccgccgaggaggcggccctcgcctacgaccaggcagcctaccgcctccgtggcgacgcagcgcgcctcaacttccccgacaacgctgcctcccgcggcccgctccatgcctccgttgacgccaagctccagaccctctgccagaacatcaccgcctccaagaacggcaagaagtccgcctccgtctccgcgtccaccgccgcagccacgtcgtccacccccaccagcaactgctcctcgccgtcctccgacgaggcgtcgtcctcgctggagtccgcggagtcgtcaccgtcacccgccaccaccaccgcagcagaggttccagagatgcagcagctcgacttcagcgaggcgccatgggatgaggcagcctgcttcgccctcaccaagtacccgtcgtacgagatcgactgggactcgcttctcgccaccaattagcacccagtttgtgttcgtcagctactactactaccgtctttagcgtttcatgatgctaggttaatgggtcgccgcgatgcagatggcattttagacattctgcacgggcttttagcggattagctctaagtctctaatccttgttcattgtgtagatctattatttgttctctttgtgggtagggtttggttagtccgtcccggatgactataagccggcgtttttgtgcccggcgtctccggtggtcggtcactggtcagtgactccggccggtgaagtcttgtgtccatggttctagctaggtgctgttccttccgctgctctgcagattgtaacagtgggagtcttgtcatgtaaaattagctcgtcaaaaatcatgtaatgtggaatattattttgttgttaatg

SEQ ID NO: 1063 - DNA, 1817 bp, Triticum aestivum
ccccgcctccatttcgcccactccgaccttcgtccacacacattccaccagccaccacccgccgaaaaagccccaatcccagcaaaccacaaacactcacgtgagttcgagcgaggtaagcatagatccgagcgagttcttgcgtcgccaaggtaaggttctccgagtctcaagccctcttcctcccgcccccctattcgtctccttgttcacccggcaggcagcgaggtctccaggacgttttagatcccggggctccagatctgttcttttttcttctcttttagttgtagtaatcggccaggcgaggttctttttccacacctccttgctcgttgtgtctagatctaccaccaacgccatctctttttgccgtggctgttgaccttgttgattttctctgcctgttctaggttttggtttggaaaccaggcagatttctttcttgttcatctttctaagaaaacaaaaatccccaaaaaaaagttcgtcctagttccttagatggctgcagctatagatctgtccggggaggatctggtgagagcactcgagccttttatccgagaagcctctgccccccttccactccactcccatcttagtcccacctcgccattctccttcccccacgccgcctacagtgggtacccgtacggggtgcaggcacaggcccagaccgagctcagcccggcccagatgcactacatccaggcacgcctccacctccagcgccagactggccagccgggccagctcggaccgcggtcccagcccatgaagcccgcttcggtggcagcggcgaccccgccgcggccgcagaagctctaccgtggcgtgcggcagcgccactggggcaagtgggtggcggagatccgtctcccccgcaaccgcacccgcctctggctcggcaccttcgacaccgccgaggaggcggccctcgcctacgaccaggccgcctaccgcctccgcggcgatgcagctcgcctcaacttccccgacaacgccgcctctcgcggcccgctccatgcctccgttgacgccaagctccagaccctctgccagaacatcaccgcctccaagaacgccaagaagtccgcctctgtctccgcgtccaccgccgcagccacgtcgtccacccccaccagcaactgctcctcgccttcctccgacgaggcgtcatcctcgctggagtctgcggagtcgtcaccgtcacccgccgccaccaccgcagcagatgttccagagatgcagcagctcgacttcagcgaggcgccatgggacgaggcagcctgcttcgccctcaccaagtacccgtcgtatgagatcgactgggattcgcttctcgccaccaattagcacccagtttgtgtccgtcagctactattactaccgtctttagcgtgtcatgatgctaggttaatggtcgcctcgatgcagatggcattttagacattctgcacgggcttttagcggattagctctaagtctctaatccttgttcattgtgtagatctattatttgttctcttgtggtagggtttggttagtccgtcccggatgactataagccggcgtttttgtgcccggcgtctccggtggtcggtcactggtcagtgactccggccggtgaagtctgtgtccatggttctagctagttgctgttccttccgctgctctgcagattgtaacagtgggagtctgtcatgtataattatctcgtcaaaaatcctgtaatgtggaatattattttgttgttaatgttcgttttgtcttgtaaattcatgaaggcatgtttttgtgctgtaaaaaaaaaa

SEQ ID NO: 1064 - DNA, 1769 bp, Avena sativa
tcaacactccacagccaacaacccaaccaccaaaagcccacaaacccagcacacacacaacacaatcccgtgagttcgagcgaggtaagcatagatccgagcgagttcttgcggtcgccaaggtaagttcctctgaatctcaaaccctcttctccactccctcccccttgttgatctcgccgtcttccctgtcggtcacagagcagtcggttccagggccttttagatcccgggcttcagatctgttcttgtttttctctcctgttctagttttagttgcctgccaagagaggttctttttccacacctccttgcttgctgctcgtgtctagatctaccaccaaagccatctctttttgctgtggctgtcgatctaccttgttttcctctgcctgttctacgttttggtttggaaaccaggcagctttcttttctttcttgttcatctttttttccaagaaaaagaaaatccaaaaaaaaagagtttgtcctagatcgttgaagctagagtagatggctgctgctatagatctgtccggggaggatctgctgagggcgctcgagccttttatccgagacgactctgcttcccctccgctccactcccatctcagtcccacctcgcccttctccttcccccacgccgcctacagtgggtacccgtacggggtgcaggcccaggccgagctcagcccggcccagatgcactacatccaggcacgcctccacctccagcgccagaccggccagccgggccacctcggcccgcgggcccagcccatgaagcccgcttccgtggcggcggccaccccgccgcggccgcagaagctctaccgcggcgtgcggcagcgccactggggcaagtgggtggcggagatccgcctcccccgcaaccgcacccgcctctggctcggcaccttcgacaccgctgaggaggcggccctcgcctacgaccaggccgcctaccgcctccgtggggacggcgcgcgcctcaacttccccgacaacgccgcctcccgcggcccgctccacgcctctgtcgacgccaagctccagaccctctgccagaacatcaccgcctccaagaacgccaagaagaccgcatccgtctccgcctccaccgcagctgccacctcgtccacccccaccagcaactgctcctcgccgtcctccgacgacgcgtcgtcctctctcgagtccgccgagtcgtcgccctcccccaccaccaccgccgcagcagaggctctggagatgcagcagctcgacttcagcgaggcgccgtgggacgaggccgcaggcttcgccctcaccaagtacccctcgtacgagatcgactgggactcgcttctcgccaccaattaacacccagcgttcttcagctactactactactaccagtaccgtctttagcgtgtcatgatgatgctaggttaatggtcagccgcgacgcagatggcattttagacactctgcgccggcctttagcaggattatctctaagcctctaatcctttggttcattgtgtagatctcttggattcgttttgtcgtgctagggtttggttagtcccggagggaatgtaagccggcgtttttgtgcccggcgccctccgatggtcggtcactggtcagtgactcaagtctgtgtccattgttctagctaggtgctgtgttccatccactgctctgcagattgtaaacagtggtaggatgtcgtgtaaaattagctccctgtcaaaaccttgtaatatggatcatattattatttt

SEQ ID NO: 1065 - DNA, 1848 bp, Brachypodium distachyon
gtccccgccccccatttcgccttcgaccttcatccacagccagccgccacccaccgagaaagcccaaaaacccaccaaacacagcctccgtgagttcgagcgaggtaagcatagatccgagcgagttcttgcgtctccaaggtaaggttctccgaaactccaaccctcttcctctcccctgttaatctcgtcttcttcgtgatccaagagcagagagtgaggtctccagggcattttagatccagggagcttcagatctgttcctttccccttgtgttctagtactagtatcattataggtggccaagagaggttctttttccacacctccttgctgcttccgtgtagatctaccaccaacgccatctgtttttgctgtggctgttgatttcctctgcctgttcttcattttggtttgggaaccaggcagctttcttcttgttctcctttttattaagaaaaaaaaattcaaaaaaaaaagtttcttcagatccttgaaactagagtagatggctgcagctatagatctgtccggggaagagctgatgagagcactcgagccttttatccgggatgcctctgcttcccctcctccactcaactcacatcccagccccacctcgccattctccttcccccacgccgcgtaccaagggtacccgtacggggtgcaggcccaggcccaggccgagctcagcccggccgagatgcactacatccaggcacgcctccacctccagcgccagaccggcccgccgggccacctcggcccgcgggcccagcccatgaagccggcttccacggcggcggcgaccccgccgcggccgcagaagctttaccgcggcgtgcggcagcggcactggggcaagtgggtggccgagatccgcctcccccgcaaccgcacccgcctctggctcggcaccttcgacaccgccgaggaagccgccctcgcctacgaccaggccgcgtaccgcctccgcggggacgccgcgcggctcaacttccccgacaacgccgcctcccgcggccccctcgacgcctccgtcgacgccaagctccagaccctctgccagaacatcaccgcctccaagaacgccaagaagtccaagtcatcctccgcttccgcagccacttcatccacccccacaagcaactgctcttcgccgtcttccgacgaggcgtcgtcctctctggagtcggcggagtcatcgccgtcgcccgccaccaacgcagcagaggttccggagatgcagcagctcgacttcagcgaggcgccatgggacgaggccgcaggattcgccctcaccaagtacccctcgtacgagatcgactgggactcgctcctcgccaccaactgacacccagttcgtctcatctcggtctctgctaagctactactagtactagtaccccgtctttagcgttgtcatggatctaggttagtgttaatggtcgccgcgatgcagatggcattttagacattctgcaccggcctttggcggattagctcccgtattcttctgatccttgttcgttgtgtagatctccgatttgtttctctcttgtgtagggtttggttttagtagtccccggaggacggtaaagccggcgtttttgtgcccggcgtctccggtggccggtcactggtcagtgaccccggccggtaaaagtcttgtgtccgtcgttctagctatagatgctgttgcttccactgctctgcagattgtaagagtggtcgaacgtcgtgtaaaattagcccgtccagaaattgtaacgtggattattattattttgttactgtcagtgctattaattccttctgtacattttgttcaagttcctctctta

SEQ ID NO: 1066 - DNA, 1955 bp, Oryza sativa
gctttgctataaaatagctccaatggcgtccctcacacctccccgcccaccattcccactttcgcccacacacacacccagatccacagccatcctcccaccgccgccgccaccatctccaagcccacgaacacccacagccaccgtgagctcgagcgaggtaagaaaagctttagatctgagcgacttcgagcgtcttcaaggtaaagttttctcgaaaccctcttcttcttcttcctcctctggctcccccacctgttcttctacggtttcttggttaggttgcttgcagagagcgagagacccagggccttttagatccagggctcccagatctgctgtttttctttcatcttctttgtgttctagtgttaggttggtagccaagaggggttctttttccacacctcacttgctagatctaccaccaaaaagccatctgtttttttactgtggctgtcgatttctccctccttcctgcctgttcttgattttggattcggaaccaggcaaatctttgttactactgttttagtatcagaaaaaaaaatcccaaaaaaaagagtgagtagatggctgcagctatagatctgtcaggggaggagctgatgagagcactcgagccttttatccgagatgcctccggctcgcctccggtttgttcccagtttagtcccacctcgccattctccttcccgcacgcgttcgcgtacggtggcgggctggcccagcagccagagctcagcccggcccagatgcactacatccaggcccgcctccacctccagcggcaggcggcgcaggccggcccgctcggcccgcgcgcgcagccgatgaaggcgtcgtcgtcgtcggcttcggcggcgggggcggcggcgacgccgccgcggccgcagaagctgtaccgcggcgtgcggcagcggcactgggggaagtgggtggcggagatccgcctcccgcggaaccgcacgcggctctggctcggcaccttcgacacagccgaggaggcggcgcttgcctacgaccaggcggcgtaccgcctccgcggcgacgcggcgcggctcaacttccccgacaacgccgcctcccgcggcccgctccacgcctccgtcgacgccaagctccagacgctctgccagaacatcgccgccgccaagaacgccaagaagtcctctgtctccgcctccgccgccgcaacatcctccgcgcccaccagcaactgctcgtcgccgtcctccgacgacgcgtcgtcctgcctggagtccgccgactcgtcgccctccctgtcgccgtcctccgccgccaccacggccgagacgccggcgaccgtgccggagatgcagcagctcgacttcagcgaggcgccgtgggacgaggccgccgccttcgccctcaccaagtacccgtcctacgagatcgactgggactccctcctcgccgccaattaacaccaccaccacttcttggctagtactcacgccgtcgttagcctaatcgtcgccgccgccgccgccgtgcagatgggattttagacattctgcaccgcacggacgggcatggattagcagttttatagtccctaatccttttggtttggttcgtttgtgtacgtagatcgatctctctccggacttgtttcctctgtagatgctagggttggttggtgttcttcctcaaccggagacgccgatgctaccggcagccggcgtttttgtgtccggcgtgcgtctccggtggccggtcactggtcggttactccggccgtggcgtccattgctcttctaaagtctgttattaccttctactgctgatcttacaggttgtaaacagtagtagtagcattattattattattatgtcttgtaatattattagcgtgttataagaacttgtaatgtgaattacctctactactactattattattatttagcgtcgttgttaaaattgttgtg

SEQ ID NO: 1067 - DNA, 940 bp, Brachypodium distachyon
tatcgaaagtggagataattggctatgtcaaagtttgttaaaacataggccatatgaggcggcccacaatggatacacacatacttaaatagtccgggctatgcactttttacttgtgtatgcatcacggattcatccttcaaagaatagatcatttcatcatctggactatgaaacaagactgactctcacacatgcgatctccagtgcgtaagattttatacctttcgaaccttcttattgccaccattgtgcgccactaactcatggaataatggacctcaaacatttcgaatagcaaagttcacgtccggtaacaggctatattgcaggcatccaattctgtaccaagctgcaccgtgccatcaatcacttgccacaataattcaggacacctttattcttgctaatctcggctttgtcttctgcacacttcagagatccgagaagagccctataaatacctcgcgccatctgtttccagttcatcaagtacacagcagcttaagcttccgagctttcccgagtgccggaacagagtagcattataagaatggcatccgtgaaggccgtgaagcccaccgggccagcagctcaggccaaggagcctgccaagcttagtgccaccaaggagcctgcaaagctcagtgccaccgcgaaaaagccagcagccgccaagggcggcatcaagaaggctgagtcgaaacctcgggagcctaagaagagggtgaagagcagcaagccggcagcagtcaaaaactgacaacggcagcaagagaaatggaacttgcatagtgatttccatgatgctatgaatatatatgaatcccatctttcccttcctctgtctcctatgatgtcattatcctgcctagacaggccttgatggtgtgcttaaccccatgtgatgatattacaaataagatgtatagttgtacca

SEQ ID NO: 1068 - DNA, 4422 bp, Sorghum bicolor
ggaaattcccgagccgcgtgttgccagtctgacagagtaaacgaaggcacgaacgcgacgcttccagtccaagcaaccgaagcggggcgacagccgagggcggccggcatggggatcgtggaggcatgggtgcgggagaagcccatccgcaccttcctagcccgactcgcccagcgccgggcggaggcggccgccgccttcctcgcctccccctccgccaccgcggtcatcgacggcgagggcggcggcgacgggagcatcccgcagctctcctccgtcgccaactccgtcgtctcccgctgctcaaggattcttgctctttcaattgagaacttacagcaaagctttgagactgattttccacacaattgtaatgaggctaatacatatgcaagagaccttttagagtattgctgccacaaagctcttcatgaagttactacacgtccagactatttggctgataagaatcttcgccgcttgatgtttgatatgatgcttgcatgggaaaccccaggcgctcaggatgcgtcagtagaaaatgaaagaaggttctattgtgcgtgattcccttgagattgaagatgaggatgaggggtcaattttttatgcaaattccacaagattggctgttcaagttgatgacaagaagacagtcgggttaagtgcttttgcacgaatagcaccttcatgcccaataatagctgacctggttactgtccacaatctgtttgatgcacttacaagttcatctggaggccgattgcactttcttgtttatgacaagtatctcaagagtttagacagggaattgaggtctgtgaaaggtatcatgcaatcatcacttgcctcaagttttcatcttgatgctggagaatgcatattagctattgatggagacaagcctattcatccggtactgcaacatattggaatatcggcgtggccaggaagattggtcctcacaacacatgctctttattttcagagtatcagagtgggatatggtgataagattgttaaatacgatctatcaacagattcaaatcaagtgattaagcgtgatttgactggaccgctgggtgtccgcctctttgataaagctgtgatgtacaaatcaagcactttgacagaaccaatttattttgatttccctgaattaggaggtccttcacgaagagactattggttagcaatcacctgtgaagtattgcaggtgaacagatttatcaggaagttcaatcttggagatgttcagagagcagaagcactctcaaaagctatcttgggcattttgagatactctgctgtcaaagaagcttttcatattgctccttcccactttaagacaacacttacttttagcttagcagaaaagcttccaaaaggagacatggtcttagaagccctgtataataactatttccaactcctggactcttcattgagacatttggcaattgattctgcagtcgataaaatgtcagagaaccattctgtaccattttctttgtatgctctctctagaatgggttttcttctgctgaagacaaaagatgaaactgaaaaggaaatgagcttttgtgctgtttgctttggtgtaacaaaatatctgcaggctgccctgaaagagtcaatttgttactctgagagaatagagtcagcacgtgctacagtcgatcaagtaaaggtggaaggcattgatgtaaatcttgccctcatgcaggagttactcttccctttcattcaagtaggcaagattgtttactctctcagccaatgggaagatccttttaaatcacttctattcttagcttttatgctgtatgttattcaaaggggtctggtcagttacattgtgccctttgttttcttaacttttgctattatcatgatttggcataagtatgttggagacggaaaattgttggaagtgcttgaagtgaaacctcctccaagtaaaaatgctgttgagcagattttgacattgcaggagggtatatccaagttagaagagtttctacaggctgcaaatattactcttctgaagttcagatctgtcttgtttgcctgtgttcctaaggccactgaagtagttgcagctgtacttattgtcacagctgcatttcttgtcttcgtaccttccaggcatctgctacagatgttactcctagagatgtatacaagggagatgcccctaaggaaacagaacactgaaaaattccgcaggcgaattagagagtggtgggctcgcattcctgctgcacctgtgcagatgatcagacctaacgaaagcaagaaaaagagatgaccatgggctttgggctctcgaatagaaaaaaaatagccacagatttcaccattccccggtttgaacctgatcagctaacttgtatagactttaaccctgactgcgtagtaatcaaaatgctacggaattccactaaaaaactagccttggtatagtgctgtgttactatgagtgtaaaatgatggatgcaaaagaattattcatttttcttgcaagacatttcttagaagtttctagagctctaatgtgctctagaagaatttatcagatgttaggactaatacttggttggaatgccaaggtgatttcatatggattctctgaagttatttgctctagcagaattgatgcatccccatagcacacccggagaagcagctgaaagtgtgtcgtatggtctagttaagcaattcattttcaaattgctatagcacctactcccctcttcgcagcagttcgcatcgcaccaacctcgcacaggagggccgccgcccctgctccgacctccgagaaccgaatggctgccgccgctgcatcttcgtcgcctccggctgccatcacctgccgagctgcggtggcctgggggccgggccagccgctggtcatggaggaggtggaggtcgccccgccggggcccatggagatccgcgtcaaggtcgtctccacctccgtctgccgcagcgacgtcactgcctggcaatccaaggcgcaacctgatctgttccctagagtcttcggccacgaagcatccggagtagtagagagtgtcggtgaaggtgtgaccgagttccaagtcggagaccacgttctcactgtcttcattggggaatgcaagagctgtaagcattgcgtctcggggaaaagcaacatgtgccagaagctcggtttggagaggaagggtgtcatgcacagtgatcagaagacccgcttctctgtcaaggggaaacctgcgtaccattactgtgccgtgtcaagcttcagcgagtacacggttgtccattctggatgtgcggtgaaggttggcctgaccgtgccaatggacagggtgtgcctgctgagctgcggtgtgtctgcaggactcggtgcagtctggaacgtagctaatgtatcaaagggctcaagtgtagctatatttggtcttgggaccgtaggactttctgtcgctcaaggtgctaagcttcggggggcgtccaagattataggagttgacactaatgctgagaagcaagaaaaggggaaattatttggtgtcacggattttattaacccagatgaattgagtgaacctgttcaacaggtaatcaaaaggattactgatggaggggtggattactcttttgaatgtgttggtgatactggagtagtatccactgcacttcaatcatgttctgatggctggggagtaactgtaactcttggtgtaccaaaaacaaaaccagaagtgtctgctcattatgcatttcttctatccggaagaacactgaagggatctttgtttggaggatggagacctaaatctgatctaccttcattggtggataaatatgcagacaaggaaatccaagttgatggcctagtcacgcatgatataccattcagtgaaatcaacaaagcacttgagctcatgctagaaaacaagtgcttgagatgtgtgattcacatgccacagtaacaggatccgacagctgcacatgatttctaccatatgttacatatctgctttcccccttgatcacctttgtggctcaactgctcaagtacttatcagcacatcggagctcgactttttgcccttttctggtgtcctggtaaagttgttgtagatccagctacccaagtccagaattgtccagagaactagactgatttgcttttgtatcttcttattactttttcttcaggaattgtcttactgatgttgaatctgtaatggctgctctgttattttaatgttccaagtataaggcatcaagccaatattgttcttctgtttaacctttggtttgatgaattgagatttgaaggattcttgaatctgtaacattgtgtaggactgaataataacaaaattgaagtgaaaatattccctaatatcagtcgctagattcttg

SEQ ID NO: 1069 - DNA, 1180 bp, Setaria italica
agccgctccacgccgaggatctgccggaatggccgctgacgctgcatcttcgtcgcctccggccgccatcacctgccgagcggcggtggcatggggcccggggcagccgctggtgatggaggaggtggaggtggccccgccgggggccatggagatccgcgtcaaggtcgtctccacctccgtctgccgcagcgacgtcaccgcgtggcaatccaaggcgcaacctgatctgttccccagaatattcggccacgaggcatccggagtggtagagagcgtgggtgaaggagtgaccgagttccaagtgggagatcacgtgctcaccgtcttcatcggggaatgccagagctgcaagcactgcgtctcggggaagagcaacatgtgccagaagctcggcctggagaggaagggcgtcatgcacagcgatcagatgacccgcttctctgtcaaggggaaacccgtgtacagtgtccagcttcagcgagtacacggttgttcattcaggatgtgctgtgaaggtcggcctgacagtgccaatggacagggtgtgcctgctgagctgcggtgtgtctgcaggacttggtgcagcttggaatgttgcagatgtatctgagggttcaagtgtagttatattcggtcttggaactgtaggactttctgttgctcaaggtgctaagctttccaagattattggagttgatactaatcctgagaagcaagaaaaggggaaagcttttggcgtcacagattttattaacccgaatgaattgagcgagcctgttcagcaggtaatcaaaaggatgactgatggaggggcagattactcttttgaatgtgtgggtgataccggagtagtttccactgcgcttcaatcatgctctgatggttggggagtaactgtaactcttggtgtaccaaaagcaaagccagaggtttctgctcattatgcatttcttctatctggaagaacactgaaaggatctttgtttggaggatggagacccaaatctgatctaccttcattggtgaataagtacgcagacaaggaaattcaagttgatggcctagtcacgcatgatataccattcggtgacatcaaccgtgcactcgaactgatgctagaaagcaagtgcttgcgatgtgtgattcacatgtcacagtgaggattgaacaactgcta

SEQ ID NO: 1070 - DNA, 1581 bp, Panicum virgatum
  misc_feature (702)..(702): n is a, c, g, or t
  misc_feature (755)..(755): n is a, c, g, or t
  misc_feature (781)..(781): n is a, c, g, or t
  misc_feature (787)..(787): n is a, c, g, or t
  misc_feature (809)..(809): n is a, c, g, or t
  misc_feature (965)..(965): n is a, c, g, or t
  misc_feature (967)..(967): n is a, c, g, or t
  misc_feature (1057)..(1057): n is a, c, g, or t
  misc_feature (1069)..(1069): n is a, c, g, or t
  misc_feature (1143)..(1143): n is a, c, g, or t
  misc_feature (1165)..(1165): n is a, c, g, or t
  misc_feature (1213)..(1213): n is a, c, g, or t
  misc_feature (1231)..(1231): n is a, c, g, or t
  misc_feature (1249)..(1250): n is a, c, g, or t
  misc_feature (1255)..(1255): n is a, c, g, or t
  misc_feature (1282)..(1282): n is a, c, g, or t
  misc_feature (1293)..(1293): n is a, c, g, or t
  misc_feature (1295)..(1295): n is a, c, g, or t
  misc_feature (1320)..(1320): n is a, c, g, or t
  misc_feature (1331)..(1331): n is a, c, g, or t
  misc_feature (1333)..(1333): n is a, c, g, or t
  misc_feature (1402)..(1402): n is a, c, g, or t
  misc_feature (1440)..(1440): n is a, c, g, or t
  misc_feature (1464)..(1464): n is a, c, g, or t
  misc_feature (1477)..(1477): n is a, c, g, or t
  misc_feature (1490)..(1493): n is a, c, g, or t
accaacctcgctcaggagaggagccgctcccccgccgaggatctaccggaatggccgctgacgctgcattttcgtcgcctccggccgccatcacctgccgagcggcggtggcgtgggggccggggcagccgctggtgatggaggaggtggaggtggccccgccggggcccctggagatccgcgtcaaggtcgtctccacctccgtctgccgcagcgacgtcagcgcgtggcagtccaaggcgcaacctggtgtgttccccagaatctttggcgggggaggcatccggagtggtagagggggggggtgaagaggtgaccgagttccaagtgggagatcacgtgctgaccgtcttcatcggggaatgcaagagctgcaaacactgcatctcggggaagagtaacatgtgccagaagctcggtctggagaggaagggcgtcatgcacagcgatcagaagacccgcttctctatcaaggggaaacccgtgtaccactactgtgcagtgtcaagcttcagcgagtacaccgttgttcattcaggatgtgctgtgaaggtcggcctgacagtgccaatggacagggtgtgcctgcttagctgcggtgtgtctgcaggactcggcgcagcttggaatgttgcagatgtatccgagggctcaagcgtagttattttcggtcttggaactgtaggactttctgttgctcangctgctaagcttcggggggcatccaagatcataggagttgatactaatctganaagcaggaaaaggggaaagttttggngtcacngattttattaacccgaatgaantgagcgagcctgttcagcaggtaatcaaaaggatgactgatggaggggcagattactcctttgaatgtgtgggtgataccggcgtagtttccactgcgcttcaatcatgttctgatggttggggagtaaccgtaactcttggtgtaccaaaagcananccagaggtgtctgctcattatgcatttcttctctctggaaggacactgaagggatctttgtttggaggatggagacctaaatctgacctnccttcattggtngataagtatgcagacaaggaaatccaagttgatggcctagtcacgcatgatataccattcggtgacatcaaccntgcactcgaactgatgctaganaacaagtgcctgcggtgtgtgattcacatgtcacagtgacagcctganaaggttgaacaactgctncatatctgctattttccnnttgancacctttgtggctcaattatccaccanagcaacatcananctcactctttttggcctttttttgnttatcgtaaantntggtgttgtaaatccaagtacagcactctcaagagaatcacaatgatcttcattctcagaaattgtccngtaacctgtcttactgagatggaacctgtaatagctgnaatgttttcatgtaacatgtatangccatcaagccantattgttcctctnnnngagcttgttttgatgatttgagatttgaaggatccttaaatttgtaacattgtgtaagattgaatgataacaaaatcggagtgaaatt

SEQ ID NO: 1071 - DNA, 1632 bp, Zea mays
ctgaattcttttctactagagctagagccaggcagccagccaacgccaagcggggtaggttgactcttctgtctacagcacctacctcttcacaccaactgccgcccctgctccgagaaccagaatggccgccgccgatgcatcttcgttgcctccgtccgccatcacctgccgagcggcggtggcgtggggaccgggccagccactggtgatggaggaggtggaggtcgccccgccggggcccatggagatccgtgtcaaggtcgtctccacctccgtctgccgcagcgacgtcactgcctggcaatccaaggcgcaacttgatctgttccccagagtcttcggccacgaggcatccggagtagtagagagtgtcggtgaaggtgtgaccgagttccaagtcggtgaccacgttctcactgtcttcattggggaatgcaagagctgcaagcactgcgtctcagggaagagcaacatgtgccagaagctcggtctggagaggaagggtgtcatgcacagcgatcagaagacacgcttctctgtcaaggggaaacctgtgtaccattactgtgcagtgtcaagcttcagcgagtacacggttgtccattccggatgtgcggtgaaggttggcctgaccgtgccaatggacagggtgtgcctgctgagctgcggtgtgtcttcaggactcggtgcagtctggaatgtagctaatgtatcaaagggctcaagtgtagctatatttggtcttgggaccgtaggactttctgtcgctcaaggtgctaagcttcgaggggcgtccaagattataggagttgatactaatcctgagaagcaagaaaaggggaaatcatttggtgtcacggactttattaacccagatgaattgagtgaacctgttcaacaggtaatcaaaaggattactgatggaggggtggattactcatttgaatgtgtgggtgattctggagtagtctccactgcacttcaatcatgttctgatggttggggagtaactgtaactcttggcttaccaaaaggaaaactagaagtgtctactcattatgcatttcttctatccggaagaacactgaagggatctatgtttggaggatggaaacctaaatctgatctaccttcattggtggataaatatgcagcaaaggaaatccaagttgatggcctagtcacgcatgatataccattcaatgaaatcaacaaagcgcttgagttgatgctagaaaacaagtgcttgagatgtgtgattcacatgccacggtaacagggtcgaacagctgcacataataatatgatatctaccatatgttgcatatctgctctttctaccttgatcatctttgtggctcaaccgttcaagtactcatcagtcatcaccacgccggagcttgagtttttgtccttttctagtcccctggtaaagttgttgtaaatccagctatccatcaagaattatcaggagaactacactgatttgcttttgtatcttcatactttttcttctagaattgtcttcttatattgaatctttaatgtctgttctgttattttaatgctccatgtacaaaccatcaagcaaatattgttcttccagccggtgccagttctgatgataga

SEQ ID NO: 1072 - DNA, 1607 bp, Zea mays
ctgaattcttttctactagagctagagccaggcagccagccaacgccaagcggggtaggttgactcttctgtctacagcacctacctcttcacaccaactgccgcccctgctccgagaaccagaatggccgccgccgatgcatcttcgttgcctccgtccgccatcacctgccgagcggcggtggcgtggggaccgggccagccactggtgatggaggaggtggaggtcgccccgccggggcccatggagatccgtgtcaaggtcgtctccacctccgtctgccgcagcgacgtcactgcctggcaatccaaggcgcaacttgatctgttccccagagtcttcggccacgaggcatccggagtagtagagagtgtcggtgaaggtgtgaccgagttccaagtcggtgaccacgttctcactgtcttcattggggaatgcaagagctgcaagcactgcgtctcagggaagagcaacatgtgccagaagctcggtctggagaggaagggtgtcatgcacagcgatcagaagacacgcttctctgtcaaggggaaacctgtgtaccattactgtgcagtgtcaagcttcagcgagtacacggttgtccattccggatgtgcggtgaaggttggcctgaccgtgccaatggacagggtgtgcctgctgagctgcggtgtgtcttcaggactcggtgcagtctggaatgtagctaatgtatcaaagggctcaagtgtagctatatttggtcttgggaccgtaggactttctgtcgctcaaggtgctaagcttcgaggggcgtccaagattataggagttgatactaatcctgagaagcaagaaaaggggaaatcatttggtgtcacggactttattaacccagatgaattgagtgaacctgttcaacaggtaatcaaaaggattactgatggaggggtggattactcatttgaatgtgtgggtgattctggagtagtctccactgcacttcaatcatgttctgatggttggggagtaactgtaactcttggcttaccaaaaggaaaactagaagtgtctactcattatgcatttcttctatccggaagaacactgaagggatctatgtttggaggatggaaacctaaatctgatctaccttcattggtggataaatatgcagcaaaggaaatccaagttgatggcctagtcacgcatgatataccattcaatgaaatcaacaaagcgcttgagttgatgctagaaaacaagtgcttgagatgtgtgattcacatgccacggtaacagggtcgaacagctgcacataataatatgatatctaccatatgttgcatatctgctctttctaccttgatcatctttgtggctcaaccgttcaagtactcatcagtcatcaccacgccggagcttgagtttttgtccttttctagtcccctggtaaagttgttgtaaatccagctatccatcaagaattatcaggagaactacactgatttgcttttgtatcttcatactttttcttctagaattgtcttcttatattgaatctttaatgtctgttctgttattttaatgctccatgtacaaaccatcaagcaaatattgttcttcc

SEQ ID NO: 1073 - DNA, 2225 bp, Saccharum officinarum
gttatttattcaaaggggttctggtcagtaacatcgccccctttgtaatcttaacttttgcaattatcatgctctgggcataagtatatgggagaccggaaaattgttgaaggtgcttgaagtgaaacctcctccaagtaaaaatgctgttgagcagattttgatattacaggaggctatatccaagttagaagattttctacaggctgcaaatattactattctgaagttcagatctgtcttgtttgcctgtgttcctaaggccactgaagtagttgcagctgtacttattgtcgcagctgcatttcttgtcttcgtaccttccaggcatctgctacagatgttagtcctagagatgtacacaagggagatgcccctaaggaaacagaacactgaaaaattccgcaggcgaattagagagtggtgggctcgcattccagctgcacctgtgcagatgatcagacctaacgaaagcaagaaaaagagatgaccatgggctttgggctctcgaagagaaaaaataacccacagatttcaccattccccggtttgaacctgatcagctaacttgtatagattttaaccctgactctgcttgtagtaatcaaaatgctaccgagttccactaagaaaactagccctggtaaccagtgtatagagaagtgttgctatgggtgtaaaatgatgactgcaaaagaattattcatttttcttgcaagacatttcttcgaagtttctagagctctgatgtgctctagaagaatttttatcagatgtttgaactaatacttggttggaatgtaaggtggtttcatatggattctctgaagttttttgctctagcagaattcatgcatccccatagcaaactggagaagcagctgaaagtgtgtcgtatagtccagttcagcacttcattttcaaattgctatagcacctactcccctcttcgcagcagttcgcatcgcaccaacctcgcacaggaaggcagccgcccctgctccgagtccgagaaccggaatggccgcggcagctgcatcttcgtcgcctccggccgccatcacctgccgagctgcggtggcatgggggccgggccagccgctggtgatggaggaggtggaggtcgccccgccggggcccatggagatccgcgtcaaggtcgtctccacctccatctgccgcagcgacgtcactgcctggcaatccaaggcgcaacctgatctgttccccagagtcttcggccacgaggcatccggagttgtagagagtgtcggtgaaggtgtgaccgagttccaagtcggagaccacgttctcactgtcttcattggggaatgcaagagctgcaagcattgtgtctcggggaagagcaacatgtgccagaagctcggtttggagaggaagggtgtcatgcacagtgatcagaagacccgcttctctgtcaaggggaaacctgtgtaccattactgtgcagtgtcaagcttcagcgagtacacggttgtccattctggatgtgcggtgaaggttggcctgaccgtgccaatggacagggtgtgcctgctgagctgcggtgtgtctgcaggacttggtgcagtctggaacgtagctaatgtatcaaagggctcaagtgtagctatatttggtcttggaaccgtaggactttctgtcgctcaaggtgctaagcttcggggggcgtcaaagattataggagttgatactaattctgagaagcaagaaaaggggaaatcatttggtgtcacggattttattaacccagatgaactgagtgaacctgttcaacaggtaatcaaaaggattaccgatggaggggtggattactcttttgaatgtgtgggtgatactggagtagtatccactgcacttcaatcatgttctgatgccggggagtaactgtaactcttggtgtccaaaaacaaaaggagaagtgtctgctcattatgcatttctctatcaagaagaacactgaagggatctttgtttggtggatggagacccaaatctgatctaccttcattggtggataaatatgcacaccaggaaatcccagttgatggccttatcacgcatgatataccttcagtgaaataacaaagcgcttgagctgatgctagaaacaagtgcttgagatggtcatcacatgccacagtacaggtcgacagctgacatgattctacatatgtaactattgctttttctcctgacaacca

SEQ ID NO: 1074 - DNA, 1338 bp, Pennisetum glaucum
gcggtggcatgggggccggggcagccgctggtgatggaggaggtggaggtggccccgccgggggccatggagatccgcgtcaaggtcgtctccacctccgtctgccgcagcgacgtcaccgcgtggcaatccaaggcgcaacctgatctgttccccagaatcttcggccacgaggcatccggagtggtagagagcgtgggtcaaggggtggccgagttccaagtgggagatcacgtgctcaccgtcttcatcggggaatgccagagctgcaagcactgtgtctcggggaagagcaacatgtgccagaagctcggtctggagaggaaaggcgtcatgcacagcgatcagaagacccgcttctctgtcaaggggaaaccagtgtaccactactgtgcagtgtccagcttcagtgagtacatggttgttcattcgggatgtgctgtgaaggtcggcccgacagtgccaatggacagggtgtgcctgctgagctgtggtgtgtctgcaggacttggtgcagcttggaatgttgcagatgtatctgagggctcaagtgtagttatattcggtcttggaactgtaggactttctgttgctcaaggtgccaagcttcggggggcgtccaagattattggagttgatactaatcctgagaagcaagaaaagggtaaagcttttggcgtcacagattttattaacccgaatgtattgagcgagcctgttcagcaggtaatcaaaaggatgactgatggaggggcagattactcttttgaatgtgtgggtgataccggagtagtttccactgcgcttcaatcatgctctgatggttggggagtaactgtaactcttggtgtaccaaaagcaaagccagaggtttcagctcattatgcatttcttctatctggaagaacactgaagggatctttatttggaggatggagacctaaatctgatcttccttcattggtgaataagtatgcagacaaggaaatccaagttgacggcctagtcacgcatgatataccattcggcgacatcaaccgtgcactcgatttaatgctagaaagcaagtgcttgcgatgtgtgattcatatgtcacagtgagggttgaacagctgctacaaatctgctctttttccctaacctttgtggctcaagtattcatcagcactccagaactatccctttttgacgttgtttttttgggttaccctggtaaattttggtgttgtaaatccaagtacagaactctcaacaaaatcacattgatttccctcggaatcttgttacttgcttcctcaagagttgcccctgtaacctgtctttaccgctgtactgttt

SEQ ID NO: 1075 - DNA, 1441 bp, Setaria italica
cgctggtgatggaggaggtggaggtggccccgccgggggccatggagatccgcgtcaaggtcgtctccacctccgtctgccgcagcgacgtcaccgcgtggcaatccaaggcgcaacctgatctgttccccagaatattcggccacgaggcatccggagtggtagagagcgtgggtgaaggagtgaccgagttccaagtgggagatcacgtgctcaccgtcttcatcggggaatgccagagctgcaagcactgcgtctcggggaagagcaacatgtgccagaagctcggcctggagaggaagggcgtcatgcacagcgatcagatgacccgcttctctgtcaaggggaaacccgtgtatcattactgtgcagtgtccagcttcagcgagtacacggttgttcattcaggatgtgctgtgaaggtcggcctgacagtgccaatggacagggtgtgcctgctgagctgcggtgtgtctgcaggacttggtgcagcttggaatgttgcagatgtatctgagggttcaagtgtagttatattcggtcttggaactgtaggactttctgttgctcaaggtgctaagcttcggggggcgtccaagattattggagttgatactaatcctgagaagcaagaaaaggggaaagcttttggcgtcacagattttattaacccgaatgaattgagcgagcctgttcagcaggtaatcaaaaggatgactgatggaggggcagattactcttttgaatgtgtgggtgataccggagtagtttccactgcgcttcaatcatgctctgatggttggggagtaactgtaactcttggtgtaccaaaagcaaagccagaggtttctgctcattatgcatttcttctatctggaagaacactgaaaggatctttgtttggaggatggagacccaaatctgatctaccttcattggtgaataagtatgcagacaaggaaattcaagttgatggcctagtcacgcatgatataccattcggtgacatcaaccgtgcactcgaactgatgctagaaagcaagtgcttgcgatgtgtgattcacatgtcacagtgaggattgaacaactgctacaaatctgctcttttttcctttatcacctttgtggctcaagtattcatcagcacatcagagctcaccctttttggctttttttttgggttatcctggtaaattttggtgttgtaaatcaaagtacagaactctcaagagaatcacattgatttccctttgaatcttgttacttgcttcctcaagagttgcccctgtaacctgtcttactgaaattataccactgtactgtttttatgttccatgtataagccatcaagccaatactacgcttcagcatgttttgatgagttgagattggaaggattcttgaatctgtaacattgtgtaagactgaatgataacacaat

SEQ ID NO: 1076 - DNA, 849 bp, Triticum aestivum
gctagctatcgcctcccacctagcaattcacgtactccaccatggccccagccgtgatggcttcttccgccaccaccgtcgcgcccttccaggggcttaagtcgaccaccggccttcccatcagccgccgctccggcagcgccggcctcaacaacgtcagcaatggcggaaggatcagatgcatgcaggtgtggccgattgagggcatcaagaagttcgagaccctgtcttacttgccacccctctccacggaggccctccttaagcaggtcgactacctgatccgctccaagtgggtgccctgccttgagttcagcaaggttggcttcgtcttccgtgagcacaacagctccccagggtactacgacggtcgatactggacaatgtggaagcttcctatgttcgggtgcactgacgccacgcaggtgctcaacgaggtggaggaggtcaagaaggagtaccctgacgcctatgtccgcgtcattggcttcgacaacatgcgccaggtgcagtgcgtcagcttcattgccttcaggccaccaggctgcgaggaatccggcaaggcctaaagtgcaagtccgatatacactacaagaatcttgttaatctatgacggatacagtctgtcatggaacagtgcaaaaccgtcaaggagggttgtccgtgacggatttataatccatcatgtatatcgcgtcataatttgacaactgtaccaccatgacggatcctggccgtcaccgatcagtccctaggcccgcccaggcccggtcctctatgacagactagtccgtcatggatttggagaagctatacaaaaatgggcttgacgtggcaaaaaaaaaaaaa

SEQ ID NO: 1077 - DNA, 984 bp, Triticum aestivum
tgcccaattttttgggggacctcctcccccccaagttctaaccaaaaagccaaggctgtttcccgttcccggatttccccgggaaattggtcgatccacgggatcccgcaattgggcccggagggacccttaccctggactgaagtactagataaaaagccaggggggctccatcctagccagccaatatacctccttagtacaggccatggcccccaccgtgatggcctcgtcggccacctccatcgtccctttcagggggtcaaatccacccccggcctacccgtcagcagccggtccaagggcgctaacctcggcagcgtcagcaaccctggaaggatcaagtgcatgcagatgtggctcatcgagggcatcaagaagttcgagaccctgtcctacttgccaccgctcagcacggaggccctccttaagcaggtcgactacctgatccgctccaagtgggtaccttgcctcgagttcagcaagcttcggttcatcttccgtgagcacaacgcatcccctgggtactacgatgcccggtactggacaatgtggaagctgcctatgttcggatgctccgacgccacgcaggtgatccacgaggtggaggaggtcacagaaggagtaccctgatgcctatgtccgcatcatcggattcgacaacatgcgtcaggtgcagtgcgtcagcttcatcgccttcaaaccaccggtctgcgaggagtccaggaaggcctatacagcttactcacgacaggccatatataaagtgccattgcagttttgtcaactctgacactgctttgggtttgccttcaccatttatctgtcttatttgttcctaagcatatgtgtatgtccatgttcatgtacgaacatggctcgagtacgcatgctcgtacgtgaacgctatcggtggctatgtatatgcacggacgccaaatcattatacaatacgtggactatatacgttttaatggttgaaca

SEQ ID NO: 1078 - DNA, 682 bp, Triticum aestivum
cctcgtgccgcatcctcctctcctccagataatacattaccatggcccccgccgtgatggcttcctcggctaccaccgccgctccagcggcagcctcagcagcgtcagcaatggcggaaggatcaggtgcatgcaggtgtggccaattgagggcatcaagaagttcgagaccctgtcttacctgccacccctatccacggaggccctcctgaaacaggtcgactacctgatccgctcaaagtgggtgccctgcctcgagttcagcaaggttggcttcgtcttccgtgagcacaacagctcccccgggtactacgacggccgatactggacaatgtggaagctgcctatgttcgggtgcactgacgccacacaggtgctgaacgaggtggaggaggtcaagaaggagtaccctgacgcctatgtccgtgtcatcggcttcgacaacctgcgccaggtgcagtgcgtcagcttcatcgcctttaggccaccgggttgcgaggagtccggcaaggcctaaactacgagttgaaacaatggcctatctcgtatgaaggtcttttgtgaacttcacttttgtccaaaactctgctgtacgactctgctttctgaccggagcataccttttgttctatatgattttgtgtatgtatgtacgaacataggttcttgagcaaaaaaaaaa

SEQ ID NO: 1079 - DNA, 461 bp, Hordeum vulgare
tacatctatggcccccaccgtgatggcctcgtcggccacctccgtcgctcctttccaggggctcaagtccaccggcggcctccccgtcagccgccgctcgaacggtgctagcctcggcagcgtcagcaacggtggaaggatcaggtgcatgcaggtgtggcccatcgagggcatcaagaagttcgagaccctgtcttacttgccaccactcagcacggaggccctccttaagcaggtcgactacctgatccgctccaagtgggtgccttgcctcgagttcagcaaggttgggttcatcttccgtgagcacaacgcatctcctgggtactacgatggccggtactggacaatgtggaagctgcctatgttcggatgcaccgacgccacacaggtgctcaacgaggtggaggaggtcaaaaaggagtaccctgacgcgtatgtccgcatcatcggattccaca

SEQ ID NO: 1080 - DNA, 700 bp, Triticum aestivum
ctagctatcgcctcccacctagcaattcacgtactccaccatggccccagccgtgatggcttcttccgccaccaccgtcgcgcccttccaggggcttaagtcgaccaccggccttcccatcagccgccgctccggcagcgccggcctcaacaacgtcagcaatggcggaaggatcagatgcatgcaggtgtggccgattgagggcatcaagaagttcgagaccctgtcttacttgccacccctctccacggaggccctccttaagcaggtcgactacctgatccgctccaagtgggtgccctgccttgagttcagcaaggttggcttcgtcttccgtgagcacaacagctccccagggtactacgacggtcgatactggacaatgtggaagcttcctatgttcgggtgcactgacgccacgcaggtgcagtgcgtcagcttcattgccttcaggccaccaggctgcgaggaatccggcaaggcctaaagtgcaagtccgatatacactacaagaatcttgttaatctatgacggatacagtctgtcatggaacagtgcaaaaccgtcaaggagggttgtccgtgacggatttataatccatcatgtatatcgcgtcataatttgacaactgtaccaccatgacggatcctggccgtcaccgatcagtccataggcccgcccaggcccggtcctctatgac

SEQ ID NO: 1081 - DNA, 623 bp, Triticum aestivum
cacgagggtcagccgccgctccagcagtgcggctggcctcggcagcgtcagcaacggcggaagaatccggtgcatgcaggtgtggcctattgaaggcatcaaaaaattcgagaccttgtcttacctgccaccgctctccacggaagccctcctgaaacaggtcgactacctgattcgctccaaatgggtgccgtgtctcgagtttagcaaggttggcttcatcttccgtgagcacaatgcctctccagggtactacgacggtcgatactggacaatgtggaagctacccatgtttgggtgcaccgacgccacccaggtgataaacgaggtggaggaggtcaagaaggagtaccctgacgcctatgtccgcatcatcggattcgacaacatgcgtcaggtgcaatgcgtcagcttcatcgccttcaagccaccaggctgtgaggagtccggcaaggcctaaacaagctaactacccttcatcatacaacatggtttcgtgtcaggttgattttatttcccttttttacttttgttctgcttgtgtatgtgttctccccctgcaactcgagttaacattatatgagtacctgcccgggcggccgctcgaaatcactagtgaattc

SEQ ID NO: 1082 - DNA, 729 bp, Triticum aestivum
  misc_feature (46)..(46): n is a, c, g, or t
  misc_feature (73)..(73): n is a, c, g, or t
  misc_feature (84)..(84): n is a, c, g, or t
  misc_feature (97)..(97): n is a, c, g, or t
  misc_feature (99)..(99): n is a, c, g, or t
  misc_feature (213)..(213): n is a, c, g, or t
  misc_feature (215)..(216): n is a, c, g, or t
  misc_feature (268)..(268): n is a, c, g, or t
cgcaacgtggtcgagactacaacctagaaaaaatcccatcgatctnctccagctttgcggcgcggcagccagncagccagcacncatggcggtggangngataaccgagggcgtgaggggcctcaaggtggaggacggcgagggggcggcgggcgccgcggccgacgcgccggccgccgccgccggcggggaggggcagaggcggggcgccancnncagcagcaaccgcatccaggtgtccaacacgaagaagcccctcttcttctangtcaacctcgccaagaggtatatgcagcagcacggcgacgtcgagctctccgcgctcgggatggccattgcgacggttgtaaccgtggcggagattctgaagaacaacggccttgctgttgagaagaagattaggacatccacggtggaaataaacgacgaatcgagaggccgcccattccaaaaggctaagattgagatagagttgggaaagagcgagaaattcgacgagttgatggcctctgctgcggcagatgccgaagaaggcgaggaggaggcctgaagaaccaaacaaagccgtagcgaccacatcctgttgctctactttgttatcgctgttgtttaaaacttcaaaaccaatgcaccagacatggcgtgtgttcttgtttaacttgtattttcgtagtgtcagtgtttgtgaactctttggcagatgataatcagtttcgtgtgcatttcttt

SEQ ID NO: 1083 - DNA, 822 bp, Triticum aestivum
  misc_feature (312)..(312): n is a, c, g, or t
  misc_feature (315)..(315): n is a, c, g, or t
  misc_feature (415)..(415): n is a, c, g, or t
  misc_feature (639)..(639): n is a, c, g, or t
tcgcctccgtccgtttctctctgcgaacgcagcacgcaacgtggtcgagactacaacctagaacgagaaacctagaaaaaaaaaatcctgtcgatctagctttgcggcgcggcagcaaaccagccagcactcatggcggtggaggggataaccgagggcgtgaggggcctcaaggtggaggacggcgagggggcggcgggcgccgcggccgacgcgccggccgccgccgccgccgccggggaggggcagaggcggggcgccagcggcagcagcaaccgcatccaggtgtccaacaccaagaagcccctcttnttntatgtcaacctcgccaagaggtatatgcagcagcacggcgacgtcgagctctccgcgctcgggatggccattgcgacggttgtgactgtggcggagattntaaagaacaacggcctcgctgttgagaagaagattaggacatccacagtggaaataaatgacgaatctagaggccgcccattccaaaaggccaagattgagatagagttggggaagagcgagaaattcgacgagttgatggcctctgctgcggcagacgccgaagaaggcgaggaggaggcctgaagaaccaaacaaagccgtagcgaccgcatcccgttgctntactttgtttccgctgttgtttaaaacttcagaaccaatgcatgagacatggcgtgtgtccctgtttaacttgtattttcttagtgtcagtgtttgtgaactctttggcagatgatgaatctgttccgcgtgcattttttttctccaaaccgctggctggaaatatcttttttcgcgtgtgca

SEQ ID NO: 1084 - DNA, 718 bp, Triticum aestivum
ccacgcgtccgcgcaacgtggtcgagactacaacctagaaaaaatcccatcgatctactccagctttgcggcgcggcagccagccagcacccatggcggtggaagagataaccgagggcgtgaggggcctcaaggtggaggacggcgagggggcggcgggcgccgcggccgacgcgccggccgccgccgccgccggcggggagggaacgcagagtcggggcgccagcgccagcagcaaccgcatccaggtgtccaacacgaagaagcccctcttcttctacgtcaacctcgccaagaggtatatgcagcagcacggcgacgtcgagctctcggcgctcgggatggccattgcgactgttgtaaccgtggcggagattctgaagaacaacggcctcgctgttgagaagaagattagaacatccacggtggaaataaacgacgaatcgagaggccgcccattccaaaaggccaagattgagatagagttgggaaagagcgagaaattcgacgagttgatggcctctgctgcggcagatgccgaagaaggcgaggaggaggcctgaagaaccaaacaaagccgtagcgaccacatcctgttgctctactttgttatcgctgttgtttaaaacttcaaaaccaatgcaccagacatggcgtgtgttcttgtttaacttgtattttcgtagtgtcagtgtttgtgaactctttggcagatgat

SEQ ID NO: 1085 - DNA, 749 bp, Triticum aestivum
tcgcctccgtccgtttctctctgcgaacgcagcacgcaacgtggtcgagactacaacctagaacgagaaacctagaaaaaaaaaatcctgtcgatctagctttgcggcgcggcagcaaaccagccagcactcatggcggtggaggggataaccgagggcgtgaggggcctcaaggtggaggacggcgagggggcggcgggcgccgcggccgacgcgccggccgccgccgccgccgccggggagggaacgcagagtcggggcgccagcggcagcagcaaccgcatccaggtgtccaacaccaagaagcccctcttcttctatgtcaacctcgccaagaggtatatgcagcagcacggcgacgtcgagctctccgcgctcgggatggccattgcgacggttgtgactgtggcggagattctaaagaacaacggcctcgctgttgagaagaagattaggacatccacagtggaaataaatgacgaatctagaggccgcccattccaaaaggccaagattgagatagagttggggaagagcgagaaattcgacgagttgatggcctctgctgcggcagacgccgaagaaggcgaggaggaggcctgaagaaccaaacaaagccgtagcgaccgcatcccgttgctttactttgtttccgctgttgtttaaaacttcagaaccaatgcatgagacatggcgtgtgtccctgtttaacttgtattttcttagtgtcagtgtttgtgaactctttg

SEQ ID NO: 1086 - DNA, 902 bp, Brachypodium distachyon
gtcccctccacgaacaccagcacgcaaacgtgggggagactagaaccttgaacctaggtcgaaactcctcaacccatcccatcttcgtttgcggcgcatcgcagcaaagcacagcacacatggcggtggaggagatcacggagggggtgagggccctcgccgtgcaggacggggaggcggcggcgccgcccggcggcgccgcggaggggcagcagaggaggggcaccaacagcagcagcaaccgcatccaggtgtccaacacgaagaagcccctcttcttctatgtcaacctcgccaagaggtatatgcagcagcacggcgacgttgagctctccgcgctagggatggcgattgcaacggttgtgaccgtggcagagattctgaaaaacaacggccttgctgttgagaagaagattaggacatccactgttgaaataaacgatgaatcaagaggccgcccgtttcaaaaggccaagatcgagattgagttaggaaagagcgaaaaattcgatgagttgatggctgccgccgcggaagatagggaagccgaagaaggggaggaacatgcttgaaaaggaccagtagccaccacctcttgttcctgctgtttctgtagtttgttattgttgtttaaaactgtcatatgagactatgatgatgaatgggtctgttcttgtttaacttgtatttgttggtggcattgtgcgtaatctcgctggctgatgataatctgttttgcggtttgacatcttttatatttctttccccaaaccgctgattggtttttaaagtagcgtgtgtaagctcatcagctttggctgatgacagtatgtgttctagacatctccgtttgctcctgctattgtcaatgagctgctgaccaaatggctgttcttatttcc

SEQ ID NO: 1087 - DNA, 866 bp, Oryza sativa
agccattcctcctcctgtctcccctgcccgtacgccaccccacaagcgaagaagacgagaggaagaggaggccaagccgcacaacccaccaccaccaccaccaccgatctgcggagagcgagctaccaccaccgagcggcgtagcttgagcgatggcggtggaggagatcaccgagggggtgaggaacctggccgtggagggggagcccgcggcggcggcggcggcggcgggaggtggtggtgagggggcgcagaggagggcggccgggagcagcagcaaccgcatccaggtgtccaacaccaagaagccactcttcttctatgtcaacctcgccaagaggtacatgcagcagcacggcgatgtcgagctctccgcgctcgggatggccattgcaacagttgtaactgttgcggagattcttaagaataacgggtttgctgttgaaaagaagattagaacatctacggtggaaataaacgatgaatcgagagttcgcccgctccaaaaggctaagattgagatagtgttagaaaagagcgagaaatttgatgagctgatggctgccgcagcggaagagagggaagctgcggaagctgaggagcaggcctgataaggactaggagcgatgacctttgttgtgtgctttgttcctgttgtttaatactgcgtgctttagagatggcatgccttcttgtttaagttgtgtttttcttttatggcagtgtgtgtaaactcagtgactgatgataatctgtttgcaattgagttgagacagcttctcaatttgtttctttggccctgatttccttcctgaatttgtctgcttccttttgggtgattatctgatgatgctatggtttggata

SEQ ID NO: 1088 - DNA, 1225 bp, Leymus cinereus x Leymus triticoides
  misc_feature (14)..(16): n is a, c, g, or t
gggctccggtcgcnnngccttcgcgcggaggcggccaaggaggcggaggtgggggagctcaggtccggggtatccgtatacaagccgcgctcctacgaggtgctcgtctccgacgccgcccgctccctcgccgccgccatcgacgacggcaggacccgcctcgagatcgagttcccgcctctgcccagcagcatctcttcttacaagggctcttcggacgagttcatcgatgccaacgtccagctcgctctcgccgtcgtaagggacctcaaaaagctcaaggggactcggtcctgcatagtgtttcctgatcaaccggagaagcgaagggcctcgcagatattcaaaacagctatagatcagatcgagggcatatccatcagttcgttggatgatctgcccaccgggccagttgataccttcttcaaatcgataagaagtacccttgatttcgactttgctgacgacaacgaagatcgatggaagtctgacgaaccagcatcactatatatctttatcaacagcagcacacgtgaccttgcatctatagagaagtatgtggaccaatttgctgcctctgtacctgctgttctctttaaccttgaactagataccttgcgttctgacttggggcttctgggattccccccaaaagatttgcattaccggtttctttctcagtttaccccagtattttatatcagacagcgtgactactccaagacaattgcagtcactccatacatagtgaactacagtggcgctgtcttccgtcaatacccagggccctggcaagtcatgcttaagcaggctgatggttcctatgcatgtgttgcagagagtgcatctcggttcaccttggggcaggccaaggacgaactactgagagttctcggtttgcaagaagaggtaggaagccagcttgaattcctcagaagaggatacaagaatgctacttggtgggaagagaatttcgatcaggagaaatcacccgcatggcgaacttgagaggcagctgctggttcaacgccgaattgccgatccgacttgcaaatggagatacataggccaaagaatgttcataaaagtcccctgaaaacagagtgttcacgaatcctgagctgatggtgcaaaagaagcccacacatcaatattgtagtcatgcagtggagacattgatatgaattatgggaggaaattctccttgccttttttttgctgatta

SEQ ID NO: 1089 - DNA, 1551 bp, Triticum aestivum
ggactcgcttctccttccctcctcgcggcgggacgccagccaccagagcagagcagagcaccgcctctcctcctccgcagccggccatggcgcctctctccaccgccgtccgcctcctgcgctcccccgcggctccggccacgctcccttctccgtccgcccgcctcgccggggcgccagcgcgcttccggtgccgcggccggctccggtcggtgcgcgcggaggcggccaaggaggcggaggtgggggagctcagggccggggtgtccgtctacaagccgcgctcctacgaggtgctcgtctccgacgccgcccgctccctcgccgccgccatcgacgacggcaggacccgcctcgagatcgagttcccgcctctgcccagcagcatctcttcttacaaggggtcttcggacgagttcatcgatgccaacgtccagctcgctctcgccgtcgtaagggacctcaaaaagctcaaggggactcggtcctgcatagtgtttcctgatcaaccggagaagcgaagggcctcgcagatattcaaaacagctatagatcagatcgagggtatatccatcagttcgttggacgatctgcccaccgggcctgtcgataccttcttcaaatcgataagaagtacccttgatttcgattttgctgatgacaacgaagatcaatggaagtctgacgaaccaccatcactatatatctttatcaacagcagcacgggtgacctttcatctatagagaagtatgtggaccaatttgctgcctctgtacctgctgttctctttaaccttgaactagataccttgcgttctgacctggggcttctgggattccccccaaaagatttgcattaccggtttctttctcagtttaccccagtattttatatcagacagcgtgactactcgaagacaattgcggtcactccatacatagtgaactacagtggcgctgtcttccgtcagtacccagggccctggcaagtcatgcttaagcagggtgatggttcctatgcatgtgttgcagagagtgcatctcggttcactttggggcaggccaaggatgaactattgagagttctcggtttgcaagaagaggtaggcagccagcttgaattcctcagaagaggatacaagaatgctacttggtgggaagagaattttgatcaggagaaatcgcccgcgtggcgaacttgagacgcagctgctggttcgacgccgaaacgccagtctgactggcaaatggagatacataggccaaagaatgttcatatagtcccttgaaaacagagtgttcatgaatcctgagctgatgatgcaactgaaattacagaaagaagcgcacacaccaatgtcatagtcatgcagtgtggacattgcctgtgctgcaactgtgccatctgatatgagttctgaggggaaattctcctcagcatttttggtgattatgtgctgagtacaagtgtaatgcatgcgactctaatattgcagtgaatcttatggcttctcttttttacttccacagaccagaagtgtatctggcaac

SEQ ID NO: 1090 - DNA, 1499 bp, Triticum aestivum
gtgtggactcgcttctccttccctcctcgcggcgggacgccagccaccaccagagcagagcacaccatcgtctcttcctcctcctcctccgcggccggccatggcgcctctctccaccgccgtccgcctcctgcgctcccccgcggctccggtcacgctcccttctccgtccgcccgcctcgccggggcgccagcgcgcttccggtgccgccgccggctccggtcggttcgcgcggaggcggccaaggaggcggaggtgggggagctcagggccggggtgtccgtctacaagccgcgctcctacgaggtgctcgtctccgacgccgcccgctccctcgccgccgccatcgacgacggcaggacccgcctcgagatcgagttcccgcctctgcccagcagcatctcttcttacaaggggtcttcggacgagttcatcgatgccaacgtccagctcgctctcgccgttgtaagggacctcaaaaagctcaaggggactcggtcctgcatagtgtttcctgatcaaccggagaagcgaagggcctcgcagatattcaaaacagctatagatcagatcgagggtatatccatcagttcgttggacgatctgcccaccgggcctgtcgataccttcttcaaatcgataagaagtacccttgatttcgattttgctgatgacaacgaagatcaatggaagtctgacgaaccaccatcactatatatctttatcaacagcagcacgggtgacctttcatctatagagaagtatgtggaccaatttgctgcctctgtacctgctgttctctttaaccttgaactagataccttgcgttctgacctggggcttctgggattccccccaaaagatttgcattaccggtttctttctcagtttaccccagtattttatatcagacagcgtgactactcgaagacaattgcggtcactccatacatagtgaactacagtggcgctgtcttccgtcagtacccagggccctggcaagtcatgcttaagcagggtgatggttcctatgcatgtgttgcagagagtgcatctcggttcactttggggcaggccaaggatgaactattgagagttctcggtttgcaagaagaggtaggcagccagcttgaattcctcagaagaggatacaagaatgccacttggtgggaagagaatttcgatcaggagaaatcgcccgcgtggcgaacttgagacgccagtctgactggcaaatggagacacataggccaaaccgccaaagcatgttcatatagtcccttgaaaacagagtgttcatgcatcctgagctgatgatgcaactgaaattacagaaagaagcgcacacaccaatgtcatagtcatgcagtgtgggcattgcctgtgctgcaactgcgccatctgatatagttctgaggggaaattctcctcagcatttttggtgattatgtgctgagtacaagtgtaatgcatgcgactctaatattgcagtgtatct

SEQ ID NO: 1091 - DNA, 1559 bp, Avena sativa
ctcgcctcgcctcgcagcgggacgtgcgtgagccaccaccagagcagagcaccgcccctcccaccctcaccctcgtccgcgcgcggccatggcgtccctctccaccgccgcacgactcccgcgctgccccgggaccccccgccgcgcgccccctccttcccccaccggccccgccgcgccgcccctgcgtttccggggccgccgccgccgtagcctcccgtcggtgcgcgcggaggcggccaaggaggtggaggaggcggtggagctcaagtccggggtggccgtatacaagccgcgctcctacgaggtgctcgtcgccgacgccgcccgctccctcgccgccgccatcggcgacggcaggacacgcctcgagatcgagttcccgcctctgcccagcagcatctcctcttacaagggctcttcggacgagttcatcgacgccaacgtccagctcgctctcgctgtcgtaaggagcctcaagaagctcagggagacccgggcctgcatagtgtttcctgatcagccggagaagcgaagggcctcagagattttcaaaactgctatagattcgatcgagggtatatccatcagttccctggatgatgtgccgaccgggccggtcgacaccttcttcagatcgataaggaagacccttgatttcgactttaatgatgagaacgaagatcaatggaaatctgatgaacagacatcattgtacatcttcatcaacagtagcacacaggacctttcatctatagagaagtatgtggaaatttttgctgcctctgcatctgttgttctctttaatcttgaactagacaccttgcgttctgacttggggcttctggggttccctccgaaagatctgcactaccgatttctttctcagtttaccccagtgttttatatcagacagcgtgactactccaagacaattgcagtcactccatacatagtgaactacagtggcgctgtcttccgtcaatacccagggccctggcaagtcatgcttaagcaggctgatggttcttatgcatgtgttgcggagagtgcatctcggttcactttggggcaggccaaggacgaactattgagagttctcggtttgcaagaagaggaaggaagctcgcttcagttcctcagacaaggatacaagaatgctacttggtgggaggagaatgtcgatcaggaggagtcgaccgcatggcggacttgaggcgccgctgctgcttcgttgcaaaaccgctgatcggaccggcaaatggagatatataggccaaaggctgtccatagaagtcccctaaaagaaagagtgttcatgggtcctgagctgaaattgaagaaagaagccaactcgccagtgatattagagtcatcagtggagacattgcctgtgataaatttgtaccatctgacatgagttctgagaggattttttcctctgcttttttggtgactagtaaaatgcccgtgcgttgctacgggaatatagatgtaaaatagaaacctgatttatacataaggttttacataaataaaaacaaaaaactatttcttgt

SEQ ID NO: 1092 - DNA, 1492 bp, Zea mays
cctgcgcctcgcggtagcgtgcggctgtgccgtcgacccgtcgtctcctttctcctccactcctcgtcgcaggcggcataacggagcgcacgcacgcacgcaatggccatggccgccccgccacccacggctctctgcgcccgccgcttccggccccaccacttcgcatactcctcccccgccacgctccgcctacccacggcctcctcctcctcacagctccggcgccgccgccggctagccgtctccccgcgcgcggacgcggcgaccgggacgggggatgtggaggcgctcagggccggggtgtccgtgtacaagccgcggtcctacgacgtgctcgtcaccgacgcggctcgctccctcgcctgcgccatcgacgacggcaagacccggctcgagatcgaattcccgcctctgccaagcagcatctcttcttacaagggctcctcagatgagttcatcgatgccaacatccagcttgctctcgttgttgctaggaagctcaaagagctcaaggggactaggtcttgtatagtgtttcctgatcaacctgaaaaacgtagggcatcagagttgttcaagacagctatagacacgattgagggtgtaaccatcagctccctggatgatgtacccactgaccctgtcaacagcttcttcaaatcaataagaaacaccctggattttgacttctcagatgacaatgaaggtagatggaaatctgatgaaccaccatcgttatatatcttcatcaacagcagcacgcgtgaccttgcttctatagagaagtatgtggaaaagttcgccacatctgttccagcccttctattcaatctcgaactagatacattgcgttctgacctggggcttctcgggttccccccaaaagatctgcactaccggttcctttctcaattcaccccagtattttatatcagacagcgtgactattccaaaacaatcgcagttgctccatacatagtgaattatagtggagctgtattccgccaatacccagccccctggcaggtcatgctgaagcaggctgatggttcctatgcatgtgtcgctgagagcgaagctcggttcactttgggacaggcgaaagaagaactattgagagttattggtttacaagaagaagagggaagctcccttgaatttctcagaagaggatacaagaatgctacctggtgggaagagaacgttgatcaggagacgtcgtctgcctggcgaacttgagatgctatacttgctggatggatgcttttctaacctggaactgggaatggataatttggccaacgagtgtccatgtcttgttgtatggaactaaaaaatctgaaattacagaaagagaagtccatgtacagcgtaataacattgcctgtgatgatcgtattattattattgttgttattattatgcgagtacacagagcttgtgagcactaagaatgtttttttacaatggtgatttgtacatttgttct

SEQ ID NO: 1093 - DNA, 1491 bp, Zea mays
cctgcgcctcgcggtagcgtgcggctgtgccgtcgacccgtcgtctcctttctcctccactcctcgtcgcaggcggcataacggagcgcacgcacgcacgcaatggccatggccgccccgccacccacggctctctgcgcccgccgcttccggccccaccacttcgcatactcctcccccgccacgctccgcctacccacggcctcctcctcctcacagctccggcgccgccgccggctagccgtctccccgcgcgcggacgcggcgaccgggacgggggatgtggaggcgctcagggccggggtgtccgtgtacaagccgcggtcctacgacgtgctcgtcaccgacgcggctcgctccctcgcctgcgccatcgacgacggcaagacccggctcgagatcgaattcccgcctctgccaagcagcatctcttcttacaagggctcctcagatgagttcatcgatgccaacatccagcttgctctcgttgttgctaggaagctcaaagagctcaaggggactaggtcttgtatagtgtttcctgatcaacctgaaaaacgtagggcatcagagttgttcaagacagctatagacacgattgagggtgtaaccatcagctccctggatgatgtacccactgaccctgtcaacagcttcttcaaatcaataagaaacaccctggattttgacttctcagatgacaatgaaggtagatggaaatctgatgaaccaccatcgttatatatcttcatcaacagcagcacgcgtgaccttgcttctatagagaagtatgtggaaaagttcgccacatctgttccagcccttctattcaatctcgaactagatacattgcgttctgacctggggcttctcgggttccccccaaaagatctgcactaccggttcctttctcaattcaccccagtattttatatcagacagcgtgactattccaaaacaatcgcagttgctccatacatagtgaattatagtggagctgtattccgccaatacccagccccctggcaggtcatgctgaagcaggctgatggttcctatgcatgtgtcgctgagagcgaagctcggttcactttgggacaggcgaaagaagaactattgagagttattggtttacaagaagaagagggaagctcccttgaatttctcagaagaggatacaagaatgctacctggtgggaagagaacgttgatcaggagacgtcgtctgcctggcgaacttgagatgctatacttgctggatggatgcttttctaacctggaactgggaatggataatttggccaacgagtgtccatgtcttgttgtatggaactaaaaaatctgaaattacagaaagagaagtccatgtacagcgtaataacattgcctgtgatgatcgtattattattattgttgttattattatgcgagtacacagagcttgtgagcactaagaatgtttttttacaatggtgatttgtacatttgttc

SEQ ID NO: 1094 - DNA, 1586 bp, Sorghum bicolor
gcagacggcagacgacgctgccgcctgcctgtcggagcgcacgcacggccatggccatggccgccccgccgccgcccacggctgtctgcgctcgccacttccggctccacctcccctgctcctcccgcctgcccatggccgccgcctctgcctcctcctcttcaccgctccggcgccgccgccggctcgccgtctccccgcgcgccgaagctggtacagggactgggacggggaccgggaccggggacgtggaggcgctcagggccggggtgtccgtgtacaagccgcgctcctacgacgtgctcgtcactgacgccgcgcgctccctcgcctgcgccatcgacgacggcaagacccggctcgagatcgagttcccgcctctgccaagcagcatatcttcttacaagggctcctcagatgagttcatcgatgcgaacatccagcttgctcttgttgttgctaggaagctcaaagagctcaaggggactaagtcctgtatagtgtttcctgatcaacctgaaaagcgcagggcgtcacagttgttcaggacagctatagatacgattgagggtgtaactgtcagttccctggatgatgtacccaccgaccctgtcaacagcttcttcaaatcaataagaaacaccctggattttgacttctcagatgacaatgaagatagatggaaatctgatgaaccaccgtcattatatatcttcattaacagcagcacacgtgaccttgcttctatagagaagtatgtggaaaagtttgccacatctgttccagcccttctattcaatcttgaactagatacattgcgttctgacttggggcttctggggtttcccccaaaagatttgcactatcggttcctttctcagttcaccccagtattttatatcagacaacgtgactattccaagacaatcgcagtcgctccatacatagtgaattacagtggagctgtattccgtcgatatccaggcccctggcaggtcatgctgaagcagctcgatggctcctatgcatgtgttgcagagagtgaagctcggttcactttgggacaggcgaaagaagaactattgagggttattggtttacaagaagaagagggaagctcacttgaatttctcagaagaggatacaagaatgctacttggtgggaagagaacgttgatcaagagacgtcggctgcgtggcgaacttgagacgctgcagctgctggctgaatgctttttctgacctgggtgtggaaaataggccaaacgaaacgagtgtccatgtcttgttgtatggaactgaaaattctgaaattacagagagagaagtccatgtacagcgtaataatatttgcctgtgctgatatcgtatcgtatcattattgttatgtgaatacgaagtaagagcttctgagcactaagaacttcttttttcaatggtgactgtaaatttgttctgtttgtggccttgggctcttcagcttgaaggtgcaagtgtaaaatgcaggggactctctggtttcagtccatatatactcaatccatcccaaattataagtcgtttgacttttttaatatcaagtttga

SEQ ID NO: 1095 - DNA, 1482 bp, Oryza sativa
tgctcgtcacttcgtctcctcctctccaccactcgtcgtcgtcggcggcgtggccatggcgacacccgcgccgctctccggcctccgcccgcgcgctcccgctcccgctcccgcggcgcgcagtcgcctgtgcggccagtcgccgccggtcgtggccccgcggctcggggcgttcccgcggcggcgtggtggggcggcacggtgctcgccgcgcgccgaggccggggacgtggaggcgcttagggcgggggtgtcggtgtacaagccgcggtcctacgacgtgctcgtctccgacgccgcccgctccctcgcctgcgccatggacgagggcaagacccgcctcgagatcgagttcccgcctctgccgagcaacatctcttcttacaagggttcctcggacgagttcatcgacgccaacatccagcttgctcttgctgttgccagaaaacttaaggaactcaaggggactagatcttgtattgtgtttcctgacctaccagaaaagcgcagggcatcccagttgttcgggactgctctagactcgattgagactgcaactatcagttccctggatgaggtatctaccggacctgttaataccttcttcagatcaatgagagataccctggattttgactttgctgacgatgttgaagatcgatggaaatctgatgaaccaccatcgctatatatcttcatcaattgcagcacacgtgacctttcaactatagagaagtatgtggaacaatttgcctcatctgtcccagcccttctctttaatcttgaactagataccttgcgctctgacttggggcttctgggattcccaccaaaagatttgcattacagatttctttctcagtttaccccagtattttatatcaggcagcgtgactactctaagacaattgcagtcactccatatatcgtgaactacagtggtgctgtattccgtcaatacccagggccctggcaggtcatgcttaagcaagccgatggttcttatgcatgtgttgcagagagtgcagctcggttcactttgggacaggctaaggaagaactgttaagagttcttggtttgcaagaagaacaaggaagctcactagaatttctcagaagaggatacaagaatgctacttggtgggaagagaatgttgatcaggagaaatcgtcagcatggcgaacttgaggttgaggccctgctgctgccttgtctgggtgctgatctgattggcggcgagtgcagacaggaacagaagaaaaaaatggttgtctgaaattgcagagcccaggcgacaaggatgcaaattgcctgtgctgcaattgtacattttgtgattgtaacatgttactgtgtgagtaacaggcattagagttttgagaggattttcctttctttttcgatgattatatatgtgttggactctgcttctttgaagcatgaagcaacttcacattttaaatggaaattcgtgttcatcc

SEQ ID NO: 1096 - DNA, 929 bp, Triticum aestivum
acctcttccccccgccaagagcagcaacgaactgcgaattctagctctgaagcagctcaagatcgggcttgctagaagaagccattccgagtcttttcccaaccatacaggctacaggcctacagcaataccatggcggcatcagtagcctgcgccttcttcttcgaggccgagccggtgggcgagcccggcatgccggcgctagacgcgtgcgcgctctgtgccaagcggctggtgcgcgacagcgacgtcttcatgtacagaggggacacgcccttctgcagcgaggagtgccgccacgagcagatgcagctcgacgccgtctccgccaggcaggccgcccggaggctgcagcggttctcggcgggagcagagtccgggcgtgcacgccatggggtgtccgtctcgagctaaccagcgagagtgccaagcgacatacagtacgtgcctgacaacgaaaggttattatgcttgagccaacctgatctccgtgcaccaagccgctggtgtccgtggctagctgatcgatcagcgcgaggtcgaggagacttgccttgcttgaagaagcaaggggcgagcgagtcaccggagtcgctcacggcaggccggcgctgcatgtgctgccggtcaagtgatttgggcataaacgcagcggaaaaggggctggattgaatctgaagaaagtgaagcaaacaacattccccgcggcttaactttgaggcggtcatgtctgaccctcagttttttcttttctttctgcgttattgtcacttctgtataagctcatttgagatggcactctcgctcggtacattctcaagcgaatcgacatacaacatgccttgtgcaatcctctttctgttcgtgaagaatcatgctaatgggattttgcaagtgtacacatagttaattaagacccaaaaaaaaaa

SEQ ID NO: 1097 - DNA, 1156 bp, Triticum aestivum
  misc_feature (224)..(224): n is a, c, g, or t
tccccccgttttaaccttggccccgggggggagaaccatgttccccacggacgccgttggccccttggggccgttttagtgggcgcccataaggcacagtttgatcaacaaaaccaggcgtgtcccggctccgggttccccggatattgttcgaacccacggttcccggttggggggcggggccccttaccctggacgaagaggatatggaaaatgggtttacncccacctcttccccccgccaagagcagcaacgaactgcgaattctagctctgaagcagctcaagatcgggcttgctagaagaagccattccgagtcttttcccaaccatacaggctacaggcctacagcaataccatggcggcatcagtagcctgcgccttcttcttcgaggccgagccggtgggcgagcccggcatgccggcgctagacgcgtgcgcgctctgtgccaagcggctggtgcgcgacagcgacgtcttcatgtacagaggggacacgcccttctgcagcgaggagtgccgccacgagcagatgcagctcgacgccgtctccgccaggcaggccgcccggaggctgcagcggttctcggcgggagcagagtccgggcgtgcacgccatggggtgtccgtctcgagctaaccagcgagagtgccaagcgacatacagtacgtgcctgacaacgaaaggttattatgcttgagccaacctgatctccgtgcaccaagccgctggtgtccgtggctagctgatcgatcagcgcgaggtcgaggagacttgccttgcttgaagaagcaaggggcgagcgagtcaccggagtcgctcacggcaggccggcgctgcatgtgctgccggtcaagtgatttgggcataaacgcagcggaaaaggggctggattgaatctgaagaaagtgaagcaaacaacattccccgcggcttaactttgaggcggtcatgtctgaccctcagttttttcttttctttctgcgttattgtcacttctgtataagctcatttgagatggcactctcgctcggtacattctcaagcgaatcgacatacaacatgccttgtgcaatcctctttctgttcgtgaagaatcatgctaatgggattttgcaagtgtacacatagttaattaagacccaaaaaaaaaa

SEQ ID NO: 1098 - DNA, 764 bp, Secale cereale
  misc_feature (261)..(261): n is a, c, g, or t
  misc_feature (419)..(419): n is a, c, g, or t
agcagccgcgaactgtgaattgactgaattctacctactctgaagcagcttaagatcaggcttgctggaagaagcctttccgactcgcttaccacacatacagcaataccatggcggcatcagtagcctgcgccttcttcttcgacgccgagccggtgggcgagcacggcatgccggcgctggacgcgtgcgcgctctgcgccaagcggctggcgcgcgacagcgacgtcttcatgtacagaggggacacgcccttctgcngcaaggagtgccggcacgagcagatgcagctcgacgccgtctccgccaggcaggccgcccggaggctgcagcggttctcggcgggagcagagtccgggtgtgcacaccacggggtgtccgtctcgagctaaccggcgggagtgccaagccacaaacangatctccgtgcaccaagccgctggtgtccgtggttggctgatcgagcagcgcgaggtcgaggaaacttgcctagcttgaagaagcaaggggcgggccaccggagtcgctcacggcaggccggcgctgcatgtgccgccggtcaagtgatttgggcaaaaacgcagcggagaaggggctggattggatctgaagaaagtcaagcaaacaagattccccacggtttaactttgaggcggtcatgtctgcccctcgttttttctttctttctgcgttattgtcacttctgtataagctcatttgcagcggtactctcgctcggtaaactttcaagcgaatcgacatac

SEQ ID NO: 1099 - DNA, 962 bp, Triticum aestivum
tcgacccacgcgtccgcccacgcgtccggacccataccgcgcaccggaccatggtttcccaggcaccaataatggccttccggtcatccggtgctccctcccccatatataccggctctccagcttcgcaccgctgcaccaaactcacccatctctttcccccgccaagagcagcaacgagctgtgtgttcttgctagctctgaagctcaagcgcgagcttgctagaagaagcatctctccccagtctgccatatagcagtaccatggcggcatcggtggcctgcgccttcttcttcgacgccgagccggtgggcgagcccggcatgccggcgctggacgcgtgcgcgctctgcgccaagccgctggcgcgtgacagcgacgtcttcatgtacagaggggacacgcccttctgcagcgaggagtgccgccacgagcagatgcacctcgacgccgtctccgccaggcaggccgcccggagggtgcagcgattctccgcggaggcggagtgccaccgtgggcagcggcagtccaggaaggtgtccatcgccagctagccgcggaaagtctttgtttggatcgacaagatctgaatgaattctgaagaaaacgacctctgtattctgaagaaccatcgatgtctcttgggaggcgtctgatgtttccgtctctccgggtaccagatgcagcctggcgccgcctacgagaggcaaggcagccaggcagggcagcatcagtcggcaccaagcatcataggagactgtagctttccccatgtgtccatggcaagctaattaagctgcccggataggaggaaattctacttgttcttgatcgatctgtgctgtgccgatgaagtgttatttgattagaaatgaaaacagaaaagtaaacaccatggatctgaagagagcaatcagacttgattcacaatttgtttatcttcagaaaaaaaaaaaaaaaa

SEQ ID NO: 1100 - DNA, 807 bp, Triticum aestivum
  misc_feature (791)..(791): n is a, c, g, or t
gaattcggcacgaggctctttcccccgccaagagcagcaacgagctgtgtgttcttgctagctctgaagctcaagcgcgagcttgctagaagaagcatctctccccagtctgccatatagcagtaccatggcggcatcggtggcctgcgccttcttcttcgacgccgagccggtgggcgagcccggcatgccggcgctggacgcgtgcgcgctctgcgccaagccgctggcgcgtgacagcgacgtcttcatgtacagaggggacacgcccttctgcagcgaggagtgccgccacgagcagatgcacctcgacgccgtctccgccaggcaggccgcccggagggtgcagcgattctccgcggaggcggagtgccaccgtgggcagcggcagtccaggaaggtgtccatcgccagctagccgcggaaagtctttgtttggatcgacaagatctgaatgaattctgaagaaaacgacctctgtattctgaagaaccatcgatgtctcttgggaggcgtctgatgtttccgtctctccgggtaccagatgcagcctggcgccgcctacgagaggcaaggcagccaggcagggcagcatcagtcggcaccaagcatcataggagactgtagctttccccatgtgtccatggcaagctaattaagctgcccggataggaggaaattctacttgttcttgatcgatctgtgctgtgccgatgaagtgttatttgattagaaatgaaaacagaaaagtaaacaccatggatctgaagagagcaatcagacttgattcncaatttgtttatcttc

SEQ ID NO: 1101 - DNA, 759 bp, Triticum aestivum
cacctcttcccccgccctctggagcacaagtccgagctagctagaagaagcctccgtctccaaccatataccatggcggcatcggtggcctgcgccttcttcttcgacgccgagccggtgggcgagcccggcatgccggcgctggacgcgtgcgcgctctgcgccaagccgctggcgcgcgacagcgacgtcttcatgtacagaggggacacgcccttctgcagcgaggagtgccgccacgagcagatgcacctcgacgctgtctgcgccaggcaggccgcccggaggctgcagcggttcacggcggaggcggagtgccaccgtgggcagcggcagtccaggaaggtgtccatcgcgagctagccggccggccccggaaagtattgtttggatccaaaatatctggattctgaagaaaacaacatctgtattctgaagaaccatcgatgtctcttgggaggcgttgtctgatgtctccctctccggccggtgctctagctttggcgccgcctacgagaggcagggcagcatcaggcggcacgaagcacaggtgcctgtagcttcccgcatgtgtccatgacaagctaattaagctgcccggatgggagtaaattgtacttgttcagttgttctcggtcgatctgtcatgtgccgatgaattatttgattagaaatgaaaacagaaaagtaaacaccatggatctgaagagagcaatcagacatgattcacaatttgtttatcctcaaaaaaaaaaaaaa

SEQ ID NO: 1102 - DNA, 673 bp, Triticum aestivum
taccatggcggcatcggtggcctgcgccttcttcttcgacgccgagccggtgggcgagcccggcatgccggcgctggacgcgtgcgcgctctgcgccaagccgctggcgcgcgacagcgacgtcttcatgtacagaggggacacgcccttctgcagcgaggagtgccgccacgagcagatgcacctcgacgctgtctgcgccaggcaggccgcccggaggctgcagcggttcacggcggaggcggagtgccaccgtgggcagcggcagtccaggaaggtgtccatcgcgagctagccggccggccccggaaagtattgtttggatccaaaatatctggattctgaagaaaacaacatctgtattctgaagaaccatcgatgtctcttgggaggcgttgtctgatgtctccctctccggccggtgctctagctttggcgccgcctacgagaggcagggcagcatcaggcggcacgaagcacaggtgcctgtagcttcccgcatgtgtccatgacaagctaattaagctgcccggatgggagtaaattgtacttgttcagttgttctcggtcgatctgtcatgtgccgatgaattatttgattagaaatgaaaacagaaaagtaaacaccatggatctgaagagagcaatcagacatgattcacaatttgtttat

SEQ ID NO: 1103 - DNA, 1073 bp, Triticum aestivum
accaaactcacccactttccttgcctcccgccaagagcagcagcgaacgcaacctgtgagctctagctctgaagctcaagctcgagcttgctagcagagccacgtagcaataccatggcggcatcggtggcctgcgccttcttcttcgacgccgagccggccggcgagcccggcaagcacgcgctggacgcgtgcgcgctctgcgccaagcggctggcgcgcgacagggacgtcttcatgtaccgaggggacacgcccttctgcagcgaggagtgccgccacgagcagatgcacctcgacgccgtctccgccaggcaggccgcgcggaggctgcagcgctttctcgccggagacggagtcccagtcccaccgtgggcagcggccgtccaggaaggtgtccatcgccagttagccggggaaagttttgttgggatctacaatatctgtattctgaaaaaaacaacatctgtattctgaaagaaccatcgttggtggtttggaaggcagtgcagggaacggaaccatcaggtggcaggtgccttcagcttcccgtatgttgtccatggcaagctaattaagcggcccgggtgcctgaagattttgggttgatctggtctgcgccgttgatttggattgtgttggaaaaaaaaagggaaaaagccatggatcttgagggaggcatcaaaacattattccacaattggttcaactttcggtggtggcccccccggggtgccccggccccttaatttcggttcccctgaaatgattggatcctgtttgggtttttggtaacgaaaggttagggaacactctgcaaaaaccactggaatgggtaaaatggaactgggttcaaacctggggttttaaattattagggttcccccaaatgaaccccggaattttaggatttcgcccctaaaccttttgggaatttttattaatgggttaaaaaaaaaaacaaagggggggcccgccaaaaaattcccctcggggggcccaaattttaccggaccccagtcttttgtgaaaaggggggccccaaaaggtgggggcgttttataagcttggcg

SEQ ID NO: 1104 - DNA, 892 bp, Hordeum vulgare
gacgatactgtaggggaggtcctgcggcaaaatagctcgatgccagaataatccaactcgctcgcttccttcgtcctccctcatccgcagcagcagcaccaaaatcagcaaagcgagcacaccaccaggctctgctctgctcagcatcttgctctcgaaagccacctgcacatacacacatacaatggcggcatcagtggcctgctccttcttcttcgatgccgagctgcttggcgagcccggcatgccggcgatggacgcgtgcgcgctctgcgccaagccgctggcgcgcgacagcgacgtcttcatgtacagaggggacacgcccttctgcagcgaggagtgccgccaggagcagatgcacctcgacgccgtctgcgccaggcaggccgcgcggaggcagcagcggttctcagcggagacggagtcccaccgtgggcagcggcggtccaggaaggtgcccgtcgcgagctaagcggacggcctagccgcagcgcgtgggcgacgaaagttttgtttcactcgacaagacctggattctgaagaaaacaacatctgtattctgaagaaccatcggaatctcttgggaggcctgtgatctgatgtctccgtctcgccggccggtgctctagcatggaccggtggaggtaccagaaccagatgaaggttgccgccgcctacgagaggcaaggcagccaggcaggcagggctgcatcaggcggcacgaagcataggtgcctgtagccttcccgcatgtgtccatggcaagctaattaagctgcccggatgggaggaaatctgtaattttgtccatcggtctgtgccgtgccgatgaattgatttggttcgaaacgaaataaagaaggccatgggtctgaagaaaatcaatcaa

SEQ ID NO: 1105 - DNA, 712 bp, Pseudoroegneria spicata
  misc_feature (31)..(34): n is a, c, g, or t
  misc_feature (150)..(150): n is a, c, g, or t
agttctagctctggagcacaagtccgagctnnnnagacaagcctctgtacccaacggtctaccatggcggcatcagtagcctgcgccttcttcttcgacgccgagccggccggcgagcccggcaagcacgcgctggacgcgtgcgcgctntgcgccaagcggctggtgcgcgacagcgacgtcttcatgtacagaggggacacgcccttctgcagcgaggagtgcaggcgcgagcagatgcacctcgacaccgtctccgccaggcaggccgcgcggaggctgcagcgcttctcggcggagacggagtcccactgtgggcagcggcagtccaggaaggtgtccatcgcgagctagccggccgggcgggcgcggaaagttttgtttggatcgacaagatctgaattctgaagaaacaacagctgtattctgaagaaccatcgatgtctcttgggaggcgtctgatgtctctgtctctccggccggtgctctagcgtggaccggtgagggtaccagatgcacctacgagaggcaaggcagccaggcagggaagcatcaggtggcacgaagcataggtgcctgtagctctcccgcatgtgtccatggcaagcaaattaagctgcccggatgggaggaaattgtacttgttcttggtcgatctgcgctgtgccgatgaattatttgattagaaatgaaaacagaaaagtaaatggaa

SEQ ID NO: 1106 - DNA, 3063 bp, Triticum aestivum
tgtgtgcccgtcctcgccggtcagtgcccgtcccatatataccaagacgaccctagtttggttcagcacagcaaacactcaatcaacctcccactcccggcgcaccaagaccaacaacccactgccaagctagctacgcgcacgagctctccatggccgcatcggtagcctgcgccttcttcttcgacgccgagccggtcggcgagcccggcgtgcacgccctggacgcgtgcgcgctctgcaccaagccgctggcaagggacagcgacatcttcatgtacagaggggacacgcccttctgcagcgacgagtgccggcacgagcagatgcagctggacgccgcctgcgccaggcaggcggccagggcggccgcccggaggcagaagcagttctcttcgggaacggagtccgggcgtgcacgccgggagtcctgggaggtgtccgtcgcgagctaaccggcgagagtggcaggctgggtacgtccaacaagatctgcgtgcacgaagccgccgttgcccgtgtccaactgatcagtgcgggatcgaggagactctcctttgttgaagaatcaagacgcgggtcaccggagttgctcacggcaggccggcgctgcatgtgccgccgatcagttgaaggggctggactggatctgaagaagtcaaccagacaagattcaccacgcaattaggcggccatgtgtgcccctcgcagtccctcggctctccttttctcctgcgtcaatgtctttttttttgaaacggaggcaaaagatttgcctcatcgattaattaagaagaagagaattgcccagttaattaaaggaaaaccgggcgaaaaccgatacatatagaccacatgcggactactctctaagaaagaaactccatgacaccatggtcaacccaacaaacatacataacatgcaacaaccataagccctcgcaaaatgacatcgcaacgaaaccctcaacgaaaccaccgaacgccaccaaatccacagaggcgagtcaatcgaagatggatgacaaaaagactgagcatcctccattaagcagtcgcggacgccttcctaataacgtcagtcttcttgcctatgttcctgatagccttcttcaccttctttattttgcccgtagaaacctcctccgctaggaggcaagcaatcgtcttggcagacccaggacaagctgcatccaagctggtgagcaagcggccaagctttttcgcgaagaccacctcatcaatacgtgccaacatagcgtcgcggtcaaagatgagagactggacgggcttcggcgccttagacacaggtgtcaaagcacctacctcatcaaactcagcaccaacagacgccaccgggccaacaacctcaggtgagagagcagcagcagccgccaaacctccaaggtccacaaaggcaagcggctgactcggctccaatgaaaacgatgaggtcgcagtcggcatcgccaagtcccctccaagagaccctatctcctcgggaagcaccatcgaaataggcaaagtgggctccccacaaagcttctgaagctcagacataatccgcagcaccggagtcacgacctcaacaatgagttcactccctgaaggaatcggcatgacaggcagcggcaactgacatactgtagcacgaggggagagatctccatacatgccaccttccccatcgacagagacaacctggatctcgggcagtagggacacatcaggcacaaccccaatctgaagctcaggcagcgaagacacattcggcaccacctctagtttggcaagagcagcctccgccctccccaaaacactgccggcacgcgcaaggcagtcgtgaagctcagtgcgaagcatcttggtctcctccaccaacccgacatgctcagccgagatagacgggatctgcacatctatcatggagacatcaccggtggaagcagccgatggagcatgacattggagcggcgaagcttggtggacaggcttcttagcacgacagaagcgagcgatatgtccagatcgaaggcagtcagtgcatcggattggatccctgcaggagtgtgcgcgatgacctcgacggagacaccggaaacacctgtctctcagccacgtcggaggggaacgccgcacattgatggaagggcgaccaaaagctgcaggaggcggcgagcagcgccccttcgagacagtctgccatcccccttgctcacgctcgagaacatcagccgcctcatcacgatggaagcatccacgccaatccccccaaccaggagcaacgagtgcaggaggttggccgccgggcaggcaagggcgtccagcaggcggcgaagcaaaggtatccaggccctcctgggaacgagccttctgccctccgatggccgggtccgatctgcggcaagcaagtgcagccgcggctagtgcggcggcggcgaacgtcgatgcgggagggaccacgggcgctggctcggaggggagcgagctcggtggcgatggacgcgagctcccgggcgcggccggctggaggagggacggagccgccacggggaccaggatgtcgacagcagcagccgtcgtcgacggagcggggcagccaccagctgccgcgggcatgggtggcgtcggtgtcgcggtggccggcgccggagctgggcagttgccggtagccgcgggcatggggagcttcggtgatgtgggcgctacgagctcgcacggaggcatcaccagcaccgccatgggcacggcacgaagctgggtgggcaggtccagcgtcgtcgtctgcggcggcggaagcaggaggtcccgatccggatctgaccgggaagacgatagggatggcggcgggacgtcaaccggcttgaagcccacaggcaacgagggtggaggcggcggcaacatggcggctgggctgcgagccagcggtggggtggccgacggggccggagtggccgccgccggtgcgcgctagcaggagagctcggggtcgggtcactcggcgccccgattattcataaactttggtaatggcggtaactgatgcttgtttgagttgatgcc

SEQ ID NO: 1107 - DNA, 880 bp, Triticum aestivum
cacccacactcccactctgctaccaccttatctagctcctcctgcaagctcctgcatcccagctagcagagcttgaagctcgaccaggatgagcaagccatcgaggtgcagggcgctgcggacgcaggtcgccctgctcctcgtcttgctcgtcgctgcctccctgctcccggctggcgacgctgcttcagggttctgcgcgggcaagtgcgcggtgcggtgcgggcggtcgcgcgcgaagcggggggcgtgcatgaagtactgcgggctgtgctgcgaggagtgcgcctgcgtgcccacggggaggagcggcagccgcgacgagtgcccctgctaccgcgacatgctcaccgccggccccaggaagaggcccaagtgcccctgaccgccctatcgtcggcccaccgtctcaagtctcaacgcaccaacggcttcttcaacctctactccaccctaccgacaggagtagtagcccagctactctatgtatgtgatgtcggacgcgcgtgcttatgtcacttccctgtgctcgctcgtgctaattatttgtgtgatgcgtattgctgcctgctaaagtgctaagtatgtgttgtcgttgtacaccacgatcgacttgtagaagtactctgctactagctgggatcgtcgggtgagtgagtttgctgcctgtaaattaaacaagtgtgtggctacctgtgcactctacgtggttgtagtacgtacaagctactaattgttctccgtgagttactgtatgagtgtacgctgaagcagtgtgtctaactgaggcctgcgggccatgtatgtatgccaatgccacgtagcatgcgcaccgagcttacaagtagcaatggaatcatcatgtcgccgtctttgtaag

SEQ ID NO: 1108 - DNA, 783 bp, Triticum aestivum
aggactaccctcacacccacactcccactctgctaccaccttatctagctcctcctgcaagctcctgcatcccagctagcagagcttgaagctcgaccaggatgagcaagccatcgaggtgcagggcgctgcggacgcaggtcgccctgctcctcgtcttgctcgtcgctgcctccctgctcccggctggcgacgctgcttcagggttctgcgcgggcaagtgcgcggtgcggtgcgggcggtcgcgcgcgaagcggggggcgtgcatgaagtactgcgggctgtgctgcgaggagtgcgcctgcgtgcccacggggaggagcggcagccgcgacgagtgcccctgctaccgcgacatgctcaccgccggccccaggaagaggcccaagtgcccctgaccgccctatcgtcggcccaccgtctcaagtctcaacgcaccaacggcttcttcaacctctactccaccctaccgacaggagtagtagcccagctactctatgtatgtgatgtcggacgcgcgtgcttatgtcacttccctgtgctcgctcgtgctaattatttgtgtgatgcgtattgctgcctgctaaagtgctaagtatgtgttgtcgttgtacaccacgatcgacttgtagaagtactctgctactagctgggatcgtcgggtgagtgagtttgctgcctgtaaattaaacaagtgtgtggctacctgtgcactctacgtggttgtagtacgtacaagctactaattgttctcccgtgagttactgtatgagtgtacgctga

SEQ ID NO: 1109 - DNA, 876 bp, Pseudoroegneria spicata
tcccactctgttgccgccttatctagctcctcctgcaagctcctgcatccatctaccatctcagctacagcttgaagctcgaccaggatgaccaagccatcaaggtgcagggcactgcagatgcaggtcgccctgctcctcgtcttgctcgtcgccgcctccctgctccaggccggcgacgctgcttcagggttctgcgcgggcaagtgcgcggtgcggtgcgggcgctcgcgtgcaaagcggggggcgtgcatgaagtactgcgggctgtgctgcgaggagtgcgcctgcgtgccgacggggaggagcagcaaccgcgacgagtgcccctgctaccgcgacatgctcaccgccggtcccaggaagaggcccaagtgcccatgaccaccctcgtccaccgtctcaacgtaccaacggcttcaacctcactcacgccctaccggcaggagtagtagctgtgtgatattggacgcgcgtgcttatgttatgtagcttccctgtgcttgtgctgattattagcgtgtgatacgatacgtcgcgcgtacgtacctgtagttgcctgctaagtactgtatatgttgtcgttgtgctaggatcgtcgtgtgagcttggtgtctgtaaattaatgcccatcggtgtcttttttttctctttgaacacaatgcccatcggtgtcaccatgtagtatatgttgcctgctgttcgttttaaccggtatttcttcgtgtgtcactcttatcggtgcacaccgtgtcagtgtggctagctgaggcctgtgggcatgccgatagggctaccaagtcagtaatgagatgatcatgtcgtcgtctttgtaagtgtcatcttgcacatgaatgtatcagtaattgttcagta

SEQ ID NO: 1110 - DNA, 881 bp, Hordeum vulgare
acggcgtgccgtccgtcgtcgcgcgggtgtcgcgccccgactggctccgcaacgccgccggcctcgccgaccccagctactggcggggcaccctccgcccgcgccccgtcctcgactggtacctgaaccgagtggaggaggcggtgtccgaggccagggagctaggctctccagacgggaagctgtcgttgatagggcattcagctgggggctggctcgcgcgcgtgtacatggaggaattcgggacttctgacataagtttactgctcacgcttggcactccccacctgccacctcccaaaggtgtttctggcgtaattgaccaaactagaggactactgaactacgtcgagaagaattgtgcccctgcagtttacacaccagaactacgatatgtatgcattgctggaaggtatattcagggtgctcctttaactggaagctcccttgctgctaccacagatgagcttgtcgccgtggatgccccgtcagaagtagctgaagcagtcatggtcagtgccgataacaaaaccgctccgacaggccccaccttccgggcccgtttcgtcggacaaggctacaaacaggtttgcggccgcgccgacgtctggggagatggggtcgtccccgaagtgtcagcgcatctggagggcgcactgaatataagcttcgacggcgtgtaccattctcctgtaggttctgatgatgaagagaggccctggtatggctcaccagcgatcctagagcaatgggtgcaccatctccttagttgattccacagaagctttaccaactccaaaagtttgtcaacaaaatggtgtactgccatgccccttttcactagtgaacagcacagcataacatcatatatacagtaatca

SEQ ID NO: 1111 - DNA, 1363 bp, Oryza sativa
cgcgtgtgcgcgcgatatctcttccaacttccaaaggcgcacgccgcgccacggcgagccactcgctccgcccaccaccaccacccgccgccgccgccgcaaggctcgccggcgatcatgctctccctcctcctcccgcccgcgcggccgcgcgccgccgtctcccccgacgcgcgtgtcgtagtggcgcaggggctcgggaacaacacggcggactacgcgcggctcgcggcggcgctgcgggacgaccacggggtgccggccgtcgccgtcgcgcgggtgtcgaggcccgactggctccgcaacgccgccggcctcgtcgaccccagctactggcgatgcaacctccgcccgcgccccgtgcttgactggtacctgaaaagagtcgatgaagctgtatctgaggcgagagaactatctcctaatgaaggcatatcattgatagggcattcagctgggggctggctggcgcgtgtgtacatggaagaatttgatgcttcagacataagtttactgctcacacttggcactcctcacttaccacctccaaaaggtactcctggggtaattgaccaaactagaggactactgacctatgttgagaagaattgtgccccagcagtttacactccagaactaaaatatgtgtgcattgctggaaggtacattcaaggtgctcctttaactgggaacaccatcgctactacagatgatattctcgctgtggatactccatcagatatagctgaagcagtcatggtcagtaccaacgacaaatctactcaatcaggcccaaccttgagagcccgcttcattggacaaggctacaagcaggtctgtggccgtgctgatgtgtggggagacggcgtcgttcccgaggtgtcggcgcatctagaaggcgcactgaacataagcttcgacggcgtgtaccactctcctgtaggttctgacgatgagcagaggccgtggtatggttcaccggcaatcctcaagcagtgggtacatcatctcctcagttgaacggttgatggctttgatgcagagaagctgacgatctgaaagtttgtagacagaaatgtattgcatgccgccaggtgagggttaggccaggggaaaactacacatttttcagtgaattagagggtagccaatgccattctatacacaacagtacaacacacatgcgatttttcttctcccaaagaatttgtaacagtataaatattgctcaatgtgcagaggtaattcatcacatacatgattgcaggttgtaatagctacacatacagtatgatctataacaaacttcattccaaagaggaataccaactcagatcattgagaatgaatattcacgtctcaa

SEQ ID NO: 1112 - DNA, 1065 bp, Brachypodium distachyon
tgggcgctgaacaggggctcgggaacaacacggccgactacgcgcggctggccggggcgctgcgggacgaccacgggatgccggccgccgtcgtcgcgcgggtgtcccgccccgactggctccgcaacgccgcggggctcgccgacctcagctactggcgcggcaccctccgcccgcgccccgtcctagactggtacctaggacgagtggaggaagcggtggccgaggccaaggagctctgctctccagatgggaagctatcattgatagggcattcggccgggggctggctcgcgcgcgtgtacatggaggaatttgggacttctgacattagtttactgctcacccttggcactcctcacctgccacctcctaaaggtgtatctggcgtaattgatcaaactagaggactactgtactatgttgagaagaattgcgccccagcagtttacacaccagaactacgatatgtgtgcatagctggaaggtacattaagggtgctcgtctaactggaaactccattactacagcggacgagattgttgcagtggacactacatcagaagcagctgaagcagtcatgatcagcgccgacaacatatctgctccgccaggccccactttccgatcccgctttgttgggcaagggtacaaacaggtctgtgggcgcgctgatgtctggggagacggtgttgtccccgaagtttcagcacatctggagggcgcactgaatataagcttcgatggcgtgtaccactctccagtaggctctgatgatgaagagaggccctggtacggctcaccagcgatccttcagcagtgggtgcatcacctcctcagctgacgcctgggttctaaaattacgtcgacaagatgatgtatgtattgacatgccgacaggtgaggtgattgttgtaccaataccaatcagcacaaaaggcaaacatttttttccagtagtacgttgcacggcatagtaccaccatgaagtaatcatgtatacagagaggatctatgctggcttcagttatacgacctaaactttatgaaattgcatgtgaact

SEQ ID NO: 1113 - DNA, 1831 bp, Triticum aestivum
aagcagaattattagaggcgcaaaggcttgcgtgcggtctcaaggaaccccgaaaaggccgagaagaaaagaagataaaaggtagttgagtagtcttgcacgcgtccatgggttgcggcttgtcgacgccggacaacgacggcgggggcggcggcgcgcggaggaaacaggggagcgtcggcgacgtcgtcgtcttcctcccggggctccgggcgcccatgggcgtggacttgtcccaggcgctcgcggggcgcctggacaagagcgccgtggagaggctgtcggccctgagagcgcgcgtcgtcgacatggcaatgcaagaatcggcggtggccctgaagcccaggcggaaggccgccgcacggcacggatcaagcactgctaacctccttcaggctctcgaagactacctgccacttctgctaggattggtgaaagaaggtagtgagttgaggcacagcgtgcagtttgtgtggactaaccaagaggacaaggccgaggagacggccatggcggatgcatggtacgaggtgctgtccgtgctgcatttgatggccatggtctgcttgctgcaggccaactccctgctccttccaagggcttacggcgatggttacgggccacgggtctctgaagagagcagacgtgccactgtcgacgttttcttgaaagcatctggctacttggactgcgcaattcgacaagtgctcccacagataccatcagaactaaggagacaacttccagtagacctggctgaaggcaacctcaaagctcttagcatgcaagctctgggtcagggtgttgacatgcagcttgggctagcaatcgatagcccaaaggccacactagctgtaaaaaggcgcttagcttgtgagatggtcaaatattggcaccaggttcaggagagcattccagatcttcctgtgtccgacggatgggggaaaaaacatctactatttgtcaaatggaagtacgtcgaagcgaagtctgcagcatactacttccatggtttgattcttgacgaaggaaacagtgagaaatctcacggaatggcaatagcagcattggaagcttcggaggaatttctgaaagaaagcaaaagggcctctgaagttttccatgcaactcctccaacatctaggagccccactccatttggaacagctaagtatctgtttgacaagatcccgaaagaggcttcaagcaaggtccggatcaaccaggacctatataccccagaaagggtcattggagcaccacccccgttgccggatttctcgttggcactaacacctgaagactatgatcttcctccattagacccactttggaacaaagaagacggccaccagtaagtgtacattcagcattcagcaagagtgtcttctgatgggaaggctctggcgctactgagaaagcaacgaccaggattctgccatgcggaggccggacacgacgcaaaggaagtgtacaaagatatgttccgacaaaaaaaatttgatgtcggcaaactggaagcaaattttagaaaggcctgaagatatctgaagagcatttttacagttaaatcttctctgacaatggaaacacattgtcaaaagcttgctttccaacaattcctgtaaaaattatatttccaatgagcgccatggttcctttttcttaggattttctgaacatggcttagttttggggccattctgagcctattaatgtggtaaatttgccaaacatgatcctgatcttcattcaatgcttgagacagaagcagcaacgatgaaatttaaactactcaacacatacagaagctctgaactgtgtaagtttg

SEQ ID NO: 1114 - DNA, 1770 bp, Triticum aestivum
aagcagaattatcagaggcgcaaaggcttgcgtgcggtctgaaggaaccccgaaaaggccgagaagaaaacaagataaaaggtggtagagtggacttgtcgacgcgtccatgggttgcggcttgtcgacgccggacagcgatggcggcggcggcggcgcgcggaggaaacagggcaacgtcggcgacgtcgtcgtcttcctcccggggctccgggcgcccatgggcgtggacttgtcccaggcgctcgcggggcgcctggacaagggcgccgtggagaggctgtcggccctgagagcgcgcgtcgtcgacatggcaatgcaagaatcggcggtggcgctcaagcccaggcggaaggccgccgcacggcacggatctagcactgctaacctcctgcaggcgctggaggactacttgccacttctgctaggattggtgaaagaaggtagtgagttgaggcacagcgtgcagtttgtgtggactaaccaagaggacaaggccgaggagacggccatggcggatgcatggtacgaggtgctgtccgtgctgcatttgatggccatggtctgcttgctgcaggccaactccctgctcctgccaagggcttacggcgatggttacgggccacgggtctctgaagagagcagacgtgccaccgtcgacgttttcttgaaagcatctggctacttggactgcgcgattcgacaagtgctcccacagataccatcagaactaaggagacaacttccagtagacctggctgaaggaaatctcaaagctcttagcctgcaagctctgggtcagggtgttgacatgcagcttgggctggcaatcgatagcccaaaggccacacaagctgtaaaaaggcgcttagcttgtgagatggtcaaatattggcatcaggttcaggagagcattccagatcttcctgtgtctgacggatggggaaaaaagcatctactatttgtcaagtggaagtatgtcgaagcaaagtctgcagcatactacttccatggtttgattcttgacgaaggaaacagcgagaaatctcatggaatggcaatagcagcattggaagcttcggaggaatttctgaaagaaagcaaaagggcctctgaagccttccatgcaactcctccaacatctaggagccccactccatttggaacagccaagtatctgtttgacaagatcccgaaagaggcttcaagcaaggtccggatcaaccaggacctgtatactccagaaagggtcattggagcaccacccccgttgccggatttctcattggcactaacacctgaagactatgatcttcctccattagacccactttggaacaaagaagatggtcaccagtagtgtatattcagccttcagcaagagtgtcttctgatgggaaggctctggcactactgagaaagcaacgaccaggattctgccatgcggaggccgaacacggtgcaaaggaagtgtacaaagatatgttccgaccgaaaatttgacgtcggcaaattggaagcaaattttacaaaggcctgaagatatctgaagagcatttttacagttaaatcttctctgacaatggaaacacattgtcaaaagctttccaacaattcctgtaaaaattatatttccaatgagcgtcatggttcctttttcttaggattttctgaccatggcttagttttgtggccattctgagcctattaatgtggtaaatttaccaaacatgatcctgattttcattcaatgcttgagacagaagcagc

SEQ ID NO: 1115 - DNA, 1781 bp, Triticum aestivum
agcagcagcagaagcagaattattagaggcgcaaaggcttgcgtgcggtctcaaggaaccccgaaaaggccgagaagaaaacaagataaaaggtggtagagtggacttgtcgacgcgtccatgggttgcggcttgtcgacgccggacagcgatggcggcggcggcggcgcgcggaggaaacaggggagcgtcggcgacgtcgtcgtcttcctcccggggctccgggcgcccatgggcgtggacttgtcccaggcgctcgcggggcgcctggacaagagcgccgtggagaggctgtcggccctgagagcgcgcgtcgtcgacatggcaatgcaagaatcggcggtggcgctcaagcccaggcggaaggccgccgcacggcacggatcaagcactgctaacctccttcaggctctcgaagactacttgccacttctgctaggattggtgaaagaaggtagtgagttgaggcacagcgtgcagtttgtgtggactaaccaagaggacaaggccgaggagacggccatggcggatgcatggtacgaggtgctgtccgtgctgcatttgatggccatggtctgcttgctgcaggccaactccctgctcctgccaagggcttacggcgatggttacgggccacgggtctctgaagagagcagacgtgccactgtcgacgttttcttgaaagcatctggctacttggactgcgcaattcgacaagtgctcccacagataccatcagaactaaggagacaacttccagtagacctggctgaaggaaatctcaaagctcttagcctgcaagctctgggtcagggtgttgacatgcagcttgggctggcaatcgatagcccaaaggccacacaagctgtaaaaaggcgcttagcttgtgagatggtcaaatattggcaccaggttcaggagagcattccagatcttcctgtgtctgacggatggggaaaaaagcatctactatttgtcaagtggaagtatgtcgaagcaaagtctgcagcatactacttccatggtttgattcttgacgaaggaaacagcgagaaatctcatggaatggcaatagcagcattggaagcttcggaggaatttctgaaagaaagcaaaagggcctctgaagccttccatgcaactcctccaacatctaggagccccactccatttggaacagccaagtatctgtttgacaagatcccgaaagaggcttcaagcaaggtccggatcaaccaggacctgtatactccagaaagggtcattggagcaccacccccgttgccggatttctcattggcactaacacctgaagactatgatcttcctccattagacccactttggaacaaagaagatggtcaccagtagtgtatattcagccttcagcaagagtgtcttctgatgggaaggctctggcactactgagaaagcaacgaccaggattctgccatgcggaggccgaacacggtgcaaaggaagtgtacaaagatatgttccgaccgaaaatttgacgtcggcaaattggaagcaaattttacaaaggcctgaagatatctgaagagcatttttacagttaaatcttctctgacaatggaaacacattgtcaaaagctttccaacaattcctgtaaaaattatatttccaatgagcgtcatggttcctttttcttaggattttctgaccatggcttagttttgtggccattctgagcctattaatgtggtaaatttaccaaacatgatcctgattttcattcaatgcttgagacagaagcagc

SEQ ID NO: 1116 - DNA, 1781 bp, Brachypodium distachyon
gtccgacgtttcagacttccagtcaagattagagagaaagaagcagagctagaggtggggtgagtcttgcttgtggtctgaagaaatccaaaaggttggataaaagaaaggaagaataaaggtgagcagcccgcggcgcatccatgggttgcgggtcgtcgaggcaggtcgatggcgacggtccgcggagaaagccggggagcgtcggcgacgtggtcgtgttccttccggggctccgggcgccgaggagcgtagacttctcccaggcgctcgcggggcgcctggataagagcgcggtggagagattgtcggctctgagagcgcgggtcgtcgaactggcaatgcaagaatcggcggccgccctgaagccgaagcggaagaccgcggcgcggcacggatctaccactgctaatctcctgcaggctctggaagactacttaccggttctgctagggttggtgaaggaaggtagtgagttgaggcacatagtgcagtttgtctgggctaaccaagaggacaatgctgaggaaacggctatggaagatgcatggtacgaggtgctgtctgtactgcagttgatggccatggtctgcctgttgcaggccaattcgctgcttcttccaagggcatatggtgatggttatgggccaagggtttctgaagagagcagacgggccactgtagacgttttcttgaaggcagctggctacttagactgtgcaattcgacaagtactcccacatatgccatcagaactaaggaggcaacttccagtagacctcgctgaaggaaacctcaaagcacttagcttgcaggctctgggtcagggggttgacatgcagcttggcctggcaattgatagcccaaaggccactctagcagtaaaaaggcgcttagcttgtgagatggtcaaatattggcaccaagttcaggagagcattcccgagcttcctgtttctgacggatgggggaaaaagcatctcctgtttgtcaagtggaagtatgtcgaagcaaaggctgcagcatactatttccatggtttgatccttgatgaaggaaacagtgaaaaatttcacggaatggcgatagcagccttgcaagcttcagaggaatttctcaaagaaagcaaaagggcttctgaagccttccatgcaactcctccagcgtcaaggagccccactccattcggaacagctaagtatatgtttgacaagatccctaaagatgcttcaagcaaggtccggatcaaccaggacctgtatactcaagaaagggtcattggagccccacctccattgccggatttctcactggccttaacacctgaagactatgatcttcctccgttagactcagtttggaataaagacaaccatcaataaacgaaggagtgccttttgacgaaacagtctggctctagtgagaaagcaagaaccaggatgctgccatgtcgaagctgaacatggtgaaaatgaactgtacaaaatatgttccgaccaaaaattgatgtctacaaatgcaagcaaagtttagaaaggcctgaagataaaatgaagagcattttacaattcaatattcttctgacaatggaagtacattgtcaaaaggtttccatcttgtaaaaagtatttccagtgagagccatggatcctttttcttaggattttctgacaatggctagttttgggtctatcataaacatattcatgtggtaaaattaccaaatttggtcatgcttcaaggactattgagtataaatggcagagacaaacgtgggaatg

SEQ ID NO: 1117 - DNA, 2741 bp, Oryza sativa
gagatcgctagctagtttgtctccgtcgaagaagtaggcgtcgtcgagggctcgagagatcttttttcctccgatggcctccgtgcagctgaccagctgtgctgtgtggtgtactggtgtgtgggcttaataattgtggggtagatttgcatttgcatcagcacgatcacaaagcttctcccctttaaataggacaagtcatacacaggagtagcctagtaaacatctctctctgcctctctctccatctgactgctcgaccagcagcaataggctctggtttcctcttcttgcaagttgcatgctccctagtccctagacttgaacagttgagcccttcctgattttgtggttctagaccacctctggcttgcagcgagaagcaacgttcgctcgcatgacgttccagctccaagattagttggaggaactgttctaaacacagaataatactacctctttcgatgcgaaaagtatgccaatttggccgtacattacgccaagttgtgctcttgctctgatgttgatcggtcccctacgaaccaagggataagagttttgcttccttttgtccctccactgtgtttgcgttcggtgtggtgctgcgcgccagcctgcagaagaagaagaagaagaagaagaagagaagatagtggtggtgggttcaatcagagcggttcttggtgtctgaagaaacgcacaaagccgaagtggaaggaagaataaagggtgaggtgagctaagtcgtaggctgtctgccgcgcgcgtaccatgggttgtgggctgtcgagggagaaggacgccggcggcggcccacggcggcggccggggagcgtcggcgacgtggtcgtgttcctcccggggctccgggtgccgaggagcgtggacttctcccaggcgctcgccggtcgcctcgacgaggcctcgtcgaggctgtcgtcgctgcgggcgcgggtcgtcgacatggcaatgcaagaatcggcggcggcgctgaagccgaagcggcgggcggcggcgcggcacggttcgagcactgctaatctcctacaggctctggaagactatctgccagtgctgctaggattggtgaaggaaggtagcgaattgcggcacggagtgcacttcgtctggactaaccaagaggataatgctgaggaaacggccatggcagatgcatggtatgaagtgttgtccgttctgcatttgatggccatggtctgcttgttgcaggccaattctctgcttcttcccaggtcatacggtgatggttatgcgccaagggtttctgaagagagcagacgagctactgttgatgttttcttgaaggcatctggctacctagactgcgcaattagacaagtactaccccaaatatcgtcggagttaaggagacaacttccagtagatctggctgaaggaaatctcaaagctcttagcctgcaagctctgggtcagggagtcgacatgcaacttggtctggcaattgatagcccaaaggccactctagcggtaaaacggcgcttagcttgcgagatggtcaaatattggcatcaaattcaggagagcattccagaaattccggtatccgatggatgggggaaaaagcatttattgtttgttaagtggaagtatgttgaagcaaaggctgcagcatactatttccatggtttgattctagacgagggaaacacagagaaatctcatggaatggcagtagctgccttgcaagcttcagaagaatttctgaaagaaagcaaaagggcttctgaagccttccatgcaactcctccaacatcaaggagccccactcctttcggaacagctaagtacatgcttgacaagattccaaaagatgcttcaagcaaggtcaagatcaatcaggacctgtatacgcaagagagggtcattggaacaccgcctccattgccggattttgcgttggctctaaaacctgacgactacgatcttcctccattagatccactttggaacaaagaagacagccgtcagtagcagtatattcagcaagaatgtgaatgttgtctttcagaggttcaggctctagtataccatgtcgaagccagacgtggtacgaatgaagtgtacaaaatttgtcccaacaaattgtggtgtcagcaaaatttaaacaaggcctggagataatctcaagagcattgtacaggcgaatcttattctgacaaaggaaatgctttgccaaaaaaaaaagaagaaaaaaactaaccatttcaaaagattccaatatgactcgtggatccattttctcaggattcccttcagaatggcttggttttgatctatactgagtactgtgaaaactgtcacattttgatcctgctgcagcgactatatcatctagacagtttccagtgttctgagatacaactacacaagcgaacaaaacgaaacttgacacgctcgtttcaaaagcctttgtctgatgttctacaatcggtccaaaaggcaagtatgcgtgccaaataacacaaagaaaaccacgcgaaatggcgcatatatagtttgcctactgccgtgagcacatatatggctacaatttacagactccaaattataaagaaacatcattattgtattatgttatttacatgttactcttaatcatacacgattgctgtttacatcaattctattctttaccactaggtttgtttctgttcaataatattgctatcaggtattcaggcaggaacatattcctttcc

SEQ ID NO: 1118 - DNA, 1919 bp, Setaria italica
tctcgctcactggtgttcgtcgtggtttatttcttcggttgtgcgcgcgtgcagagactgcagagacggggagcggaggtagtagtggtggcggtggcccttgctgggtggaggtggaggcttcgattcgggcggtggctcgtggcctgacgaatcccggaaaggccgccggaaaggggaggacaaaggtaaacaggccgctgtgaagccatggggtgcggggcgtcgagccagaaggacgccgccggcgggccccggagacggccggggagcgtcggcgacgtggtcgtgttcctcccgggcctccgggtgccgaggagcgtcgacctcgcccaggcgctcggcgggcgcctggacaggagcattgtggagcggctgtcggctctgagagcgcgcgtcgtcgagatggcaatgcaagagtcggcggtggcgctgaagccaaggcggagggcggcggcacggcacggatctagtacagccaatctcctacaggctcttgaagaatacttgcccgttctgctaggattggtaaaagaaggtagtatgttgaggcacgccgtgcaattcacttggactaaccaagaggataatgctgaggagacggccatggcagatgcctggtacgaggtgctgtccgtgctgcatttgatggccatggtctgcttgctgcaggccaacaccctgcttctccccaggtcatacggcgatggctatgcaccaagagtttctgaagagagcagaagggtcactgttgatgttttcttgaaggcagctggatacttagactgcgcaattcggcatgtacttccacagattccaccggaactaaggaggcaacttccagtagacctcgttgaaggaaatctcaaagctttaagcctgcaagctctgggtcagggggtggacatgcagcttggtttggctatcgatagtccaaaggccactttagcagtaaaacggcgcttagcctgtgaaatgatcaagtattggcaacatgttcaggaaagcattccagatcttcctggctctgatggatgggggaaaaagcaccggctgtttgtcaagtggaaatatgttgaagcaaaggctgcagcatactattttcatggtttgattcttgatgagggaaatacagagaaatcccatggaatggcaatagccgcacttcaagcttcagaagaatttctgaaagaaagcaaaagggtttcggaagccttccatgcaactcctccaacatcgaggagccctactccattcggaacagcaaaatatatgtttgacaagatcccaaaagatgcttcaagcaaggtccgaatcaaccaggacctgtatacccaagaaaaggtcataggaactccgcctcccttaccagattttgcattggcgctaacacctgaagactatgatcttcctccattagatccactttggaacaaagaagacagacgtcattaggtgtatatgcaacagaatggtttcttcagacgaaaagcttggcgttagagagaaacaagaagcaccaagatctgccatgcgaaagctgagcatggtaaaagtgtacaaagtatgtttgaaccaaatttcgtatcaaaaaaaaatccaaccaattgttaggaaggcctgaagataatctgaagagcattgtacaggcgatttttcttctgataagggaaatgctttgtcaaagggttcatttaacattcttgatcctgattcctgatgttcctgatgcttgcattttctcgacaagggcatagctttgggcccgttctgatttatgtgtggtccctcaatagctttgccagattcaatgatatttcaagaactgtaaccttcagagtttcataatttgattgggaaccagcctgggaccaaaagtggcagctttcaacttgtatttcataatgtctgtcataaac

SEQ ID NO: 1119 - DNA, 1651 bp, Pennisetum glaucum
gagggagagacgagagggatttgatggtgtagtactgtgctgggtggtggcttgtggccggacgaatcccggaaaggccgccggaaagggggaggggaggacaaaggtaaaacaggccccgctgtgaagagccatggggtgcggggcgtccagccagaaggacgccgccggcgggccacggagacggccggggagcgtcggcgacgtggtcgtgttcctcccgggcctccgggtgccgaggagcgtcgacctcgcccaggcgctcggcgggggcctggacgggagcatcgtggagcggctgtcggcgctgagagcgcgcgtcgtcgagatggcaatgcaagagtcggcggcggcgctgaagccgaagcggaagacggcggcacggcacgggtctagtacagccaatctcctacaggctcttgaagactacttgccagttctgctaggattggtaaaagaaggcagtacgttgaggcatgccgtgcaattcacttggactaaccaagaggataaagctgaggagacggccatggcagatgcctggtacgaggtgctgtccgtgctgcatttgatggccatggtctgcttgctgcaggccaacaccctgcttctccccaggtcctacggcgatggctatgcaccaagagtttctgaagagagcagaagggccactgttgatgttttcttgaaggcagctggatacttagactgtgcaattcgacatgtacttccacaaattccaccggaattaaggaggcaacttccagtagacctcgttgaaggaaatctcaaagctttaagcctgcaagctctgggtcagggggttgacatgcagcttggtttggctatcgatagtccaaaggctactttagcagtaaaacggcggttagcttgtgaaatggtcaagtattggcaacaagttcaggaaagtattccagagcttcctggttctgatggatgggggaaaaagcaccgtctgtttatcaagtggaaatatgttgaagcaaaggctgcagcatactactttcatggtttgattcttgatgagggaaatacagagaaatcccacggaatggcaatagccgcacttcaagcttcagaagaatttctgaaagaaagcaaaagggtttcggaagccttccatgcatctcctccaacatcgaggagccctactccattcggaacagcaaaatatatgtttgacaagatcccaaaagatgcttcaagcaaggtccgaatcaaccaggacctgtatacccaagaaaaggtcataggaactccacctcccttaccagattttgcattggcgctaacacctgaagactatgatcttccttcattagatccactttggaacaaagaagacagacgtcattaggtgtatatgcaacagaatggtttcttcagaagaacacttggcgttagagaaacgagaagcacaaagatctgccatgccaaagctgagcatggtaacaaatgaagtgtacaaagtatgtttgaacaaaatctcgtggtaaaaaaatccatccagttgttaggaaggcctgaagataatctgaagagcattgtacaggcgatttttcttctgacaaaggaaatgctttgtcaaggggttcatttaacaatctcgatcctgattcctgattttccc

SEQ ID NO: 1120 - DNA, 1948 bp, Zea mays
tttctctctcgaaatccgttgtatgatatgatgacgaggaaaccccaaaaaatagaagaaagaattccaaaaccctccctctcctgttcagtatcttctgcggctccgccgtggattcttcgtgcgataaactaagcagggcgctgcacgaggatggggtgcggggcgtcgagccagaaggacgccggggcgccgcggaggcggccggtgagcgtcggcgacgtggtcgtcttcctcccgggcctccgcgtgccgagggccgtcgacttggcccaggcgctcggcggctgcctggccaggagcgccgtggaccggctgtcggctctgcgatcgcgggtcgtcgacatggcaatgcgagagtcggcggcggcgctcaagcccaggcggagggcggcggcacggcacgggtctagtacagccaatcttctacaggccctcgaagactacttgccggctctgctaggactggtaaaagaaggtagcgtcttgaggaacaaagtgcacttcacctggagtaaccaggaggataatgctgaggagacggccatgccagacgcctggtacgaggtgctgtccatgctgcatctgatggccatggtctgcctgctgcaggccaacgccctgcttctcccgaggtcatacggcgatggctatgccccaagggtttctgaagagagtcgacgggctactgttgatgtcttcttgaaggcagctggatacctagactgtgcagttcggcatgtactcccgaagatgccactggagctaaggagacaacttccagtagacctggctgaaggaaatctcaaagctctaagcctccaagccctgggtcagggggttgacatgcagcttggtttggctattgatagtccaaaggccactttagcagtaaaacggcgcttagcctgtgagatggtcaaatattggcaacaagttcaagagagcattccagagcttcctatctctgatggatggggtaaaaagcaccggctctttataaagtggaaatatgttgaagctaaggctgcagcatactatttccacggtttgattcttgacgagggaaataccgaaaaatcccatggaatggcaatagctgcactccaagcttcagaggaatttctaaaagaaagcaaaagggtttcagaagccttccatgcaactcctccaacatcgaggagtcccaatccattcggaacagcaaaatatctgtttgacaagatcccaagagatgcttccagcaaggttcgaatcaaccaggacctgtatactcaagaaaaggtcattggagcgccacccccattaccagattttgcattggcgctaacacctgaagaatatgatcttcctccactagatccactttggaacaaagaagacacaagccattaagtgtatatgcagcagaatggttgcttctggcaaaaatattggctctggagagaaaggaaggaccaagatctgccatgtcaagagctgatgtgtaatgaatgaagtgtacaaagtattttcaaacaaaaatacatgttcacaaatttacgcaaggcctgaagacaatctgaagagctttgtacaggcgattcttcttctgacaagggaaatgctatgtcaaagggttccttgatcattgtgcatcttgatgcttgcattttgtcaaaaacagattttcagcaatttatgtagaactgtaaactagcctctgatcgaaagtggcagccttcaaatttttttttgccataaaacatttacatcggcaccttaaaacatgccgtgggacaatcagtttcatctgagcacttaggtgaacaggattttcaaataatcagtggatactgtggcaaagtcagcttccagccattcagtgcatgcatatacagtcataaaattttagttttgaacttctgaatgcaaaaaaaaatctccatatgatttctcttgatcaact

SEQ ID NO: 1121 - DNA, 2106 bp, Zea mays
gtagccgcctctcctcctccttctccttcttccccctctcaaggctcccctcctccacagcctgcagcccagctcacgaggaccaggaggagaagaagttgcatagccgcccatctgcatccacactccaacagttgagtccctctctccctaccacccccccccccccccccagttgccttatctcctcacgtcctagctacaaccatacctgcgtgcgccggcagcgagaaaggaccagctaccggccgtgacgttcttctcaccgtacgtcgccgagggattagataaactaagcagggcgctgcacgaggatggggtgcggggcgtcgagccagaaggacgccggggcgccgcggaggcggccggtgagcgtcggcgacgtggtcgtcttcctcccgggcctccgcgtgccgagggccgtcgacttggcccaggcgctcggcggctgcctggccaggagcgccgtggaccggctgtcggctctgcgatcgcgggtcgtcgacatggcaatgcgagagtcggcggcggcgctcaagcccaggcggagggcggcggcacggcacgggtctagtacagccaatcttctacaggccctcgaagactacttgccggctctgctaggactggtaaaagaaggtagcgtcttgaggaacaaagtgcacttcacctggagtaaccaggaggataatgctgaggagacggccatgccagacgcctggtacgaggtgctgtccatgctgcatctgatggccatggtctgcctgctgcaggccaacgccctgcttctcccgaggtcatacggcgatggctatgccccaagggtttctgaagagagtcgacgggctactgttgatgtcttcttgaaggcagctggatacctagactgtgcagttcggcatgtactcccgaagatgccactggagctaaggagacaacttccagtagacctggctgaaggaaatctcaaagctctaagcctccaagccctgggtcagggggttgacatgcagcttggtttggctattgatagtccaaaggccactttagcagtaaaacggcgcttagcctgtgagatggtcaaatattggcaacaagttcaagagagcattccagagcttcctatctctgatggatggggtaaaaagcaccggctctttataaagtggaaatatgttgaagctaaggctgcagcatactatttccacggtttgattcttgacgagggaaataccgaaaaatcccatggaatggcaatagctgcactccaagcttcagaggaatttctaaaagaaagcaaaagggtttcagaagccttccatgcaactcctccaacatcgaggagtcccaatccattcggaacagcaaaatatctgtttgacaagatcccaagagatgcttccagcaaggttcgaatcaaccaggacctgtatactcaagaaaaggtcattggagcgccacccccattaccagattttgcattggcgctaacacctgaagaatatgatcttcctccactagatccactttggaacaaagaagacacaagccattaagtgtatatgcagcagaatggttgcttctggcaaaaatattggctctggagagaaaggaaggaccaagatctgccatgtcaagagctgatgtgtaatgaatgaagtgtacaaagtattttcaaacaaaaatacatgttcacaaatttacgcaaggcctgaagacaatctgaagagctttgtacaggcgattcttcttctgacaagggaaatgctatgtcaaagggttccttgatcattgtgcatcttgatgcttgcattttgtcaaaaacagattttcagcaatttatgtagaactgtaaactagcctctgatcgaaagtggcagccttcaaatttttttttgccataaaacatttacatcggcaccttaaaacatgccgtgggacaatcagtttcatctgagcacttaggtgaacaggattttcaaataatcagtggatactgtggcaaagtcagcttccagccattcagtacatgcatatacagtcataaaattttagtttgaacttctgaatgcaaaaaaaatctccatatgatttctctgatcaact

SEQ ID NO: 1122 - DNA, 2026 bp, Zea mays
aaccctgtaggcctctcccttcttctgctctccctcccttctcaaggcttcctcctgcagtccagctcaccaggaccaggaggaacaaagaagttgcatcgaacacagctgagttcctccctcttccctgaaatgcgcccggcagctagaaaggagcagctagcgggcgggctgcccatacgtcgttgagcaccgcggagacggccgggagcagggggggcgggagggatagtggcggcctctgctgctgctggtcgaggcttcgattccgggcgggggctggtggtctcgagaatcccggagggaagggagcgagcgcaaagatagatacctaagcgggccgcttccgctgcacagccacaggcatggggtgcggggcgtcgagccacaaggacgccggggcgcgccggagacggcctgggagcgtcggcgacgtggtcgttttcctcccgggcctccgggtgccgagggccgtcgacttcgcccaggcgctcggcggctgcctggccagggctatagtcgagcggctgtcggctctgaggtcgcgggtcgtcgagatggcaatgcaagaatcggcggcggcgctcaagcccaggcggaaggcggctgcacggcacgggtctagtacagccaatcttctacaggccctcgaagactacttgccagttctgctgggactagcacaacaaggtagcgtcttgagacacaaagtgcagttcacctggagtaaccaagaggataatgctgaggagacagccatttcagatgtctggtacgaggtgctgtccgtgctgcacttgatggccatggtctgcttgctgcaggccaacaccctgcttctcccaaggtcatacggcgatggctacgccccaagagtttctgaagagagtagacgggccactgttgatgtcttcttgaaggcagctggatacctagactgcgcaattcgtcatgtacttccgaagatgccactggaactaaggagacaacttccagtcgacctggctgaaggaaatctcaaagctctaagcctgcaagcctttgggtcagggggttgacatgcagctcggcttggctattgatagtccaaaggccactttagcagtcaaaaggcgcttagcctgtgagatggtcaaatattggcaacaagttcaagagagcattccagagcttccagtctctgatggatggggaaaaaagcaccggctatttgtaaagtggaagtatgttgaagccaaggctgcagcatactatttccacggtttgattcttgacgagggaaataccgagaaatcccatggaatggcaatagctgcactacaagcttcagaagaatttctgaaagaaagcaaaatggtttcggaagccttccatgcaactcctccaacatcgaggagtccgaatgcattcggaacagcaaaatatctgtttgacaagatcccaagagatgcttccagcaaggtccgaatcaaacaggacctgtatactcaagaaaaggtcattggagcaccacccccattaccagattttgcattggcgctaacacctgaagattatgatcttcctccactagatccactttggaacaaagaagatacacaccattaagtgtctatacagcagattggttgcttctggcaaaaaattggctctggagagaaaggaggaccaagatctaccatgtcaaaggtcgaacatggtaacaaatgaagtgtacaaaatattttcaaacaaaattacatgtcaacaaaattaagcaaggcttgaagataatctgaagagctctgtacaggcaattttcttctgacaagggaaatgatatgtcaaagggttcattgatcattgtcgatcctgattcctgatgcttttattttttcaacaacagattttcagcattcgaaatggaactggaatcagcctctgatcgaagtggaaacctttttttagtcgtaaacatttacattggcaccttaaaatatactctggaacaatcagtctcagctgaacagtttataatacatgaact

SEQ ID NO: 1123 - DNA, 2025 bp, Zea mays
aaccctgtaggcctctcccttcttctgctctccctcccttctcaaggcttcctcctgcagtccagctcaccaggaccaggaggaacaaagaagttgcatcgaacacagctgagttcctccctcttccctgaaatgcgcccggcagctagaaaggagcagctagcgggcgggctgcccatacgtcgttgagcactgcggagacggccgggagcagggggggcgggagggatagtggcggcctctgctgctgctggtcgaggcttcgattccgggcgggggctggtggtctcgagaatcccggagggaagggagcgagcgcaaagatagatacctaagcgggccgcttccgctgcacagccacaggcatggggtgcggggcgtcgagccacaaggacgccggggcgcgccggagacggcctgggagcgtcggcgacgtggtcgttttcctcccgggcctccgggtgccgagggccgtcgacttcgcccaggcgctcggcggctgcctggccagggctatagtcgagcggctgtcggctctgaggtcgcgggtcgtcgagatggcaatgcaagaatcggcggcggcgctcaagcccaggcggaaggcggctgcacggcacgggtctagtacagccaatcttctacaggccctcgaagactacttgccagttctgctgggactagcacaacaaggtagcgtcttgagacacaaagtgcagttcacctggagtaaccaagaggataatgctgaggagacagccatttcagatgtctggtacgaggtgctgtccgtgctgcacttgatggccatggtctgcttgctgcaggccaacaccctgcttctcccaaggtcatacggcgatggctacgccccaagagtttctgaagagagtagacgggccactgttgatgtcttcttgaaggcagctggatacctagactgcgcaattcgtcatgtacttccgaagatgccactggaactaaggagacaacttccagtcgacctggctgaaggaaatctcaaagctctaagcctgcaagccttgggtcagggggttgacatgcagctcggcttggctattgatagtccaaaggccactttagcagtcaaaaggcgcttagcctgtgagatggtcaaatattggcaacaagttcaagagagcattccagagcttccagtctctgatggatggggaaaaaagcaccggctatttgtaaagtggaagtatgttgaagccaaggctgcagcatactatttccacggtttgattcttgacgagggaaataccgagaaatcccatggaatggcaatagctgcactacaagcttcagaagaatttctgaaagaaagcaaaatggtttcggaagccttccatgcaactcctccaacatcgaggagtccgaatgcattcggaacagcaaaatatctgtttgacaagatcccaagagatgcttccagcaaggtccgaatcaaacaggacctgtatactcaagaaaaggtcattggagcaccacccccattaccagattttgcattggcgctaacacctgaagattatgatcttcctccactagatccactttggaacaaagaagatacacaccattaagtgtctatacagcagattggttgcttctggcaaaaaattggctctggagagaaaggaggaccaagatctaccatgtcaaaggtcgaacatggtaacaaatgaagtgtacaaaatattttcaaacaaaattacatgtcaacaaaattaagcaaggcttgaagataatctgaagagctctgtacaggcaattttcttctgacaagggaaatgatatgtcaaagggttcattgatcattgtcgatcctgattcctgatgcttttattttttcaacaacagattttcagcattcgaaatggaactggaatcagcctctgatcgaagtggaaacctttttttagtcgtaaacatttacattggcaccttaaaatatactctggaacaatcagtctcagctgaacagtttataatacatgaact

SEQ ID NO: 1124 - DNA, 1988 bp, Sorghum bicolor
gttcgtcgtgctttgtgtcgtgcgcgtccgcgtgcagactactgcagagacgggggagcagggatagtggcggacggtctctgctgttggtggtggaggcttcgattccgggcgcgggcggggtggcttgtggtctcaagaatcccggaaaggccgccggaaaggcagcgggcgggcgcaaagataactaataggcaggccactggacaggcatggggtgcggggcgtcgagccagaaggacgccgggccgccccggagacggctggggagcgtcggcgacgtggtcgtcttcctgccgggcctccgggcgccgaggaccgtcgacttcgcccacgcgctcgccggctgcggcgtggccaggagcgtcgtggaccggctgtcggctctcaggtcgcgggtcgtcgagatggcaatgcaagagtcggcggcggcgctcaagcccaggcggaggacggcggcacggcacgggtccagtacagccaatcttctacagacccttgaagactacttgccagttcttctaggactagtaaaagatggtagcatcttgaggcacaaagtgcagttcacctggagtaaccaagaggatagtgccgaggagacggccatttcagatgcctggtacgaggtgctgtccgtgctgcatttgatggccatggtctgcttgctgcaggccaacaccctgcttctccccaggtcatacggcgatggctacgccccaagagtttctgaagagagtagacgggccactgttgatgtcttcttgaaggcagctgggtacctagactgcgcaattcggcatgtacttccgaagatgccgctggaactaaggagacaacttccagtagacctggctgaaggaaatctcaaagctctatgcctgcaagccttgggtcagggggttgacatgcagctcggtttggctattgatagtccaaaggccactttagcagtaaaacggcgcttggcctgtgagatggtcaaatattggcaacaagttcaagagagcattccagagcttcctgtctctgatggatgggggaaaaagcaccggctgtttgtaaagtggaaatatgtggaagcgaaggctgcagcatactatttccatggtttgattcttgacgagggaaataccgagaaatcccatggaatggcaatagctgcactccaagcttcagaggaatttctgaaagaaagcaaaagggtttcggaagccttccatgcaactcctccaacatcgaggagtcccaatccatttggaacagcaaaatatctgtttgacaagatcccaagagatgcttccagcaaggtccgaatcaaccaggacctgtatactcaagaaaaggtcattggagcaccacccccattaccagattttgcattggcgctaacacctgaagactatgaccttcctccactagatccactttggaacaaagaagacacgcaccattaagtgtatatgcagcagaatggttgcttctggcaagaaattggctctggagagaaaggaaggaccaagatccaccatgtcaaagtcgaacatggtaacaaatgaagtgtacaaaatattttcaaacaaaattacatgtcaacaaaattaagcaaggcctgaagataatctgaagagctttgtacaggcgattcttcttctgacatgggaaatgctatgtcaaagggttcattgatcattttcgatcctgattcctgatgcttgcattttgtcaacaacggattttcagcatttcatatggaactggaaccagcctctggtcgaaagtggcaaccttcaatttttttagtcataaacatttacattgccaccttaaaacataccctggaacaatcagtttcaccggagcagtttatattagatgaacatgatttccaaataatcagtgtggccaaaaagttaccaccttccaaccaatcagtgcatgcataaacagtcataaaatttcagttctaattttagaatacaaaaaaa

SEQ ID NO: 1125 - DNA, 1126 bp, Triticum aestivum
agcccggggggctgggagggggccacggtggacgaggcctccatggagcgcagcaagagcttcgtcaaggccctgcaggagctcaagaacctgcggccgcagctctactccgcctccgagtactgcgagaagtcctacctcaacacccaccagaagcagatggtgctggacaacctgaaagactacgcggtgcgggcggttgtcaacgccgtcgaccacctaggcacggtggcctacaaactgacggacctgttcgagcagcaggcttccgagatctcgaccttcgagctcaagcttgcgcgcttgaaccagcaaattttcacctgccaaatctatgtggacaaagaaggctccaggcagcagcagatgatgggggcaagcatgaagcaccacaagcactacatcctaccatctactggttataagagaactcaggctgttgcgcacctgggaaccgacactaatcaggaatcacagcctagaccttacccctcagcaaagacgctttcctggcatctggcatcggacaatagcccttcggcaaatagagcacataaacctacattcatcctagatgatacgataccatccaaactcgcatcagatggtccgcatcttcttggtaaggagttgcctgcttctcccgtgcgtaggcctctgcaacttaacaggaataccaaatccgacgtcgcacaaaaggttggcgcaaaggatctgtcggcgtttagttctttcgacaggcctacagggcgtgaaatccaaaaggctcctgccagcactaagagcgtgctagcatctctttttatcaagcacaagtcagcaaagatgaaaagtatctcagctcgatgatcctcccttgatgtaattgaagtttgttgtaataaccagtacaagccaagtaaaatgcaattgtatctcttcaagatgtcaagtcataacatctcttatctgtgtaatatgtgctgattcaaagcctgtaatgaaaatcatatgcaagtttggaagtgtgtttagttatattcatccaatagcatgatcttccctgagatactgatttgactagtaaattgtacgtgctttgcacgtcattcaaatgcatataaaaagcatgggaaaatacatttga

SEQ ID NO: 1126 - DNA, 1049 bp, Triticum aestivum
  misc_feature (86)..(86): n is a, c, g, or t
  misc_feature (257)..(257): n is a, c, g, or t
  misc_feature (299)..(299): n is a, c, g, or t
  misc_feature (375)..(375): n is a, c, g, or t
  misc_feature (410)..(410): n is a, c, g, or t
gagagagaatgcagcagcagcaggagcaggagcagcaggcggcgcggcggcggcggcggagcccggggggctgggagggggccacngtggacgaggcctccatggagcgcagcaagagcttcgtcaaggccctgcaggagctcaagaacctgcggccgcagctctactccgcctccgagtactgcgagaagtcctacctcaacacccaccagaagcagatggtgctggacaacctgaaagactacgcggtgcgggcngttgtcaacgccgtcgaccacctaggcacggtggcctacaanctgacggacctgttcgagcagcaggcttccgagatctcgaccttcgagctcaagcttgcgcgcttgaaccagcaanttttcacctgccaaatctatgtggacaaagaaggntccaggcagcagcagatgatgggggcaagcatgaagcaccacaagcactacatcctaccatctactggttataagagaactcaggctgttgcgtacctgggaaccgacactaatcaggaatcacagcctagaccttacccctcagcaaagacgctttcctggcatctggcatcggacaatagcccttcggcaaatagagcacataaacctacattcatcctagatgatacgataccatccaaactcgcatcagatggtccgcatcttcttggtaaggagttgcctgcttctcccgtgcgtaggcctttgcaacttaacaggaatatcaaatccgacgtcgcacaaaaggttggcgcaaaggatctgtcggcgtttagttctttcgacaggcctacagggcgtgaaatccaaaaggctcctgccagcactaagagcgtgctagcatctctttttatcaagcacaagtcagcaaagatgaaaagtatctcagctcgatgatcctcccttgatgtaattgaagtttgttgtaataaccagtacaagccaagtaaaatgcaattgtatctcttcaagatgtcaagtcataacatctcttatctgtgtaatatgtgctattcaaagcctgtaatgaaaatcata

SEQ ID NO: 1127 - DNA, 1377 bp, Triticum aestivum
gaattcggcacgaggctccatcagtggctggctccgctttgcctctctctctctctctctctctctctctctctctctctctctctctctctctctctctgaggcctgagccctctgtcactccacgagtccatgtccatgcacaggtaaagccgctgcgtcctagaagatccaggcggtgggatgaggcccactgcagcagcagcagccaaaccttccttcttcctcgccagacaccaaccattcccgacatcatcaagggcagcagcagcagcagccgatccatgcaagtcgcccaacaagttgaggcgcattggccggtcatggcgagccgcgtcggcgggcagcaaccgcggcgacgagcgcggccagtccgtatcgacggtggcgacgacgccgtcagggaggcgggcccggctgtcggcgaggcgacgggagagcatcaggctcctggacgtgctgccgggccagggcggcatcggcgagttcctgcggcaccccgccggcgtggagtccctgctcaacacccgggcgctgcagagcttcgcgccggtggagccggagtcggagtcgggcccagccggcgccttcaggtgcacgctgcaccccatgggcttcctcggcttccaggtcgccccggtcctggacctccgcgtcaccccgacccgcgacgactgcaccgtcgagatgctctcctgcaggtttgagggttcggactcgatcgaacagcagaatgagctcttttcagcggttatgaggaaccgaataacatggggagacaatggtgatcaggagccatgcttggacatcgatgtcaatttggaggtcactctggaggtgtacacgaagccattcagcttgctcccgctgtcggcagtggagaaaccaggcaacctgctgatgcaagggctgcttgacaggcttgtcccgatgctgggtgagcagctgctgagggactaccactcctgggtacagcagcaggcccagtcttcgtcctcatgagcgagcgactgcccaaagtctgaaaaaaacactacctacctagcagattcctgggattcatggccgggtcggcttccatcaaatccagctggcagcagcaccaagaaagaatcacgaggacgcggcatgggtcaatttgtcgatgcttgcatgatataagaaagaatcatttactgtacatcccatcctaacctttgagagaaatcattcgaatttcgaaaaggttgtgcctagctaacttttgacccatgtaccacacatctactagaaaactcgtgctgcacattagcatgatgttgaaggttctggttgccgttattgcatcagtctcaatgtaatactagtagatgtcacattacacagctacttacagca

SEQ ID NO: 1128 - DNA, 1399 bp, Triticum aestivum
  misc_feature (458)..(458): n is a, c, g, or t
  misc_feature (559)..(559): n is a, c, g, or t
  misc_feature (576)..(576): n is a, c, g, or t
  misc_feature (726)..(726): n is a, c, g, or t
  misc_feature (764)..(764): n is a, c, g, or t
  misc_feature (817)..(817): n is a, c, g, or t
  misc_feature (820)..(820): n is a, c, g, or t
  misc_feature (831)..(832): n is a, c, g, or t
  misc_feature (846)..(846): n is a, c, g, or t
  misc_feature (1076)..(1076): n is a, c, g, or t
  misc_feature (1094)..(1094): n is a, c, g, or t
  misc_feature (1146)..(1146): n is a, c, g, or t
  misc_feature (1318)..(1320): n is a, c, g, or t
  misc_feature (1330)..(1330): n is a, c, g, or t
  misc_feature (1357)..(1357): n is a, c, g, or t
  misc_feature (1398)..(1398): n is a, c, g, or t
gaattcggcacgaggctccatcagtggctggctccgctttgcctctctctctctctctctctctctctctctctctctctctctctctctctctctctctgaggcctgagccctctgtcactccacgagtccatgtccatgcacaggtaaagccgctgcgtcctagaagatccaggcggtgggatgaggcccactgcagcagcagcagccaaaccttccttcttcctcgccagacaccaaccattcccgacatcatcaagggcagcagcagcagcagccgatccatgcaagtcgcccaacaagttgaggcgcattggccggtcatggcgagccgcgtcggcgggcagcaaccgcggcgacgagcgcggccagtccgtatcgacggtggcgacgacgccgtcagggaggcgggcccggctgtcggcgaggcggcgggagagcatcaggctcctggacgngctgccgggccagggcggcatcggcgagttcctgcggcaccccgccggcgtggagtccctgctcaacacccgggcgctgcagagcttcgcgccggtggagncggagtcggagtcgggnccggccggcgccttcaggtgcacgctgcaccccatgggcttcctcggcttccaggtcgccccggtcctggacctccgcgtcaccccgacccgcgacgactgcaccgtagagatgctctcctgcaggtttgagggttcggactcgatcgancagcagaatgagctcttttcagcggttatgacgaaccnaataacatggggagacaatggtgatcaggagccatgcttggacatcgatgtcnatntggaggtcacnntggaggtgtacacnaagccattcagcttgctcccgctgtcggcagtggagaaaccaggcaacctgctgatgcaagggctgcttgacaggcttgtcccgatgctgggtgagcagctgctgagggactaccactcctgggttcagcagcaggcccagtcttcgtcctcatgagcgagcgactgcccaaagtctgaaactaacactacctacctagcagattcctgggattcatggccgggtcggcnttcatcaaatccagctgncagcagcaccaagaaagaatcacgaggacgcggcatgggttaatttgtagtngatgcttgcatgatataagaaagaatcatttactgtacatcccatcctaacctttgagagaaatcattcgaatttcgaaaaggttgtgcctagctaacttttgacccatgtaccacacatctactagaaaactcgtgctgcacattagcatgatgttgaaggttctggttgnnnttattgcatnagtctcaatgtaatactagtagatgtnacattacacagctacttacagcagggggctttccctcaagna

SEQ ID NO: 1129 - DNA, 1270 bp, Avena sativa
aaacgataagctcgatcagtggctctcgtgagctctttgtcagtccatgtccatgcaaagctagagcagctgcagccgagaagaagctagcagacgatggaatgaggcccacggcggcaaccagaccttccgtcttcctcgccagacaccaaaaaccaatccccacgtcgtcaagggcagcaggactagtagcagccgatccatgcaagcaaatcaagaacacgaacaagcgcaccggccggtcatggcgagccgcatcggcaggaagcaaagacggcaccgacactgacggcggccagtccgtatcgacgacggttgtgacaccggcaaggaggcaggcccggctgtcggcgaggcggagggagaccatcaggctcctggacgtgctgccggacctgggcggcgcggcgcgggacggcagcatcggcgagttcctgcggcaccccgccggcgtggagtccctgctcaacaccagggcgctgcagagcttcgcgccggtggagtcgggcccggccggcacgttcaggtgcacgctgcacccgatggggtttctgggcttccaggtcgccccggtccttgacctccgcgtcgcgcccacccacgacgactgcaccgtcgagatgctctcctgcaggtttgagggttcagactcgattgagcaacagaatgaactcttttcagcggttatgaggaaccacataacatggggagacaacggtgaccgggagccatgcttggacatcgatgtcaatttggaggtcactctggaggtgtacacgaagccattcagcctgcttcccttgtcagcagtggagaaaccaggcaacctgctgatgcaaggcctgcttgacaggcttgtccccctgctgggtgagcagctactcaaggactaccattcctgggttcagcagcagcctggatcttcctcatgagtgactccacggggaagcctgaaactaacactactagccgattcctgggttcatgtcaggatggctccataaagttcagctggcaatagcatcaagaatcacgaggaaacattcatgaatgcatatgcgcctggttattttgtggccatgggtaactaatcggtgtatccggattgatgcttacacgatacaatatagttgaacaggaatagtgatgttcacaatgaaaaccatgaggatttccataatccgaatgagcaatactaacattaatcatataattgtttcaaaaacattaatcatcacgattttactagcatcagtacttcagtgacaac

SEQ ID NO: 1130 - DNA, 1041 bp, Triticum aestivum
gcacgaggcttcttccccctcacgtctccatcacttccttccacttctcccacatttacacaccaccgcaccagctagctagctacactcccactgccatctctctcacaggctcacacgctcagcaccgcactgcactcccgtcgctctcggccatggcgtcctacaggctgctcgtgatcctggtcttctccgcgctcctcctcgacgtcgcagtcgccgacacctacccggccgactgcccctacccgtgcctgctgccgccgcccacgcccccggcctccagcgccgactgcccgccgccaccctcctcgccgtccggctccggctctggctacgcgtacccacctccgtcgtcctcggggaactccccgccgacgccgtcgtcctggagctacccgccgccctctgggggctacattcccggcttctaccagcctcccgccggcgggggaggtggtggtggcggcaacttcgggcctgcgccaccgccgcccaaccccatcctgccgtggtacccctggtactaccggtccccgccgtcctcgtccgcgaccaggggcagcgcctcggcggtcgcgctctgcttggtggccgccgtaactgccactgctgccctcgtcggttactagtatgatcatccatcagttactagctaagctagcactccaacattttttcctttccgttcgtagtcgattcttgatatatactccatatgtataatggggcaccattaatatttagctatcgtactcatcaactcatgtgtattggttcattgctcagctggcttttgggtagtgagtggagcgactatatattgctggctatagtttcttgggagcataatatatgtggctagtgatcgcaagaatcttgtgcctttcctcagtgcctcatcctttttcttgttataattgatgtactcgtgtagtggcatatatactcgatcgttgctattactttcccgtgttgggagtgattgttctcgcgtactacgcttggtcggaacattcttcacaaaatgtgcatcgttgc

SEQ ID NO: 1131 - DNA, 1835 bp, Hordeum vulgare
cccagagccgcgtacgccgagctgagcactgacggcacccctccaggggcatccccgtaattaccccgcacctcccggggcattcgcgccaccgactcccgtccctgcctgccagatcccgctgctgctacgtacacacacctacagctacatagcctggcaacgggccatcactacaccatcagtgatttttcagtggtgctgcccagctcagtgctctccaccagtccgccccgccccatcccgagctccaggcgccgacgcaccgaggacgaggaggacgatggaggcgcggcggcgggcggcgctggtggcgctggcggtgctggccatggcggcggcggcggcggaggggtacaacatcaccaagatcctgggcgagtacccggagtactcgcagttcaacaagctgctcacgcagacgcggctggcgcaggacatcaacaagcgccgcaccatcaccgtcctcgtcgtcgccaacggcgacatgggcagcctcgccggcggcggccgcacgctgcagaccatccgccacatgctccagattcacgtcctcgtcgactactacggcggcaagaagctccaccagctcgcgcacggcgtcaccgcgtgctcctccatgttccaggagtccggcgcggcccccggcatgtctgggtacgtgaacatcacgcagcaccggggcggcaaggtgacgttcacggcggaggacgcggaggacagcgcgccgtcgtcggccttcgtcaagtccgtcaaggagatcccctacgacctggcggtgctccagatcagcaaggtgctggcctcgccggaggccgaggcgcccgtggcggcgccggcgccggtcaacatcaccgagctgctctccaagaagtactgcaagagcttcgcgggcctgctggcggccgacgccgaggcatacagcaccatcaacgccaccaaggacaacgggctcaccctcttctgccccgttgacgccgccgtcgcctccttcatgcccaagtacaagaacctgacggccaaggggcggacggccatcctgctgtaccacgccgtgccggactactactccctgcagctgctcacctccaacagcggcaaggtgagcacgctcgccacctccaacgtcgccaagaaggactacagcttcgacgtggagaaggacggcgagacggcggagctcgacaccaaggtgaactcagcgtcggtcacctacaccatcaaggacgacgacccgctcgccgtctacgccatctccaagttcctgcagcccaaggagctgtacaaggtcgccaaggacaaggacctcgccccagcgccggcgcccgaggggcccaagaagaagaagaccaccaagaagaagccctccgcggccgcctcgccatcggacgacgacgacgatgactccgccgcggactcgcccgacgacgactcctcgtccgacgacgccaccgcagacaaggacggcgccgcgccgtccgcggtcgccgggtgggtgaccgccgccgtggccgtggcgtcggcgctggcactggcagcttgataaggtgtgtgaacaggtgtgtttttgtgctgagttctccgaaaattcgtggcccttgttattcagtgcggaaaataagaagggccgtttcattcgtatttattactgctgcatgtcctcaaggaaaaagaagggaaaagacaggaatttccaaggttttgttgtgatgatcattttgtaatgatagtggtcaatgggactggagtgtgcgtgtttcgttgtgtttatagtactactactacatatatgaaagacatcatggagttttagagtgatgtagtgcattttctta

SEQ ID NO: 1132 - DNA, 1678 bp, Hordeum vulgare
aacgggccatcactacaccatcagtgatttttcagtggtgctgcccagctcagtgctctccaccagtccgccccgccccatcccgagctccaggcgccgacgcaccgaggacgaggaggacgatggaggcgcggcggcgggcggcgctggtggcgctggcggtgctggccatggcggcggcggcggcggaggggtacaacatcaccaagatcctgggcgagtacccggagtactcgcagttcaacaagctgctcacgcagacgcggctggcgcaggacatcaacaagcgccgcaccatcaccgtcctcgtcgtcgccaacagcgacatgggcagtctcgccggcggcggccgcacgctgcagaccatccgccacatgctccagattcacgtcctcgtcgactactacggcggcaagaagctccaccagctcgcgcacggcgtcaccgcgtgctcctccatgttccaggagtccggcgcggcccccggcatgtctgggtacgtgaacatcacgcagcaccggggcggcaaggtgacgttcacggcggaggacgcggaggacagcgcgccgtcgtcggccttcgtcaagtccgtcaaggagatcccctacgacctggcggtgctccagatcagcaaggtgctggcctcgccggaggccgaggcgcccgtggcggcgccggcgccggtcaacatcaccgagctgctctccaagaagtactgcaagagcttcgcgggcctgctggcggccgacgccgaggcatacagcaccatcaacgccaccaaggacaacgggctcaccctcttctgccccgttgacgccgccgtcgcctccttcatgcccaagtacaagaacctgacggccaaggggcggacggccatcctgctgtaccacgccgtgccggactactactccctgcagctgctcacctccaacagcggcaaggtgagcacgctcgccacctccaacgtcgccaagaaggactacagcttcgacgtggagaaggacggcgagacggcggagctcgacaccaaggtgaactcagcgtcggtcacctacaccatcaaggacgacgacccgctcgccgtctacgccatctccaagttcctgcagcccaaggagctgtacaaggtcgccaaggacaaggacctcgccccagcgccggcgcccgaggggcccaagaagaagaagaccaccaagaagaagccctccgcggccgcctcgccatcggacgacgacgacgatgactccgccgcggactcgcccgacgacgactcctcgtccgacgacgccaccgcagacaaggacggcgccgcgccgtccgcggtcgccgggtgggtgaccgccgccgtggccgtggcgtcggcgctggcactggcagcttgataaggtgtgtgaactggtgtgtttttgtgctgagttctccgaaaattcgtggcccttgttattcagtgcggaaaataagaagggccgtttcattcgtatttattactgctgcatgtcctgaaggaaaaaagaagggaaaagacaggaatttccaaggttttgttgtgatgatcattttgtaatgatagtggtcaatgggactggagtgtgcgtgtttcgttgtgtttatagtactactactacatatatgaaagacatcatggagttttagagtgatgtagtgcattttcttagtt

SEQ ID NO: 1133 - DNA, 1488 bp, Triticum aestivum
tccgctctgctcagctcagcgccctccaccagtccgccccactccatcccgagctgagctgagccgccaccagcactagcggccaagctctagacgccggctgcctcaccgacgaggagaggataatggaggcgcggcggcggacgttgctggtggcgctggcggtgctggccctggcggcggcggcggaggggtacaacatcaccaagatcctggcggcgtacccggagtactcgcagttcaacaagctgctgacgcagacgcggctggcgcaggacatcaacaagcgccgcaccatcaccgtgctcgtcgtggccaacggcgacatgggcagcctcgccggcgggggccgcacgctgcagaccatccgccacatgctccagattcacgtcctcgtcgactactacggcggcaagaagctccaccagctcgcgcacggcgtcaccgcatgctcctccatgttccaggagtccggcgcggcccccggcatgtccgggtacgtgaacatcacgcagcaccggggcggcaaggtgacgttcacggcggaggacgcggaggacagcgcgccctcctccgccttcgtcaagtccgtcaaggagatcccctacgacctggcggtgctccagatcagcaaggtgctggcctcgccggaggccgaggcgcccgtggcggcgccggcgcccgtcaacatcaccgagctgctctccaagaagtactgcaagagcttcgccggcctgctggccgccgacgccgacgcctacagcaccatcaacgccaccaaggacaacgggctcaccctcttctgccccgtcgactccgccgtcgcctccttcatgcccaagtacaagaacctgacggccaagggccggacggccatcctgctctaccacgccgtgccggactactactcgctgcagctgctcacctccaacagcggcaaggtcagcacgctcgccacctccaacgtcgccaagaaggactacagcttcgacgtggagaaggacggcgagaccgcggagctcgacaccaaggtgaactcggcgtcggtcacctacaccatcaaggacgacgacccgctcgccgtctacgccatctccaagttcctgcagcccaaggagctgtacaagatcgccaaggacatcgcccccgcgccggcgcccgaggcccccaagaagaagaagaccaccaagaagaagccctccgcggccgcctcgccctcggacgacgacgacgactccaccgcggactcgcccgacgactcctcgtccgacgacgccaccgccgacaaggacggcgccgcgccgtccgcggtcgccgggtgggtgacggccgccgtggccgtggcctcggcgctggcattggcagcttaataaggtgtgtgaactagtgtgtttttgtgctgagttctccgaaaattcgtggcccttgttatttatcgcgaaaaataagaagggccatttcattcatatttattaccacatgtcctga

SEQ ID NO: 1134 - DNA, 1682 bp, Triticum aestivum
gctctgctcagctcggctcagtgctctccaccagtccgccccaccccactccatcccgagctgagctgagacgacaccagcggccaagctccagacgcagcggcaacgaccgaggaggagaggataatggaggcgcggcggcgggcgttgctggtggcgctggcggtgctggccctggcggcggcggcggcggaggggtacaacatcaccaagatcctggcggcgtacccggagtactcgcagttcaacaagctgctgacgcagacgcggctggcgcaggacatcaacaagcgccgcaccatcaccgtgctcgtcgtggccaacggcgacatgggcagcctcgccggcgggggccgcacgctgcagaccatccgccacatgctccagattcacgtcctcgtcgactactacggcggcaagaagctccaccagctcgcgcacggcgtcaccgcatgctcctccatgttccaggagtccggcgcggcccccggcatgtccgggtacgtgaacatcacgcagcaccggggcggcaaggtgacgttcacggcggaggacgcggaggacagcgcgccctcctccgccttcgtcaagtccgtcaaggagatcccctacgacctggcggtgctccagatcagcaaggtgctggcctcgccggaggccgaggcgcccgtggcggcgccggcgcccgtcaacatcaccgagctgctctccaagaagtactgcaagagcttcgccggcctgctggccgccgacgccgacgcctacagcaccatcaacgccaccaaggacaacgggctcaccctcttctgccccgtcgactccgccgtcgcctccttcatgcccaagtacaagaacctgacggccaagggccggacggccatcctgctctaccacgccgtgccggactactactcgctgcagctgctcacctccaacagcggcaaggtcagcacgctcgccacctccaacgtcgccaagaaggactacagcttcgacgtggagaaggacggcgagaccgcggagctcgacaccaaggtgaactcggcgtcggtcacctacaccatcaaggacgacgacccgctcgccgtctacgccatctccaagttcctgcagcccaaggagctgtacaagatcgccaaggacatcgcccccgcgccggcgcccgaggcccccaagaagaagaagaccaccaagaagaagccctccgcggccgcctcgccctcggacgacgacgacgacgatgactccaccgcggactcgcccgacgactcctcgtccgacgacgccaccgccgacaaggacggcgccgcgccgtccgcggtcgccgggtgggtgacggccgccgtggccgtggcctcggcgctggcattggcagcttaataaggtgtgtgaactagtgtgtttttgtgctgagttctccgaaaattcgtggcccttgttatttatcgcgaaaaataagaagggccatttcattcatatttattaccgcatgtcctgaagaaaaagaaggaaaaagacaggaatttccgggtttttgttgtgatgatcattttgtaatgatagtggtcaatgggactggaatgtgtgtttgtgtttataatactactcctatatatgaaagacatcctggagcttcgactgatgtacaatttctatagttctaccgctcaacttttgcctta

SEQ ID NO: 1135 - DNA, 1667 bp, Brachypodium distachyon
aggcgagatggtagccgcggcgaggtcgacggcgaggtggctgctgctgcttgccctggtggccgcgtaccacggcggaggagcttccgtccgggctgccgcgggtgccggtgctcattggctgggcgggctgagccgggcgtcgttccccaagggcttcgtcttcggtacggccacgtcggcgtaccaggtcgagggcatggcggcctccggcggccgcgggccctccatctgggacgcattctcgcacatcccaggaaacgtcgtgggaaacacaaatgcagacgtcacaacggatcaataccatcgctacaaggaagatgttaatctcatgaaaggattgaatttcgatgcctaccggttttctatctcatggtccagaatctttccagatggtgaaggaaaagttaacgaagaaggtgtagcgtattacaataatctgataaactacttgcttcagaaaggcattactccttatatcaatctttaccacgctgatctacctcttgcacttgagaagaagtatggaggctggttgagtgcaaagacagtggaactattcgcagactatgctgacttctgttttaagacctttggcaatcgtgtaaagcactggtttacattgaatgaaccaaggatagcttgtcttcttggttacgatgtagggtccactcctcctcaaaggtgtaccaaatgtgctgctggtgggaactcagcaacagaaccttacattgttgcacataattttctcttagcacatggttatgcagttgcaagataccggaacaagtaccaggcagctcagcaagggaagattggaatcgtcctggacttcaattggtatgaagctctcacaaattcagctgaagacgaagcagcagctcaaagagccagggacttccatgttggttggtttgttgatccactaataaatggacactacccacagataatgcaagaccttgtgaaagagagattgcccaggttcacttctgatgaagttaaaatagtcaagggatcagcagactatattgggatcaatcaatacacagctagctacataaagggccagaaactggtgcagcaggcgccgactagctactcagccgattggcaggttacttatgcctctctgcgtaatggcaaacctattggaccaaaggcaaattctgattggctttacatagtcccgacagggatgtacggatgtgtgaactacctcagagtgaagtatggaaatccagcaatcgtcataaccgaaaacggaatggaccaacctgggaacctcacccgtgatgagtacttgcgcgatgtcacgagggttcggttctaccggagttacctggccgagctgaaaaaggccatcgacggtggcgctaacgtgcttgggtactttgcgtggtctctcctcgacaactttgagtggggatctggctacacatccaagtttggcatcgtgtatgtcgacttcaactcaaccaaactcgaacggcacccgaaggcatcggcctactggttcagagacatgctgaagggctaacactgaaggggtgcccgtgagttagcctaacgccattatcatcctattgagtttttacccactgttgtatgggtggcaccataattcagatggcacaataattcactctttcgtttcatatcgtgta

SEQ ID NO: 1136 - DNA, 2000 bp, Quercus alba
atggggctctctcctctgaacttacgctcctactgtactgcccagtgatcattctacattttcttcttaaaccatcacacactctctcaagataacagatcggaaccgaaacttctagaatgcgacgagattgtatattgtagcgaaatcagaatcggagtcagagatggggaagcagagcgcgtgggtggcgattcagaagaagcggtggccgctgctgattctcgctctgctttcgctcttcaccgcaatgcttttcttcaccagaacctcgttcgattcctgcgccaccaacagtaccagctctgctacaagtaatagcattgttatcaacaacaatcgttttcgagaagaagagaaagacaaatttacaaacgttcagattcaatcaaaagccgcaccgaatccgctagatttcatgaagtcgaagctcgtgctcttggtttcccacgagctctctctttctggtgggccattgttgttaatggagctagcgtttttgctgagaggtgtgggtgcggaggttgtgtggataactaaccagaaaccggtggagctagacgacgtcgtttacagtttggagcataaaatgttggacagaggggttaaggtcctatctgcaaagggtcaaaaagctatagatacagctcttaaagctgatttggttattttaaatactgctgttgctgggaaatggctggatgctgttctcaaggaaaaagttcctcatgtgcttccaaaggttttgtggtggattcatgaaatgagagggcattatttcaaagtggagtatgttaagcacctcccttttgttgcaggtgccatgattgattcacatacaactgcagaatactggaagaacagaacccgagagcgtttagggattaaaatgcctgaaacttacgttgtgcaccttggaaatagcaaggaactaatggaggttgctgaagatagtgtatgcaagagaattcttcgtgagcatgttcgagagtctcttggagtgcggaatgaagatctaatctttgccatcataaacagtgtttcacgtgggaaaggtcaggatctatttcttcgttcctttcatgaaagtctgcaacttattaaagagaagaaactgcaggtgccaccaattcatgcagtaatagtgggaagtgacatgaatgctcaaacaaagttcgagacagaactgcggaactttgtactagagaaaaaaattcaggaccgtgttcactttgtcaacaaaaccctgacagtagctccttatttggcttctattgatgttcttgttcagaactcccaggcccgaggagagtgctttgggaggataaccattgaagcaatggcctttcagctgcctgtgttgggcacagcagctggaggcaccatggaaatagtggtgaatgggacaacaggtttgttgcatcctgctgcaaaggaaggtgtgacacctcttgcaaataacattgtcaaattggccacacatgtagaaaggaggctaacaatgggaaagaaaggatatgagagggtgaaggagaggtttctggaaccccacatgtcacatagaattgctctggttttgaaggatgttcttcagaaggcaaagagccattccacttaaatcaaatgagagtttttcttctccacttcagttcagaggagttgggatgtaatccttatgtaatgacaaatctcatacacatgaaagttcattgtattttatgtaggaagttccatagataagtcaaagtgagttgtgatataatagtcggtttcctccattgtttataggatcattgaagtatatctggacacggcagtttcttgttgaaaattttgcttgttaaaaccgttttgaccggaaatttatgttcttgtgagcataagtgcactaaagtttgcagtccatgaactgcagatcttcccacaatggacatatgttcgacttgaaaaaaaaaattgccatattaatgtattgcagagttattcctttccttaaaatt

SEQ ID NO: 1137 - DNA, 3458 bp, Gossypium hirsutum
actttctagtctttgctttgctttgctttgttgggtgtgtttcgtttatttgttctagttattttagactgagtttctttttgcgtttcaagagcaagtttttttttttttggatgagaatgtaaatgggttccttagaaaatgggatctcgttgaagagagccggtagcaggaacgaaaggcacccgttttcgagccgacccagatcgagattttcccggcttttgctcttcaagaagctagattatctccaatggatttgcaccgttgctgttttcctcttctttgttgtgtttttccaaatgtttttgccggttcagtaatggacaaatctcaaggttccttcttagatgataaagattcggtatttggagaattgagttatttgaaagagatgggtgcgctagattttggtgaagatatcagattggaaccgtgcaagctattagagaagtttcagagagaaaataaactagtcaatttggattcttcatctggtttcaaccggagtcaacaccgtttccattatagaaaacctcagcttgcattggtgtttgctgatctattggttcacccacaacaattgctaatggtgaccattgcaaccgcattgaaagagattggctatgaacttcaggtatactcccttgaagatggtcttgcacgcaatgcttggcaaagcgtcggagttccggtcaccattcttaaagtcgaacggaatgagattgctgttgattggctgaactatgacggtatacttgttagctctcttgaggccaagagtgtcttttctagttttattcaggaacctttcaaatctattccacttatatggacaatccatgaacgagcgcttgccatacgttctagagaatacacttcaagtggacagattgagcttgtgaatgattggaaaaaagttttctgtcgtgctactgttgttgtcttccctaactatgcacttccgatgatctattctacatttgattctggaaactattatgtcattcctggttctccagctgtggtatggaaaggagagaatgcaatgaatttgttaaaagatagtcagcgtataaagatgggttatggacctgatgaagtactcattgcaattgttggaagtcaattcatgtacaagggcttgtggttggagcatgcccttattttgcaggctttattacccctctttgctgacaataattcaaattcccacccgaaaatcattattttaagcaatgattcaacaagcaactacagcatggctgttgagagaattgctctcaacttgaggtatcctagtggtgtggtgaagcatgtggctgttgaggaagaagtcgacaacgttctgagcatgactgacattgtgatatatggctcatttcttgatgagccatcattcccggaagttttgacgaaagccatgtcccttgggaaaccaatcatagcaccagaactctccaatatcaggaaatatgttgatgacagggtaaacggctatatttttcccaaggagaatattaaagttttgacccaaatcattttgcaagtgatatcgaatggaaaattgtctccattggcacgcaatattgcttcgattgggagagaaactgttaaaaacttgatggttcaggaaactgttgaaggatatgcctttctactggaaaatattctcaagcttccatcagaagttgcacctcttaaggctgttgctgaacttccttcaaagttaaaggaagaatggcaatggaacctgtttggggattttctaaattctactcttggagacaggagtgccaattttttgaacaagttagaggagcaatggaaccattctcgaagggagaagtttggttcattaattgctgtggatgattcattttcatatgaaatttgggaggaagaaaaaaggacgcatattctcgatactaaaaggagacgagaggagcaagagttgaaagatagaactgatcaacctcgtggaacctgggaggacgtatatcgaaatgccaagaaggcggaccgtatgagaaatgacttgcatgaaagggatgaaagggaactcgaaaggattggtcaaccattgtgtatttatgaaccttattttggtgaaggaacatggcctttcctgcaccaaaattctctttaccgtggaattggattgtccacaaaaggtcgaagacctgggatggatgatgttgatggaccgtctcgtctgcaacttcttaacaacccatactaccgagacactcttgatgaatatggggccttctttgctattgctaaccggattgaccgtctacacaggaatgcctggatagggtttcagtcatggcgagcaacagctcggaaggcatccttgtccggaattgctgaaacttcattgttagacgccatcgaaaagcgaaagtatggtgacgcactatacttttgggttcggatggacactgatccaagaaacaacatgcagagggacttttggtcattttgtgacgctataaatgctggaaagtgcaagcttgcattctctgagactcttaaaaggatgtatggcttagggcaggatttcaactctttgccacccatgcctgaaggagaaggcacatggtctgtcatgcagagttgggccttgccaacaaagtccttcctagagttcgttatgttctcaaggatgtttgtggatgcattagatgcacaaatgtatgatgagcactatcaaagtggtcactgttatctgagtttctcgaaggacaagcattgctactcacgggtgcttgagctgcttataaatgtttgggcatatcacagtgcacgtcggattgtatatgtgaatcctgaaaccggtgcgatgcaagaataccacaagttcaaggatcggaggggtaaaatgtggatcaaatggttttcattcaacactttaaaggtcatggatgaggatttagccgaggaagcagattctgaccacccaaagagacgatggttatggccatcaacaggtgaggtcgtctggcaaggtgttcttgacagagagagaaatctccggaaccggcaaaaagagacaaggaagcagaaaagcaaagacaaactagagaggatgaggcataaacaccgtcaaaaagcattagggaagtatgtgaaaccccttccagaagatattgagatctcaaattcaacaacagtaacatcagtttaatttcatatctgttttttgcatctttggcaatagaacctagtttgataattctttaatttttgatcttcttctacccttttctttttgcttctatgccttgtttatgtcagaaaggatgcatcatttgtttaaatgtgagtatttttgtatttagctaacagcatccttctggtcattaatattcttgaatggctcaaactgtacactaagttttacctttctccttattttctgccctcaattctaaattttatttttcgatgtt

SEQ ID NO: 1138 - DNA, 4032 bp, Theobroma cacao
aaaagaaagggaataataattacaatagattctccaccgaagttacagctcgcaagcaaattcctacttgtctttaccgatttcttcacgttaaccctttcgttttctccgaatctatcgctctcttgctttgctcctcagtaaaaatcggaaaaaaaaaaagagagaaaaaaaccgaaaatcccttgccaatgctttattacgtatgtcactctctattaatctttgacaattcagtgactatcggaatccacctaaatgccagcgtagccatatccctttgctcatgaaaactcacaagctttctctctttctgtaataaataaacactcaacacccactgctagtcttttctttgctttgtttgtgggccttgtctttttttttttttatattgttttagtttgagctaattttttttagtgtaacttttggatgagaatgtaaatgggttctttagaaagtgggatttcattgaagagagctggtagtagaaacgaaagaaacccgtttctgaaccgacccagatcaagattttctcggtttttgctcttcaagaagctagattatctccaatggatttgcacagttgttgttttccttttctttgtggtgttctttcagatgtatttgcctggttcagtaatggacaaatcccaagattcctttttggaagataaagatttggtatatggagaattgaggtacttaaaagagatgggtgggttagattttggtgaagatatcagattggaaccccgtaagcttttagagaaatttcagagagaaaataaagtacttaatttggaatcttcatctggtttcaaccggagtcaacaccgtttccaatatagaaagccccagcttgcattggtgtttgctgatctattggttgacccacaacaattgctaatggtaaccattgcaactgcattgagagagattggttatgctattcaggtctactcccttgaagatggtcctgtgcacaatgtttggcaaagcattggagttccagtcagcgttcttcaagtcaattccaatgagattggtgttgattggcttaactatgatggcatacttgtcagctctcttgaggccaagggtgtcttttctagttttatgcaggaacctttcaaatctattcctcttatatggaccatccatgaaagaactcttgctgttcgttctagacaattcacttcaagtgggcagattgagcttgtgaataattggaaaaaagttttcagccgtgctactgttgttgtcttcccaaactatgcccttccgatgatctattctgcatttgatactggaaactattatgttattcctggttctcctgctgaagcatggaaaggagagaatgcaatgaatttgtacaaagataatcagcgtgtgaagatgggttacggacctgatgaagttctcattgcaatcgttggaagtcaatttatgtaccggggcttgtggttggagcatgcaattgttttacaggctttattaccactctttactgacttttcatctgatactaattcaaattcccatcccaaaattattattttaagcggtgactcaacaagcaactacagcatggctgttgagagaatcactcataacttaaaatatccaagtggtgtggtgaagcatgttgctgttgatggagatgttgacagtgttctgagcatgactgacattgtgatatatggctcattccttgaggagccatcatttccagagattttgataaaagccatgtgccttgggaaaccaatcatagcaccagatctctccaatatcaggaaatatgttgatgacagggtaaacagctatctttttcctaaggagaatattaaagttttgacacagatcatattgcaagtgatatcaaaaggaaaattgtcaccattggcacggaatattgcttcaattggaagtggaactgtcaaaaacttgatggttcgggaaactgttgaaggctatgccttgctactggaaaatgttctcaagcttccatcagaagttgcccctcctaaggctgttatggaacttccttcaaagttaaaagaagaatggcagtggaatctatttgaaggttttctaaattctacatttgaagacagaagttccaaatttttgaacaagttagaggagcagtggaaccattctcaaaaagagaggtctggttcattacttgacacgaacgattcattttcatatgagatttgggaggaagaaaaaaagatgcagattattaatattaaaaggagaagagaggaacaagagttgaaagatagaactgatcaaccccgtggcacctgggaggatgtatatcgaagtgccaagagggctgaccgcttgaggaatgacttgcatgaaagggatgaaagggagcttgaaaggactggtcaaccattatgtatctatgaaccttactttggtgaaggaacctggcctttcttgcaccataattctctttatcgtggaattggattgtccactaaaggtcgaagaccaaggatggatgatgttgatggaccgtctcgtctgcaacttcttaacaacccatactaccgagacactcttggtgaatatggggccttttttgcgattgctaaacgaattgaccgcctacacaggaatgcctggataggatttcagtcatggagagcaacagctaggaaggcattcttgtctaagattgctgaaacttcattgttggacgccactgaaaagcacaagtatggtgatgcactatacttttgggttcgaatggacatggatccaagaaacagcatgcagggggacttttggtcattttgtgatgctataaatgctggaaattgcaagtttgctttctctgaggctcttaataggatgtatggcataaagcatgatttgatttctttgccacccatgcctgaagatgggggcacgtggtctgtcatgcagagttgggccttgccaacaaagtccttcctagagtttgttatgttttcaaggatgtttgtggatgcattagatgcacaaatgtatgatgagcaccatcaaagtggtcactgttatctgagtttcgcaaaggacaagcattgctactcacgggtgctggagctacttataaatgtctgggcataccacagtgcaaggcggatggtatatgtgaaccctgagactggtgtgatgcaagaataccacaagttaaagggtcggagagggataatgtgggtcaaatggttttcattcaacaccttaaagggcatggatgaggatttggcggaggaggcagattctgaccacccaaaaagacgatggttatggccatcgacaggtgaggttgtctggcaaggtgtacttgagagagagagaaatctccgcaaccgacagaaagagaaaaggaagcaaaaaagtaaggataaacaagagagaatgaggcataaataccatcaaaaggcattggggaagtatgtgaaaccccttccagaagagatgcaaaattcaaattcaacaatagtaacatcagagtaatttcacgtgtgtttttgcatccttggcagtagaatctaatttgatgattctttaatttttgatatattttttttcaccttttccttttcttgtctgtcttatttttgtcagaaaggatgcattattttgtgtacatgtgagtccttttgtatgtagctaaccgcatccttctggtcattgacgttcatgaatggctcaattgtatactagtttttccccttaatttcaaattctattccagtactgaaattaacttatctttctacccatggtttttcaccctgagccgagggaattggtggttaatactttgctgtggggatccaatgcatgtgagcttcacttattggtcgggtgcatagggaattggtgcatgtaacacgctaactttgagtccgatcctggcagaagcactcgagaaaatggtgaagaagatcatacaattcctatttatggtaatagcagcaccgacaccataagtaacaacaaatcagggtagcaata

SEQ ID NO: 1139 - DNA, 1255 bp, Zea mays
gggcggcggcggcggactgtcactcgtgccacacggcccccaaacggtaactagagagcagaagaaactcgcattcccattcccagccaatcgcctctcgcttttaaatcctgcgccctaccgccgcctccactcccaccgctctcaatcctcccgcctcttcctaatccgcctcctcccgctcagtcgccgccgtggaggaaggagcaactcgatcgccagtcatgacccggggagagaaccaggagtcgcagaccgggaacgtctccgccgcatctgcggctgcgccgggaccgaagccggcatcggcgggggccgggaagggcgcggagggccagtcggtggtgcggcggctgcagtcggagctgatggcgctgatgatgggcggcgacccgggcgtgtcggcgttccccgagggggacaacatgctccactgggtgggcaccatcgcgggatccgccgggacggcctacgagggcacctcctaccgcctcgcgctggccttcaccgccgagtacccgtacaagccgcccaaggtgcggttcgacaccccctgcttccaccccaacgtcgacgtgcacggcaacatctgcctggacatcctccaggacaagtggtcctccgcctacgacgtgcgcaccatcctcctctccatccagagcctgctcggagagccgaacaacgactcgccgctcaacacgcaggcggcggcgctttgggcgaaccaggaagagttcaggaagatggtggagaagctctacaaggccgccgcgtagaggacagcacacggcgcagatgccgactcaggttcttcaagcaccgatctcacttggatcgattgacgtggatggttttgttgggttgggttcccagtctggtgctgtagcggtgtagcaggaacgcgtgggtagccttgagcctggcgattctgtaattgtcctttgagttctgaaatgttaagagattcatttttacatgactttttgttttttcatttttacactctggatatggacgggactagttgaatttaggaagatcgtatgatctcgaaaatgttcagtaactgcatcaacacaatgttcaaatgaccttcgtccttgttgccgactgggaaggaaaagccacctcgtttcctcttctaacggcgcagtgttgctcggatgatgtatcaaatggaccctatagccaaactacgaatggtgttttgaattgggattttttttataaagacaatcatttttttctaaataga

SEQ ID NO: 1140 - DNA, 1226 bp, Zea mays
cacacggcccccaaacggtaactagagagcagaagaaactcgcattcccattcccagccaatcgcctctcgcttttaaatcctgcgccctaccgccgcctccactcccaccgctctcaatcctcccgcctcttcctaatccgcctcctcccgctcagtcgccgccgtggaggaaggagcaactcgatcgccagtcatgacccggggagagaaccaggagtcgcagaccgggaacgtctccgccgcatctgcggctgcgccgggaccgaagccggcatcggcgggggccgggaagggcgcggagggccagtcggtggtgcggcggctgcagtcggagctgatggcgctgatgatgggcggcgacccgggcgtgtcggcgttccccgagggggacaacatgctccactgggtgggcaccatcgcgggatccgccgggacggcctacgagggcacctcctaccgcctcgcgctggccttcaccgccgagtacccgtacaagccgcccaaggtgcggttcgacaccccctgcttccaccccaacgtcgacgtgcacggcaacatctgcctggacatcctccaggacaagtggtcctccgcctacgacgtgcgcaccatcctcctctccatccagagcctgctcggagagccgaacaacgactcgccgctcaacacgcaggcggcggcgctttgggcgaaccaggaagagttcaggaagatggtggagaagctctacaaggccgccgcgtagaggacagcacacggcgcagatgccgactcaggttcttcaagcaccgatctcacttggatcgattgacgtggatggttttgttgggttgggttcccagtctggtgctgtagcggtgtagcaggaacgcgtgggtagccttgagcctggcgattctgtaattgtcctttgagttctgaaatgttaagagattcatttttacatgactttttgttttttcatttttacactctggatatggacgggactagttgaatttaggaagatcgtatgatctcgaaaatgttcagtaactgcatcaacacaatgttcaaatgaccttcgtccttgttgccgactgggaaggaaaagccacctcgtttcctcttctaacggcgcagtgttgctcggatgatgtatcaaatggaccctatagccaaactacgaatggtgttttgaattgggattttttttaaaaagacaatcatttttttctaaataga

SEQ ID NO: 1141 - DNA, 844 bp, Saccharum officinarum
actcaatcgccgccaaggagaaaggatatagcaaggggaggaacagcccacccactcgatcgtcagcgatggcccggggcgagaaccaggagtcgcagaccgggaacgtgcccgccgcatccgcggcggcggcgccgggggcgaagccggcgtcggcgggggccgggaagggcgcggagggccagtcggtggtgcggcggctgcagtcggagctgatggcgctgatgatgggcggcgacccgggcgtgtcggcgttcccggagggggacaacatgctccactgggtgggcaccatcgcgggctccgccgggacggcgtacgagggcacctcctaccgcctcgcgctggccttcaccgccgagtacccgtacaagccgcccaaggtgcggttcgacaccccctgcttccaccccaacgtcgacgtgcacggcaacatctgcctggacatcctccaggacaagtggtcctccgcctacgacgtgcgcaccatcctcctctccatccagagcctgctcggagagccgaacaacgaatcgccgctcaacacgcaggccgcggcgctctgggcgaaccaggaagagttcaggaagatggtggagaagctctacaagcccgccgcgtagaggaggaggaggacagcacccggcgcagatgtcgcctcgggttcttcaagcacttgctctcgcttggatcgatcgacaagagattattaggtggatgggatgggatggtttcgttgggttgggttcccagtctggtgctgtagcaggagtatgtgggtccctggagcctggcgattctgtaattgttctttgagttctgaaatgttcagagattcattttt

SEQ ID NO: 1142 - DNA, 1007 bp, Sorghum bicolor
gtgccgcgccgcccccaacggtcactagacagcagaagagactcgcattcccatcccgagccaatcgcctctcgcctttaaatcctgcgcccccaccgcagcctccactcccaccgctctcgatcctcccaccgctccgactcaatcgacgccgaggagagaaaggaagggccactcgatcgtaagcgatggcccggggagagaaccaggagtcgcagacggggaacgtgcccgccgcatcagcggcgtcagcgacgggggcgaagccggcgtcggcgggcaccgggaagggtgcggagggccagtcggtggtgcggcggctgcagtcggagctgatggcgctgatgatgggcggcgacccgggcgtgtcggcgttcccggagggggacaacatgctccactgggtgggcaccatcgagggctccgccgggacggcgtacgagggcacctcctaccgcctcgcgctggccttcaccgccgaatacccgtacaagccgcccaaggtgcggttcgacaccccctgcttccaccccaacgtcgacgtgcacggcaacatctgcctcgacatcctccaggacaagtggtcctccgcctacgacgtgcgcaccatcctcctctccatccagagcctgctcggagagccgaacaacgactcgccgctcaacacgcaggcggcggcgctctgggcgaaccaggaagagttcaggaagatggtggagaagctctacaagcccgcggcgtagaggagaggaggaggacagcgcccggcgcagatgtcgcctcgggttcttcaagcactgatctcgcttggatcgatcgacaagagattattgggtggatggatgggtttcgttgggttgaaggctcccaggagtatgtgggtccctggagcctggcgactctgtaattgttctttgagttctgaaatgttcagagattcattttaacaggacctgttttcgtcccttttcattctgactgcgatatggatagggacaagactgctc

SEQ ID NO: 1143 - DNA, 1258 bp, Panicum virgatum
atcgcctttaaatcccgcgccgccgccgcctcctctctctcccccgctctcttccaatccaatctctccctccgctctcttccaatctctctccctctccgcgtctccaatctctgggagagagaggaagcgcaccccggcccgatcgccagccatggcccgcggagagaaccaggagtcgcagaccggcaacgtccccgcggcttcggcgtcggcggcggggccgaagccggcggcggcgggggccgggaaggccgcggagggccagtcggtggtgcggcggctgcagtcggagctgatggcgctgatgatgggcggcgacccgggtgtgtcggcgttcccggagggggacaacatcttccactgggtgggcaccatcgccgggtcggcgggcaccgcctacgagggcacctcctaccgcctcgcgctcgccttcaccgccgagtacccctacaagccgcccaaggtgcggttcgacacgccgtgcttccaccccaacgtcgacgcgcacggcaacatctgcctcgacatcctccaggacaagtggtcctcggcctacgacgtccgcaccatcctgctctccatccagagcctcctcggagagccgaacaacgactcgccgctcaacacgcaggcggcggcgctctgggcgaaccaggaagagttcagaaagatggtggagaagctctacaaggccgccgcgtagaggaaggaggcccgagaaagacgtccggcgccgatgccgcggcttcgcgggcgggtggggttgcatggagaagctctgcaagcagtgatctcgcttcgatgataaggggttaggtgcattctttggtggggttcggtttcctggcgagtggcgagtctgtaattgttttctgagttatggatgttcagtgggcagtgattcgtttcactttacagtagtagttgttatcgcctcttgttgtttcaatcttgatattggaatgacaaattccatttcagaaatgctcaggaaacgcatcagcgggatttcgaggatgttcacaaactgcatcagcgtgatttcgaaaaagtgcggtttcaaatgacctttgtttcccatacgaaaatctatacgagtaggagcagacagaagtcatttcccctcctgttgcagtgttttatactcggctggatggcaaccaagccaatttttttgtatggggatattgtttttcccaaaccttgacagatgtaacagattattaatttcctaactttgcaaacatttttagag

SEQ ID NO: 1144 - DNA, 817 bp, Saccharum officinarum
tttaaatcctccgccccaccgctctgatctatcctggatctcttgccgccgcctcccctcaatcgcccgccgccgacgagaaagcaccgactcgatcgtcagccatggcccggggagagaaccaggaggcgcagaccgggaacgtccccgcggcatccgcatccgcatccgcgccgaagccgtcagcgtcggcggcgggggccgggaagggcttggaaggccagtcggtggtgcggcggctgcagtcggagctgatggcgctgatgatgggcaccgacccgggcgtgtcggcgttcccggacccggagggggacagcatgctccactgggtgggcaccatcgcgggctccgcggggacgccctacgagggcacctcgtaccgcctcgcgctggccttcaccgccgagtacccgtacaagccgccccaggtgcggttcgacaccccctgcttccaccctaacatcgacgcgcacggcaacatctgcctcgacatcctccaggacaagtggtcctccgcctacgacgtgcgcaccgtcctcctctccatccagagcctgctcggagagccgaacaacgactcgccgctcaacacgcaggcggcggcgctctgggcgaaccaggaagagttcaggaagatagtgcagaagctctacaagccccgcgcgtagaggaggaggacaagcactgatctcgcttgggtcgatggagaaaacaagatgcttccgttgggttgggttccagtcctgtggtataggtgactgtccttggagttctgaacgtccgacgaatgctttcgtggggttgggttcccactctg

SEQ ID NO: 1145 - DNA, 817 bp, Saccharum officinarum
tttaaatcctccgccccaccgctctgatctatcctggatctcttgccgccgcctcccctcaatcgcccgccgccgacgagaaagcaccgactcgatcgtcagccatggcccggggagagaaccaggaggcgcagaccgggaacgtccccgcggcatccgcatccgcatccgcgccgaagccgtcagcgtcggcggcgggggccgggaagggcttggaaggccagtcggtggtgcggcggctgcagtcggagctgatggcgctgatgatgggcaccgacccgggcgtgtcggcgttcccggacccggagggggacagcatgctccactgggtgggcaccatcgcgggctccgcggggacgccctacgagggcacctcgtaccgcctcgcgctggccttcaccgccgagtacccgtacaagccgccccaggtgcggttcgacaccccctgcttccaccctaacatcgacgcgcacggcaacatctgcctcgacatcctccaggacaagtggtcctccgcctacgacgtgcgcaccgtcctcctctccatccagagcctgctcggagagccgaacaacgactcgccgctcaacacgcaggcggcggcgctctgggcgaaccaggaagagttcaggaagatagtgcagaagctctacaagccccgcgcgtagaggaggaggacaagcactgatctcgcttgggtcgatggagaagacaagatgcttccgttgggttgggttccagtcctgtggtataggtgactgtccttggagttctgaacgtccgacgaatgctttcgtggggttgggttcccactctg

SEQ ID NO: 1146 - DNA, 881 bp, Avena sativa
ccaaaccctctccggccagtccgatccgatctgctcctgtcccctcgatccatcgccgcgagtagcaaccgcacggacgaacgatggcgaggggcgagaacagcgagtcgcacggcagcggcaacgtccccgcgtcccccgcggcgtcctcggtgaagcaggccccggcggcggcgcgtggcgcggaggggcagtcggtggtgcggcggctgcagtcggagctgatggcgctgatgatgggcggcgaccccggggtgtcggcgttcccggagggggacaacatcttccagtggatcggtaccatcgacggctccgccgccaccgcctacgagggcacctcctaccgcctcgcgctcgccttccccagcgactacccctacaagccacccaaggtgcggttcgagaccccctgcttccaccccaacgtcgacacccacggcaacatctgcctcgacatcctccaggacaagtggtcctcagcctacgacgtccgcaccatcctcctctccatccagagcctgctcggagagcccaacaacgactccccgctcaacacacaggcggctgcgctgtgggcgaaccaagaagagttcaggaaaatggtagagaagctctacaagcccgcatagaggaaaaggaaggcgggatccatcggaatggaagaagcggctccacaagactggtgttccataatagtagttgtcaactgttggatatggacatgtaatagcttggatagattgtgaactgttcgatagattctttcagtgttccagtttttgttccggtgtttctgtctgccattgctgagatggacatactttgtaacgaggaattcaacttccagatgattcagaagaatatagctcccatttattccg

SEQ ID NO: 1147 - DNA, 888 bp, Brachypodium distachyon
ccaaaccctctctccctctccatcctccggcgggcggcggctctcctcctcgatccatccatccatccatcaatcgggcacgaagcgatggcgaggggcgagaacagcgagtcgcacggcagcggcaacgtcccggcggcggcgcccgcggcggtcgggaagcaggccccggcggcggcgcggggcgcggacgggcagtcggtggtgcggcggctgcagtcggagctgatggcgctgatgatgggcggggaccccggggtgtcggcgttcccggaaggggacaacatcttccagtgggtcggcaccatcgacggctccgccgccaccgcctacgagggcacctcctaccgcctcgcgctctccttccccagcgactacccttacaagccgcccaaggtcaagttcgaaacgccttgcttccaccccaacgtcgacacccacggcaacatctgcctcgacatcctccaggacaaatggtcctccgcctacgacgtccgcaccatcctcctctccatccagagcctgctcggagagccgaacaacgactcgccgctcaacacgcaggcggccgcgctttgggccaaccaagaagaatttaggaagatggtggagaagctctacaagccagcgtagaggaagtggggaaggcggcggggtaacggatccgcgaagggtttggcttgaatcggttccttcgatctgctccccgatctggtgttcgatattgtcaactgttagatacttggcctgtacttgcttcgagttttgtttgcccgactgtttcgctttcgcgtgctgttatcccgatgtaacttatggtgtctgctgccatcgctgagatgggcatactttactcaattcaagttctggaacgaggtgttcgattaa

SEQ ID NO: 1148 - DNA, 2007 bp, Sorghum bicolor
cagccatccccaaaacccgcgcacaccggcgacggccggagaacctccccgccggcaacagccatgccgccgcctctccaggcccaccgcctcctcatctcccaccgccgcctcccctctcccgctcgccgccggttcaccgccgcgtcttccctccaatccgctcccgccacaaccctggccccgggtcccgccacatcctccatcctctccatccgcgagtcgctcctttccggcgagaggacagcggcggacatcacctccgagtacctctcccgcctccgccgtaccgagccgagcttgcgcagcttcatccacgtcgcggacgccgccgccgagcgggaggcggaggaactcgaccggaggattgcgtccggggagaaggatgcggtggggccgctcgctggagtgctggtgggagtgaaggacaacctctgcaccgccaacatgccctccacgggcgggtcgcggatactagacgggtaccggccggcgtacgacgccacggccgtgcggcggctgcaggaggccggcgctattgtggtggggaagacgaacctcgacgaattcggaatggggagcaccaccgagggctccgcgtttcaggtgacgacaaacccgtgggatgattcacgtgtgcctgggggatcctctggtggttctgcttctgcggtatctgctaggcaatgtgtagtgtcactaggaagcgacacaggggggagtgtgagacaaccagcgtcattttgcggtgtagtggggttgaagccaacttatggtcgggtttctcgttttggtctcatggcctatgcttcatcgctggatgttgtgggatgctttggttcatctgtttttgacactgcaaccatcttatctgttgttgctggccatgacaagatggactcaaccagcagttcacaggttgttccagactatgcatcggagttggtctccctagatttactagaatcaaaaccattggctggtctgagaattgggattatacaagaaactcttggagaaggtgttgccaacggagtcatatcatcaatcaagggtgctgcttcacacctggagcagttgggatctgtagtggaagaggtttcactgccttcattttctcttggcttaccagcatattacatactagcctcatctgaagcttcttctaatctatcacgctatgatggtatcaggtatggaagacagttttcagctgatgacttgaatgagctttatggagagtccagggctaatggtttgggtcatgaggtcaaaatgagaattttgatgggaacctatgctctttctgccgggtactatgatgcatactacaaacgagcacaacaggtgaggacactggttaaggaaagcttcaaagatgctttggaaagatatgacattctaatttcaccagctgcgccatcagcagcctacaagataggtgaaaagataaatgatccattagccatgtacgcaggagatatcttgacggtgaatgttaatttggcgggtcttcctgcattggttgtgccttgtggatttgttgaaggtggacctgcagggctcccagttggacttcagctgatcggatctccattctgtgaggggaatttgctgagagtaggccacatctttgagcagactcttcagaatctcagctttgttccaccgttgttggcagagagctagtcaacataccgttgttggcagagagctagtttcaacataggcatctcagccgctcgacaagcaattacctgaggcccttctgtgcatcgacttcattcccatgcggaagaggttggtactacgcgtgtagaaaatagaatctttgcccgtggagttgctgataattgtgagagagcaacggcacccatgcgatgtacgccagcaatcagcacattgcatacagcacagcattgtacacaccgacagaatgattgatgattttgtatcaacgttggttctctcttgtgtcaagttttgcatagaaaatttgtgtccctg

SEQ ID NO: 1149 - DNA, 1834 bp, Setaria italica
ctcccaccgacgcctccccactcccgctcgccgccggttcaccgccgtctcttccgtccaatccgctcccgccacgaccttagccccggggcccgccacatcgtccatcctctccatccgcgagtcgctgctctccggcgagaggaccgcggtggacatcacctccgagtacctctcccgcctccgccgcaccgagccgagcgtgcgcagcttcatccacgtcgcggacgccgccgcagagcgggaggcggaggagctcgaccggaggattgcctccggggagaaggatgcggtggggccgctcgctggagtgctggtgggagtgaaggacaacctctgcaccgccaacatgccctccactggcgggtcgcggatactggacggataccggccggcgtacgacgccacggcggtgcggcggctgcgcgaggctggcgccattgtggtggggaagacgaacctcgacgaattcggcatggggagcaccaccgagggctctgcgtttcaggtgacaacaaatccgtgggatgatgcacgtgtgcccgggggatcgtctggtggttctgcttctgctgtttctgctagacagtgcgtagtgtcactaggaagtgatacaggtggaagtgtgagacaacctgcgtcgttttgtggcgtagtggggttgaagccaacttatggtcgggtatctcgttttggcctcatggcctatgcttcatcgctggatgttgtgggatgctttggttcatcagtttttgacactgcaaccatcttgtctgttgtcgcgggccatgacaagatggattcaaccagcagttcgcaggatgttccagactatgcatcagagttagtctctctagattcacttgaatcaaaaccattaaatggtgtaagaattgggattatacaagaaactcttggagaaggtgtggacactggagttgtatcatcaatcaagggtgctgcttcacacctggaacggcttggatctgtggtggaagaggtttcactgccttcgttttctcttggcttaccagcttattacatactagcttcatctgaagcttcatctaatctatcacgctatgatggtatcaggtatggaaggcaggtttcagctgatgatttgaacgaggtttatggagagtcccgggctaacggtttgggtcacgaggtgaaaatgagaattttgatgggaacctatgctctttctgctgggtactatgatgcatactacaaacgagcgcagcaggtgaggacattggttaaggaaagcttcaaagatgctttggaaagatatgatattcttatttcaccagctgcgccatcagcagcctacaagataggtgaaaagataaatgatccattagccatgtatgcaggagatatcatgacggtcaatgttaatttggccgggcttcctgcattggttgtgccttgcggatttgttgaaggtggagctgcggggctcccagttggattacagatgatcggatcaccattcagtgaggggaatttgctgagagtaggtcacatctttgagcagacactccagaatttcagttttgttccacctttgctggcagaacactagctgctatgtaggcttctctctgccctactcagagctatcaaacaagcaattaccagagacgggttttcaaagcccttctgttattcttataattttgcagacatgtcatgtggtataccgaggaaattggctgtgcgcatgtagaatttagacatttttctgctaaagcaaactaacaggagttgcttccaactttgatgcaatatacatgtggaattgctgataattgagtgagacaacgac

SEQ ID NO: 1150 - DNA, 2040 bp, Hordeum vulgare
gagaatctccccgccggccgccgccatgccgccgcctctccaggcccaccgcatgctcctctcccaccgccgcacatcccccatacctcgtcgccgcttcaccgcggtctcctccctctcctccccccccgccaagaccctggccccgggcccgaccccctcctccatcctctccatccgcgagtcgctcctctccggcgagaggaccgcggccgacatcacctccgagtacctctcccgcctccgccgcaccgagccgagcctgcgcagcttcatccacgtggccgacgccgccgccgagcgggaggcggaggagctcgaccggaggattgcctcgggtgggcaggatgcggtgggaccgctcgccggggtgctcgtgggcgtcaaggacaacctctgcaccgccagcatgccctccaccggcgggtcgcggatactcgacgggttccagccggcgtacgacgccacggccgtgcggcggctgcgagaggcgggcgccatcgtggtggggaagactaacctcgatgagttcggcatggggagcaccaccgagggctctgggtttcaggtgaccacaaacccttgggacgattcgcgcgtgcctgggggatcctcaggtggttctgcttctgcggtttctgctagacagtgtgtggtgtccttagggagtgacacaggtggaagtgtgaggcaaccggcatcgttttgtggtgtggtagggttaaagccaacttatggccgggtatctcgttttggcctcatggcttatgcttcatcactggatgttgtgggatgctttggatcatcagtttttgacactgcaaccatattgtctgtcattgctggccatgacaaaatggattcaaccagcagctctcatgatgttccagactatagatcagacttggcatctctaagtttactagaatcaaaaccattaaataatgtgagaattgggattatccaagaaactcttggagagggtgtggatgctggagtcatatcatcaatcagggctgctgcttcgcatctggaacagctaggatcggtggtggaagaggtttcgatgccttcattttctcttggcttgccagcatattacatattggcctcttctgaagcctcatctaatttgtcacgctatgatggcatcaggtatgggcggcaggtttcggctgatgacttgaatgagctctacggaaattcccgggctagtggtctcggtcatgaggtcaaaatgagaattttgatgggaacttatgcattatctgctggatactatgatgcatactacaaacgagcgcaacaggtgaggacgctggttaagaaaagcttcgaagaagctttgggcaaatacgatattcttatttcacctgctgctccatcagcagcctacaagataggtgaaaagacaaatgatccattagctatgtacgccggagacatcatgacggtgaatgttaacatggctgggcttcctgcattggttgtgccttgtggattcgtcgaaggtgggtctgcgggtctcccagtcggacttcagatgatcggatctcccttcagtgaggggaatttgctgagagtaggccacatcttcgaacaaacgctgcaggatctcagcttcgttccaccactggcggcagataactagcgcctttcttcgtgtctcgttcaagcggttcctagggctgcgtgggttttagaggcccctcttttcattcattcctaaagttttgagatatattatttcgtcgttgtatggcgaggaaactggttgtacgcaatgcgtgagatttcccattgtgggagtggttggggacaagagtctgagacggcatgtgcacatgtgcaattcctgcaagccaacagctgcgtcgcccacattcggtatcggcccacgtcgatggtatattttttgtaatcctggttcacatcaatggtattctgcaaatctttttgattgattgactgataacagtgcaggctattcatggcttcatgtgcatcacacgttctgtaaacgatcaaccaacggaacat

SEQ ID NO: 1151 - DNA, 2052 bp, Triticum aestivum
  misc_feature (78)..(78): n is a, c, g, or t
  misc_feature (163)..(163): n is a, c, g, or t
  misc_feature (222)..(223): n is a, c, g, or t
  misc_feature (237)..(237): n is a, c, g, or t
  misc_feature (360)..(360): n is a, c, g, or t
  misc_feature (363)..(363): n is a, c, g, or t
  misc_feature (367)..(368): n is a, c, g, or t
  misc_feature (492)..(492): n is a, c, g, or t
  misc_feature (582)..(582): n is a, c, g, or t
  misc_feature (612)..(612): n is a, c, g, or t
  misc_feature (630)..(630): n is a, c, g, or t
  misc_feature (633)..(633): n is a, c, g, or t
  misc_feature (668)..(668): n is a, c, g, or t
  misc_feature (672)..(672): n is a, c, g, or t
  misc_feature (686)..(686): n is a, c, g, or t
  misc_feature (776)..(776): n is a, c, g, or t
  misc_feature (967)..(967): n is a, c, g, or t
  misc_feature (1541)..(1541): n is a, c, g, or t
  misc_feature (1544)..(1544): n is a, c, g, or t
  misc_feature (1559)..(1559): n is a, c, g, or t
  misc_feature (1571)..(1571): n is a, c, g, or t
  misc_feature (1595)..(1595): n is a, c, g, or t
  misc_feature (1602)..(1603): n is a, c, g, or t
  misc_feature (1664)..(1664): n is a, c, g, or t
  misc_feature (1945)..(1945): n is a, c, g, or t
  misc_feature (1956)..(1956): n is a, c, g, or t
  misc_feature (2035)..(2036): n is a, c, g, or t
  misc_feature (2038)..(2041): n is a, c, g, or t
  misc_feature (2044)..(2044): n is a, c, g, or t
  misc_feature (2046)..(2047): n is a, c, g, or t
  misc_feature (2049)..(2049): n is a, c, g, or t
cccacgcgcaccggcgtccgccggagaacctccccgccggccgccgccatgccgccgcctctccaggcccaccgcatnctcctctcccaccgccgcgcatcccctatccctcgccgccgcttcaccgcggtctcttccctctcctccgcccccgccaagaccntggccccgggcccgcccgcctcctccatcctctccatccgcgagtcgctcctgtccggnnagaggaccgccgcngacatcacctccgagtacctctcccgcctccgccgcaccgagccgagcctgcgcagcttcatccacgtggccgacgccgccgccgagcgggaggccgaggagctcgaccggaggattgcctcnggngggnnggatgcggtggggccgctcgccggggtgctcgtgggcgtcaaggacaacctctgcaccgccagcatgccctccaccggcgggtcgcggatactggacgggttccagcccgcgtacgacgccacngccgtgcggcggctgcgcgaggcgggcgccattgtggtggggaagactaacctcgacgagttcggcatggggagcaccaccgagggctcngggtttcaggtgacaacaaacccttgggangattcgcgcgtgcctggnggntcctcaggtggttctgcttctgcggtttctgctanacantgtgtggtgtcctngggagtgatacaggtggaagtgtgaggcaaccggcatcgttttgtggtgtggtagggttaaagccaacttatggccgggtatctcgtttnggcctcatggcttatgcttcatcactggatgttgtgggatgctttggatcatcagtttttgacactgcaaccatattgtccgtcattgctggccatgacaaaatggattcaaccagtagctctcatgatgttccagactatagatcagacttggcatctctaagtttactagaatcaaaaccattaaatantgtgagaattgggattatccaagaaactcttggagagggtgtggatgctggagtcgtatcatcaatcaggtctgctgcttcgcatctggaacagctgggatcagtagtggaagaggtttcgatgccttcattttctcttggcttaccagcatattacatactggcctcttctgaagcctcatctaatttgtcacgctatgatggcatcaggtatgggcagcaggtttcagctgatgacttgaatgagatgtatggagattcccgggctaatggtctcggtcatgaggtcaaaatgagaattttgatgggcacctatgcattatctgctggatactatgatgcatactacaagcgagcgcaacaggtgaggacgctggttaagaaaagcttcgaagaagctttgggaaaatacgatattcttatttcacctgctgctccatcagcagcctacaagataggtgaaaagacaaatgatccattagctatgtacgctggagacatcatgacggtgaatgtgaacatggctgggcttcctgcattggttgtgccttgtggattcgtcgaaggtgggtcngcnggtctcccagtcggncttcagatgatnggatctcccttcagtgaggggaanttgctgnnagtaggccacatcttcgaacaaacgctgcaggatctcagttttgttccaccactgctggcngatggctagccagccgcatcggccccttcctttctgtctttggtttagagcggttttctgcaagcagttcatagggctacgtgggtttagagggccctcttttcattcattcctaaagttttgagatatatgtttcatttcatggttgtatgccgaggaagctggttgtacacatgtttcccccgtgggagtcagcagttggggaccgagtctgggacgccatgtgcacatgtgtaactcctgcaatgcagcattcaatatgggccgacatcgatgacatnttttttgtaancctggttcacatcagtgatattttgcaaatccttttgattgattgactgataatagtgcaagctgttcatggcttcatnncnnnngcntnntngtg

SEQ ID NO: 1152 - DNA, 1818 bp, Panicum virgatum
catcctctccatccgcgagtcgctgctctcaggtgagaggaccgcggcggacatcacatccgagtacctctcccgcctccgccgcaccgagccgagcttgcgtagcttcatccacgtcgccgacgccgccgcagagcgggaggcggaggagctcgaccggaggattgcctccggggagaaggatgcggtggggccgctcgctggagtgctggtgggagtcaaggacaacctctgcaccgccaacatgccctccactggcgggtcgcggatactggacggataccagccggcatacgacgccacggcggtgcggcggctgcgggatgctggcgccattgtggttgggaagacgaacctcgacgagttcggcatggggagcaccaccgagggctccgcgtttcaggtgacaacaaacccgtgggatgattcacgtgttcccgggggatcctctggtggttctgcttctgcggtttctgctaggcaatgtgtagtgtcactaggaagtgatacaggtggaagtgtgagacagccggcatcattctgtggcgtagtggggttgaaaccaacttatggtcgtgtatctcgttttggcctcatggcctatgcttcatcgttggatgttgtgggatgcttaggttcatctgtttttgacactgcaaccatcttatctgttgttgctggccatgacaagatggattcaactagcagttcgcaggatgttccagactatgtatcagagttggtctctctagatttacttgaatcaaaaccactaaatggtttgagaattgggattatacaagaaactcttggagaaggtgtggatactggagtcatatcgtcaatcaaggatgctgcttcacacctggaacacttgggatctgtggtggaagaggtttcactgccttcattttctcttggcttaccagcatattacatactagcatcatctgaagcatcttctaatctatcacgctatgatggtatcaggtatggaaggcaggtttcagctgatgacctgaatgagatttatggagagtcccgtgctgatggtctgggtcatgaggtcaaaatgagaattttgatgggaacctatgccctttctgctgggtactatgatgcatattacaaacgagcacaacaggtgaggacactggttaaggaaagcttcaaaggtgctttggaaagatatgacattcttatttcaccagctgctccatcagcagcctacaaaataggtgaaaagataaatgatccattagcaatgtacgctggagatatcatgacggtgaatgttaatttggccgggcttcctgcattggttgtgccttgtggatttgttgaaggtggagctgcagggctcccagttggactacagataatcggatctccattcagtgagggaaatttgctgagagtagggcacatctttgagcaaacactgcagaatttcagttttgtccctccgttgttggccgaacgctagctgcaatataggattctctgccctactctgagttatcaaacaagcaattaccagagtcacgggttttgaaggcccatttgtccattcttacaagttttgagacatgtcatgtgttatactgaggaaattggctgcacgcatgtagaatttagatattttcctcgtggaattgctgatgattgagtgaaacagacagcgacacccatgtgagcgagttctgccgtactacgaggcaagatcagcaatttgaatatgcaaatgcttgaccattagtttcggccaatggtcggcatagctgggaagctaataaaacatgatctcctttgacaaaa

SEQ ID NO: 1153 - DNA, 1716 bp, Oryza sativa
acctccttcccctctccacgcctcatctgctgcgccccaaaaccccgaacccccacactcacgcgcggcggcgttcgccggagagcctcccctccggccgccgccatgccgccgcctctccaggcccagcgcctcctcctgtcccaccgacgcctcccttctccccacctccgctgcttcaccgccgtctcctccctcccgtccgctcccgccaagacggtggcggccgcggcggcccacgccccctcctccatcctctccatccgcgagtcgctcctctccggcgagaggaccgcggcggagatcaccgcggaatacctctcccgcctccgccgcaccgagccgagcgtgcgcagcttcatccacgtggcggacgccgccgccgagcgggaggcggaggagctcgaccggaggattgccaccgaggggctggatgcggtggggcctctggccggggtgctcgtcggcgtgaaggacaacctctgcaccgccaatatgccctccacaggtgggtcgcgaatactggacggttaccagccggcgtacgatgccactgcggtgcggcggcttcgtgaggcgggcgccattgttgtggggaagactaacctagacgagttcggcatggggagcactacagagggctccgggtttcaggtcacaacaaacccttgggacgattcacgtgtgcctgggggatcctcaggtggttctgcttctgcggtctctgctagacaatgtgtggtatccttagggagtgatacaggtggaagtgtgagacagccagcatcattttgtggtgtggtagggttaaagccaacctatggccgggtttctcgtttcggcctcatggcttatgcttcatcactagatgttgtgggatgctttggttcatcagttgttgacactgcgacaatcttgtcagtaattgctggccatgacaaaatggattcaactagtagctctcatgatgtttcagactataaatcagagttggtcccactagatttgctagaatcaaaaccattaaatggtatgagaattggaattattcaagaaactcttggtgagggtgtagaaactggagtcatatcatcaatcaaggatgctgcttctcacttggaacaattgggatcagtggtggaagaggtttctctgccttcattttctcttggcctacccgcatattacatactggcttcatctgaagcctcttctaatctatcacgttatgatggtatcaggtatgggaggcaggtttcaggcgatgacttgaatgaactttatggaggttcccgggctaacggtctgggtcacgaggtcaaaatgagaattttgatgggaacttatgctttatctgctggatactatgatgcatactacaaacgagcacaacaggtaaggacactggttaagaaaagcttcaaagaagctctggaaagatacgatattcttgtttcacctgctgcgccatcagcagcttacaagataggtgaaaagataaatgatccattagctatgtatgcaggagataccatgacggtgaatgttaatttggctggtctccctgcattggttgtgccttgtggatttgttgagggtggatctgcggggctcccagttggacttcagatgattggatcccccttcagtgagcttcatcagtggacagtggttatggaaaatggccttggttttgataaatttgaactgtcataa

SEQ ID NO: 1154 - DNA, 1869 bp, Brachypodium distachyon
atgaaactagctgatatcaatgaggcctatttgagccaggtcacccctatcgacacaaaatgttatgtctcttccctcccatccgcccccgccaagaccctggccccgggcccgggcccctcctccatcctctccatccgcgagtcgctcttgtccggcgagaggaccgcggccgacatcactgccgagtacctctcccgcctccgccgcaccgagccgatcgtgcgcagcttcatccacgtggcggacgccgccgccgagcgggaggcgcaggagctcgaccggaggatcgcgtcgggtgggcaggatgcggtggggccgctcgccggggtgctcgtgggcgtcaaggacaacctctgcactgccaacatgccctcgactggcgggtcgcggatactggatgggtaccagcctgcgtacgacgccacggcagtgcggcggctgagggaggcgggcgccattgtggttgggaagactaaccttgacgagttcggcatggggagcactaccgagggctctgggtttcaggtgacaacaaacccttgggatgattcccgtgtgcctggtggatcctcaggtggttctgcttctgctgtttctgctagacaatgtgtggtgtccttagggagtgatactggtggaagtgtgaggcaaccagcatcgttttgtggtgtagttgggctaaagccaacttatggacgtgtatctcgttacggactcatggcttatgcttcatcactggatgttgtggggtgctttggatcatcagttgttgacactgcaaccatgttgtctgtcattgctggccatgacaagatggattcaaccagcagctcacatgatgttccagactatagatcagacttggtgtctctaaatttactagaatcaaaaccattaaataatctgagaattgggattattcaagaaactcttggagacggtgtggacactggagtcatatcatcgatcaaagctgctgcttcacaccttgaacaattgggatctgtggtggaagaggtttctctgccttcattttctcttggcttaccagcatattacatactggcctcttctgaagcgtcatctaatctgtcacgctatgatggtatcaggtatggaaggcaggtttcggctgatgacttgaatgagctttatggagattcccggtctaatggtctcggtcatgaggtcaaaatgagaattttaatgggaacttatgcattatctgctggatactatgatgcatactacaaacgagctcagcaggtgaggacgctggtgaagaaaagcttcgaagaagctttgagaagatatgacattcttgtttcacctgcggctccatcagcagcctacaagataggtgaaaaggcaaatgatccattagctatgtacgctggagatatcatgacggtgaatgttaacttggctggtcttcctgcattggttgtgccttgcgggttcgtcgatggtggatctgcaggtctccctgttggacttcaaatgattggatccccctttagtgaggggaatctgctgagagtaggtcacatcttcgaacaaacgctgcaagatttcagttttgtcccaccactgttggcagatagctagatgcattgttgcatttcttcaactactctgcgagcagttcctacagctactggttttgaaggtcctcctattcattcctgaagcgattctgcagacaactgctctgcacacatggaatattggttcacaccaaccaatgatagttttgtaatctttttgattggtcaataatagtacggcttgttaatggcttaatgtgcatcacgtcgtgtgctgttcgttgaactattctttttgaaacagtcaactcaggcaact

SEQ ID NO: 1155 - DNA, 1902 bp, Sorghum bicolor
cactgtgcggatctgtaaccggtagtgcgtttccactttccacttcctccttcccagttcatccacggcagaggaattaatcaactgcacagctgcattcctcaatcctaacccctcaatcttccgttcccaagtccaactgcgtttcttcctccgcgtcttcaaggaggggagacctgaaggagaaacgaatccagcctggtggctgccggtgctggagctgggcgctgctgcatactgcgtaggcaagagcaggcaatggcggaggcgaatacggggaaggagaagaaggaagtggtgcggctggagcgcgagtccgtgatccccatcatgaagcccaagctcatcatgaagctcgcctacctcatcgaacatcaatccgacaaagaagaattcttaaagctctgcaagagggttgagtacaccataagggcttggtaccatctccagtttgatgatatgatggaactgtttgctctctttgatcctgtgcatggtgctaaaaaactccagcagcagaacttctcatctgaggagatcgatatgcttgagcagaacttcttgtcctatttctttcgggtgatggaaaagagcaattttaacatagtaaatgaagatgaggttgaacttgctcattctggacaatatctgttgaatcttcccattaaagttgatgaatcaaagttagataacaagcttctgtcgaagtattttaaggagcaccatcatgaaaacctacctgacttcgcggataagtatgttatatttcgcaggggcattggattggaccgcactagcaactttttcttcatggagaaagtggacatgatcatagctcgtgcgtggcgagggttccttgagaaaacaagactgcaaaagctcttctcaagaaagaaaaatactaagccaaagatagattccaagaagaatgatgatttagctagtgaagtagaagacaaggagctttatgttgaacgcatacgactcgaaacaatgaagttaagctttcagaatttaatcggcaaggtcacaattcaagagcctacatttgaagaggtgattgtcttgtataggagaaaaactccaaagggacaggatgatagagcaattcatgtaaaacacttcaaaaatattccaatggcagatatggagttggttctgcctgagaagaaaaacccaagcctcacaccaatggattgggttcagtttattgtttcagttgtcattggacttgttacactcatcagctcattggaaatgcctaaagctgatttctgggttgtagttgccatcctttctgctctggcaggatattgcgctaagatctatttctcgtttcaacagaacatggcaacctaccaaaacctaatcactcaatccatgtatgacaaacaactagatagtgggaaaggcacactcttgcatctctgtgatgatgtgattcaacaggaggtcaaggaggtcataattgcctactatattttgatggaaaatggaaaggctaccagtgatgaccttgacttgcaatgcgaggagttaatccaggaagagtttggcttgcaatgcaattttgaggtgatggatgctgttcaaaagctggagaggcttggtatcattacaagagattctattggaagaatttgctgtgttcctctaaagcgtgccaatgagatcatcggcgccacaacagaagagctggttatgaaagccaggcaaagctagcaatcgtatttgaataatgtaaccgcattgtaaattcttgcctgatggcactgtaacgtttaccgtttacggtaccccagaaagtcctaacactgaactcttgcatatcaggtggtaaatacattctggtcgtctccacacacagtaattctccagtgaaagctaccagaaatgtggttg

SEQ ID NO: 1156 - DNA, 2262 bp, Oryza sativa
gggtccctcgcttccctcgtgccgggcgccgtctgggctgggaggaagacgacgacgacggcgcgtggatctatctgtaaccgcaatgcgctccattcctctccatctcgcgataattaatcgcgatttgcaccgctcaaaattccgatctgcgtttctcctcctctccaaatctccgcgtttcttcttcttccgcagcaacggatcgaggaggacacgagagattgcggcggcggctgtggcattagcttgatactggggcaatggcggaggcggaggcggggaggaaggagaagaaggaggtggtgcggctggagcgcgaatcggtgatccccatcatgaagcccaagctcatcatgaagctcgcctacctcatcgaacaacaatctgacagagaagaattcttgaagctctgcaagaggattgagtacaccattagggcctggtatcatctccagtttgatgatatgatggaactatttgctctttttgaccctgttcatggtgcccaaaaactgcaacagcagaatttctcgactgaggaagtcgatacactcgagcagaacttcctgacctatttctttcaggtgatgcaaaaaagcaatttcaacatattatcagatgatgaggttgagcttgctcattctggacaatatctgctgaatcttcccatcaaagttgatgaagcaaagttagataacaaacttttgtcaaagtattttaaagagcaccatcacgacaacctaccggagttctcagataagtatgtcatattccggaggggcattggactggatcgcactagcaactttttctttatggagaaagtggacatgatcatagctcgtgcgtggcgatggttcttggagaaaacaagactgcaaaagctcttctcaagaaagaaaagtgttaggccaaagacagattccaagaagaatgatgatctagttggtgaagaagaggacaaggagctatatgttgaacgcatacgacttgaaacaatgaatttgagcttgcgcaacttaattggcaaggttacaattcaagagcctacatttgaagaggtgattgtcttgtacaggaggaaaagccctaagggccagaatgatagatcaattcatgtaaagcacttcaaaaatattccaatggcagatatggagctggttttgcctgagaagaaaaatccaagcctcacaccaatggactgggttcagtttattgtttctgttgtcattggacttgttacacttgtcagttcgctcgaaatgcctaaagctgatttctgggttgtagttgccgtcctttctgccctggctggatattgtgccaagatctatttatcgtttcaacagaacatggcaacatatcaaaacctaataactcaatcaatgtatgacaaacagctagatagtgggaaaggcacacttctccatctctgtgatgatgtgattcagcaggaagtcaaggagattataatttcctactatattttgatggaaaatggaaaggcgactattgaggatcttgacttacaatgtgaagagttaatccaagaagagtttggcttgcaatgcaattttgaggtgatggatgctgttcagaagttagagaggcttggcatcattacaagagattctattggaagaatatgctgtctatctctgaagcgtgccaatgagatcattggcgctactacagaagagctggttatgaaggccagacaaagctagttatccaattctatttgaaccagtttaggggggcaataggtcctggacggctgcggaataattctccgatggaagttgagcagatatgctattgttgttctgttgtaggacctgctgtattatgcaatgtttaatgcatgttgtaagaaatttagtttcttcttggaacaaaatgtggaaagatttcagtaaaaaaaaatgtggaaagaggttcatgaactgctgccttgtttgttcagttaatgaatactcctacaagaaatgcagcagcctgctaactcaaggcacaagagccaagtatgacgcataaaaagcatactgaagcagtgaaaaagcgctgctgatggtgcactgtatctcagccactgaatcagtgacgtccgacacagtgacactgggttgctggttctttttctgctcttttcatttacaaatcatgtcctcatgttgcagttgtcttttccttgtctctcctgatgtgtaaaacacaaggctctgtgcttgctgttgctaacaattcagattcatcaga

SEQ ID NO: 1157 - DNA, 2318 bp, Brachypodium distachyon
gttggatctgtaaactgcaaatgcgtttctttccacgccggccataattaatccaacgcgttgcgccgagccgttccaattcgtgtcgtcgtcttcctcgccaatccgcgaatcccctgttcctcctgcgctgcgccgcaggaagaatccacgccggagacgacgtggcggcgttggtgggggtagctagacaagaaggcaatgccggcggcggcggcggcggaggcgaagatggggagggacaaggaagtggtgcggctggagcgcgagtcggtgatccccgtcatgaagcccaagctcatcatgaagctcgcctatctcattgaacgcgagtccgacagggaagaattcttgaagctctgcaagagggtggagtacaccattagagcttggtaccatctccagtttgatgatatgatggaactgtttgctctcttcgaccctgtgcatggtgccaaaaagctgcagcagcagaacttttcttctgatgaagttgatatactagagcagaacttcctgacctatttctttcaggtgatgcaaaaaagcaatttcaacatagtatctgatgatgaggtcgaacttgctcattctggacaatatctattgaatctgccaataaaagttgatgaagcaaagttggataacaaacttttgacaaagtattttaaggagcaccatcatgacaatctaccagagttctcggacaagtatgtcatatttcgaaggggcataggactggaccgcactagcgattttttcttcatggagaaagtggatatgatcatcactcgtacatggcgatggctcctagagaaaacgagactgcaaaagcttttcttgagaaagaaaaaggacagaccagtgatagagtccaagaaggatgatgatctagttggtgaagaagacaaagagctatatgttgagcgtatacggatggaaacaatgaagttgagcctgcggaacttaattggcaagatcacaatccaagagcctacatttgaagaggtgattgtcttgtacaggaagaaaagtccgaagggccaggatgatagagcaattcatgtaaagcacttcaaaaatattccgatggcagatatggagttggttctgcccgagaagaaaaacccgagcctcacaccaatggactgggtccaattcattgtttctgttgttattggacttgttacactcattggttcacttgaaatgcctaaagctgatttctgggttgtgattgccatcctttctgctctggctggatattgcgctaagatctatttttcgtttcaacagaacatggcaacctatcaaaacctgatcacccaatcaatgtatgacaaacaactagatagtgggaaaggcacacttctgcacctctgtgatgatgtgattcagcaggaagtcaaggaggtcataatttcctattatatattaatggaaaatggaaaggctactatcgaggatcttgatttgcaatgtgaagagctaatccaggaagagtttggtttgcaatgcaactttgaagtgattgatgctcttcaaaagttagagagacttggtattgttacaagagattctattggaaggatctgttgtcttcctctaaagcgatccaatgaaatcattggtgctactactgaggagctcgttatgaaagccagacaaagctagtaaaagtaaatgtcaatgtgaaccagaagcaagcaagggtgtggagatgaggggaggcacagagtttgggggtgcgataatgagcatcagcttggtgtccgccatttctgcagcagccaccactgctcgtcctcgtcatggtgcagtgaagcagcagctgagcataaaggtgaagccacagcagaagcatgctggctgctgggaaagcagtggcaatggcagggcagtggtggcgagggccgggccggggccactgacggagattgagccggacctgcaggaggaccccatcgacaagtggcgtaccaacggcgtcagcccggaggactttgtctacggagtttatgatggccaccacacctatgatgaaggccaagaaaagaagggcttctgggaggaagtaggtgagtggtaccaagaagctgagcctcctcagggcttccaagcattcatctcctggtcatttcctcctgcagtcatccttggcatggctttcggtgtgccggggccggtcacgtcggctagatgcagttgaagatgatatgtaggacataaacatttcctaaggaaaccatggatgacatagcaccacgaaaaagatcttttaaataaagctggaataggaaaggctcattttctatggt

SEQ ID NO: 1158 - DNA, 1431 bp, Sorghum bicolor
cgtcgttggcgtcggcgcctgcgtttcgttcctcttcttccctccatcagcagcatcacctcgctgcgctcgggttccatttccatttgcttcgtctcggtcacctcagatcagatcaagggacgggacgccagcccacctgccaccctcctccttcgctccctccctcccatcccagatcccccaccccagccatggccaccgccttcgagtccccgacctcctcccccgccgccgcgcccttccacgacgaccctttcctccacttcgacggctcggcccccgccgccgacggcttcccggcctccccggacgcctatgcgccctcccccttcggcatgccccactccaacggcgacctccacgacgaccctttcgccgcacccgctgactccaacggtgggcccatcctcccgccgcccaccgagatggggcgcgaggagggattcctgctccgcgagtggcgccgacaaaatgctatccaccttgagaaaaaggagaagaatgagaaggagctgaggagccaaatcatcgttgatgctgaagagtttaagaaagcttttgttgagaagagaaagctcaatgttgagacaagcaagggccaaaaccgtgacagggagaagcttttcctagcaaaccaggaaaagttccatgctggtgcggataagcagtactggaaggcgatatcagaacttatcccacatgagattgctaacatcgagaagagaggggcaaggaaagataaggagaaggaaaagaagcctgggatcgtggtgatccagggcccaaagcctgggaagccaacagacatggcacggatgcggcagatattgctgaagctgaagcacactcccccaccacacatgaagccacccccgccacctgctgcagccactggaaaggatggagcaccagctgctgctggaaaggatggagctaagccagcagcccctgccaatggcagtgtccctgagatggaaaaggccgccgcggtggcaccagtgcctgcagcagcaccaccagcagcaactgagccgattgcagctgcctaatctaatcatttatggtaggaggatgtgaaaaatctcttatttagagttgttgcagaggcggtggtggtgaaactgaaaacgtgtgaatttccggcatggtggagacatgcactgtgtatttgttaaggcacctcgattcatttacattactatatatttttattgcattttgtagagaagggcatgtgtatcctggttcatggtaataataaggttgtattaggaggatgtatgttttggtggctgtattatgtttcttcttccaagtgttggaaattttcctttgttataaaaactgattgtattgttctgctactatctgctgcatatatggagtatatttttgtgcattttgatctatctgagctagggatgcttg

SEQ ID NO: 1159 - DNA, 1348 bp, Saccharum officinarum
gacaagagcgactcttcttccaacatcagactcacctcgctcgccgctcgcgttccattgggatttgcttcggctcacctcagatcgagggacgctaggccacctgccactcacctccctcccatcccagatcccccagccatggccaccgccttcgagtccccgacctcctcccccgccgccgcgcccttccacgacgaccctttcctccacttcgacggctcggcccccgcccccgccgacgtcttcccggcctccccggacgcctacgcgccctcccccttcggcatgccccactccaacggcgacctccacgacgaccctttcgccgcacccgctgactccaacggtgggcccatcctcccgccgcccaccgagatgggacgcgaggagggattcctgctccgcgagtggcgccgacaaaatgctatccaccttgaggaaaaggagaagaaggagaaggagctgaggagccaaatcattgttgatgctgaagagtttaagaaagcttttgttgagaagagaaagctcgatgctgagacaagcaagggccaaaaccgtgacagggagaagcttttcctagcaaaccaggaaaagttccatgctggtgcggataagcagtactggaaggcgatttcagaacttatcccacatgagattgctaacatcgagaagagaggggctaggaaagacaaggagaaggagaagaagcctgggatcgtggtgatccaaggcccaaagcctgggaagccaacagacatggcacggatgcggcagatattgctgaagctgaagcacactcccccatcacacatgaagccacctccgccacctgctgcagccaccggaaaggatggagcaccagctgctgctggaaaggatggagctaagccagcagcccctgccaatggcagtgtccctgagatggaaaaggccgctgtggcggcaccagcgccggcagcagcaccaccaacagcaactgagtcgatcgcagctgcctaatctaatcatttatggtaggaggatgtgaaaaatctcttattagagttgttgcagaggcggtggtggtgaaactgaaaaacgtgtgaatttccggcatggtggagacatgcactgtgtatttgttaaggcacctcgattcatttacattactatatattgttattgcattttgtagagaaggggcatgtgtatcctggttcatggtaataataaggttgtattaggaggatgtatgttttggtggctgtattatgtttcttcttccaagtgtttggaaattttcctttgttattaaaactgattgtattgttatgctactatctgctgcatatatggagtatatttt

SEQ ID NO: 1160 - DNA, 1276 bp, Saccharum officinarum
  misc_feature (1235)..(1235): n is a, c, g, or t
cctcagatcgagggacgctaggccacctgccactcacctccctcccatcccagatcccccagccatggccaccgccttcgagtccccgacctcctcccccgccgccgcgcccttccacgacgaccctttcctccacttcgacggctcggcccccgcccccgccgacgtcttcccggcctccccggacgcctacgcgccctcccccttcggcatgccccactccaacggcgacctccacgacgaccctttcgccgcacccgctgactccaacggtgggcccatcctcccgccgcccaccgagatgggacgcgaggagggattcctgctccgcgagtggcgccgacaaaatgctatccaccttgaggaaaaggagaagaaggagaaggagctgaggagccaaatcattgttgatgctgaagagtttaagaaagcttttgttgagaagagaaagctcgatgctgagacaagcaagggccaaaaccgtgacagggagaagcttttcctagcaaaccaggaaaagttccatgctggtgcggataagcagtactggaaggcgatttcagaacttatcccacatgagattgctaacatcgagaagagaggggctaggaaagacaaggagaaggagaagaagcctgggatcgtggtgatccaaggcccaaagcctgggaagccaacagacatggcacggatgcggcagatattgctgaagctgaagcacactcccccatcacacatgaagccacctccgccacctgctgcagccaccggaaaggatggagcaccagctgctgctggaaaggatggagctaagccagcagcccctgccaatggcagtgtccctgagatggaaaaggccgctgtggcggcaccagcgccggcagcagcaccaccaacagcaactgagtcgatcgcagctgcctaatctaatcatttatggtaggaggatgtgaaaaatctcttattagagttgttgcagaggcggtggtggtgaaactgaaaaacgtgtgaatttccggcatggtggagacatgcactgtgtatttgttaaggcacctcgattcatttacattactatatattgttattgcattttgtagagaaggggcatgtgtatcctggttcatggtaataataaggttgtattaggaggatgtatgttttggtggctgtattatgtttcttcttccaagtgtttggaaattttcctttgttattaaaactgattgtattgntatgctactatctgctgcatatatggagtatatttttgttc

SEQ ID NO: 1161 - DNA, 1305 bp, Panicum virgatum
tcgactcgacgcggcatcccattccctcctccgacagctcagctcaagatcaccttctcttccctgcagctgcagtccagcagcaggatccagatcccgaggggccatggccaccgccttcgactcccccacctcctcccccgccgccgcgcccttccatgacgacgccttcctccacttggacggctcggccgccgcagccgacgccttcccggcctccccggacccctacgcgccctcgcccttcggcatgccccaggccaacggcggcctccacgacgaccccttcgccgactccgacggtgggcccatcctcccgccgcccaccgagatgggtcgcgaggagggattcctgctccgcgagtggcgccgtcaaaatgcaatcctccttgaggaaaaggaaaagaaggagaaggagctgaggagccaaatcatccttgacgctgaagaatttaagaaagcttttgtcgagaagcggaagctcaatgttgagacaagcaagggccaaaaccgtgacagggagaagcttttcctagcgaaccaggagaagttccatgctggtgcggataagcagtactggaaggcgatatcagaacttatcccacacgagattgccaacatcgagaagagaggggcgaggaaagataaggagaaggagaagaagcctgggatcgtggtgatccagggcccaaagcctgggaagccgacggacatgtcacggatgcggcagatattgctgaagctgaagcacactcctccgccacacatgaagccgcctccgccacctgcagcagctgctgggaaggacggtgccccggctgccgctgcaaaggatggagctaagccagcagcacctgccaacggaagtgttccagagatggagaaggccgcggcagcggcgcctgcaccagcaactgaacctatcgcggctgcctaagctaattgtttgcggtaggaggatagagttgttgcagaggaggtggtgttggtgaaactgaaagctcatctgaatagccgccggcatggcggaggcacctactgtgtattttgttaaggcacctttgattcattacattattattacaatattgttattgcattttgtagagaggtgggatgtgcattctggtactaataaggtaaatgaggctgtagtaggaggatgtgtggctatggtttcgtcttccaagtgtttgggattttcctttgttcaaattggttgtattattacgtgactataaatctgctgcatatatatatcattggtgtttcatctatctttatatatatatattcttatttctc

SEQ ID NO: 1162 - DNA, 1281 bp, Panicum virgatum
tcccttcccttctccgacagctcagctcaagatcaccttcccctccagtcccggatccagatcccgaggggccatggccaccgccttcgactccccgacctcctccccggccgccgcgcccttccatgacgacgccttcctccacgtggacggctcggccgcctcagccgacggcttcccggcctccccagacccctacgccttcagctccgacgcaccctcgccctttggcatgccccaggccaacggcggcctccacgacgacccgttcgccgactccgacggtgggcccgtcctcccgccgcccaccgagatgggtcgcgaggagggattcctgctccgcgagtggcgccgtcaaaatgcaatcctccttgaggaaaaggaaaagaaggagaaggagctgaggagccaaatcatccttgacgccgaagaatttaagaaagcttttgtcgagaagcagaagctcaatgttgagacaagcaagggacaaaaccgtgacagggagaagcttttcctagcgaaccaggagaagttccacgccggtgcggataagcagtactggaaggcaatatcagaacttatcccacacgagattgctaacatcgagaagagaggggcgaggaaagataaggagaaggagaagaagcctgggatcgtggtgatccagggcccaaagcctgggaagccgacggacatgtcacggatgcggcagatattgctgaagctgaagcacactcctccgccacacatgaagccacctccgccacctgcagcagctgctgggaaggacggtgccccggctgccgctggaaaggatggagctccggctgccgctgccaaggatggagctaagccagcagcccctgccaacggcagtgttccagagatggagaaggccgcggcggcagcagcgcccgcaccagcagctgagcctatcgcggctgcctaagctaatcatttgcggtaggaggatagagttgttgcagaggaggtggtgttggtgaaactgaaagcgcgtctgaatcgctggcatggccggaggcacctagtgtgtattttgttaaggcacctttgattcattacattactacaatattgttattgcattttgtagagaggtgggatgtgtattctggtacaaataaggtaaatgaggctgtattatggtttcgtcttccaggtgtttgggattttcctttgttcgaattggttgtattattacgtgactatatctgctgcatatatatgtactttatgcttccttggtgtttaaaaaaaaaa

SEQ ID NO: 1163 - DNA, 1375 bp, Setaria italica
aggtcagatcaagctgcgcacacccaccaggccaccaccaccttgccgaggatccagatcccgagggggccaagccatggccaccgccttcgactcccccacctcctcccccgccgccgccgcgcccttccatggcggcgacgccttcctccacttcgacggctcggccgacgtccacgcctccgccgacggattcccggcctccccggacccctacgccttccgctccgacgcgccgccctcgcccttcggcatgccccaggccaacggcggcgccgtccacgacgacgaccccttcgcccctgactccaacggtgggcccatcctcccgccgcccaccgagatgggccgcgacgaggggttcctgctccgcgagtggcgccgtcaaaatgcaatcctccttgaggaaaaggaaaagaaggagaaggagctgaggagccaaatcatccttgatgctgaagaatttaagaaagctttcgttgagaagcggaagctcaaccttgagaccagcaagggtcaaaaccgtgacagggagaagcttttcctagcgaaccaggagaagttccacgccggcgcggataagcagtactggaaggcgatatcagaacttatcccacacgagattgctaacattgagaagagaggggcgaggaaagataaggagaaggagaagaagcctgggatcgtggtgatccagggcccaaagcctgggaagccgacggacatggctcggatgcggcagatattgctgaagctgaagcacactcccccgccacacatgaagccacctccaccacctgcagcagccgccggcaaggatggtgcgccagctgctgctggaaaggacggagctccagctgctgctgcaaaggatggagcaaagccagcagcccctgcgaacggcagcgtccctgagatggaaaaggccgcgggggcagcacctgcaccagcaactgagcctatcgcagctgcctgagctaatcatttgcggtaggaggatagagttgtttcagaggaggcggtggtgaaagtgtctgaattgctggcatggctgaggcacctactgtgtattttgttggggcaccttgattcattacattacattactactatatattgttattgcattttgtagagaggtgggatgtgtgtatcctggtattaataaggtaaaatgaggatgtgtgtactatgttcctgtcttccaagtgtcttgagattttgttcaaactggttgtattacgtgacgatctgctgcatatgtatattttgtgcttccttggtttttcgatcaatttcatttaccgtctattttatctgtctgtattgctcctaaccatctgtgctgtaacatttcatctattctatatcttgc

SEQ ID NO: 1164 - DNA, 1269 bp, Pennisetum glaucum
gggagcacaaaatatacatatgcagcagatagatagtcacgtagtacaaccagtttgaacaaaatctcaaaacacctgcaagacaggaacacagtacacaacatcctcatttaccttattaataacaggatacacacgtcccacatctctacaaaatgcaataacaatatatagtagtaatgtaatgtaatgaatcaaggtgcctcaacaaaatacacagtaggtgccctctcagccatgccagcaattcagacactttcaccaccaccaccacctctgcaacaactctatcctcctaccgcaaacaattagctcaggcagctgcgataggttcagttgctggtgcaggtgccgccacggcagcggccgcggccttttccatctcagggacgctgccattggcaggggctgctggctttgctccatcctttgcagcagcagcagcagcagcagcagctggagctccatccttgccggcggcagcatccttgccagctgctgctgcaggtggcggaggtggcttcatgtgtggcggtggagtgtgcttcagcttcagcaatatctgccgcatccgtgccatgtcagtcggctttccaggctttggtccctggacaacaacgatcccaggcttcttctccttctccttatctttcctcgcacctctcttctcaatgttggcaatctcatgcgggataagttctgatatcgccttccagtactgcttatccgcgccggcatggaacttctcctggttcgctaggaaaagcttctccctgtcacggttttgacccttgctggtctccaggttgagcttccgcttctcaacaaaagctttcttaaattcttcagcatcaaggatgatttgggtcctcagctccttctcgttcttttccttttcctcaaggagaattgcattttgacggcgccactcgcggagcaggaatccctcgtcgcggcccatctcggtgggcggcgggaggatgggcccaccgttggagttagcagcggcgaaggggtcgtcgtggacggcgccgttggcctgtggcatgccgaagggcgacggcgcgtcggagcggaaggcgtaggggtccggggagggcgggaatccgtcggccgaggggtggacgtcggcggaggcgtcgaagtggaggaaggcgtcgtcgtggaagggcgcggcggcgggggaggacgtgggggagtcgaaggcggtcgccatggcttgggccctcgggatctggatcctcctggccgcggcctcgctgggggtgg

SEQ ID NO: 1165 - DNA, 1275 bp, Sorghum bicolor
aatccatccaaccaacttcaaccaccttttcaatccaatcttgttgcattgcattgcataattttgcatcgaagatcgatgtgattccgtgaaaaggaggaggaggagaagaaggggctgaggccgaatccgattccgccgatgagaaggcgagcgatggcgaggctggcggtggccgcgagggcgttctccgcctcggcttccggcgcgggcgccggcggcgtgtccatggtgcagggggcgtcccggggcatcggcctcgagttcgtgcggcagctgctgcggagaagcggcgaaggccgcgtcgtcgccacgtgccgcgcgccgggttccgcggccgagctccagaagctcaaggaggagcacgcgccggggcgcctcaccgtgctgccgctcgacgtcaccgacgagaacaccatagaggcagccgcggcctcaattacagagacccatggttctctggacctgctgatcaactccaccggcatcctttcgatcccgaacgtgatacagccagagactacactaagcaaggttcagaagtcatccctgatgctggcatatgaggtgaatgcagtcggcccaatcttagtgatcaagcacatgtggccattgctgaaaattggaggtcgttccgagactgggagaggatttgcattggttgcaaatatgagcgctagagtcagttcaataggagacaatgctttgggaggctggcatgcatacagagcttctaaaacggcgctgaatcagttgaccaagactgtgtcagtggagtttggcaggaaggacaacattgcctgcatcctgctccatcctggaaccgtggacactgacctctcaaggccatttcagagaaatgtgcccaaggataagctcttcacaagagagttctctgtacagaagcttctctccatcattgacaacgtcaagaaaagcgacaacggcaagttcttcgcgtgggatggccaagaaatcccttggtgaatggtccctcaacactcgtttgagtctaaacaacgtcattgattttaattcgacgatgcttttttctgttcaacacgcattggtccttttcatgcttatcaaccaaacaaataaaacagtcacttgcccccggcagccataataacagattcgtcaaagtcagggagaatgtgacggtcaacaaagacaaagttaaagtcaaagtcaaagtactgttgactgatttgttatgagaaaaatagattcggatgatgaactcaaacgaattaactacatttgtttcaagcg

SEQ ID NO: 1166 - DNA, 1578 bp, Panicum virgatum
  misc_feature (1109)..(1109): n is a, c, g, or t
  misc_feature (1168)..(1169): n is a, c, g, or t
accgcctcttcaatccttgttgaattgctcggtcgctcgctcgtgccatgatctacgagagatcgtgaagggagtgaaggcgggcggggccgaatccgccgatgaggggaggaggaggagcagcgacggcgagactggcggtggccgcgagggccttctcctccgccggcggcggcgtggccatggtgcagggcgcgtcccgggggatcggcctcgagttcgtgcggcagctgctgcggaggcgcgaccagggccgcgtcgtcgccacgtgccgcgcgccgggctccgccgccgagctccagaagctcaaggaggagcacgcgccggggcgcctcaccgtgctgccgctcgacgtcacgacgagaccaccatagaggccgccgcgtcctcgatccaagagacccacggttctcttgactgctgatcaactccaccggcatcctttccatcccaaacgtgatacaaccagagactacactgagcaaagttcagaagtcatccctgctgctggcctatgaggtgaatgcagtcggcccgatcttagtgatcaagcacatgtggccattactgaaggttggaggtcgctccgagaccgggagaggattctcattggttgcaaacataagcgctagagtgagttcgataggagataatggtctgggaggctggcattcatacagagcttctaaaacggcgctgaaccagttgacgaagacagtgtcagtagaatttggcaggaaggacaacattgcctgcatcctgctgcatccaggaaccgtggatacagacctctcacggccattccagagaaacgtccccaaggataagctcttcacgagagaattctccgtgcagaagctcctctccatcattgacagcgtcaagaaaagcgacaacggcaagttcttcgcatgggatggccaagaaatcccttggtgactcgtgatcgctgtttcagccagcagtatacaggtcaacaatgagaacaatttttcttttttgcaaagtgttgtcctgttatcgaccattccacgtaatcgctccggattttccacaagcgcatgccaccacattcagaagtgagctgctgtagaacaggaagaaccacntgcgaaacatggcgataggtttttcattcactttccggctccatagaaaaagatgtganngtctgctgattagtgatgacgcaaattttattcaattttatttgagtcccttaattttgggagtttttctcattcatgatgatccatcaatctgctcttgacatgtgaaggcgtcgagagaagtcaatagtattatttagatattacccacctaatgcgtgtttgacccaaaaggaactggagaagagagaacacgttggttagaggcttggagccaccaatgaagactggtcatactgtgcgcagccttctctgcagccggtgcaatcatggttaggataacattttgataaataattactctgttaacattttgttcatctttgtatgttcataaggatatgttttttaattcaaatctaatggcaccaactctgtaaactatgtatttgtaaagtaactgtttgtt

SEQ ID NO: 1167 - DNA, 1211 bp, Pennisetum glaucum
gagccgcacgggcgccgccgccattactgcgcgcgatccaactccccacccacctctccaatccttgtggcattgaagcggggtcgagcccgaatccgccgatgagaggaggagcagcgatggcgaggctggcggtggccgcgagggccttctccgcctcgccctccgccggcgccggcgtggccatggtgcagggcgcgtcccgggggatcggcctcgagttcgtgcggcagctgctgcggaggagcgaccagggccgcgtcgtcgccacgtgccgcgcgccggcgtccgccgcggagctccagaagctcagggacgagcacgcgcccgggcgcctcaccgtgctcccgctcgacgtcaccgacgaggccaccattgaggctgctgctgcctcgattagggagacccatggtgctattgatctgctgatcaactccaccggcatcctttccatcccaaatgtgatacaaccagagactacactgagcaaagttcagaagccgtccctaatgctggcatacgaggtgaatgcagtcggccctatcttagtgatcaagcacatgtggccattactgaaggctggtggtcgctccgagaccgggagaggattctcattggttgccaacatgagcgctagagtcagttcgataggggacaatggtctgggaggctggcattcatacagagcttctaaaacagcactgaatcagttgacgaagacagtgtcggtggagtttggaaggaaggacagcattgcctgcattctgctacatcctggaaccgtggacactgacctctcacgcccatttcagaggaatgtccccaaggataagctcttcacgagagaattctctgtacagaagctcctctccgtcatcgacaatgtcaagaaaagcgataatggcaagttcttcgcttgggatggccaagaaatcccttggtgacttgagattgcccgtttcagtctacagcatattagtcaacacgaaaatatcagccacgcttttaacccaacatttttttagttgaaaaataataagccatgtcctttttaccgatacctttgggttattgcacatcttaagatgtacaagggcctcatgtgaaaggaagaatcgtaaaaacacaaaggttagttctcctttgtaattcgatttgagctacataggaataatgtattgtttgctgatggcacacaatttattgatgac

SEQ ID NO: 1168 - DNA, 1304 bp, Oryza sativa
atacgtgtgccttcatctagccacgcaattctcccccaaaatttcccccacaacaacgacccgccattactgcccctgtgcgcctcgcctcgccaccgaaccgccgcgagcacccggaggaagagaatcgaatcgaggcgagaggaggagcaatggcgacggcgaggacgctggcggctgcggcggcggcggcgagggcgttctcgttgacggcgacatccggcggcggcgtgtccatggtgcagggcgcgtcccgcggcatcgggctcgagttcgtgaggcagctgctgaagaggagcgacgagggccgcgtcgtcgcgacgtgtcgcgcgccggattcagccgtggagcttcagaagctgaggcaggagcacgagcagcgcctcgccgtgctcccgctcgacgtcaccgacgagagcaccatagaggcagctgcggcctcgataggagagacccatggatctctgaacctgctgatcaatgcaactgggatcctttcaattccgaatgtgatacatccagagactacatttagcaaagttcagaagtcatccctgctactggcatatgaagtgaacgctgttggccctattttagtgatcaagcatatgtggccattcctgaaggctggaggttgctctgagaccgggagaggattttcattggttgcaaacatgagtgccagagtcggttcaataggtgacaatggcctaggaggctggcattcatatagggcttctaaaacagcactgaatcaattgacaaagactgtatcagttgagctggggaaaaaggacaacattgcctgcatcctgctgcatccaggaaccgtggacactgacctctcacgcccttttcagaagaatgttcccaaggataagctcttcacaagggagttctctgttcagaagctactgtccatcatcgacaatgtcaagaagagcgacaacggcaagttcttcgcttgggatggacaagaaatcccatggtgatatcaatcagcacttcagcagagcaagtgagcaacagtgtccaaaatttgtgctcaatattttctcagcctttattgtgttgttggcaccaaatagatcgtgtcaatgctcgatttgaattctatttggatctacgatgatctgaacataacaaaccaaaatccattttcttttcgcttcctttttagatgcatacaaatgatcgatgtaactttcttttgccactggtggcacaacagttaacccagtgtaattagctgcaacgtattctgatggatgtatatgttgaaaaacttccagccaatttctcaa

SEQ ID NO: 1169 - DNA, 1168 bp, Hordeum vulgare
cagctcagggaccatgcgcgcgaatacgctcagagcagcaatggcgacggcgaggatggcgatgtcgctgccgtcgccggcaagagcgctctcgtccgcggccgccgcccctcccgcctccggcgtgtccatggtgcagggcgcgtcgcgcggcatcggcctcgagtttgtgaggcagctgctgcggaggagcgaccagggccgcgtcgtcgcgacgtgccgcgcccccgactccgccgccgagctccaggagcttaggcgggagcacgcggggcgcctcaccgtgctgccgctggacgtcaccgacgagagcaccatagaggccgccgcggccgcagttggggagacccacggatccctcgacctgctgatcaatgccgccggcatcctttcgatcccaaatgttatacagccagagacctcgttgagcaaagttcagaagtcatccctgctactggcatacgaagtcaatgctgtcggtcctattctggtcatcaagcacatgcgcccgttcctgaagatcggtgcgagcttggaaacagggaaaggtttctcgttggttgcgaatatgagcgctagggttggctcgataggggacaatgctctgggaggctggcattcgtacagagcttctaaaacagcactgaatcaattgacaaagactgcatcagtcgagttgggcaagaaggacaacatcgcctgcattttgctgcatccaggaacagtcgacaccgatctctcacggccgttccagagaaatgtggccaaggataagctcttcacgagggagttctctgtacagaagctcctgtccatcatcgacaatgccaagaagactgacaacgggaagttcttcgcttgggatggccaagaaattccttggtgaccactgaccactgttttccagtcagtgatcatttctaccctaattttcttcttcagaaccacctgtgtttatttttagccttaaactcaatgcctgaacccacctctagtaagatctctgatatgaaaagcatgtgaagtatatttcccttttctcccaaactacttgaaaattatgcatacatgatgtttagcgctgagtacaactttacaagttaaacttgtttccttgtatatgtataagcactggtgcctacagtctactaaattaagtacacacact

SEQ ID NO: 1170 - DNA, 1178 bp, Hordeum vulgare
cagctcagggaccatgcgcgcgaatacgctcagagcagcaatggcgacggcgaggatggcgatgtcgctgccgtcgccggcaagagcgctctcgtccgcggccgccgcccctcccgcctccggcgtgtccatggtgcagggcgcgtcgcgcggcatcggcctcgagtttgtgaggcagctgctgcggaggagcgaccagggccgcgtcgtcgcgacgtgccgcgcccccgactccgccgccgagctccaggagcttaggcgggagcacgcggggcgcctcaccgtgctgccgctggacgtcaccgacgagagcaccatagaggccgccgcggccgcagttggggagacccacggatccctcgacctgctgatcaatgccgccggcatcctttcgatcccaaatgttatacagccagagacctcgttgagcaaagttcagaagtcatccctgctactggcatacgaagtcaatgctgtcggtcctattctggtcatcaagcacatgcgcccgttcctgaagatcggtgcgagcttggaaacagggaaaggtttctcgttggttgcgaatatgagcgctagggttggctcgataggggacaatgctctgggaggctggcattcgtacagagcttctaaaacagcactgaatcaattgacaaagactgcatcagtcgagttgggcaagaaggacaacatcgcctgcattttgctgcatccaggaacagtcgacaccgatctctcacggccgttccagagaaatgtggccaaggataagctcttcacgagggagttctctgtacagaagctcctgtccatcatcgacaatgccaagaagactgacaacgggaagttcttcgcttgggatggccaagaaattccttggtgaccactgaccactgttttccagtcagtgatcatttctaccctaattttcttcttcagaaccacctgtgtttatttttagccttaaactcaatgcctgaacccacctctagtaagatctctgatatgaaaagcatgtgaagtatatttcccttttctcccaaactacttgaaaattatgcatacatgatgtttagcgctgagtacaactttacaagttaaacttgtttccttgtatatgtataagcactggtgcctacagtctactaaattaagtacacacacttgcagtggta

SEQ ID NO: 1171 - DNA, 1176 bp, Brachypodium distachyon
gttgcgttcgccattaatgcaacccagcccaaccgtgtgagaaggtggggaggaaggaagacgacgccattaggcccattacgcgcccggcggcgacagaagacagggagagggtgccggcgacggcggcggcgatgcgcgcgaacccgctcctcagatcggcaatggcgacggcggccagggcgttctcctcctccaccggccccgtcggcggcggcgtgtccatggtgcagggcgcgtcccggggcatcgggctcgagttcgtgaggcagctgctgcggcggagcaaccatggccgcgtcgtcgcgacgtgccgcgccccggagtcggcggccgagctccaggagctgaggcgggagcacgcgcggcgcctcaccgtgctgccgctcgacgtcaccgacgagaccaccatacaggctgccgcggcctcaattggggagacccacggatctcttgaactgctgatcaatgccgccggcatcctttcgatcccagatgttatacatccagagacctcactgagcaaagttgagaagtcatccctgctactggcatatgaagtgaatgctgtcggtcctattctagtgatcaagcacatgcgtccattcctgaagatcggtgccagttcggaaacagggagaggtttctcgttggttgcaaatatgagcgccagggttggctcgataggagacaatggtctgggaggctggcattcgtacagagcttccaaaacagcactgaaccaattgacaaagactgcatcggttgagttgggcaagaaggacaacattgcctgcattttgctgcacccgggaacagttgacactgacctctcacggccattccaaagaaatgtagccaaggataagctcttcactagagagttctctgtacagaagctcctgtccattatggacaatgccaagaagagcgacaacgggaaattcttcgcttgggatggtcaagaaatcccttggtgactacgatgtctgatatgagaagcacgtgaagtaattcccttttcctcatcatttttaagttttaactatttgaagattatgcgaataagaggtttgtgactgtgtaaaagtcaatctagtttcctaaaagatgtacaagcacctgctaagcactggtgcctactaaagtattgatgctacaaaattgacaccccat

SEQ ID NO: 1172 - DNA, 1039 bp, Triticum aestivum
cgctgtcgtcgccggcaagagcgctctcgtccgcggccgcgcaccctcccgcctccggcgtggccatggtgcagggcgcgtcgcgcggcatcgggctggagttcgtgaggcagctgctgcggaggagcgaccagggccgcgtcgtcgcgacgtgccgcgcccccgactccgccgccgagctccaggagctgaggcgggagcacgcggggcgcctcaccgtgctgccgctggacgtcaccgacgagagcaccatagaggccgccgcagccgcagttggggagacccacggatccctcgacctactgatcaatgccgccggcatcctttcgatccaaaatgtgatacagccagagacctcgttgagcaaagttcagaagtcatccctgctactggcatatgaagtcaatgctgtcggtcctattctagtcatcaagcatatgcgtccgttcctgaagattggtgcgagcttggaaacagggaaaggtttttcgttggttgcaaatatgagcgctagggttggctcgattggagacaatgctctgggaggctggcattcgtacagagcttctaaaacagcactgaatcaattgacaaagactgcatcagtcgagttgggcaagaaggacaacatcgcctgcattttgctgcatccaggaacagtcgacaccgatctctcacggccgttccagagaaacgtggccaaagataagctcttcacgagggagttctctgtacagaagctcctgtctatcatcgacaatgccaagaagactggacaacgggaattcttccgcttggggatggccaagaaatccttggtgaccactgttttccaagtcaagtgatcatctctaccccaattttcctcttcaagaaccacctgtgtgtccttttagccttaaattcaaatgcctgaaccaactctagtaagacaatgatatgaaaacatgtgaagtatattccctttcctctcactttaactacctgaaaattatgcatatatgatgttaaccctgagtacaactttaaaaaaaaaaaa

SEQ ID NO: 1173 - DNA, 577 bp, Zea mays
acgccgagcactccttctcctcctcctctgtcggcggtcgtgggagacgtacacggcgattaggaggcacgtcgtccaccagtctcctcgcagggatgtcgaagagcacggaaatcgcagataaagcaatcatcttgatgcaggatcatgccaagcatatctatcgtatttgcaatgagaagctaatattgggtaaaggattgactgcatttgaggtcaaagaacttcgtgaagcacttgaattcgccgccgaaggattggaccagggctcccttttttgccaagaggaattggatgcaactgttaaggaggaacaattggagcatgacgagaaggtggcttcacagatgattgaaagcccacttccttctcctgattcggactgcttcctatcccttgaagagcacattgagaagttttggggcgttgattacaactcggaccagatgcctagctactccgactaggctcagagtttatggtgttgtgaaattctggatgtttgggtgtaatggtattttggatgtgtatatgaactgtaattctggatgtgtggatgtaatggtgaactgactga

SEQ ID NO: 1174 - DNA, 479 bp, Zea mays
ggatgtcgaagagcactgaaatcacatataaagcaatcatcttgatgtaggatcatgccaagcatattcttcgtatttgcaatgagaagctacccttcggtaaggggttgactgcatttgaggttaaagaacttcgtgaagcacttgaatttgtcgccgaaggattggaccaggactcccttttttgccaagaggaattggatgcaactgttaaggaggaacaattggagcatgacgagaaggtggctttagagaggattgaaagcccactaccttctcgtgattcggactgcttcctatcccttgaagagcacattgagaagttttggggcgttgattacaactcagaccagatgcctagctactccgactaggttcagggtttatggtgtactcaaattctggatgtgtggatgtaatcctattttagatgtgtatgtgaacttgaattctggatgtgtggatgtaatggtgaactg

SEQ ID NO: 1175 - DNA, 2858 bp, Zea mays
gggaccggtgttcgaccatgagtcgatccccgaccatgtcgccgtctccgtgttcgagttcgtcaggccggagtatgatgctgagctcaccgtcttcgacaccgactcggacagcctcaacgacctgctggtagtcgacatggagccggtccatgacgccgagctcaccgtgttcaaccaaggaaacgacggctccttgactgcacacaccggcgtcctcgacgggcaccctatctttgacgtggagctcgtatttgatgaggagcctctcatcgaaatcgattgcagcatctttaacactaatgcgcccttcatgtgtttgacagattgtctgagctacgtcgatgacatggtgtctgctacttttaaggaggggcctatctttgataaggagactgtagtagaagcagtacagaaggaaagtgacagggattactatactgttcacggtgagaaagccatgtttattgcaaggacatactatcacacaatttctgctttacgtcatttaggcagcaactctggtggaatctcaagtgtcggtgtgagcaaggctatgtttgagaccattgttcgcaagatcttattagataggactgactgtactttagaactctacgagggtagtggctctgattggaggttaacaaaatctggaaaacctggaaatattggtggatttgaagacattttgtttataaacaatgacatgcaagagtcaccagtcatgaccaacaggaagcttgggttggctgaattccgcgaagataaccgattcacaaatgttggatcagcacttcttgcattatgtctcacagcagattgtgagaaatccatcaattcacattctcttcaagatgccattactaaatgcagtattctgttgactgagagaaaaaagtctaacttcaaatcaaaggatcttgtgcaagatcttgaagaaatcaaaggttctgttaaactagtttgtgatctgatatctcaatttgactactctcttggtgcccttggagctctattatcttatgctgagttgctagcaaatgatactaattatgggaattacacaattgaaaagtacaatttggactgctacatgagacttgattctgctgtggtgctagcattgaccattcatgaagaaaaaactgatgtaaacaaaaacttttatttgtttggcttggtgaacagaacgtgtactgttgagatgggaaagagattgcttaaccaatggctgaaacaacctcttttagatgtgaatgaaatcactagcagattatatatggttcaggctgctatatctacttttgataccaaaactactattagaacagttgtgcaaatacacatgtgtgaacctgctggtgcttctcaaaatgttgaacacatgggtcagctacaaaagccttgggatcctggtggttttcatattgggcttgtttctggagcgcagcgtgttggtttcaatttcggagaatatattgagctgctggagaggtacaacaaggcaccattctctctgaagacttgggacccagatattcaacattctctattcaaagaagcttctcatgactacttgcacatcttcataagacaaagcaaattcataatgagcaaatatacatggcatgatgttgcttggggacaagcaacgttttggctgggcggtagtgtaacacatggcttgtttctggcctggtgtcacatggcccaacccacggcccaactcggaagatgggtacaagagcagcatcagagaaatgaggatggagagaaaaaaagaatccgatcttattcccttctgtcgccgtcttccgtccggaggcgcgattcagctcgccaacgctcgacggcggccctgcgctttattattgagaatgctgaaaataaggataatagggatcagggtgatatgtttagaatctgtgatgaggatgagatgtatgcgttcttaaggcttggagatgaggatgaggagatgaatcgaatccacccggaacaaaatgaactgaggaggagaaaactgtcccataattcagctgaagtcccattaccagaacttggtcattttcgtcagacaattcagttcaaagctgacccacaatttagttctggatgtcaaactgacaattcagttcaaatgaagtcagagaacaaggattacagttcacacaaccacaatttcagttcaccagaattacatccacacatccagaatttcatcccgtctccagtcccctcgcaggttttaggtttagggtttagaggtttagtgtttatctgtagtggtaaatttttatctgctcctcgtcgtgtactaatggatgcagagatgtcgaagagcactgaaatcgcagataaagcaatcatcttgatgcaggatcatgccaagcatatctatcgtatttgcaatgagaagctacccttgggtaagggcttgactgcatttgaggttaaagaacatcgtgaagcacttgaattcgccgccgaaggattggaccaggattcccttttttgccaagaggaattggatgctactgttaaggaggaacaattggagcatgacgagaaggtgactttagagaggattgaaagcccactaccttctcctgattcggactgcttcctatcccttgaagagcacattgagaagttttggggcgttgattacaactcagaccagatgcctagctactccgactaggtttacggtttatggtgactgaattctggatgtgtgtcttgtaatggtttatggtgactgaaattctggatgtgtgtcttgtaatggtttatggtgtctaaaattctggatgtgtggatgtaattctggtgaactgaaattgtggttgtgt

SEQ ID NO: 1176 - DNA, 2178 bp, Saccharum officinarum
gcgcgccgtctttgcggaacgaccctgaccacggcccctatctctttcgttcctaccccattcttcttctgccaccctgaagcttttccttcgttctcatcttgttctcggggcgtcgacggggacaaattgacaaaaggtggtgcgatcttgttgggttcacgccgcggcgggagaggcgagagggacagagggtgcgccgcggtgccggagagccgccccccacccccagccatggcattgccggttcccctcgtccgcctggcgctgctgctgctcgtcgcgctgccattctgcgccgcgcatcccggaccgggggccttccctgctcctcgccacttccagagccccgcgctccactctgatggatttggcttgctggcaaggaggtcaattgctgaagctcctactgacatcaacgtcactacgaatagctcctttgtattggcggcagataggacatatcgaaaggatcccttgaatggtttcaggaaatacacgggtggctggaatatcagtgaagtgcactattttgcttccgtcggatatacagccattccactgttcgccattgctctggcatggtttgtgatctttttcctggttatgcttgggatttgctgccgtcactgctgttgcccgcgtcacacctacaagtattctcgaacagcatatgctctgtcattgatacttctaatattgttcacttgtgctgcaattgctggatgtgctatgttatatgatggccaggcaaaattccacaagagcacaacaactactctgaagtttgttgttagccaggcaaattatactgttgacaaccttaggaacctatctgatagtttgtctgctgcaaagaggatcgacatagcacaatcctttttactgcctcctaacgtgcaaactgagataaatgaaatccaaggaaagctgaactcatcagctaccgatcttgctattaaaacaacagataatgctgcgaagataaaaaagttgctaaacagagtgcggctggctttaattgtcattgcagcagtgatgcttcttctcgcatttattggcttcttgttatccatctttggtctggaattccttgtctctgtcttggttgttattggatggatactggttactgggacgtttatcctgtgcggtgtctttcttcttctgcacaatgttgtttcagatacttgtgttgcaatggaagagtgggttgctcatccgacagaacacactgccctggacgaggttatcccctgtgtcgagcctgccacagcaaacgaatccctgtacagaagcaggcaggtcaccttcgagctggtgaacgtggtgaaccaggtgatcaccaacgtgtcgaataggaacttccctccacagttgacacctttctactacaaccagtcggggccactgatgcctctgctgtgcaatccattcacacctgatctgagggaccgcaactgcacccgaggggaggttaccttggacaacgcaacccaggtttggaagaactacgaatgccagagcaaaactgtttcaggagccgagatttgtgccacggtggggcgcgtcacccccagcatctacagtcagatggcggcgggcgtgaacgtgagccaggggctgtaccagtacgggcctttcctcatccagctggaggactgcacctttgtgcgcgacaccttcacgaccatcaaccagggctactgccccgggctggagcggtacagcaagtgggtgtacgtgggcctggtgatggtctcttcggcggtgatgctgtcactcgtcttctgggtgatctacgccagggagcggcgccaccgcgtgtacagcaagcagcaccagccgtacccggtggaagacaagccggctccgatggtcccgggcgcatgatggtccgttcctcccatgcttgcgacgctgtgcatacgccgtgctaggttgggttgggttttcgtgaatgtagatggatgtaccctggatggttagttgctttgctgttgctgattttcgtagacgaagttcatgtgaattctcgtactgactgtagctggatttgtgggtcgaacttgagaggtcagacagcctgcaactgtttgtgttgggattgggcattagtggtgtactgatctggaactgtaagattgcatatttgcatgttcttcagttcgcttctct

SEQ ID NO: 1177 - DNA, 2196 bp, Saccharum officinarum
  misc_feature (147)..(147): n is a, c, g, or t
  misc_feature (288)..(288): n is a, c, g, or t
  misc_feature (943)..(943): n is a, c, g, or t
  misc_feature (1126)..(1126): n is a, c, g, or t
  misc_feature (1132)..(1132): n is a, c, g, or t
  misc_feature (1278)..(1278): n is a, c, g, or t
  misc_feature (1897)..(1897): n is a, c, g, or t
  misc_feature (2016)..(2016): n is a, c, g, or t
  misc_feature (2170)..(2170): n is a, c, g, or t
  misc_feature (2172)..(2172): n is a, c, g, or t
gcgcgccgtctttgcggaacgaccctgaccacggcccctatctctttcgttcctaccccattcttcttctgccaccctgaagcttttccttcgttctcatcttgttctcggggcgtcgacggggacaaattgacaaaaggtggtgcnatcttgttgggttcacgccgcggcgggagaggcgagagggacagagggtgcgccgcggtgccggagagccgccccccacccccagccatggcattgccggttcccctcgtccgcctggcgctgctgctgctcgtcgcgctnccattctgcgccgcgcatcccggaccgggggccttccctgctcctcgccacttccagagccccgcgctccactctgatggatttggcttgctggcaaggaggtcaattgctgaagctcctactgacatcaacgtcactacgaatagctcctttgtattggcggcagataggacatatcgaaaggatcccttgaatggtttcaggaaatacacgggtggctggaatatcagtgaagtgcactattttgcttccgtcggatatacagccattccactgttcgccattgctctggcatggtttgtgatctttttcctggttatgcttgggatttgctgccgtcactgctgttgcccgcgtcacacctacaagtattctcgaacagcatatgctctgtcattgatacttctaatattgttcacttgtgctgcaattgctggatgtgctatgttatatgatggccaggcaaaattccacaagagcacaacaactactctgaagtttgttgttagccaggcaaattatactgttgacaaccttaggaacctatctgatagtttgtctgctgcaaagaggatcgacatagcacaatcctttttactgcctcctaacgtgcaaactgagataaatgaaatccaaggaaagctgaactcatcanctaccgatcttgctattaaaacaacagataatgctgcgaagataaaaaagttgctaaacagagtgcggctggctttaattgtcattgcagcagtgatgcttcttctcgcatttattggcttcttgttatccatctttggtctggaattccttgtctctgtcttggttgttattggatggatantggttnctgggacgtttatcctgtgcggtgtctttcttcttctgcacaatgttgtttcagatacttgtgttgcaatggaagagtgggttgctcatccgacagaacacactgccctggacgaggttatcccctgtgtcgagcctgccacagcnaacgaatccctgtacagaagcaggcaggtcaccttcgagctggtgaacgtggtgaaccaggtgatcaccaacgtgtcgaataggaacttccctccacagttgacacctttctactacaaccagtcggggccactgatgcctctgctctgcaatccattcacacctgatctgagggaccgcaactgcacccgaggggaggttaccttggacaacgcaacccaggtttggaagaactacgaatgccagagcaaaactgtttcaggagccgagatttgtgccacggtggggcgcgtcacccccagcatctacagtcagatggcggcgggcgtgaacgtgagccaggggctgtaccagtacgggcctttcctcatccagctggaggactgcacctttgtgcgcgacaccttcacgaccatcaaccagggctactgccccgggctggagcggtacagcaactgggtgtacgtgggcctggtgatggtctcttcggcggtgatgctgtcactcgtcttctgggtgatctacgccagggagcggcgccaccgcgtgtacagcaagcagcaccagccgtacccggtggaagacaagccggctccgatggtcccgggcgcatgatggnccgttcctcccatgcttgcgacgctgtgcatacgccgtgctaggttgggttgggttttcgtgaatgtagatggatgtaccctggatggttagttgctttgctgttgctgattttcgtanacgaagttcatgtgaattctcgtactgactgtagctggatttgtgggtcgaacttgagaggtcagacagcctgcaactgtttgtgttgggattgggcattagtggtgtactgatctggaactgtaagattgcatatttgcatgttcttcagttngnttctctccgtcagtgtatcacgat

SEQ ID NO: 1178 - DNA, 2243 bp, Panicum virgatum
ctgtccctgtcgtggcaccaaagccaaatcccactcttttgacacctctaatcccaaaggggaggcgaaaatcccgttaaccccagggcattccccggaggcgacgaacagcccagggcaggggtcacaagagaggaggcggagggacgaacgaaaagctgaaaagaatccatctctaccgcctcaagctttcctccgttctcatcttctcggggtggggggcgacaagcggtgcgatcttgttgggttcacgggggggagagagaggggggcgccggagaggtgctccgccgccatggcattgcccgttcccttcgtccgcctgacgctgctgctgctcgtcgccctgccattctgcgcggcgcatcccggtccgggcttccatactcatcgcgagttccagaggcccgcgctcgactcagatggatttggcttggtggcaaggagatcaattgctgaagctcctgctgacataaacatcactacgaatagctcctttgtcttggcagcagataggacgtaccgcagggaccccttgaatggtttcaggaaatatccaggtggctggaatatcagtgaagtgcactattttgcttctgttggatatacagccattcccctgtttgcgattgccctggtgtggtttgtgttcttttttctggttatgcttgggatttgctgccatcattgctgttgtccacatcgcagttacaagtattctagaacagcatatgccttgtcactgatacttctaatattgttcacttgtgctgcaattgttggatgtgttatgttatatgatggccagggcaaattccataaaagcacaacaactactctgaaatttgttgttagccaggcaaattataccgttgacaaccttaggaacctatctgatagtttgtctgctgcaaagaaggttgacattgggcgattcttactgcctcctaatgtgcaaaatcaaatcaacgaaattcaaggaaagttggattcatcagctaatgatcttgcagttaaaacaacagataatgctgcaaagattaaaaaattgctaaaccaagtgcggatggctttaattgtcattgcggctgtaatgcttcttctggcttttattggcttcttgttatccatctttgggctggaattccttgtctccgtcttggtggttattggatggatactagttactggaacatttatcctgtgtggtgtcttccttcttctgcacaatgtcacgtcagatacctgtgttgcaatggaggagtgggttgctcatcctactgaacacactgccctggatgagattatcccttgcgttgaacctgccacagcaaatgagaccctgtatagaagcaggcaagtcactttccagctagtgaatctggtgaaccaggtgatcaccaacgtgtcgaatcagaactttccttctcctcctcccgtagcaacgcccttctactacaatcagtcggggccattgatgccgctgctctgcaacccattcacacctgatctgagcaaccgcacctgcaccagaggagaggttaccttggacaatgcaacacaggtttataggagctttgaatgccagaccaccactgtctcaggagccgagatctgcaccacggtggggcgtgtcacccccaggatctatggccagatggcggccggtgtgaccgtgagccaggggctgtaccagtatggccctttcctcattcagctggaggactgcaccttcgtccgcgacacgttcacgaccatcaaccaggagtactgccctggcctgcagcggtacagcaagtgggtgtacgtcggcctggtgatggtctcggcggcggtgatgctgtccctgatcttctgggtgatctacgcgagggagcggcgccaccgcgtgtacaacaagcagttcatcgcccagcaccagccgtacccggtggaagagaagccggccccaaccgccccacacgcttgatgaccgttcccatatgcctgtgcatactcggtgctagtggttttcgtaatgtagatcgccggacccttgattgttggttgcttgctgatttccgtagccgaggtttatgtgcattttcgttctgacggtagctggatttgtggctcgaatttgcagaggtcagacagacttcgtctgtccgtgtttcggtttctgttgggaatggtcattggtggtgtactgtacatacagtcatggtctggaagaactgcatggtcttcagtttgcttctctt

SEQ ID NO: 1179 - DNA, 2220 bp, Setaria italica
ccgaaaggacccgaaaatcccgttaaccccactgcattacccccagaggcgacgaacagccaaccgcggcgcaggtgtcacaggagggagggacgaacaaaagctgaaaaaaatccatctttgcgacccccatctctttcgtgctcctaccccctccctgttccgcctgaagcttcccttcgttctcatcttctccgggtggggggcaacgggtggtgcgatcttgtttgggttcacgcgggggagaagggcaccgcagaggcagagctgctccgccatggcattgcccgtccccttcgtccgcctgtccctgcttctgctcgtcgcgctgccattctgcgcggcgcatcccgccccgggcttccatgctcctcgcgagttccagacgcccgcgctcgactcagatggatttggcttggtggccaggaggtcaattgctgaagctcctgctgacataaacatcactacgaatagctcctttgtcttggcggcagataggacataccgaaaggaccccttgaatggtttcaggaaatatccaggtggctggaatatcagcgaaatacattattttgcttccgtcggatatactcccctgttcgccattgccctggtgtggtttgtggtgttttttctggttatgcttgggatttgctgccaccattgctgttgtccgcatcgcagttacaagtattcccgagcagcatatgctttgtcattgatacttctaatattgttcacttgtgctgcaattactggatgtattatgttatatgatggccagggaaaattccacaaaagcacaacgcatactctgaaatttgttgttagccaggcaaattatactgttgacaaccttaggaacctgtctgatagtttatctgctgcaaagaaggttgacattgggcgattcttactgccttccgatatgcaaagtcagattgatgaaattcaagcaaagttgaactcatcagccactgatcttgctattaaaacaacagataatgctgcaaagattaaaaaattgctaaaccaagtgcggcttgctttaattatcattgcggctgtaatgcttcttctggcatttattggcttcgtgttatccatctttgggcttgaattcctcgtctccgtcttggttgttattggatggatactggttactggaacgtttatcctgtgcggtgtcttccttcttctgcacaatgtcacgtcagatacttgtgttgcaatggaggagtgggttgctcatcctatagaacacactgccctggatgagattatcccctgtgttgaacctgccacagcaaatgagtccctgtatagaaacaggcaagtcacattccagttggtgaatctggtgaaccaggtgatcaccaacgtgtcgaatcagaactttccttctcctcctccggtagcaacgcctttctactacaatcagtcagggccgttgatgccgctgctctgcaacccattcacacctgatctgagcaaccgcacctgcaccagaggagaggttaccttggacaatgcaactcaggtttacaagagctttgaatgccagaccaccacggtctcaggagccgagatctgcaccacggtggggcgcgtcacccccaggatctatggtcagatggccgcgggtgtgacggtgagccaggggttgtaccagtacggccctttcctgattcagctggaggactgcaccttcgtccgcgacacgttcacgaccatcaaccaggactactgccccggcctgcagcggtacagcaagtgggtgtacatcggcctggtgatggtctccgcggcagtgatgctgtccctgatcttctgggtgatctacgcgagggagcggcgccaccgcgtgtacaacaagcagttcatcgcccagcaccagcagtacccggtggaagacaagccggccccaacggccccacacgcttgatgacagttcccatccatgcctgtgcatactccatggtccatggtagtggtttttgtaatgtagatcgcggtacccttgattgttggactgttggttgcttgctgattttcgtagccgaggtttatgcgcattttcgtactgacggtagctggatttgtgttgagattggccattggtggtgtacatacagttatgatctggaaggattgcatggtcatcagtttgcttctctttcctgcatgtgtatggccagcgctgctgttgttgcggaattt

SEQ ID NO: 1180 - DNA, 2277 bp, Oryza sativa
agcagaatcgcgttaacccccgacccgagtgtatttagcgcaatcgcaaaaggcaaaagcgaggaagaacagacaggggaacgcggaaaaagggaaaaaagaatccgtctttgcatcccacatccctgtctttctcctctcctacccttcttcttcttccacttgaagctttttctctcttggtcttatcctcctccttgttgttgcgggaagaggcaggaaggaggaggttttgtggtgcgatcttgttggggtttcaggtcagaagggagaaggggagaggtcagccatggcattgcctgtttccctcctccgcatcgcggcggttctgctcgccatcttgccattctgcgccacgcatccaagccccgggttccatgctcctcgcgagtttcacaaggcactcgtcccagatagatatggatttgtggcaagaagatcaattgctgaagctcctgttgacgtaaatgtcactacaaacagttcctttgtcttggcgcaagagcgaacatatagaaaagaccccttgaatggattcaggaaatatactggcggttggaatattagcgaagtgcactatatggcttcagttggatacacagcttttccactgttcatcattgccttggtgtggtttgtgctgttttttctggttatgcttggaatttgctgcaagcattgctgttgtccacatcgcagttacacatactctcgggtagcatatgccctatctctgatacttctaatattgttcacttgtgctgcaattgttggatgtgtcatgctgtatgatggtcaaggaaagttccataaaagcacaacgactaccttgaattttgtcgttagccaggccaattttactgtcgaaaaccttaataacttatccgatagtttatctgctgcaaaaaaggttgacatagggcgatcctttttgcctaacgatgtgcaaaatcagatcaatgaaattcaaggaaagttgaactcatcagctactgagcttgctactagaactactgacaattccgagaagatacaaaaattgctaaatcaagtgcggattgctttgattatcattgcggcagtaatgcttcttctggcatttattggcttcttactatctatctttggcctggaattcattgtctctattttggtgattatcgggtggatactagtcaccgggacgtttatcctgtgtggtgtcttccttcttctgcataatgtcgtcgcagatacttgtgtctcgatggaggagtgggttgctcatccaacagagcacacagctctggatgacattattccctgtgttgaacctgccaccgcgaatgaatccctgtatagaagtaggcaagtcacttaccaactggtgaatctggtaaaccaagtaatcaccaacgtgtccaatggaaacttccctccgcaaactcctttcttctacttcaatcagtcggggccactgatgcctacactctgcaacccgttcacagccgatctgaataaccgtacttgcaccagaggagaggttaccttggacaatgcaacccgggtttggaagaattttgagtgccagactaccactgtctcaggaactgagatatgcactaccgtgggccgtgttaccccaacgattctcggtcagatggcagcgggcgtgaatgtgagccaggggctgtatcagtatgggcccttcctgatccagctggaggactgcactttcgtccgcgacaccttcaccaacatcaaccagaaccactgccctggcctggagaggtacagcaaatgggtttacgtcggcctggtgatggtttcgtcggccgttatgctctccctcgtcttctgggtgatctacgccagggagcggcgccaccgtgcgtacagcaaacagcacaactacgctgacaagccgcatccgactggcccggacgcttgatgcatatggccgatgctgtgctgcagaagaatctccatgtccatactcttcgtgcctgtcatcatcatgtagatcaccgtgccttctgattgttcgttggttacaccgatcctgtcctcttctttttttttcttttttttttgttgtagcattgatgtgaattattattgtagcttgatctttttcatcttgtttgctcttcttggtgaactgaaactttgttaagaggtgctgtttgtgaacttgagatagatttctgactttgtgccattagagtttcagtttgtgtacctgctgctgttgatgtacagtcatcatggtccagaagaattgttgcattgtcatta

SEQ ID NO: 1181 - DNA, 1056 bp, Sorghum bicolor
cgcgtcggtcgtgtcaagttttgctccagtccctgaaacgaagagttgaggggaaaaaaatctagaaacttctctcgtccagcccacagaatccaccgagccacggcgtcaccgccagcgccactgacatctccgggaaggaaccgaacggacccccgagaaaagaatcggtgcgtcggaaggaagagcaatcccgcggtggcggagcgagtacccagtccctacggcgagggatgtggtgggagtgggaaggcggcggtggggaagcgccgcgggaggagacccccgtcgacttcgacttcatctccctcctttccaagcccaaggattactacaagatactggaagtagactacaatgcgtcagaggagacgatcaggtccagctatatccgccttgcactgaaatggcaccctgataagaagcagggcgaagaaagttcaacctccaaatttcaggaaattaacgaggcataccaagttctgagtaatcctgcaaaaaggcaagagtatgacaagaaaggcattctatatgttcaagatcagaatgtagtggactacctgaaccggcacaaggggctaatacttacctgcaatggtcttggcataaggtactcagtatggtgaacatgctcaggggtccacagtttgcacccatctgcagtcttggagaatctaattgtaaaatagcattgatctgaaaatgatatagtgcagcagtgccacgtttgaaagccaaagatttggcaatgatatagtgcagcagtgccacgtttgaaagccaaagatttgacaacttgagttcatcctacaacagagttgatttttatttgtcgatcagctgttgttgaatgaaagaagcagatatgttccggctgctccttgtatgtaacgtacttttcctaacctatgccatgtaagcgtctgtttctgtcttggcgctttatgttgacgttaagtgaatttgaatgtctatggaatacagagtggtatcatgttccttccccggaaactatttatctacaacctcattaacatattaaacgtttcctggtat

SEQ ID NO: 1182 - DNA, 843 bp, Saccharum officinarum
accgagccacggcgtcaccgccagcgccactgacatctccgggaaggaaccgaaccgaccgacccctgaaaagaatcggtgcgtcggaaggaagagcaatcccgtggtggcggagcgaggacccattcccttccacggcgagggatgtggtgggagtgggagggcggcggtggggaggcagagcgggaggagacgcccgtcgacttcgacttcatctccctcctcgccaagcccaaggattactacaagatactggaagtagattacaatgcgtcggaggagacgatcaggtccagctatatccgccttgcactgaaatggcaccctgataagaagcagggcgaagaaaattcgacctccaaatttcaggaaattaacgaggcataccaagttctgagtaatcctgcaaaaaggcaagagtatgacaagaaaggcattgtatatgttcaagatcagaatgcagtggactacctgaaccggcacaaggggctaatacttacctgcaatggtcttggcataaggtactcagtatggtgaacacgctcagggatccacagtttgcacccatctgcagtcttggagaatctctaattgtaaaatagcattgatctgaaaatgatatagtgcagcagtgccatgtttgaaagccaaagattgacaacttgagttcatcctacaacagggttgaattttatttgtcggtcagctgttgttgaatgaaagaggcagatatgttccggctgctccttgtatgtaacgtactgttcctaacctatgcaatgtaagcgtctgtttctgtctcggcgctttatgctgacgtttagtgaatttgaatgtctgcgg

SEQ ID NO: 1183 - DNA, 741 bp, Panicum virgatum
  misc_feature (7)..(7): n is a, c, g, or t
  misc_feature (11)..(12): n is a, c, g, or t
  misc_feature (14)..(14): n is a, c, g, or t
  misc_feature (17)..(17): n is a, c, g, or t
cggcgcngcgnnanccngcggcggcagaaatcccgcggcggcggagcgagggagccaatcccgcgtcgaggggagggtgcgagatgtggtgggaatgggagggcggcggcgaggaggcggcgcgggaggagacccccgtcgacttcgatttcatctccctgctcgccaagcccaaagattactacaagatattggaagttgattacgatgcgtcggaggagacaatcaggtccagctatgtccggcttgcgctgaaatggcaccctgataagaagcagggtgaagaaaatgcaacctccagatttcaggagattaatgaggcgtaccaagttctgagtaatcctgcaaaaaggcaagagtacgacaagaaaggcattctatatgttcaagatcagaatgtagtggactacctgaaccggcacaagggtttaatactcacctgcaatggccttggcataaggtactcggtatggtgagcatgttcagagacgccacggtccgcatccacctgcaatcttgggtgggtgttgtaagataccatctagtaaaaaagaatatggtacggcagtaccatttttggggagctaaagatggacatatcttacaacaaagttgattttatttgttgatcagctgttgttggttgcaagaggcagatatgttcctgtaatcctgttgctgcctgatgccctgtatgtaagacactgttcctaacctatgcaatgtgagcgtctgttcctg

SEQ ID NO: 1184 - DNA, 854 bp, Pennisetum glaucum
ccgcggcggcggagcgaggaacaaatcccacggtgaggggacggtaggagatgtggtgggaatgggagggggacggcgaggaggcggcgcgggaggacgaggagacccccgtcgacttcgacttcatctccctgctcgccaagcccaaggattactacaagatattggaggttgattacgatgcgtcggaggagacgatcaggtccagctatatccggcttgcgctgaaatggcaccctgataagaagcagggtgaagaaaatgcaacctccagatttcaggagattaacgaggcataccaagttctgagtaatcctgcaaaaaggcaagagtacgacaaggcaggcattatatacgtccaagaccagaatgtggcggactacttgaaccggcacaagggtttaatactcacctgcaatggccttggcatcaggtattcggtatggtgaatatgttcagttgcaccacagtctgcatccacccgcagtcttagatgatgtctaattgcaagataaagaaaatggtatggtggtaccatattttggggagctaaagatggacgtgttgagttcatcttacaacagtgttgattttatttgttgatcagcggttgttgattgcaagaggcagttatgttcctgtaatcgttgctcccagcatgtaagacactgttctaatctatgtaatgtgactatgtgagcggcgtctgttccgtaagaatcactttgagttttatgttgacacagtggaatgtctagaggggaaactgagtgctaaaaccacatgctctttcctggaaaaacttatgatccccaggttaccggtttactgcagtatatatctataacaacgtc

SEQ ID NO: 1185 - DNA, 796 bp, Oryza sativa
gaagcccacgaaatccaactaccgccagccatctcacgggacgggagaatcgccggaatcggcgcgattctccgggcacgaatcgggccgagaaatcccgggtgcgcgctgcgtcgaagcggcgcggcgagaggggaggggaatgtggtgggagtgggaggaggacggcgaggaggcggcgcggccgggggaggaggtccccgtcgacttcgacttcatctccctcctctgcaagcccaaggattactacaagattctggaagtgggatatgatgcgtcggaagaggcgatcaggtcgagctatatacgtcttgcactgaagtggcaccctgacaagaagcagggcgaagaaaatgcaacctccagatttcaggagattaatgaagcataccaagtgctcagtaatccagccaaaaggcgagagtatgacaagaaaggcattctttatgttcaagatcataatgtagtggactatctgaaccggcacaaaggtttaatccttacttgcaatggccttggcataaggcattcagtatggtgatcttactcaggggtactacagtctgcatccatctgctgtctttggatggtgtgtgtcattgtaaaatctcatgtaatctgcaaaatgtagcacggtcatgcggacctgccacttttgggaggaaatgatgacgctgagttcatcctgtgttttgacaaatggaaagtggtcggaagggaattagggaaaatatcagctgatctgttggtgacactgcttctcccactcaattttcaatgtgtcaaaactcaatag

SEQ ID NO: 1186 - DNA, 671 bp, Brachypodium distachyon
cgaatgtggtgggaatggtgggacggcgaggaggcggcggcggggccgcgggaggaggtccccgtcgatttcgacttcatctccctcctctgcaagcccaaggattactacaagatactggaagttgattatgatgcttcggaggagacaatcaggtcgagctatatccgtcttgcactgaaatggcaccctgacaagaagaagggtgaagaaaattcaacttcaatatttcaggacattaacgaggcataccaagttctcagtaacccagtaaaacggcaggagtatgacaagaaaggcattttatacgttcaggatcagaatgcagcggattacctgaaccggcacaagggtttgatacttacatgcaacggtcttggcgtgaggtactcggtgtggtgagcttcctccaaggtaccaaccagagtctgcacccgtcagcggtcttggacgacgtgtgtagttgtaaaatcccatctagttcacaaaatgtagcacggtactctcatttgggggcctaaatggcagcttagagttcatcctacaacagatatgatttatatttgctgatcagctgttgtagactgcaagaggcagagatgtcctatgttgcatatagcccctaaaacactgttcctaacctatggaatgtcagcatatgtgttcctgaa

SEQ ID NO: 1187 - DNA, 876 bp, Avena sativa
caacgaaaacctgcaaggagacagcggaagaaaaatctagaaccttccttggctgcggcgagcccacgaaatccaacagctgccagactgccacggccatccccgtgaaggaaggaaccgggaatcgactccggcaggaccctgcggcgaggggaccgatccacgcgagggcggggaggggaggaaatgctgtgggagtgggaggacggcgaggaggcggggcggcagagcgaggaggttccagtcgatttcgacttcatctctctcctctccaagcccaaggattactacaaaatattggaagttgattatgatgcgtcagaggagacaatcaggtcgagctatatccgtcttgcactgaaatggcaccctgacaagaaacaaggtgaagaaaaggctacatccaaatttcaggacattaatgaggcttaccaagttctcagtaatccagtaaaacggcaggagtatgacaagaaaggtgttttatatgttcaggatcagaatgcagcagattacctgaaccgacacaagggtttaatacttacatgcaatggccttggtgtaaggtactcggtatggtgagctttctcatgggtaccagagtctgcgatcttggatgatgtgtgtagttgtaaaatctcatccagttcacaaaatttagcacggtactactgttttagggggccaaaatggcaacatagagttcatcctacaacagacatgatttatatttgttgattgtctgttgtagattgcaagaggcagagatgtcctatgttgcatattgctcctgaaacactgtttctaaccatgaaacgtcagcatcagttcctgaatgcgttgtaatcttaccgtcccaatgagtggttggatgtc

SEQ ID NO: 1188 - DNA, 872 bp, Triticum aestivum
cccaacgaaaatcgcaaggagacgacgaaaagaaaacaaaaaatctagaaccttccctggctgcggcgagccggcgaccccacgaaatccaacgactgccagaccgccacggccatccccggaaggaaggaaggaaggaagggaccagggaatccacacccgcgagcagccgcggcgaaggaatccccacgagggcggcgaggggagaggccaggcgagggaatgttgtgggagtgggaggacggcgacgaggcggcgcggacgggcgaggaggtccccgtcgatttcgacttcttctccttcttcgccaagcccaaggattactacaagatactggaagtcgattatgatgcgtcggaggagacaatcaggtcgagctacatccgtctggcgctgaaatggcaccctgacaagaaacaagatgaagaaaaggcaacatccagatttcaggacattaatgaggcataccaagttcttagcaatccagtaaaacggcaggagtatgacaagaaaggtgttttatacgttcaggatcagaatgcagcggattacctgaaccgacacaagggtttaatacttacatgcaatggccttggtgtaaggtactcggtgtggtgagctttctcaggggtacaagagtctgcgtctatgtgcggtcgtggctgatgtgtgtagttgtaaaatcccacctagttcacaaagtttagcacagtactaccatctggtgggggcttagcgtttcatcctacaacagacatgatttatatttgttgattgtctgttgtaggttgcaggaggcatagatgccctatgtcgcacatttgctcctgaaacactgttcccatcctatgaaatgaaagcatctgtgttca

SEQ ID NO: 1189 - DNA, 837 bp, Setaria italica
gacccccgtcgacttcgatttcatctccctgctcgccaagcccaaggattactacaagatattggaagttgattacaatgcgtcggaggagacgatcaggtccagctatattcggcttgcgctgaaatggcaccctgataagaagcagggtgaagaaaatgcaacctcaagatttcaggagattaacgaggcgtaccaagttctgagtaatcctgcaaaaaggcaagagtacgacaaggcaggcattatatatgttcaagatcagaatgtagtggactacttgaaccggcacaagggtttaatactcacctgcaacggccttggcataaggtactcggtatggtgaacatgttcaggtgcgccacggtctgcatccacctgccgtcttagatgatgtctaattgcaagataagatccagtaaaaaaaatatggtacggcagtactatattttggggagctaaagatggacaggttgagttcatcttacaacagtgttgattttatttgttgatcagctgctgttgattgcaagaggcagatatgttcctgtaatcgttgctcccagtatgtaagacactgttctaatctatgtaatgtgagcggcgtctgttcctgaagaatcaagaatgtcttgtcattttatgttgacgcagtggaatgtctagggggggaaaatcgagtgctaaaacccatgctctttccaggaaaaacttgtaatccctagattactggtttactgcagtatatatctataacaacgttactgcagtactcactcttccgttatatttgaaagaggatactgtattttgtacatgattcagtgtacaaagcaa

SEQ ID NO: 1190 - DNA, 757 bp, Hordeum vulgare
cgggaatccacacccgcgagcagccgcggcgaagggaatccccgcgaggggagaggccgggcgagggaatgttgtgggagtgggatgacggcgacgaggcggcgcggacgggcgacgaggtccccgtcgatttcgacttcttctccttcttcgccaagcccaaggattactacaagatactggaagttgattatgacgcgtcggaggagacaatcaggtcgagctacatccgtctcgcgctgaaatggcaccctgacaagaaacaagatgaagaaaaggcaacctccagatttcaggacattaatgaggcgtaccaagttctcagcaatccagcaaaacggcaggagtatgataagaaaggtgttctgtacgttcaggatcagaatgcagcggattatctgaaccggcacaagggtttaatacttacttgcaatggccttggtgtaaggtactcggtgtggtgagctttctcaggggtactagggtctgcgtctatgtgcggtcttggatgatgtgtgtagttgtaaaatcccatctagttcacaaagtttagcacggtactaccatctgatggggccttagagtttcatcctacaacagacatgatttatatttgttgattgtctgttgtaggttgcaagaggcatagatgccctatgttgcacattgcccctgaaacactgtccccatcctatgaaatgaaagcatctgtgttaatgaatgccttgtcattttacgcaaaaaaaaaaaaaaaaaa

SEQ ID NO: 1191 - DNA, 838 bp, Saccharum officinarum
  misc_feature (105)..(105): n is a, c, g, or t
  misc_feature (126)..(126): n is a, c, g, or t
  misc_feature (222)..(222): n is a, c, g, or t
  misc_feature (531)..(531): n is a, c, g, or t
accgagccacggcgtcaccgccagcgccactgacatctccgggaaggaaccgaaccgaccgacccctgaaaagaatcggtgcgtcggaaggaagagcaatcccgnggtggcggagcgaggacccantcccacggggagggatgtggtgggagtgggagggcggcggtggggatgcggagcgggaggagacccccgtcgacttcgacttcatctccctcctcnccaagcccaaggattactacaagatactggaagtagattacaatgcgtcggaggagacgatcaggtccagctatatccgccttgcactgaaatggcaccctgataagaagcagggcgaagaaaattcgacctccaaatttcaggaaattaacgaggcataccaagttctgagtaatcctgcaaaaaggcaagagtatgacaagaaaggcattgtatatgttcaagatcagaatgcagtggactacctgaaccggcacaaggggctaatacttacctgcaatggtcttggcataaggtactcagtatggngaacacgctcagggatccacagtttgcacccatctgcagtcttggagaatctctaattgtaaaatagcattgatctgaaaatgatatagtgcagcagtgccatgtttgaaagccaaagattgacaacttgagttcatcctacaacagggttgattttatttgtcggtcagctgttgttgaatgaaagaggcagatatgttccggctgctccttgtatgtaacgtactgttcctaacctatgcaatgtaagcgtctgtttctgtctcggcgctttatgctgacgtttagtgaatttgaatgtctgcgg

SEQ ID NO: 1192 - DNA, 1258 bp, Sorghum bicolor
agccacgcaaccaaagccaaggacaccaccaccattctctctactcctcactgagaggaaacaaagggaagcatcttgagcgagtgttcggagccaatggagaagtcgtcgtccgagaatgccaccccgctgaagctgttcgggtcgtgggcgagctcgtacacgcaccgcgtgcagctggcgctgcggctcaagggccttgagttcgactacgtggaggaggacctggggaacaagagcgacgagctgctccgccacaaccccgtccacaagaaggtccccgtcctcgtccacggcggccgcgccctcccggagtccgtcatcatcctccagtacctcgacgacgcctggcccgagacccgcccgctcctccccgccgacgccttcgaccgcgcgctcgcgcggttctggtgccacttcgccgacgacaagctcgggccggcggtgggcgcggtgttcgcgtcgacgggggaggaccaggaggcggcggtgcggcaggtgcacgagaacctggcgctgctcgagaccgagctccgcgacggcgcgttcaggggccgtcgcttcttcggcggcgacgaggtgggcctcctggacgtcgtcctgggctgcggctcctactggctcgccgtgttcgaggacgtcaccgggctgcgcctcgtggacgccgacgccttcccgcgcttccacgcctggctgcgcgacttcgaggccctggacgaggtccgcgacaccatccccgccgtcgaccgcctcctcgactacgcgcgcggcctccgccacatgctgctcggcctcgccggcgccggcgccgcggccgcaccctccgcccccgacgcccccaccactgccgccgcgcccgcggctgacatcgccgtcgacatctgaacgcgcaaggcggcgtcgtcgggctccggcgtccggcgtctggcgtctgtgccagcgcggcgcctgtccggctagggatcagtagcagctagtaccagtatagtttgccgtgtcgatggcgccatgtacgtgtggtggctgcggagtctgcgtgcgtgcctggagtgggctgctgctgctgccacccactgttataatggcgcagtttgtgtttgtctaggtgtcgagtttgttttctcaacgtcctttttttttttcttttgatataaactttccctccagtgtagtctatgtttgcttgttctagcagtttggctggcttgttgaaatgttagccagcatgtgcacctttctggtaatttcttcgagcaag

SEQ ID NO: 1193 - DNA, 1205 bp, Panicum virgatum
gaagcatcttgatccatcttgagtggtagggtccagcaggagcgagcggcgagctatggagaaggcggccgacaatgcgagccaggcggcggcgccgctgaagctgttcgggtcgtgggcgagctcctacacgcaccgcgtgcagctggcgctgcgcctcaaggggctggacttcgagtacgcggaggaggacctcgggagcaagagcgccgagctgctgcgccacaaccccgtgtacaagaaggtgcccgtgctcgtccacggcggccgcgcgctcccggagtccgtcatcatcctgcagtacctcgacgacgcctggccggagacacgcccgctcctccccgccgacgccttcgaccgcgcgctcgcgcgcttctggtgccacttcgccgacgacaagctcgggccggcggtgggcgcggtgttcgcgtcgacgggggaggaccaggaggcggcggtgcgccaggtgcacgagaacctcgccctgatcgaggcggagctccgcgacggcgcgttcaagggccgccgcttcttcggcggcgacgaggtggggctcctggacgtcgtcctcggctgcggctcctactggctcgccgtgttcgaggaggtgaccggggtgcgcctcgtggacgcagacgcgttcccgctcttccacgcctggctgcgcgacttcgaggccctggaggaggtccgcgagaccatccccgccgtcgaccgcctgctcgagtacgcccgcggcgtgcgccacatgctgctcggcctcgccggcgccggcgccgcggctgccaccccggccgaggcgcccgccgcggcggcgcccgcgccggctcccgcggctgacatcgccgtggacatctgatcgttccgcaggacgccgccgtgcgcctgccggcggcgccgtccggctgctggtgatcagtagctagcctagctagtagctatagtagcagtatggttcgccgtgtcgatggcgccatgtgtggcgtgtgggtgactgttgaggctgcgtgcccgcctcaagtgcgcgcctctgcgttctcagtgctcacgcctgaaggggcgcagtctgtcttggtgtccagtttgttttctcaacttcttcctcatgttgggtctctgtctgctgtgagtcctccctgtggttgggaatcttatgtgtatctactactagtaatctagcagtttagcttgcttgtttaaatgtt

SEQ ID NO: 1194 - DNA, 882 bp, Setaria italica
cacaaccattagctggcagctgctactcaaagaggaaagaaagcatcttgatctcgagtggtagggtccaggggcgagcagctcggagcgcgcggtgagccatggagaagacgccgaagaacgtgagccaggcggcggcggcgccgctgaagctgctcgggtcgtgggcgagctcgtacacgcaccgcgtgcagctggcgctgcggctcaaggggctcgagttcgagtacgcggaggaggacctcgggaacaagagcgtcgagctgctccgcctcaaccccgtgtacaagaaggtgcccgtgctcgtccacggcggccgcgcgcttccggagtccgtcatcatcctccagtacctcgacgacgcctggccggaaacccgcccgctcctccccgccgacgccttcgaccgcgcgctcgcccgcttctggtgccacttcgccgacgacaagctcgggccggcggtgggcgcggtgttcgcgtcgacgggggaggaccaggaggcggcggtgcggcaggtgcacgagaacctggccctgatcgaggcggagctccgagacggcgcgttcaagggccgccgcttcttcggcggcgacgaggtgggcctcctcgacgtcgtcctgggctgcggctcctactggctcgccgtgttcgaggaggtgaccggggtgcgcctcgtggacgccgacgcgttcccgctcttccacgcctggctgcgcaacttcgaggccctggacgaggtccgggagaccatcccggccgtcgaccgcctgctcgagtacgcccgcggcgtccgccacatgctgctcggcctcgccggcgccggctccgcggccgcatccgccgccaccccctccgaggcccccgccgcgccagcgcccgcgg

SEQ ID NO: 1195 - DNA, 1157 bp, Leymus cinereus x Leymus triticoides
aaaaagaatctcactgcaagcaacaatacaaacaccgctcgagcatcctaagatcgactgagttctggcaatggagaaggcggcggagaacgtcgacgctggcgcggcggcgcagctgaagctgttcgggtcgtgggcgagctcgtacacgcaccgcgtgcagctggccatgcggctcaaggggctcggcttcgagtacgcggaggaggacctcggcaacaagagcgacgcgctgctgcaccacaaccccgtttacaagaaggtccccgtgctcgtccaccacggccggcccctcgccgagtccgtcatcatcctccagtacctcgacgacgccttccccgccacccgccagctcctccccgccgacgccttcgaccgcgccgtcgctcgcttctggtgccacttcggcgacgacaagcttgggcctgcggtgggggcggtgttcgcgtccacgggggaggaccaggaggctgcggtgcggcaggtgcacgagaacctggcgctgatcgaggcggagctgcgggagggggcgttcaagggccggcgcttcttcggcggcgacgaggtcggcttcctcgacgtcgtcctgggctgcggctcctactggctggccgtcttcgaggaggtcaccggcgtgcagctggtggacgccgaggcgttcccgctcttccacgcctggctgcgcgacttcgaggcgcaggacgaggtcagggagaccatcccctccatcgaccgcctcctcgagtacgcgcgcggcctccgccagatgctggtcgccatggccgctggcgcagcctcggctgacgcccccaccgccgctccacccgccgcggcgcccccggccgccaccacggctgacatcgccgtggacatatagcccgcaggctgtgcacgctgcactgtggttcgtgtcgctcgtcgtcgtagctactagctagtgtagtttcccgtgttgtgccgtgccgagcatgtggtgaggcgccatgaattgcgctgctaccagtaccactatagttagtggcgcagtctggctaggtctcttctcttctctctttgttatgcgttgtgtgtttgtaactgggaatcttatgtgtttgcttcctagctttgcttgtttagacataatgcacgtgtgactgtcagattctttggattca

SEQ ID NO: 1196 - DNA, 1230 bp, Triticum aestivum
atctcactccactccactccactgcaagcaacaatacaaacaccactcgagcatcctaagatcgaccagagtccttccttcctttcacgtagccggccatggagaaggcggcggagaacgttgacgccggtgcggcggcgcagctgcagctgcagctgaagctgttcgggtcgtgggcgagctcgtacacgcaccgcgtgcagctggccatgcggctcaaggggctcgccttcgagtacgcggaggaggacctcggcaacaagagcgacgcgctgctgcgccacaaccccgtctacaagaaggtccccgtgctcgtccacgacggccgctccctcgccgagtccgtcatcatcctccagtacctcgacgacgccttcccggcctcccgccagctcctccccgccgacgccttcgaccgcgccgtcgctcgcttctggtgccacttcggcgacgacaagcttggacccgcggtgggggcggtgttcgcgtccacgggggaggagcaggaggctgcggtgcggcaggtgcacgagaacctggcgctgatcgaggcggagctgcgggagggggcgttcaagggccggcgcttcttcggcggcgacgaggtcggcttcctcgacgtcgtcctgggctgcggctcctactggctggccgtcttcgaggaggtcaccggcgtgcagctggtggacgcccaggcgttcccgctcttccacgcctggctgcgcgacttcgaggcgcaggacgaggtgagggagaccatcccctccatcgaccgcctcctcgagtacgcgcgcggcctccgccagatgctggtcgccatggccgccggcgccggcgctggcgcagcctcggccgatgcccccaccgccgctccgcccgccgcggcgcccccggccgccaccacggccgacatcgccgttgacatatgaccataggctgtgcacgcgttgaactgtggtttgtgtcggtcggacgtcgtcgtagctactagctagtatagtttcccgtgttgtgcggtgccgagcatgtggcgagccgccatgaattgcgctgctaccactatagttagtggcgcagtctggctaggtgtcgtttatttctttctcttctctttctctcattgttatgcgttgtgtgtttgtaactgggaatcttatgtgtttgcttcctagctttcttgtttagacataatgcacgtgtgtgagactggcaaaaaaaaaaaaaaaacga

SEQ ID NO: 1197 - DNA, 3708 bp, Sorghum bicolor
tccaggacatgtgtcttgtacagctggtttgaggaaagaggtgctcctgtttgcccataatggctttagcttatgctagtgccatgtttcctccttcgagctcttcacataaaacttgggaggacccgtcattcttcaagtggagaaagcgtgaggcgcatgtgccattgcgctcacaggacacgctggaaggagccctgaagtattggcatgaacggaggaatgtgaactacctcaattctgacactgctgtctggaacgatgatgcggttcgcggtgctctggaaagtgctgttttttggtccaagggcttaccatacgccaaatctctaagtggatactggaaattccttctgtctccttcggtggaaagtgttccagagagattctatgatactcattttgatgattcaaattgggcggctttgccaggcacgtcctacttgcttgcagttccctcaaattggcaaatgcatgggtttgaccgtccaatctacacaaatatgacttatcctttcccattgaacccaccatttgtgccggctgataatcccacgggttgttacaggacagtttttcacatcccaaaagagtggaaaggtcggaggatcttgctgcactttgaagctgttgattctgcattttttgcttgggtaaatggagtaccaattgggtatagccaggacagcaggcttcctgctgagtttgaagttaccgattgctgccatccttgtgattcggacaaggaaaatgttcttgctgttcaagttatgaggtggagtgatggttcttatcttgaagatcaggatcactggaggctgtctggtattcacagggatgtgctcctactatcaaagccacagatttttatcacagattacttcttcaaagcaaccttggatgataatttcagtttagctgatattgaggtcgacgtggagattgactcacacaagaaagaccgggagcatgtcccaactttgtctattgaagcaacactctttgataactctggactatctatcagtatagatgctggtctttcatatgctaatgcagtcaatttgaaaccgaagccaaacccaactggaagcccttgtcgtggttttcatggttatgttcttggtggaaaaatagaaaatccaaaactttggtctagtgagcatcccaacttatacactcttgttgttctccttaaagatgccaatgggaagcttattgattgtgagtcatgccaagtgggcattcgtaatgtggtcctggcacacaagcaaatgcttgtcaatggatgtcctgttgtactaagaggtgtcaacagacatgagcaccatccacgccttggaaagacaaatttagaagcatgcatgattgaggatgtgattttgatgaagcaaaacaatatcaatgctgttagaaatagccattacccacagcacccgaggtggtatgagttatgtgacatctttggtctttatgtcatagatgaagccaacattgagacacatggttttgatgattctagcactttcaagcatcctacactagaacctatctgggcaaatgcaatgcttgatcgtgttgttagcatggtggagagagataagaatcatgcatgcattattgtttggtccctaggaaatgaatcttcatatggacctaatcatgtttccatgtctgggtggattcgtggaagggatccaacaagactccttcattatgagggaggtggttccagaacatcatccacagatattgtgtgccccatgtatatgcgtgtctgggatattgttaagatagcaaaagatccatctgaaacaaggcctctaattctttgcgaatattcacatgctatgggaaacagtaatgggaatattgatgcgtattggatggccatagacaacacttttggactccaaggaggttttatatgggactgggttgatgagggtttactgaaggaggactcagatggatctaaattttgggcatatggtggtgactttggagatactccaaatgactccaatttttgcctcaatggcattgtgtggcctgatcggacgattcacccagctgttcatgaagttaaataccttcaccagcctatcaaaatatcatcagcagaaaacatgcttaagattgaaaatggacacttttttgagacaacagaatctttggacttcagttgggttcttcatggagatggttgcatcttgggctctggtcctttgaatgttccaactttggcaccgcaaactagtcatctcatcaacatggaattatcaccatggtttgccctttggagtgcttgtgcagcaaaagaagtatttttgtctgtaaatgtgaaacagaggcatgaaacacgatgggctaaagccggtcatctcttggcttcagcacaactgtgtttgcctcagaaaaatgtctttgtccccaacgtgatagcattctccagcagccctttggtctgtgaacgcattggtgatagtgtaaccatctgcaagaataatgcatggaaaattaaagtaaacagtcaattgggaacaatcgacagctggaaggtcaacgacgttgagcttatgagcaaggggatactcccatgcttttggcgcgcaccaactgacaacgacaaaggaggtttcttcaccaagccatacgcttcgcgatggagagaagccttcctcgacaacgtctcgttccacagcagtcagttctctatcaaggaatcgccggacaacaccgtggagttctccaccgtctactacggcgttcccgggcacttgccgaagcctgacgacgaagcctccgagtccattctcttccgggtgaagatggtctgccggatccacgagtcaggcgacgtggttctcgactacgaggtgaaccccaaggccgacctccctccccttccccgggtaggcgtcgtgttcagcgccgagaggtccctgagccacgtcacttggtacgggcggggccccttcgagtgctacccggaccgcaaggcggcggcgcacgtcggcgtgtacgagagcagcgtggaggagctgcacgtgccgtacattgcccccgtggagtgcggcgggcgggcggacgtcaggtgggtggcgctccgcgacggcggcgggctcggcctgtacgcgtcggcgcacggcggctccccgccgatgcaggtgagcgccagctactacggcgccgcggagctcgacagggcgacgcacgtccacaggctggtgaagggggacgacatcgaggtgcatcttgaccacaggcacatggggctgggcggcgacgacagctggtcgccgtgcgtgcacgagcagtacctgctgccgccgacgcggtacgccttctccctgcggctctgccccctgctgccgacgtcgttgtgccatgacatctacaggtctcagctacccagctgatggtgccggaggcccgtgaagagagaggcaggcccatcgagccttgcgaaacaacaatgaaccagagacgcattcgatcctgcaatggactggccagtgaattattatattataaataatatacaataaatcagagacgcattcgcctggttcccgtgatgttctaacaaatcctggatatgtttttcggtttcgttactagtaaacgtaactcagcacgtcaatcagactccattgcatttgcatagaacttaacacatcttgaaatcggatttcgtatcatctt

SEQ ID NO: 1198 - DNA, 4057 bp, Oryza sativa
gtaatagaacccgacagcgatgggaccgggcccacccagccgctcaaagctgggttccatggtcactgccaggtggggcccagattctgcagtttcttctacctttggaacacttgtctgtctaatccactccaacttgatcggcagcaacagatcgctcgcctccccgtctcctcgcccgccgccttcgccgatctccatccggcgagcatccctcccgccgccgtcctgctgctgcttccgccgccggaggggagggatatgtgcctgtgaaaaatcggaggaaagggggtataaatctttgaccataatggctgtagcttctgccagtgcactgttttccgccaagaatcttccgcataaaccctgggaggacccgtcattctttaggtggagaaagcgggaggctcatgtgccgttgcgctcacatgacacacctgaaggagccctcaagtattggcatgaacggaggaatgtgaactatcttaattctgactctgctgtttggaatgatgacgcggttcgtggtgccctggaaagtgctgcgttttggtccaagggcttgccatatgtccagactctaagtggatactggaagttccttttggcttcctcgccagaatctgttccagagaaattctatgatgcctacttcaatgattcagattgggaggctttgccagttccctcaaactggcaaatgcatgggtttgaccgtccaatctacacaaatgtcacttatcctttcaccatgaacccgccatttgtgccaaatgataatcctactggctgttataggacggtttttcgcatcccaaaagagtggaaaggtcgaagaatcttgttgcactttgaagctgttgattcagcgttttttgcttgggtaaacggcgttcctgttggatatagccaggacagcaggcttcctgctgagtttgagatcacagatttctgccatccttgtgactcagaaaaggaaaatgttcttgctgttcaagtgatgaggtggagtgacggttcctatcttgaagaccaggaccattggtggctatctggtattcacagggatgttctactagtatcaaagccacagatctttattacagattattttttcaaagcaaccttggatgaaggcttccgtgtagctgatattgaggttgaggtggaaattgactcacaaaagcaggatcgggagcatgtctcaactttgtctattgaagcaacattgtatgacaattatggacctgctgatgttttaacttctgatatgtctgctgctagtgtggccaatttgaagttgaagccagcttcaagaccaaaacactgttatggttttcatggttatgttcttggtggaaaagtagaaaatccaaaactttggtctagtgaacatcccaacttatacactcttgttgttgtccttaaagattccaacgggaagctcattgagtgtgaatcatgccaagtaggaatccgtaatgtcgtcctggcacacaagcagatgcttgtcaatggatgtcctgttgtaataagaggtgtcaacagacatgagcatcatccacgtgttggaaagacaaatttagaagcttgcatgattaaggatctggttttgatgagacaaaacaacattaatgctgttagaaacagccattatccccaacatccaaggtggtatgagctgtgtgacatttttggactttatgtaattgatgaagccaacatcgagacgcatggctttgatgaatctagccatttcaaacatcctacacttgaacccttctgggcaagtgctatgcttgatcgtgttgttggtatggtggagagagacaagaatcatgcatgcattatagtatggtccttgggaaatgaatcttcgtatggaccaaatcactcagccatgtctggctggattcgtggaaaggacccgacaaggcccatccattatgaaggaggtggttctagaacatcctccactgatattgtatgcccaatgtacatgcgtgtctgggatattcttaagatcgcacaagacccttctgaaaataggcccctcattctttgcgaatattcacatgctatgggaaacagtaatggaaatattgatgcatattggatggccatagacaacactgttggactccaaggtggttttatatgggactgggtcgatcagggtttactaaaggaagatgctgatggatctaaaaactgggcatatggtggcgactttggagacactccaaatgacttgaatttttgtcttaatggcattgtatggcctgatcggacaattcacccagctgtgcatgaagttaaatatttataccagcctatcaaaataacaatgatggataacatgcttaagattgaaaacgtacatttttttgagacaacagaagctttggacttcagttggctacttcaaggagatggctgtgctttgggctctggttcacttaatgtcccatccatagcaccacagagtactcatctgatcaatatgaagtcatcaccttggtttactatttggagtacttgtgtcgtaaaagaaatatttttgtccattaacgtgaaattgaggtaccaaacacaatgggccaaagatggccatatcttggcttcagcacaaatttgtttacctccgaaaaaaggctttgtccctcatgcgatagcactgcccaggagctctttggtttcggaacgtgttggtgatcatgtactcatcagcaaaagtaatgcctggcaaatcaaagtaaacagtatttcaggaacaatcgatagttggaaggtcaacaacattgagcttatgagcaagggaatacacccatgcttttggcgaacaccaactgacaacgacaagggaggcttctacaccaagccctatgtttcaagatggagagaagcttctctcgacaacatctcgttctacagcagccagttttctctgaaggaattgccagaccaaaccgtcgagatctccaccatctactacggtcttcctgggaatcaaccaaagcctgatgaaacctctctctcagacgaatccgagtccgtcctcttccgggtgcagatgcgcggccggatctacgactccggcgacgtgatcctggactacgaggtgagccccaagaacgacctgcctcctcttcctcgcgtcggcgtcgtgttcaacgccgacaagtccctgagccgtgcaaaatggtacgggagggggccattcgagtgctacccggaccggaaggccgccgcgcacgtcggcgtgtacgagagcggcgtcgacgagctgcacgtgccgtacattgtccccggcgagtgcggcggccgggctgacgtccggtgggtggcgctccaggacgccgacgggttcggcctcttcgcgtcggcctacggcgagtcgccgccgatgcaggtgagcgccagctactatggcgccgcggagctcgaccgcgcgacgcataaccacaagctcgtcaagggagacgacatcgaggtgcatcttgatcacaagcacatggggctgggaggggacgacagctggtcgccgtgcgtgcacgagcagtacttgctgccgccggcgagatacgccttctcggtgaggctgtgcccgttgctgccgtcgtcgtcgtgccatgacatctaccactctcagctaccctgttgatccgtctgagatgggcaagtgaggcaataaagcagagacgtatatatgctcctgtaaactaccggctgcaatgaccaggttgtttgtcgactgtgaaataagcgagcgagcttgatgctattcctcaatcttgactacagtgtcaatttctcctataaatggcaatggggacccatgaccctgatacccgatgggtttttactctattagaagctaattatgttctaactcttatacttatgggtctattgataggcgaaaattcttacccattgggtacgtgggtatggttatattctttacccacccatacccacaaacctgtgggtgaaaaatcccgtagattgagcctaaaactatgaataagataaatctcaactactattaaatcat

SEQ ID NO: 1199 - DNA, 689 bp, Saccharum officinarum
ccgtcttcttccgcctccgttccgcagaagcgaggaaaaaaaaaactcggcgcgtgccctgcctctccctcctccctcctcgtcgtcacccacctcctcgcatattgtggtctggtgtagattggagatctgcccgaacttgggctgagttccccttccgttggacattcattgaggcagcatgcctaagataaaaacaagccgtgtcaagtatcctgaaggatgggagcttattgaaccaacaatccgtgagttggatgccaaaatgagagaagctgaaaatgatccacatgatgggaagagaaagtgtgaagctctctggcctattttccgcatttctcatcaaaggagccgctacatatatgatctttactacagaaggaaggagatatcacaggagctttatgagttttgcctggaccagggttatgcagaccgtaacctgattgcaaagtggaaaaagccaggttacgagcgcctttgctgccttcggtgcatacagacacgtgaccacaactttgcaacgacttgtgtctgccgggtccccaagcatctgagggaggagcaggtgatagaatgtgtccactgcggctgcaggggttgtgccagcggtgactaatcatcgcaacctaaccacatgagatgtcccgtgagcatggatcggctgcgggattaacatgaatgtattg

SEQ ID NO: 1200 - DNA, 919 bp, Saccharum officinarum
  misc_feature (792)..(792): n is a, c, g, or t
cgcaaaagcgagggggaaaaaaaaaactcggcgcgtgccctgcctctccctcgtccctcgtccctcctcgtcgtcacccacctcctcgcatattgtggtctggtgtagattggagatctgcccgaacttgggctgagttccccttccgttggacattcattgaggcagcatgcctaagataaaaacaagccgtgtcaagtatcctgaaggatgggagcttattgaaccaacaatccgtgagttggatgccaaaatgagagaagctgaaaatgatccacatgatgggaagagaaagtgtgaagctctctggcctattttccgcatttctcatcaaaggagccgctacatatatgatctttactacagaaggaaggagatatcacaggagctttatgagttttgcctggaccagggttatgcagaccgtaacctgattgcaaagtggaaaaagccaggttacgagcgcctttgctgccttcggtgcatacagacacgtgaccacaactttgcaacgacttgtgtctgccgggtccccaagcatctgagggaggagcaggtgatagaatgtgtccactgcggctgcaggggttgtgccagcggtgactaatcatcgcaacctaaccacatgagatgtcccgtgagcatggatcggctgcggtgattaacatgaatgtattgtggtaactagtggggaagactttcctgacgtttggatgtttccaactggtatgtactatgatgatttctcgtgccacaaaatcttgggtaaaataagagccctttggatttttnagaaaaaaactgtgatcccgatgtcgattcgagaccgctagccggttgcgtggtgggatctggttttgtcgtgtgttttcgcgtttcgatcggggtatttcaaataaaaaaggggggcccttttaag

SEQ ID NO: 1201 - DNA, 1013 bp, Panicum virgatum
cggcccaaactagggcttgggattaggccagagcaagccggccttcccccttctcggcttcttcccccttttcccctgacgacccgaccgcctccttccttccgccaaaccgaagcgcgcggcgtgcctgcttggctgcttcgcaggagttcgtcccttcttctcgacatccatatcctcgcctccagtggcccggtgtggagtgggatccatttggaatcggattgatttcccctttcgctgatttgtgttctctagacattccataaaccagcatgccaaagataaagacaagccgtgtttcgtatccggaaggatgggagcttattgaaccaacaatccgtgagttggatgccaaaatgagagaagctgaaaatgatccacatgatgggaagaggaagtgtgaagctctctggcccattttccgtatttctcatcaaaggagccgctacatatatgatctttactacagaaggaaggagatatcacagaagctttatgagttttgcctggaccagggttatgcagaccgcaatctgattgcgaagtggaaaaagccaggttatgagcgcctttgctgccttcggtgcatacagacacgtgaccacaactttgcaacgacttgcgtctgcagagtccccaagcacctcagggaggagcaagtgatcgaatgtgtccattgcggctgcaggggctgtgccagcggtgactaatcttgtcgttatgctgttgggttcatgactcatcatctcaaccttaacacttgtgatctctcgtgagcatgttccgataaagagcagcgggtgcctatagaggtgattcgcatgaatgtattggtgcaacttgtaagcctaggatgcttaatttcttgacgtttgtatgtctctgttatgctcagacttgttgacttcgtatgtatgtattatgacgatttcacctcatgcagcccatgctgatatactgttttgtttttttctgtacatatatgaatgagtgtgctaattggattattc

SEQ ID NO: 1202 - DNA, 902 bp, Zea mays
aagaaaacaaactagaaacaccaccaccaccacatacctgagttcctgtgaagtttatctgagttacctgacgaattagggtcctcttccccagatctggtggggaagaaccctacctcacgtcccggatcccatccggcggccaaggggagttacacgctagccggcggtcggccagccgccgccaaccgcctcagccccaacagtcgcaccgccgccgccgaggcaaactcgaagccacccccgccgccgcagccacagccgcgccgagcttgagccgtcgttgctccgctgaatcgcccccatcgtctctcctgaagagagaggacatttattgagacagcatgcctaagataaagacaagtcgtgtcaagtatcctgaaggatgggagcttattgaaccaaccatccgtgagttggatgccaaaatgagagaagctgaaaatgatccacatgatggaaagagaaagtgcgaagctctctggcctatttttcgtatttctcatcaaaggagccgctacatatatgatctttactacagaaggaaggagatatcacgggagctttatgagttttgcctggaccagagctatgcagatcgtaacctgatcgcaaagtggaaaaagccaggatacgagcgcctttgctgccttcggtgcatacagacacgtgaccacaactttgcaacgacttgtgtctgccgagtccccaagcatctgagggaggagcaagtgatagaatgtgtccattgcggctgcaggggttgtgccagcggtgactaatcttgtcatcatgttgttgggctcacgactcatcaccatcctaaccacattagggcttggtcggttattcccaatacacatggattggatgggatttgaaaaaattatggaaaaagtttg

SEQ ID NO: 1203 - DNA, 820 bp, Zea mays
agcattatgttggcccttttgcttactccatttgcatgatgccaggacatttattgagacagcatgcctaagataaagacaagtcgtgtcaagtatcctgaaggatgggagcttattgaaccaaccatccgtgagttggatgccaaaatgagagaagctgaaaatgatccacatgatggaaagagaaagtgtgaagcgctctggcctattttccgtatttctcatcaaaggagccgctacatatatgatctttactacagaaggaaggagatatcacgggagctttatgagttctgcctggaccagagctatgcagaccgtaacctgatcgcaaagtggaaaaagccaggatacgagcgcctttgctgccttcggtgcatacagacacgtgaccacaactttgcaacgacttgtgtctgccgagtccccaagcatctgagggaggagcaagtgatagaatgtgtccattgcggctgcaggggttgtgccagcggtgactaatcttgtcatcatgttgttgggctcacgactcatcatcaccatcctaaccacattagatgtctcgtgagcatggatcggctatggtgattagcatgaatgtgttgtggtaactagttggaagactaaatttcctgacgtttggatgtttgcaactgctatgtactataaagactcctcgtgccacaaatgtttttgttaaattagtagcgcttttgcatcttgtatgattctgtaaattgtcttttatcaccaattgctcaggagccaagctagtacattgctcgaatccttattgagccccagccccggttctatttta

SEQ ID NO: 1204 - DNA, 777 bp, Zea mays
aggacatttattgagacagcatgcctaagataaagacaagtcgtgtcaagtatcctgaaggatgggagcttattgaaccaaccatccgtgagttggatgccaaaatgagagaagctgaaaatgatccacatgatggaaagagaaagtgtgaagcgctctggcctattttccgtatttctcatcaaaggagccgctacatatatgatctttactacagaaggaaggagatatcacgggagctttatgagttctgcctggaccagagctatgcagaccgtaacctgatcgcaaagtggaaaaagccaggatacgagcgcctttgctgccttcggtgcatacagacacgtgaccacaactttgcaacgacttgtgtctgccgagtccccaagcatctgagggaggagcaagtgatagaatgtgtccattgcggctgcaggggttgtgccagcggtgactaatcttgtcatcatgttgttgggctcacgactcatcatcaccatcctaaccacattagatgtctcgtgagcatggatcggctatggtgattagcatgaatgtgttgtggtaactagttggaagactaaatttcctgacgtttggatgtttgcaactgctatgtactataaagactcctcgtgccacagatgtttttgttaaattagtagcgcttttgcatcttgtatgattctgtaaattgtcttttatcaccaattgctcaggagccaagctagtacattgctcgaatccttattgagccccagccccggttctatttta

SEQ ID NO: 1205 - DNA, 1057 bp, Zea mays
aaataggtgttttacgttttagggttgtaaaaaaacttcttccatatcccggccgaggcttcctctgctcgggatcgaccgcgagagcttcgctccaccccgcgcggccgcgcctgccgcctgcgctagccggaggtcggccagccgccccagcctcaacagtcgcacagccgccgccgaggcaaactcgaagccaccccgccgccgcagccacagccgcgccgagcttgagccgtcgttgctccgctgaatcgcccccatcgtctctcctgaagagagaggacatttattgagacatcatgcctaagataaagacaagtcgtgtcaagtatcctgaaggatgggagcttattgaaccaaccatccgtgagttggatgccaaaatgagagaagctgaaaatgatccacatgatggaaagagaaagtgtgaagctctctggcctattttccgtatttctcatcaaaggagccgctacatatatgatctttactacagaaggaaggagatatcacgggagctttatgagttctgcctggaccagagctatgcagatcgtaacctgatcgcaaagtggaaaaagccaggttacgagcgcctttgctgccttcggtgcatacagacacgtgaccacaactttgcaacgacttgtgtctgccgggtccccaagcatctgagggaggagcaagtgatagaatgtgtccattgcggctgcaggggttgtgccagcggtgactaatcttgtcatcatgttgttgggctcacgactcatcatcaccatcctgaccacattagatgtctcgtgagcatggatcggctacggtgattagcatgaatgtgttgtggtaactagtgggaagactaaatttcctgacgtttggatgtttccaactgctatgtactataaagattcctcgtgccacaaatgtttacgttaaattagtagcgcttttgcatcttgtatgattctgtaaattgtttttttatcaccaattgctcaggagccaggctagtacattgctcgaatccttatgaatccccagccccggttctactttc

SEQ ID NO: 1206 - DNA, 1058 bp, Zea mays
aaataggtgttttacgttttagggttgtaaaaaaacttcttccatatcccggccgaggcttcctctgctcgggatcgaccgcgagagcttcgctccaccccgcgcggccgcgcctgccgcctgcgctagccggaggtcggccagccgcctcagccccaacagtcgcaccgccgccgccgaggcaaactcgaagccacccccgccgccgcagccacagccgcgccgagcttgagccgtcgttgctccgctgaatcgcccccatcgtctctcctgaagagagaggacatttattgagacagcatgcctaagataaagacaagtcgtgtcaagtatcctgaaggatgggagcttattgaaccaaccatccgtgagttggatgccaaaatgagagaagctgaaaatgatccacatgatggaaagagaaagtgtgaagctctctggcctatttttcgtatttctcatcaaaggagccgctacatatatgatctttactacagaaggaaggagatatcacgggagctttatgagttttgcctggaccagagctatgcagatcgtaacctgatcgcaaagtggaaaaagccaggttacgagcgcctttgctgccttcggtgcatacagacacgtgaccacaactttgcaacgacttgtgtctgccgggtccccaagcatctgagggaggagcaagtgatagaatgtgtccattgcggctgcaggggttgtgccagcggtgactaatcttgtcatcatgttgttgggctcacgactcatcatcaccatcctgaccacattagatgtctcgtgagcatggatcggctacggtgatttgcatgaatgtgttgtggtaactagtgggaagactaaatttcctgacgtttggatgtttccaactgctatgtactataaagattcctcgtgccacaaatgtttacgttaaattagtagcgcttttgcatcttgtatgattctgtaaattgtttttttatcaccaattgctcaggagccaggctactacattgctcgaatccttatgaaaccccagccccggttctactttc

SEQ ID NO: 1207 - DNA, 920 bp, Panicum virgatum
cagaccaaacggacaccgccctttccccaccttaccctgacgacccgaccgcatcttccttccgcaaaaccgaagctcgcggcgtgcgtcccttctcctcgacatccatatcctcgcctccactggcccggcgtggagtggagagtggggatccatttggacttggattgatttccccttccgctgacattccgtaagccagcatgccgaagataaagacaagccgtgtttcgtatccggaaggatgggagcttattgaaccaacaatccgtgagttggatgccaaaatgagagaagctgaaaatgatccacatgatgggaagaggaagtgtgaagctctctggccaattttccgtatttctcatcaaaggagccgctacatatatgatctttactacagaaggaaggagatatcacagaagctttatgagttttgcctggaccagggttatgcagaccgtaatctgatagcgaagtggaaaaagccgggttatgagcgcctttgctgccttcggtgcatacagacacgtgaccacaactttgcaacaacttgtgtctgccgagtccccaagcacctcagggaggagcaagtgatcgaatgtgttcattgcgggtgcaggggctgtgccagcggtgactaatcttttcattatgcttttgggctcatgactcatcatctggacctaacacttgagatctcttgtgagcatgggccgataaagagcgacggttgcctatagaggtgattcgcatgaatgtatcggtgcaacttgtaagcctaggatgcctctaaatttcttgatgtttggatgtctccaactgttatgctcagacttgttgactttgtatgtatgtattatgacgatttcacctcatgcagcccatgctgatactaatttactagcgtcttttacttttta

SEQ ID NO: 1208 - DNA, 1037 bp, Sorghum bicolor
ggccgatcacagacaccgccttttcccctactctccccttcttcccctttccctgacctccagcctctaggccgatcacagacagacaccgccttcttccgattgcgtttggcaaaagcgggggaaaaaaaaaaagtcggcgcgtgccctgcctctccctcctcgtcgtcaagtcgtcacccacctcctctcatattgtggtctggtgtggattggagatctgctcggacttggactgagttccccttccgttggacattcattgaggcagcatgcctaagataaaaacaagccgtggtcagtatcctgaaggatgggagcttattgaaccaacaatccgtgagttggatgccaaaatgagagaagctgaaaatgatccacatgatgggaagagaaagtgtgaagctctctggcctattttccgtatttctcatcaaaggagccgctacatatatgacctttactacagaaggaaggagatatcacaggagctttatgagttttgcctcgaccagggttatgcagaccgtaacctgattgcaaagtggaaaaagccaggttacgagcgcctttgctgccttcggtgcatacagacacgtgaccacaactttgcaacgacctgtgtctgccgggtccccaagcatctgagggaggagcaggtgatagaatgtgtccattgcggctgcaggggttgtgccagcggtgactaatcttgtcatcatgttgttgggctcacgaactcatcatcgcaacctaaccacatgagatgtcccgtgagcatggattggctgcggtgattagcatgaatgtattgtggtaactagtggcgaagactaaatttcctgacgtttggatgtttccaactgttatgtactatgacgatttctcatgcaacaaatgcttatgttaagttaaattagttagcgcttttgcattttatacgagtctgctattagttggccttttttttaccgtcaattgcccaggcagccaggttagtacattgcccgactcctcatgaatccccggccctggtt

SEQ ID NO: 1209 - DNA, 896 bp, Setaria italica
cttcatttcccctttcccctgacgacccgaccgcctccttccgccaaagcgaagctcgcggcgtgcctcctcatccacatcctccgcttcgagtggcccggcgtggagtggagatccatctggacctggattgatttcccctttcgttgattcgtgttcctggacattccataaggcagcatgccgaagataaagacaagccgtgtttcatatccggaagggtgggagcttattgaaccaacaatccgtgagttggatgccaaaatgagagaagctgaaaatgatccacatgatgggaagagaaagtgtgaagctctctggccaattttccgtatttctcatcaaagaagccgctacatatatgatctttactacagaaggaaggagatatcacagaagctttatgagttctgcctggaccagggttatgcagaccgtaatctgattgcaaagtggaaaaagccgggttatgagcgcctttgctgccttcggtgcatacagacacgtgaccacaactttgcaactacttgtgtctgccgggtccccaagcacctcagggaggagcaagtgatagaatgtgtccactgcggctgcaagggctgtgccagcggtgactaatctcgtcatcatgctgttgtgcccatgactcatcatctcaacctaacactttgagctgtttcgtgagcatgggccgacaaagagcaactgtggcctatagaggtggttcgcatgaatgtgttgcagtaatttgtaagcctaggatgacataatttcctgacgttcggatgtttccaactgttatgctgttgacctgttgactttgcatgtgctatatgacggtttcacctcatgcaagcccatgttggtactaatttgctcgcgtttttacatttttc

SEQ ID NO: 1210 - DNA, 830 bp, Pennisetum glaucum
gcttccgcagttgctcggaagcgaagttcgcggcgtaggagctcatcccttcccgtcgaccgccctcgtcatccgcatcctccgactccggtggcccggcgtggagtggagatccactagattgattccccctttcgttgatttgtgttccccagatattctataaggcagcatgccgaagataaagacaagccgtgtttcatacccggaagggtgggagcttatcgaaccaacaatccgtgagttggatgccaaaatgagagaagctgaaaatgacccacatgatgggaagagaaagtgtgaagctctctggccaattttccgtatttctcatcaaaggagccgctacatatatgatctttactacagaaggaaggagatatcacagaagctttatgagttctgccttgaccagggttatgcagaccgtaatctgattgcaaagtggaaaaagccaggttatgagcgcctttgctgcctccggtgcatacagacacgggaccacaactttgcaacgacttgtgtctgccgggtccccaagcacctcagggaggagcaagtgatagaatgtgtccactgcggctgcaagggctgtgccagcggtgactaatcttgtcatcatgctgttgtgctcatgactcatcatctcaacctaacactttgagatattccgtgagcatgggcggataaagagcaactgtggcttgtagaggtgattcgcatgaacgtgttgctgtaatttgtaagcctaggatgacccgactttcggatgtttctatccaactgttatgctgttgacttgttcactctgtgctatgacgtttccatat

SEQ ID NO: 1211 - DNA, 934 bp, Pennisetum glaucum
gaggatgcggatgacgagggcggtcgacgggaagggatgagccccttttcccctttctccttccgcagttgctcggaagcgaagctcgcggcgtaggagctcatcccttcccgtcgaccgccctcgtcatccgcatcctccgactccggtggcccggcgtggagtggagatccactagattgattccccctttcgttgatttgtgttccccagatattctataaggcagcatgccgaagataaagacaagccgtgtttcatacccggaagggtgggagcttatcgaaccaacaatccgtgagttggatgccaaaatgagagaagctgaaaatgacccacatgatgggaagagaaagtgtgaagctctctggccaattttccgtatttctcatcaaaggagccgctacatatatgatctttactacagaaggaaggagatatcacagaagctttatgagttctgccttgaccagggttatgcagaccgtaatctgattgcaaagtggaaaaagccaggttatgagcgcctttgctgcctccggtgcatacagacacgggaccacaactttgcaacgacttgtgtctgccgggtccccaagcacctcagggaggagcaagtgatagaatgtgtccactgcggctgcaagggctgtgccagcggtgactaatcttgtcatcatgctgttgtgctcatgactcatcatctcaacctaacactttgagatattccgtgagcatgggcggataaagagcaactgtggcttgtagaggtgattcgcatgaacgtgttgctgtaatttgtaagcctaggatgacccgactttcggatgtttctatccaactgttatgctgttgacttgttcactctgtgctatgacgtttccatctcatgcaagcccatgttgctaccaatttgctagcgtttttacaaaaa

SEQ ID NO: 1212 - DNA, 845 bp, Cynodon dactylon
ggggaggtccggtctacacgaactcgcacacggataccgccttccctccccccttcttcttcctcttttcgcccctcgcagccaaagctacgcgcctcgtatcaaaaaaaaaaaaaaaaaaaaaagctacgcgcctagccgcctacggcccggccccgccgcctggctcggaggaatccttctcccctcgccgtccttcgcatcaatccccttcctatcgccggactggggtggagcggggggagatccgcccgggattgtattagtttcttctttccttgctttgtgttctcagcgagacacaggactgcgcttgagggctaggcagcatgcctaagataaagacaagccgtgttgagtatcctgcaggatgggagcttattgagccaacaattcgtgagctggatgcaaaaatgagagaagctgaaaatgatccacatgatgggaagaggaagtgtgaagcactctggccaattttccgtatatctcatcaaagaagccgctacatatatgatctttactacagaaggaaggagatatcaaaggagttgtacgaattctgcctgaatcagggttatgcagaccgtaatctgattgcaaagtggaaaaagcccggctatgagcgtctttgttgccttcgttgcatacagacacgtgaccacaactttgcaactacttgtgtctgccgggtccccaagcatcttagggaggagcaagtcatagaatgcgtccattgcggctgcaggggttgtgccagcggtgactaatcttgtcattatgttgctggtctcagggctcatgatcataatctaaccacttgagattgtctcttgagcatggtttga

SEQ ID NO: 1213 - DNA, 937 bp, Oryza sativa
ctggtagctccggtccaaactccaaacccgcccgtctcctcttcggccgtctttgctcgaccggagcggagcgcagcgcaggccaacggcgtggacgacgcgcgccccctctggatcgccgctcccccgcgcgccacagcttccatccggcgactgcaaggccgcccaagccaagagggtttctttgcaagctttagccgctcgacgttcattgacagaacatgcctaaaataaagacaagccgtgtcaaatatcctggaggatgggagcttattgaaccaactatccgtgagttggatgccaaaatgagggaagctgaaaatgacacacatgatgggaagagaaagtgcgaagccctctggccaattttccgtatttcccatcaaagaagtcgctacatatatgatctttattacagaaggaaggagatatcaaaagagttgtatgagttttgcctggaccagggttatgcagaccgtaatctgattgcaaagtggaaaaagccgggttatgagcgcctttgctgtcttcgatgcatacagacacgagaccacaactttgcaactacatgcgtctgccgggtccccaagcatctcagagaggagaaggttatagaatgtgttcactgtggatgcagaggctgtgccagcggtgattgagatatcgtcattatcttgtttgaatctgtcaaactaagcagacataatgtttcttgagcgaaatttcggctaaaaacgtttacgaaaacgttttgtaaacccgcctaccgggtatgacgttatttaagtacctgagattgtggttacggtctgcattaatctgccgcatggtcattgcttgatcatcggcctcaacaccctgcatatgtgtattctaaagttttttaatggaaacatctgttactcgatgctataattgccgctatggtctttgaaga

SEQ ID NO: 1214 - DNA, 858 bp, Saccharum officinarum
gacttgcggaggtccaccggctcctccaggatttgagacaacatgcctaagataaagacaagccgtgtgaaatatcctgaaggatgggagcttattgagccgacgcttcgggatctggaggccaaaatgagggaagctgaaaatgatccacatgatgggaagaggaaatgtgaagctctttggccaatcttccgtatttctcatcaaaagagtcgctacatatatgatctttactatcgaaggaaggaaatatcgaaagaattatatgagttttgcttagaccaaggttatgcagatcgcaatctgattgcaaagtggaaaaagccaggttatgagcgcctctgctgccttcgctgcatccagacacgagaccacaactttgcaaccacttgcgtctgcagagtgcccaagcacctcagggaggaaaaggtgatagaatgtgtccactgcggatgcaggggctgtgccagcggtgattaaagttgatatcctgcggttgtgggataacctcaaagctgttcgaaatgtgccattatatttgagcccgtatgctgtgaacaagcaccgtataatcaggtggccagcggtgattacagtttcccatctcgtggctgcaaaataatgtcggacaaattgctcgaggtggctcgttgtattgatgatatctgttgaggacaagcactggttaatcagttgatttcaacctatgcaattgtattgtaaaatgccaaaatcaaagttaattcaagccattacttccagtgtactgtttacaaatattggtgactatatagtgacaacatatttgtcacatcaactgctagtatggccattatttgcgattagtgacaaaagata

SEQ ID NO: 1215 - DNA, 920 bp, Panicum virgatum
ctcggactctctcctccctttgctcttccttccctggcggcgacgactgggtgagcggcggcgccatctgtcctgtcttcgcccagccctttgccggcgacgagcgcatcctccttctccagatctgagacatgcctaagataaagacaagccgtgtgaaatatccagaaggatgggagcttattgaaccaacacttcgtgatttggaggccaaaatgagggaagctgaaaatgatccacatgatgggaagaggaagtgtgaagctttatggcccatcttccgtatttctcatcagaagagtcgctacatatatgatctttactatcgaaggaaggaaatatccaaagagctatatgagttttgcttggaccaaggctacgcagatcgcaatctgattgcgaagtggaaaaagccaggttatgagcgcctctgctgcctccgctgcatacaaacacgagaccacaactttgcaaccacctgcgtctgcagggtccccaagcatctcagggaggagaaagtgatagaatgcgtccactgcggatgcagggggtgtgccagcggcgattaaagcctcaatctcgtggttggaaaataatctcaaaactaatcgcgctagatgtctcgttatacttggacgagcctcctatgggaacttaaaaacaaacaccttatgagcatgaccaggtgattacaacttgcgcaatggtacgggtgtggagatgtgccactgccaggcgactaaaagcttcctcatctcgtgtcaagaaatgacgccaaaacgatctgtatttgatccccgttgaggacaagcactgtataaactgttgatttcaacttgtgcaatgtattgtaaaaaaaatcaagtgactattttcatggattgcttacaaatattgtgactgtatagcgacaaagtttt

SEQ ID NO: 1216 - DNA, 958 bp, Saccharum officinarum
  misc_feature (825)..(825): n is a, c, g, or t
tcacccgccggacagtggatggcgaagggcccgcgacttgcggaggtccaccggctcctccaggatttgagacaacatgcctaagataaagacaagccgtgtgaaatatcctgaaggatgggagcttattgagccgacgcttcgggatctggaggccaaaatgagggaagctgaaaatgatccacatgatgggaagaggaaatgtgaagctctttggccaatcttccgtatttctcatcaaaagagtcgctacatatatgatctttactatcgaaggaaggaaatatcgaaagaattatatgagttttgcttagaccaaggttatgcagatcgcaatctgattgcaaagtggaaaaagccaggttatgagcgcctctgctgccttcgctgcatccagacacgagaccacaactttgcaaccacttgcgtctgcagagtgcccaagcacctcagggaggaaaaggtgatagaatgtgtccactgcggatgcaggggctgtgccagcggtgattaaagttgatatcctgcggttgtgggataacctcaaagctgttcgaaatgtgccattatatttgagcccgtatgctgtgaacaagcaccgtataatcaggtggccagcggtgattacagtttcccatctcgtggctgcaaaataatgtcggacaaattgctcgaggtggctcgttgtattgatgatatctgttgaggacaagcactggttaatcagttgatttcaacctatgcaattgtattgtaaaatgccaaaatcaaagttaattcaagccattacttccagtgtactgtttacaaatattggtgactatntagtgacaacatatttgtcacatcaactgctagttttggccattattgcgaattaggacaaaaaaattttcctttatttgggccggggtggaaaatttattttggaaggcttatttcaaattgtcttgattgg

SEQ ID NO: 1217 - DNA, 969 bp, Hordeum vulgare
cccgacccaccgtgcggcaccgtcttctgctctcagtctcccgacatcccgccccctcgccctaccctagcccgatccaacgcggctccagtgccaccgccgtgccctaacctctcctccgcggctccctacccgtcgccgccccacacccctccgcctttcacgcgagtcgccgtcgccgccccacacccctctacctttcacgcgagtcgccctgccgtcccaaccccgtccgcgatttcggccatcggtttctgaggtttgtgcattccaaagccagccctaggacaccccttgtgacagcatgcctaagataaagacaagccgtgtcgaatatcctgaaggatgggcgcttattgaacccacaatccgtgagctggatgccaaaatgagagaagctgaaaacgatacacatgacgggaagaggaagtgtgaagcactctggccaattttccgcatttctcatcaaaggagtcgttacatatatgatcttttctatagaaggaaggaaatatcaaaggagctctatgagttctgcctggaccagggttatgcagaccgtaatctgattgcaaagtggaaaaagccgggctacgagcgcctctgctgcctccgctgcatccagacccgagaccacaactttgcgacgacgtgcgtgtgccgggtccccaagcacctgagggaggagcaggtgatcgaatgtgttcactgtggctgcaagggatgtgccagcggcgactaactgactgattatgcgtcagtggaatccatggtggttctaaaccaaacactctagatgtttcttaagccttgtctctggcaagaacagtcgtcctgtaatgtaagcacttgcagatacctgttgcgcgcgcgcgcgcgcgtgtgtgtgtttgcaatcctcttatccggtttcctgacattgggggttaaggaaacacgcagttgctccgtgcccatggcttaccatca

SEQ ID NO: 1218 - DNA, 975 bp, Hordeum vulgare
cccgacccaccgtgcggcaccgtcttctgctctcagtctcccgacatcccgccccctcgccctaccctagcccgatccaacgcggctccagtgccaccgccgtgccctaacctctcctccgcggctccctacccgtcgccgccccacacccctccgcctttcacgcgagtcgccgtcgccgccccacacccctctacctttcacgcgagtcgccctgccgtcccaaccccgtccgcgatttcggccatcggtttctgaggtttgtgcattccaaagccagctctaggacaccccttgtgacagcatgcctaagataaagacaagccgtgtcgaatatcctgaaggatgggcgcttattgaacccacaatccgtgagctggatgccaaaatgagagaagctgaaaacgatacacatgacgggaagaggaagtgtgaagcactctggccaattttccgcatttctcatcaaaggagtcgttacatatatgatcttttctatagaaggaaggaaatatcaaaggagctctatgagttctgcctggaccagggttatgcagaccgtaatctgattgcaaagtggaaaaagccgggctacgagcgcctctgctgcctccgctgcatccagacccgagaccacaactttgcgacgacgtgcgtgtgccgggtccccaagcacctgagggaggagcaggtgatcgaatgtgtccactgtggctgcaagggatgtgccagcggcgactaactgactgattatgcgtcagtggaatccatggtggttctaaaccaaacactctagatgtttcttaagccttgtctctggcaagaacagtcgtcctgtaatgtaagcacttgcagatacctgttgcgcgcgcgcgcgcgcgtgtgtgtgtgtttgcaatcctcttatccggtttcctgacattgggggttaaggaaacacgcagttgctccgtgcccatggcttaccatcaaaaa

SEQ ID NO: 1219 - DNA, 1153 bp, Sorghum bicolor
acccccgactccccgagaccgagaccgaaaccgagcgtgcccgcatgcggccgagcagaagcggtccccaaatccccaatccccccgaaccctaacgaccactgagtcaccaccgttgccccgtgccgccgcgcggcagagcctcgacgccccgacgcgaaccatagcgactgccgagtcgctgccccgcgcggccgagctccgacgccccaacgccgacgacgcgagaggcccgacacaggatttgagacaacatgcctaagataaagacaagccgtgtgaaatatcctgaaggttgggagcttattgagccaactcttcgggatctggaggccaaaatgagggaagctgaaaatgatccacatgatgggaagaggaaatgtgaagctctttggccaatcttccgtatttctcatcaaaagagtcgctacatatatgatctttactatcgaaggaaggaaatatcaaaagagttatatgagttttgcttagaccaaggttatgcagatcgcaatctgattgcaaagtggaaaaagccaggttatgagcgcctctgctgccttcgctgcatacagacacgagaccacaacttcgcaaccacttgcgtctgcagagtgcccaagcacctcagggaggaaaaggtgatagaatgtgtccactgcggatgcaggggctgtgccagcggtgattaaagttgctatcctgtggttgtgggataacctcaaaactgttcgaaatgtgccattgtatttgagccggtatgctgtgaacaagcaccgtataatcaggtggcgagcggtgattacagtttcccatctcgtggctgcaaaataatgtcggactaattgctcgaggtggctcgttgtattgatgatgatatctgttggggacagcactgtataatcagttgatttcaacctgtgtgtgcaatgtattgcaaaatgccaaaatcaaagttaaattcaagtgattacctccagtgtactgtttacaaggtgactatatagtgacaacatttttgtcacatcgactgctagtatggccattatttgcgattagtgacaaatgatatgcctcatcatgggtagggctgaacaaaatgtttgattgcttatttcaaagttgctttgattgtactcgtttgattttcaaa

SEQ ID NO: 1220 - DNA, 1191 bp, Setaria italica
gatcttcgagacgctggccgctgggccagtgaaccagggatcaggttctgccgttccggacccgtttgccccggtcttgtccaaccaaacccggcggctccgtcgctctcctccgttccccgccgccagtctcgaccgagccgacgatctccgcttccgccgccgccgacgaacccaccgccatctccggttgcggcctcgtcattcggcaaggtcctcaacatccccgccgttgctgacgttgattccggccgatctcttctacgccgtcgtcgtcgtcggaggacctctctccgagcccgtcctcctcgccagtcccaacctcgagatttgagacatgcctaagataaagacaagccgtgtgaaatatcctgaaggatgggagcttattgagccaacacttcgtgatttggaggccaaaatgagggaagctgaaaatgatccacatgatgggaagaggaagtgtgaagctctatggcccatctttcgtatttctcatcagaagagtcgctacatatacgatctttactatcgaaggaaggaaatatcaaaagagctatatgagttttgcttggaccaaggctatgctgatcgcaatctgattgcaaagtggaaaaagccaggttatgagcgcctctgttgcctccgatgcatacaaacacgagaccacaactttgcaaccacttgcgtctgtagggtccccaagcacctcagggaggagaaagtgatagaatgcgtccactgcggatgcaagggttgtgccagcggcgattaataaaagctttcggtctcgtggttggaaaataatctcaaaactaatcgctcaagatgcttcgttatacttgagctcctattgaaaagttgaaaacaaacatcgtacaaccaggtgattacagcttgtgcaatggtgtgggtgtcgagacgtgccagcagtgattaaagtttcctccatctcgtggttggaaaataatgtcagaacgcagtcgctgctcgctggatatgtctcgttgtatttgatctccgttgaggacacagtgtaatcggttgatttcaaattgtgcaatgtattgtaaaatcaagtgactgttttcattaagtttacaaatatttgtgactacagtgatttaccattcgttactttaacagctggtacggccattatttgtgaacttaatgaaaacagtcacttga

SEQ ID NO: 1221 - DNA, 699 bp, Avena sativa
tgaaccccgtccgcgatttcggccgtggtttctgaggtttgtgtattcaagcccagccctaggagatcccttgtgacagcatgcctaagataaagacgagccgtatcgcctatcctgaaggatgggtgcttatcgagcccacaatccgtgagttggatgccaaaatgagagaagctgaaaacgatacgcatgatgggaagagaaagtgtgaagccctctggccaattttccgcatttctcatcaaagaagccgctacatatacgatcttttttatagaaggaaggaaatatcaaaggagctgtatgagttttgcttggaccagggttatgcagaccgtaatctgattgcaaagtggaaaaagccgggttacgagcgcctttgctgcctccgatgcatccagacgcgagaccacaacttcgcaaccacatgcgtgtgccgggtccccaagcacctgagggaggagcaagttatcgagtgcgtccactgtggctgcaagggatgtgccagcggtgactagcataccaactctaggtatgccgtggaatcaggggcttggtttggaacctacccagtctctggtagaaacaatcgtattgtaagcacttggcagatacttgttgtttacaattgctcacctaatttcctgacactgtggttacgaaccagacatgtgcactatctatctatctatccgacta

SEQ ID NO: 1222 - DNA, 674 bp, Festuca arundinacea
  misc_feature (216)..(216): n is a, c, g, or t
  misc_feature (265)..(265): n is a, c, g, or t
  misc_feature (288)..(289): n is a, c, g, or t
  misc_feature (337)..(337): n is a, c, g, or t
  misc_feature (376)..(376): n is a, c, g, or t
  misc_feature (430)..(430): n is a, c, g, or t
gcacgaggctaatccgacccaacggggctctagagctgcggccgcgccctatctctcctccgcggcccccaatccgtcgccgcccccacctccaccccctacgctcgcgcgtcgccgccatcgccgccccccttcaacctcatcgcgcccccctgctgtctcaaccccgtccgcgattttggccgtttgtttctgaggtttgtgtgttccaaaccngccctaggagatcccttgtgacagcatgcctaagataaagacgagccgngtcgaatatcctgaaggatgggnncttattgaaccaacaatccgtgagctggatgccaaaatgagagaagcngaaaacgatacacatgatgggaagagaaagtgcgaagcnctctggccaattttccgcatctctcatcaaagaagtcgttacatatacgatctnttctatagaaggaaggaaatatcaaaggagctgtatgagttttgcctggaccagggttatgcagaccgtaatctgattgcaaagtggaaaaagccgggttacgagcgcctctgctgcctccggtgcatacaaacacgagaccacaactttgcgaccacttgcgtgtgccgggtccccaagcacctgagggaggagcaagttatcgaatgtgtccactgtggctgcaagggatgtgccagcggtg

SEQ ID NO: 1223 - DNA, 909 bp, Triticum aestivum
  misc_feature (252)..(252): n is a, c, g, or t
  misc_feature (831)..(831): n is a, c, g, or t
cggctccagtgccgccgccgtgccctaacctctcctccgcggctcccaacccgtcgccgcccggacccctccgcctttcacgcgagtcgccgccaccgccgttcccgttcaaccccaccgcgtcgccctgccgtcccaaccccgtccggcgatttcggtcatcgtttctgaggtttgtgcattccaagccagccctaggacacctcttgtgacagtatgcctaagataaagacaagccgtgtggaatacccngaaggatgggtgcttatcgagcccacaatccgtgagctggatgccaaaatgagagaagctgaaaacgatacacatgacgggaagaggaagtgtgaagcactctggccaattttccgcatttctcatcaaagaagccgttacatatatgatcttttctataaaaggaaggaaatatcaaaggagctgtatgagttctgcctggaccagggttatgcagaccgtaatctgattgcaaagtggaaaaagccgggttacgagcgcctctgctgcctccgctgcatccagacccgagaccacaactttgcgactacatgcgtgtgccgggtccccaagcacctgagggaggagcaggtaatcgaatgcgtccactgtggctgcaagggatgtgccagcggcgactaactgactagttatgcgtactcagcatgtgtcgtcgaatccatggttctaaagtgagcattctagatgtttcttaatcgtgttctctagtaaagaacaattcgtcctgtaatgtaagcacttggcagatatctgttgcggctgtagtctgtacacaatcggtcatccagtttttatccnttgcttcatcattatcatcctaggaaggcctgaagttgcgcacagatctagtactgtatgagagaagaagtgcgggtg

SEQ ID NO: 1224 - DNA, 830 bp, Triticum aestivum
  misc_feature (49)..(49): n is a, c, g, or t
cctaatccgactcagcgccgccgccgtgccctaacctctcctccgcggncaccaccccgcacccctccgcctttcacgcgagtcgccgccaccgccgttcccgttcaaccccaccgcgccgccctgccgtcccaacccatccgcgatttcggccatcgtttctgaggtctgtgcattccaaaccagccctaggataccccttgtgacagtatgcctaagataaagacaagccgtgtcgaataccctgaaggatgggtgcttattgaacccacaatccgtgagctggatgccaaaatgagagaagctgaaaacgacacacatgacgggaagaggaagtgtgaagcactctggccaattttccgcatttctcatcaaagaagccgttacatttatgatcttttctataaaaggaaggagatatcaaaggagctgtatgagttctgcctggaccagggttatgcagaccgtaatctgattgcaaagtggaaaaagccgggttacgagcgcctctgctgcctccgctgcatccagacccgagaccacaactttgcgacgacgtgcgtgtgccgggtccccaagcatctgagggaggagcaggtgatcgaatgcgtccactgtggctgcaagggatgtgccagcggcgattaactgactagttatgtgtattcatcatgtgtcgccgaatccatggtggctctaagccaagcactctagatgtttcttaagcgtgttctctggtaaagaacagatcgtcctgtaatgtaagcacttggcagatactcctacctgatgatgtgtgcgtgcaacctcttatccagtttcccgacaga

SEQ ID NO: 1225 - DNA, 917 bp, Panicum virgatum
cctctcttccctcggactctctcctgccttgctcttccttacctggcggcgacgactcggcgagcggcggcgccatctgtcctgtcttcgcccagccctttgccggcgacgagcgcatcctccagatctgagacatgcctaagataaagacaagccgtgtgaaatatccagaaggatgggagcttattgaaccaacacttcatgatttggaggccaaaatgagggaagctgaaaatgatccacatgatgggaagaggaagtgtgaagctttatggcccatcttccgtatttctcatcagaagagtcgctacatatatgatctttactatcgaaggaaggaaatatcgaaagagctatatgagttttgcttggaccaaggctacgcagatcgcaatctgattgcgaagtggaaaaagccaggttatgagcgcctctgctgcctccgctgcatacaaacacgagaccacaactttgcaaccacctgtgtctgcagggtccccaagcatctcagggaggagaaagtgatagaatgcgtccactgcggatgcagggggtgtgccagcggtgattaaagcttcgatctcatggttggaaaataatcgctctagatgtctcgatatacttgagctcctatggaaagttgaaaacaaacaccgtatgagtatgaccaggcgattataacttgcgcaatggtacgggtgtggagatgtgccactgccagtggtggttaaaagcttgctcatctcgtgttgaaaaatggcgtcaaactatcgctgtatttgatccccgctggggacaagcactgtataatctgttgatttcaacttgtgcaatgtattgtaaaaaaaatcaagtgactattttcatggaccgcttacaaatatttgtgactgtagagacaaagttttcatcacttc

SEQ ID NO: 1226 - DNA, 833 bp, Triticum aestivum
ccagtgccgccgccgtgccctaacctctcctccgcggctcccaacccgtcgccgcccggacccctccgcctttcacgcgagtcgccgccaccgccgttcccgttcaaccccaccgcgtcgccctgccgtcccaacccatccgcgatttcggccatcgtttctgaggtctgtgcattccaaaccagccctaggacaccccttgtgacagtatgcctaagataaagacaagccgtgtcgaataccctgaaggatgggtgcttattgaacccacaatccgtgagctggatgccaaaatgagagaagctgaaaacgatacacatgacgggaagaggaagtgtgaagcactctggccaattttccgcatttctcatcaaagaagccgttacatttatgatcttttctataaaaggaaggaaatatcaaaggagctgtatgagttctgcctggaccagggttatgcagaccgtaatctgattgcaaagtggaaaaagccgggttacgagcgcctctgctgcctccgctgcatccagacccgagaccacaactttgcgacgacgtgcgtgtgccgggtccccaagcacctgagggaggagcaggtcatcgaatgcgtccactgtggctgcaagggatgtgccagcggcgactaactgactagttatgtgtattcatcatgtgtcgtcgaatccatggttctaaagtgagcactctggttatttctcaagtgtggcctctggtaagaacaatcgtcctgtaatgtaagcacttggcagatatctgttgtgtctgtacaatcggtcatccagttttcctaacagaaacacacatttgctccc

SEQ ID NO: 1227 - DNA, 871 bp, Cynodon dactylon
ccggggacgactcatcatcatccatcgggctccacttccgcggttccgccaccggcgccgctctctttgcccccaccgatccagcctcgtcgttcctcggagctcctcaccgctctcacgacctctgacgccactaactcccgatcttctcgttgcccccgcgtaagtcatccccgtcagtactcctgtttgggctcgccgtctcgccggccgcaacctccagatttgacacaatatgcctaagataaagacaagccgtgtgaaatatcctgagggatgggagcttattgagccaacacttcgtgatttggaagccaaaatgagagaagctgaaaatgatccacatgatgggaagaggaagtgtgaagctctatggccaatcttccgaatttcccatcaaaagagtcgctatatatacgacctttactatcgaaggaaggaaatatcaaaagagttatacgagttttgcttgaaccaaggctatgcagacaaaaatctgattgcaaagtggaaaaagccaggatatgaacgcctttgctgcctccgctgcatacaaactcgagaccacaactttgccaccacctgtgtctgcagggttcccaagcacctgagggaggaaaaagtaattgaatgtgtccactgcggatgtaggggctgtgccagcggtgattgaagcttccgttacatctcatggttggagaaataatatcagaacaagtcgctcagagatggcttggtgtatttgaacttcgtatgaaaaacaagcacctatagtgagatggtttgaacttgtattatgtactggtgctatgtggcttgtgtcgaatgcacattgtgccgaattgtctcaaaactgatcgttatgtggtca

SEQ ID NO: 1228 - DNA, 994 bp, Oryza sativa
gtcctgctacgcatactctcccctctgactctttgcgccaagtcaatctccccgtctgtcttctcggcctcaactcccgtctcctcgctagttcgcccgccgcgccgcctgcgtcgatttcagtccatcctgcggaggggagcagcggtgggtgccgtcctcctgctgcttccgcctccggtaattaggtttgttcgttgagacgacatgcctaagataaagacaagccgtgtcaagtatcctgaaggatgggagcttatagaaccaactctgcgtgatttggaagccaagatgagggaagccgagaatgatccacatgatgggaagaggaagtgcgaagctctctggccaatctttcgtatttctcatcaaaaaagccgttacatatatgatctttactatcgaagaaaggagatatcaaaagagctgtatgaattttgtttggaccaaggtcatgctgataaaaatctgatcgcgaagtggaaaaagccaggttatgagcgtctttgctgcctccgatgcatacagacacgagaccacaactttgcaaccacttgtgtctgtagggtccccaagcacctcagggaagaaaaggttatagagtgtgtccattgtgggtgcagagggtgtgccagtggtgattgaagtcgctgtcctgtggctacaaataatctgagagtaatcgctcgagatgtttccttgtgtttgatctctgttaagacaagcaccatatgaccatataatcaggcgattcgtgtggtgtactgtaaactcttgggctatggcatgtgtctggtgagtaatgacgatttctcaacatgttgtgttcgcaaatggttcagtagaaactagctggaagtttgatggattactgtaccccgctagacctacttactacaatactactgtatgaacacttccttgctacagaggtattaggatgatgttgagttatcaggttttctgcaatatactgtatcacgcttcttggact

SEQ ID NO: 1229 - DNA, 827 bp, Musa acuminata
gctaggttttcttttcttgaggccgttctgcccccttctcttcctctcgtcttcttctgcatcgtggccgccgatcgcatcgcgcactgcctggccgccactacgcctccggcggaggaggtgacatcgacacccaaagcttactggctgataattagtcattgaagagagcagagtttaattcagaaaaaaatgccgaaaataaagactagccgtgttaaatatccggaagggtgggagcttattgagcccactcctcgagagctcgaggcaaagatgagggaagctgaaaatgatccccatgatgggaagagaaagtgtgaagcactttggcctatttttcgaattgctcatcaaaagagccgttatatatatgatctttatcatcggaggaaggaaatttcgaaggaactatatgaattctgcctggatcagggctatgcagaccgtaatttaattgcgaagtggaaaaagccaggttacgagcgcctctgctgcctgaggtgcatgcagacacgagatcacaatttcgcaaccacctgtgtctgcagggtccctaagcacctgagggaagaaaaagtgatagaatgcgtccactgtggctgcaggggctgcgcaagcggagattaagtcctattcacatcttaaggtgataaataatgtgtggtatgtgctgacagacttaatggagatttcatgtaagcttttgtatgtggattcctccccgcataaggctgaaaacatttatcttgtcatctatcgtgtaacattgcctttgtgtggctaatatgtggtcaaatccaacttgatgtcctataatttggctt

SEQ ID NO: 1230 - DNA, 953 bp, Musa acuminata
  misc_feature (45)..(48): n is a, c, g, or t
  misc_feature (61)..(61): n is a, c, g, or t
  misc_feature (65)..(65): n is a, c, g, or t
  misc_feature (84)..(84): n is a, c, g, or t
  misc_feature (103)..(103): n is a, c, g, or t
  misc_feature (110)..(110): n is a, c, g, or t
  misc_feature (113)..(113): n is a, c, g, or t
  misc_feature (136)..(136): n is a, c, g, or t
  misc_feature (273)..(274): n is a, c, g, or t
  misc_feature (283)..(283): n is a, c, g, or t
  misc_feature (286)..(286): n is a, c, g, or t
  misc_feature (297)..(297): n is a, c, g, or t
  misc_feature (301)..(301): n is a, c, g, or t
  misc_feature (307)..(307): n is a, c, g, or t
  misc_feature (311)..(311): n is a, c, g, or t
  misc_feature (357)..(357): n is a, c, g, or t
  misc_feature (383)..(383): n is a, c, g, or t
  misc_feature (792)..(792): n is a, c, g, or t
  misc_feature (854)..(855): n is a, c, g, or t
gctaggttttcttttcttgaggccgttctgcccccttctcttccnnnngtcttcttctgcntcgnggccgccgatcgcatcgcncactgcctggccgccactncgcctcnggnggaggaggtgacatcgacacccnaaggtgcgcgccctatactactcctttccgttgttgtcgaccattgttcgcatcgatggcggcgctgcccttgccctaaccctaggcttacaccgttctttcttcaagtcaatggcttctctgatagttcttactgnntgataattngtnattgaagagancagngtttanttcngaaaaaaatgccgaaaataaagactagccgtgttaaatatccggangggtgggagcttattgagcccactcntcgagagctcgaggcaaagatgagggaagctgaaaatgatccccatgatgggaagagaaagtgtgaagcactttggcctatttttcgaattgctcatcaaaagagccgttatatatatgatctttatcatcggaggaaggaaatttcgaaggaactatatgaattctgcctggatcagggctatgcagaccgtaatttaattgcgaagtggaaaaagccaggttacgagcgcctctgctgcctgaggtgcatgcagacacgagatcacaatttcgcaaccacctgtgtctgcagggtccctaagcacctgagggaagaaaaagtgatagaatgcgtccactgtggctgcaggggctgcgcaagcggagattaagtcctattcacatcttaaggtgataaataatgtgtngtatgtgctgacagacttaatggagatttcatgtaagcttttgtatgtggattcctccccgnntaaggctgaaaacatttatcttgtcatctatcgtgtaacattgcctttgtgtggctaatatgtggtcaaatccaacttgatgtcctataatttggctt

SEQ ID NO: 1231 - DNA, 802 bp, Pennisetum glaucum
tacgtcgtcgccgttagcgcaggacctctctccgagcccgtcttaccccaccaggcctagcctcgagatttaagacatgcctaagataaagacaagccgcgtgaaatatcctgatggatgggagcttattgagccaacacttcgtgatttggaggccaagatgagggaagctgaaaatgatccacatgatgggaagaggaagtgtgaagctctatggcccatcttccgtatttctcatcagaagagtcgctacatatatgatctttactatcgaaggaaggaaatatcaaaagagctatatgagttttgtttggaccaaggctatgcagatcgcaatctgattgcaaagtggaaaaagccaggttatgagcgcctctgctgcctccgctgcatacaaacacgagatcacaacttcgccaccacttgcgtctgcagggtccccaagcacctcagggaggagaaagtgatagaatgcgtccactgtggatgcaaggggtgtgccagcggcgattaaaaagctttctgtctcgcggttggagaaatattctcaaaaactaatcgctcgagatgcttctttatgcttgagctcttacgagaagttgaaaacaaacacagtataaccaggtgattacagcttgtgcaatggtgtgggtgtcgagacgtgccagcggttattaagttcctccatctcgtggctggaaatatgtcagaacgaagtcgctgctcgctggaatgtctcgttgtattttatctcagttgtggacacagtgtaatcggtttgatttcagactgtgcaatgtat

SEQ ID NO: 1232 - DNA, 1057 bp, Pennisetum glaucum
ggttatcagacgctggcagctgggccagtgaaccaaggatcaggctctgccgttccggacccgtttgccccggtcttgtccaaccaaacctggcggctccgtcgctctcctccgttccccgccgccagtcccgaccgagccgacgatctccgctcccgccgccgccgacgaacccaccgccactctccggttgtggcacctcgtcattcggcagcgtcctcaacgtccccaccgtttctgacgttgattccgaccgacctgttctacgtcgtcgccgttagcgcaggacctctctccgagcccgtcttacccaccaggcctagcctcgagatttaagacatgcctaagataaagacaagccgcgtgaaatatcctgatggatgggagcttattgagccaacacttcgtgatttggaggccaagatgagggaagctgaaaatgatccacatgatgggaagaggaagtgtgaagctctatggcccatcttccgtatttctcatcagaagagtcgctacatatatgatctttactatcgaaggaaggaaatatcaaaagagctatatgagttttgtttggaccaaggctatgcagatcgcaatctgattgcaaagtggaaaaagccaggttatgagcgcctctgctgcctccgctgcatacaaacacgagatcacaacttcgccaccacttgcgtctgcagggtccccaagcacctcagggaggagaaagtgatagaatgcgtccactgtggatgcaaggggtgtgccagcggcgattaaaaagctttctgtctcgcggttggagaaatattctcaaaaactaatcgctcgagatgcttctttatgcttgagctcttacgagaagttgaaaacaaacacagtataaccaggtgattacagcttgtgcaatggtgtgggtgtcgagacgtgccagcggttattaaagtttcctccatctcgtggctggaaaataatgtcagaacgaagtcgctgctcgctggaaatgtctcgttgtattttatctcagttgtggacacagtgtaatcggtttgatttcaga

SEQ ID NO: 1233 - DNA, 976 bp, Brachypodium distachyon
gaaaccccacccagcaccaccaaacggccgcgccttctctgagccaacgccacctccgcttcggctccctcaacggccagagctcgagctcccatcctctcccaacgccggccgcgtcgtcctcgtcccgttcctgcctcccctcgacctcctggtaccccctcgtccagcggagatccagctcggacgcggcgtggggagccagatcctcgacctccagagcgagcacggcgcggggcacgaaggcggcggcagcagctggcggtcagagaaggttcctcttgtattaagcatatttcgttgagacaacatgcctaagataaagacaagccgtgtgaaatatcctgaaggatgggaacttattgaaccaactctccgtgatttggaagccaaaatgagagaagcggagaatgatacacatgatgggaagaggaagtgtgaagctctctggccaatcttccgtatttctcatcaaaagagtcgctacatatatgatctttactatcgaaggaaggaaatatcaaaggagttatatgagttttgcttggaccaaggttatgcagacaaaaacctgattgctaaatggaaaaagccaggttacgagcgtctttgctgcctccgatgcatacaaacacgagaccacaactttgcaaccacttgtgtgtgcagggtccccaagcacctcagggaagaaaaggtgatagagtgcgtccactgcggatgcaaggggtgtgccagtggtgattgaagttgcgatctcgtggttaagaataatctgaaagaaactgatcgatgatccctctagatgtttaattatgtttgatccctgatgtttcaagtacaacactagtcaggtgattggagcgcaatgtattgtaaactcttgggttgtgcgtggcattatgtttttaagactcgattttttccgtcatggtagatcatgattatcttgctgaaaatgcttggcgaccttcct

SEQ ID NO: 1234 - DNA, 1051 bp, Aristolochia fimbriata
taagtccacaacaaaaattaagacaagaacctaagagtcattttctatttgtccgttggaataataactaattaaagaaggttactgaatttccccaagtctctgactctctccctccgtctctccccgtatatagcataggtccataggatcttgttcactgaatcactgccaaatccagttttaagggaagtcttcgatagtagcttttatatccgacgacgggcgaggagagtctccagtggaattgtggaaaacagaggttgagaatattgaagagtgacaagaatgccaaaaattaagacaaatcgtattaaatatcctaatgggtgggaattgattgagcctacacttcgtgagcttgaggcaaagatgagagaagccgaaaatgacccgcatgatggcaagagaaaatgtgaagcattatggccaatttttcgaattgcacaccagaagagtcggtatatctacgatctttactaccgaagaaaggaaatatctaaagagctctatgaattctgcttggatcaaggttatgctgatcgaaatctaattgccaagtggaaaaagcctggctatgagcgactgtgctgcctccgatgcattcagccccgagaccacaactttgcaaccacctgtgtctgccgagtccctaagcacttgagagaagagaaagtaatcgaatgtgtccactgcggttgccgtggttgtgccagtggagattaatagcagtctctttgattcattaaaatctattgactccgtttcgattttgcaaaagtcagctacctgtgggtgtcttttaatgtaaattatgaacatccgcttacatgtaactaagattgagaatttcattctggagaaaatgtgacatatgtacacgttggctgtcaccctgcctgaaaatgtattccagctaaattttcttcttaactgtgaattatgtactcttgtagcaaattccctccattggtatgggtatggccattccgttcttgagttatgcggcctccctccactgtgttgttttgaaggtgtgttcattctgaga

SEQ ID NO: 1235 - DNA, 929 bp, Avena sativa
gaacgacaccccgaccgtgcacttggccgcccgctcctgccagccagcgaagatccaaacacatcttattcagaagaatacggcctgcatctcttcctcctttcgcgactggtcgccggaagactcgccgccgaacaccggtcctccttccaccgaatcgtgagacagcgaaggtttttcttctagtaaacatacttcccgggacaacatgcctaagattaagacaagccgtgtgaagtatcccgaaggatgggagcttattgaaccaactctccgtgatttggaaggcaaaatgagagaagccgagaacgatacacatgatgggaagaggaagtgtgaggctctctggccaatcttccggatttctcatcaaaagagccgttatatatatgatctctactaccgaaggaaggagatatcaaaggaattatatgagttttgcttggaccaaggttatgcagacaaaaatctgattgccaaatggaaaaagccaggttatgagcgcctttgctgcctgcgatgcatacaaacgcgagaccacaacttcgcaaccacctgcgtctgcagggtccccaagcacctcagggaagagaaggtgatagagtgcgtccactgcggttgcaaggggtgcgccagcggtgactgaacttggccaaggctttgttaagaaataatccggaactaaccgctcaggatgtttgttggattcgatccctgatgagaacaagcagtatactgtgtaatcaggcgatttgtgcaatgcattgtaagctcttgggcgggtggtatgtgtttgtaatgtaagacccagttttccgacatggaagcttgcaactgtactggtaacgtgatgtcctgatcttccatgatggatgagttgttgttgtaacgtgataccttgctgtgaagtagtttatgagcagattttc

SEQ ID NO: 1236 - DNA, 917 bp, Triticum aestivum
ctgctgcgaacggctgccctccccaacggccacgctagaccgcccgctcctgccaagatccaacgcaactttccgccccctcgtctggtcgtcgggccgtcgccgccggacaccgcccccttccaccgaagcgcggcagctcgaaggttcgtgttctaataagcttattcccttgaggcagcatgcctaagataaagacgagccgtgtgaagtatcctgaaggatgggagcttattgaaccaactctccgtgatttggaagccaaaatgagagaagccgagaacgatacacatgatgggaagaggaagtgtgaggctctctggccaatcttccgtatttctcaccaaaagagccgttatatatatgatctctactatcgaaggaaggagataaaaagggagctgtatgagttttgcttggaccaaggttatgcagacaaaaatctgattgctaaatggaaaaagccaggttatgagcgcctctgctgcctccgctgcatacagacacgagaccacaacttcgcgaccacctgcgtctgcagggtccccaagcacctcagggaagagacggtgatagaatgtgtccactgcgggtgcaaggggtgtgccagcggtgactgaagccgccactcgttgttaagaataaactgaaactgattgctcaagatgctctgttcgatccctgatgaatgaaaacaagcaacgcacaatcaggtgattcgtccatatattcactgtaaactcttgagccgtggtatgtatttgcgtgagaagactcggttttccgccgtggaagttgactactgtttcgctgaatgttatgttaaccccctccatgatggattacagtacagtagtattgttgtgccttgctgttactactagtttactactacctctgtaacttaaaaaaaaaaa

SEQ ID NO: 1237 - DNA, 791 bp, Elaeis guineensis
gccctctccgttcccttttccgctccctttctccagttctccttctctcgtgccgccgcagccgcggcgaggagccctttcctccagtgagagtccgcggccgcctctggttcgcctcctccgccgacggtctctggccttctcgaatcgcagcccacagattgatagtcagaaattgaaaagattaggtggaaatcagttgtcttttacagaatgcctaagataaagacaagccgagtcaaatatccagaaggatgggagcttattgagcctacccttcgtgaattagaggcaaaaatgagagaagctgaaaacgatccacatgatggaaagagaaaatgtgaagccctttggcctatctttaaaattgcgcatcagaagagccgctacatttatgacctatactatcgcaggaaggagatatcaaaagagttgtatgaattttgcttggatcagggccatgcagaccgtaatctgatagcaaaatggaaaaagccaggttacgagcgcctttgctgcctgcggtgcatgcagacacgagatcacaacttcgcgactacttgtgtctgcagggtccccaggcacctgagagaagaaaaagttatagagtgtgttcattgtggctgcagggggtgtgctagtggagattgatgagtactgtcatctgagcaaaagaaaagttatgtcagatttttatatgtaacgacgttgaatctgtaaacaaaatgcaaatgcgattaactatgtatcattgcaaacttgagaagaatgtgttagtacttgaagcgttt

SEQ ID NO: 1238 - DNA, 901 bp, Hordeum vulgare
ggggttggagtcgttctgcaaagcggccgccctcctacgcaacgcccacgataggccgcccgctcctgccaagatccattacaactttccgctcctcgtccggtcgtggtggagccgtcgccgccgacctccggctcctcttccgccgacgcacggcagctcgaaggtccgtgatctagtaagctactctcctggggcagcatgcctaagataaagaccagccgtgtgaaatatcccgaaggatgggagcttattgaaccgactctccgtgatttggaagccaaaatgagagaagccgagaatgatacacatgatgggaagaggaagtgtgaggctctctggcccatcttccgcatctctcaccaaaagagccgttatatatatgatctctactatcgaaggaaggagattaaaaaggagttgtatgagttttgcttggaccagggttatgcagacaaaaatctgattgctaaatggaaaaagccaggctatgagcgtctctgctgcctccgctgcatacagacacgcgaccacaacttcgcaaccacctgcgtctgcagggtccccaagcacctgagggaggagacggtgatagaatgcgtccactgcggatgcaaggggtgcgccagcggcgattgaggccgccaactcgtggtagagaataatccaaaactaatcaccccattagacccctgatgagaacaagtgctactgcataatcaggtgatccgcgcaaatgtattgttaacttggtactatgtgtgagaatactgttttttcgctgtggaagctggcaactgtttggctgaatgttgtagcctgatcttccattatggattactgttgttgtgccttgactactgaagcattttcttattactaaaaaggtagtattagagca

SEQ ID NO: 1239 - DNA, 894 bp, Hordeum vulgare
gttctgcaaagcggccgccctcctacgcaacgcccacgataggccgcccgctcctgccaagatccattacaactttccgctcctcgtccggtcgtggtggagccgtcgccgccgacctccggctcctcttccgccgacgcacggcagctcgaaggtccgtgatctagtaagctactctcctggggcagcatgcctaagataaagaccagccgtgtgaaatatcccgaaggatgggagcttattgaaccgactctccgtgatttggaagccaaaatgagagaagccgagaatgatacacatgatgggaagaggaagtgtgaggctctctggcccatcttccgcatctctcaccaaaagagccgttatatatatgatctctactatcgaaggaaggagattaaaaaggagttgtatgagttttgcttggaccagggttatgcagacaaaaatctgattgctaaatggaaaaagccaggctatgagcgtctctgctgcctccgctgcatacagacacgcgaccacaacttcgcaaccacctgcgtctgcagggtccccaagcacctgagggaggagacggtgatagaatgcgtccactgcggatgcaaggggtgcgccagcggcgattgaggccgccaactcgtggtagagaataatccaaaactaatcaccccattagacccctgatgagaacaagtgctactgcataatcaggtgatccgcgcaaatgtattgttaacttggtactatgtgtgagaatactgttttttcgctgtggaagctggcaactgtttggctgaatgttgtagcctgatcttccattatggattactgttgttgtgccttgactactgaagcattttcttattactaaaaaggtagtattagagcatctac

SEQ ID NO: 1240 - DNA, 845 bp, Triticum aestivum
ccctccccaacggccacgctagaccgcccgctcctgccaagatccaacacaactttccgccccgtcgcccggtcgtcgagccgtcgccgccgaacaccgcccccttccgccgaagcgcggcagctcgaaggttcgtgttctaatacgcttattcccttgaggcagcatgcctaagataaagacgagccgtgtgaagtatcctgaaggatgggagcttattgaaccaactctccgtgatttggaagccaaaatgagagaagccgagaacgacacacatgatgggaagaggaagtgtgaggctctctggccaatcttccgtatttctcaccaaaagagccgttatatatatgatctctactatcgaaggaaggagataaaaagggagctgtatgagttttgcttggaccaaggttatgcagacaaaaatctgattgctaaatggaaaaagccaggttatgagcgcctctgctgcctccgctgcatacagacacgagaccacaactttgcaaccacctgcgtctgcagggtccccaagcacctcagggaagagacggtgatagaatgcgtccactgcggatgcaagggctgtgccagcggcgattgaagtcaccactcgttgttaagaataataatctgaaactgattgttcgagatgctctgtccgatccctgataaatgaaaacaagtaacgtacaatcaggtgattcatccatatattcactgtaaactctcgagcggtggtatgtatttgcgtgagaagactcggttttccgccgtggaagttgactactgtttcgctaaatgttatgttaacccgatcttccatgatggattacagtacagta

SEQ ID NO: 1241 - DNA, 832 bp, Triticum aestivum
ggccacgctagaccgcccgctcctgccaagatccaacacaactttccgccccctcgtccggtcgtcgggccgtcgccgccgaacaccgcccccctccaccgaagcgcggcagctcgaaggttcgtgttctaatacgcttattcccttgaggcagcatgcctaagataaagacgagccgtgtgaagtatcctgaaggatgggagcttattgaaccaactctccgtgatttggaagccaaaatgagagaagctgagaatgatacacatgatgggaagaggaagtgtgaggctctctggccaatcttccgtatttctcaccaaaagagccgttatatatatgatctctactatcgaaggaaggagataaaaaaggagctgtatgagttttgcttggaccaaggttatgcagacaaaaatctgattgctaagtggaaaaagccaggttatgagcgtctctgctgcctccgctgcatacagacacgagaccacaactttgcaaccacctgcgtctgcagggtccccaagcacctcagggaagagacggtgatagaatgtgtccactgcggatgcaaggggtgtgccagcggcgattgaagtcgccactcgttgttaagaataatctgaaaccgattgctcgagatgctctgttggatccctgatgaatgaatgaaaacaagtaacgtacaatcaggtgattcgtccatatattcactgtaaactctcgagccgtggtatgtatttgcgtgagaagactcggttttctgccgtggaagttgacaactgtttcgctgagaatgttatgttaacccgatcttccatgatggatcacagta

SEQ ID NO: 1242 - DNA, 881 bp, Triticum aestivum
ggggctgccctccccaacggccacgctagaccgcccgctcctgccaagatccaacacaactttccgccccctcgtccggtcgtcgggccgtcgccgccgaacaccgcccccctccaccgaagcgcggcagctcgaaggttcgtgttctaataagcttattcccttgaggcagcatgcctaagataaagacgagccgtgtgaagtatcctgaaggatgggagcttattgaaccaactctccgtgatttggaagccaaaatgagagaagctgagaatgatacacatgatgggaagaggaagtgtgaggctctctggccaatcttccgtatttctcaccaaaagagccgttatatatatgatctctactatcgaaggaaggagataaaaaaggagctgtatgagttttgcttggaccaaggttatgcagacaaaaatctgattgctaagtggaaaaagccaggttatgagcgtctctgctgcctccgctgcatacagacacgagaccacaactttgcaaccacctgcgtctgcagggtccccaagcacctcagggaagagacggtgatagaatgtgtccactgcggatgcaaggggtgtgccagcggcgattgaagtcgccactcgttgttaagaataatctgaaaccgattgctcgagatgctctgttggatccctgatgaatgaatgaaaacaagtaacgtacaatcaggtgattcgtccatatattcactgtaaactctcgagccgtggtatgtatttgcgtgagaagactcggttttctgccgtggaagttgacaactgtttcgctgagaatgttatgttaacccgatcttccatgatggatcacagtagtattgttgtgccttgctgttaaaaaaaaaa

SEQ ID NO: 1243 - DNA, 877 bp, Triticum aestivum
cgctagaccgcccgctcctgccaagatccaacgcaactttccgccccctcgtctggtcgtcgggccgtcgccgccggacaccgcccccttccaccgaagcgcggcagctcgaaggttcgtgttctaataagcttattcccttgaggcagcatgcctaagataaagacgagccgtgtgaagtatcctgaaggatgggagcttattgaaccaactctccgtgatttggaagccaaaatgagagaagccgagaacgatacacatgatgggaagaggaagtgtgaggctctctggccaatcttccgtatttctcaccaaaagagccgttatatatatgatctctactatcgaaggaaggagataaaaagggagctgtatgagttttgcttggaccaaggttatgcagacaaaaatctgattgctaaatggaaaaagccaggttatgagcgcctctgctgcctccgctgcatacagacacgagaccacaacttcgcgaccacctgcgtctgcagggtccccaagcacctcagggaagagacggtgatagaatgtgtccactgcgggtgcaaggggtgtgccagcggtgactgaagccgccactcgttgttaagaataaactgaaactgattgctcaagatgctctgttcgatccctgatgaatgaaaacaagcaacgcacaatcaggtgattcgtccatatattcactgtaaactcttgagccgtggtatgtatttgcgtgagaagactcggttttccgccgtggaagttgactactgtttcgctgaatgttatgttaaccccctccatgatggattacagtacagtagtattgttgtgccttgctgttactactagtttactactacctctgtaacttaat

SEQ ID NO: 1244 - DNA, 677 bp, Ananas comosus
cacttggttcgccccgaccggcatctccgctgcgacgcatcatctccttccctcgtccgtcctcacaaatccgtgctctatcgaggcatttgctatctggaaatctaaggtgggaagcacttgtcctctaagcaccatgcctaaaataaagacgagcagggtgaaatatccagaaggatgggagcttattgagcctacacttcatgaattagaagcaaaaatgagagaagctgaaaatgatccacatgatgggaagagaaaatgcgaagcactttggcctatatttcgaattgcacatcagaagagccgttacatatatgacctttaccataggaggaaggagatatcaaaggaattgtatgaattctgcctcgatcagggctatgcagaccgtaatctaattgcaaaatggaaaaagccgggctacgagcgcctttgctgccttcgctgcatgcagacacgagatcacaactttacaaccacgtgtgtctgtagggttcctaaacatctcagggaagaaaaggttattgaatgcgttcattgtggatgtggaggatgtgctagtggtgactaagtattgtactaaatcacatttattatgtttctgcatctctttgttgacaggataaccattatctaatgcttattatgtaatacttttatgtgttggcgttatt

SEQ ID NO: 1245 - DNA, 811 bp, Eucalyptus gunnii
cggccggggattcgacagcaaggtatcctcctctctctctctctctctctctctcgatcttgcttagccgctgttttctccagcaaagcagccgatcttgtctcctctcactgttagttcccgatctccttccggcagaaaatctctctctagacaaggtatataagtatgccgaaagtgaagaccaaccgtgtcaaatatccagaaggatgggaactgatagaacctacacttcgtgaattgcaagcaaagatgagagaagctgaaaatgaccctcatgatggaaagagaaaatgtgaggctctgtggcctattttcaagattgctcatcagaaaagccgatacatatatgatctgtattatcggaggaaagaaatctcaaaagaattgtatgagttctgcttggaccaaggatatgcggataaaaacctgattgctaaatggaagaagcctggttatgagcggctctgctgcttacggtgcatccagccacgtgaccacaatttcgctaccacatgtgtgtgtcgagtgcccaagcatttgagggaggagaaggtgatagagtgcgtccactgtggttgcagggggtgtgcgagtggagattgattactcacctccaatgtgcgcaataggtatctaatttgtttctgcatgctcttgggggacaggctaggagtcattaggctttccataattttatgcttatctccgtgaaactctccagtgaatggagtgtcgtatgcttagcatttgacagtgaagactgtggaccgacccgaggcaaactcaatagactttgtcctgcttgtct

SEQ ID NO: 1246 - DNA, 682 bp, Amborella trichopoda
  misc_feature (372)..(372): n is a, c, g, or t
gctcactgcattgcctcccccaccccccctctctgtggctttgcgaaatcttggatactctctcactgcaaaagcctggggtcgctctctgtgcgaaatcttgggacaccatgccaaagataaagacaaatcgtgtccaatatcctggtggatgggagctaattgaacctactcttcgtgagctagaggcaaagatgcgagaagccgagaatgatactcatgatggtaagagaaagtgtgaggccctttggccgatattccgaatagctcatcagaagagtcgctacatatatgacctttactatcgaagaaaggaaatttcgaaggagttatatgagttctgtttggaacaaggctatgctgatcgcaatntaattgctaaatggaaaaagcctgggtatgaaaggctttgttgcttacggtgcatacaaccacgagatcataacttcaacacgacatgtgtttgtagagtgccaaagcatttgagggaagagaaggttatagaatgcgttcactgtggttgcaggggttgtgctagtggagactgataaatttgaaagacaagattgtatgattttctcagcagatggacttttgtaggattaacattgttttgcatgtataggaaagatcaaactttccaagccttggaaatcaaagaaagctgtgtattaatctctca

SEQ ID NO: 1247 - DNA, 456 bp, Aquilegia formosa
aatgccaaagattaaaaccaaccgtgtcaaatatccaactggatgggagctcatagagccaaccctccgtgagctggaagcaaagatgagagaagctgaaaatgatccgcacgatggaaagagaaaatgtgaaggattatggcccatctttcgaatagctcatcagaagagtcgctacatatatgacctgtactaccgaaggaaagaaatatcaaaggagctgtatgagttctgcttggaacaaggctatggtgaccgcaatctaattgcgaagtggaaaaagtctggttatgagcggctttgttgcctacgatgtatacagccacgggatcacaattttgccactacgtgtgtatgcagagttcccaagcacttaagggaagagaaagttatcgaatgtgttcactgcggttgtggggggtgtgccagtggagattgattgattcctccaataca

SEQ ID NO: 1248 - DNA, 1149 bp, Aristolochia fimbriata
tccgacgcgggggggcctataaataagaaggctcggattctttttctttccctcttccttcaatgttacccctctaattttcgcgccagcatagccgctgcaactttgccgagacgatccgcgagattcagaatcaacatatagctggaacaagaatgccaaagataacaacaagccgtacaaaatatccacaaggatgggaacttattgagcctactcttcgtgagctggaagcaaagatgagagaagctgagaatgacccacatgatggtaagagaaagtgtgagacattatggcctatttttcgaatctcacatcaaaggagccgatatatatttgatctctactatcgacagcaggaaataagtaaggagctttatgaattttgcctggatcaaggctatgctgatcgtaacttaattgccaaatggaaaaagcctggctatgaacggctctgctgtctaagatgcattcagccacgagaccacaactttgccaccacttgcatttgcagggtccctaaacacttgagggaagaaaaggtgattgaatgtgtccattgtggttgccacggttgtgctagtggagactaattattctaacttctaattcgcttactcaggtgccacatctctttcaattctaatatcgagcttttcttttgattgagctattaaggtgaagtttggacatctgttaatctagactaatattgtacccagaagcatcaatattatggtggttcagaacagttaacccatggacttaaactggggctcatcgttttcaatcattgaaaggtgaatgaaacctgctcatatgagaggatggttaaattcacctttcagttgggatgtaaagtgactagcaccaaaactagtccatggaccatctctgggccctgattttgtgtcgattgacttctattaaattaatcagtaaactcaccatgacccttatgacccatcgttataagttttctgtagtatttaatctagtttctattgcatgtaacatggtttaagcatggtgaaccaacggattcctttgtgatgcccgtggaaatattacatgattagcatctcttttcctgtctggtagaacttatagattgcagcaagatctttgtgattaatgtgagtttgatga

SEQ ID NO: 1249 - DNA, 899 bp, Momordica charantia
gccctaggtttgatctctgttctcccaagcttagtttttgaatttcgctcagtcccaatccgctctttttgtctcttcgctttctcacggcttaatattcttctggatctcgcctgccgactcttcaatcacccgccaacgaggatttcttcgagacgaaaatgcctaagattaagacgaaccgtgtcaagtacccggagggatgggagttaatcgaaccaactctccgagaactgcaagctaagatgagagaagccgagaatgacccacatgatggtaagagaaaatgcgagacgttgtggcctatattcaaaatagcgcatcagaaaagccgctatatctttgacctctatcatcgaaggaaggagatatccaaggaattatttgaattctgtttggaccaaggctatgcagatcgtaacttaattgcaaaatggaagaagcctggttatgaacgtttgtgttgcctaagatgcatgcaaccccgagatcataactttgcgacaacatgcgtgtgccgggttcccaagcatctgagggaggagaaggttatcgagtgtgtgcattgtggttgcaggggctgtgcaagtggagattgatatcttctccctggcagtttgtctctctaatcatataactacagacagctttgagactcttcgtactcttgagctgtaagctctaattgtaactttttcactatgtacttactctgttcatacgcattgagttgccattatctgggaaagacaggttcatataaatatttattttcccttgggcatgattgtgttgtgacataggaagaaagcaaatttttcttgcgtcaacaaatggatcgctttattgtgaatcactgtagttttgttatagatggtatggtatggtaaaatctggtt

SEQ ID NO: 1250 - DNA, 908 bp, Cucumis sativus
cccctgtttttagatctgaaaccgctctccttctccacccttcctctctccgattctcatttcttctttcactaatctctcacaatttcatttaactttgcttcgatttcaattttccacttcaactttctgcggagaattgaatcaaacaaccatcttttttaactttctttcctttcaatctcttttacctactgtcccacccgctctctctcgccttcaagttcttcctgtatcttcattcacccgccctcaaggaaattttccaggcaaaaaaatgcccaagattaagacgaaccgtgtcaagtatccggagggatgggagctaattgaaccaacactccgagagttgcaagctaagatgagagaagctgagaatgacccacatgatggtaagagaaagtgcgagactttatggcctatattcaaaatagcacatcagaaaagccgctatatctttgatctttatcatcgaaggaaggaaatatctaaggaattatttgagttctgtttggaccaaggctatgctgatcgtaacttaattgcaaaatggaagaagcctggttatgaacgtttgtgctgtctaagatgcatgcaacctcgagatcacaactttgcgacaacatgcgtgtgccgggttcccaagcacttgagggaggagaaagttattgagtgtgtgcactgtggttgcaggggctgtgcaagtggagattgatattcttctctctgattacaactacagacgcttggatgctatgttcatacgcttgggttgtaatttggtaaaagctcaaattctaacatttgcactagaaacttactctgttcatactcattagtcatcgagttgccgttaactgggaaaagatgatagttcgtatagaaatattcatttccccttgggcatg

SEQ ID NO: 1251 - DNA, 779 bp, Oryza sativa
gccccggcccccgatcctccctccgaccactgcttcctcccacctgcggagacggaaccctaaaaaatttcttcttccccttctcgtccgggcagcggaaggagctctaagccagaagaagcatcatgcctaagataaaaacaagtggtgtgaaatatcccgatgggtgggagcttatagaacccaccctctcagagctccattccaagatgagagaagctgagaatgatccgcatgatgggagaaggaagtgcgaggcactgtggcccatcttcaagatcaatcaccagaggagccgatatctttatgacctatactacaacaggaaggagatatcccaggagttgtatgagttctgccttgaccagggacatgctgaccgtaacctcatcgccaaatggaagaagcaaggctatgagcgtctctgctgcctgcgctgtatccagacacgagaccacaactttgcgaccacctgtgtttgcagggttcctaagcacctaagggaagaacaggtgatagagtgtgtccactgtggttgcaaaggttgtgctagtggtgactaagtatccactattgggattacttttcaagttacatcaggagcaagttgatgaatgtaaactgaataactgatgtagtgatatctctgatgtacttggaaaaatgcctagcctgtctagagagtagactgaatgtactcgtaagatgatggatgtggtaatgtgaaaaaaacttgagttcttctaccacttctatcttatcttatttccattccttct

SEQ ID NO: 1252 - DNA, 1067 bp, Cucumis melo
catgaagcgccgcctccccctgtttttagatctgaaaccgctctccttctcgagccttcctctctccgattctcattttcttttccactaatctctcgcaatttcattacctttgccataactttgctttgatataaattttccacttcaacttcccggggagagttgattcaaagaaccatcttttttaactttctctcctttcaatctcttttagctacactccgatcccctctctctcggctttcaaattcttccggtatcttcattcacccgccgacaaggaaattttccagacaaaaaatgcccaagatcaagacaaaccgtgtcaagtatccggagggatgggagctaattgaaccaactctccgagaattgcaagctaagatgagagaagccgagaatgacccacacgatggtaagagaaagtgcgagactttatggcctatattcaaaatagcacatcagaaaagccgctatatctttgatctttatcatcgaaggaaggaaatatctaaggaattatttgaattctgtttggaccaaggctatgctgatcgtaacttaattgcaaaatggaagaagcctggttatgaacgtttgtgctgtctaagatgcatgcaacctcgagatcacaactttgcgacaacatgcgtgtgccgggttcccaagcacctgagggaggagaaagttattgagtgtgtgcattgtggttgcaggggctgtgcaagtggagattgataccttctcctcgtagtttgtttctctgattatgactacagacgcttggatgctgtgttcatactcttggcttgtaatttggtaaaagctcaaattctaacatttgcactagaaacttactctgttcatacttgttaggggcatcgagttgccgttaactgggaaagatgatagttcgtataaaaatattcttttcctcttgggtatgaattgtgacatagcagaaggcaaaattttcttacatcagcaatcttgtgtttgcttttactgaatcattgtagctttacagtgtatgttataatttccgtgcaaactatttaagtcta

SEQ ID NO: 1253 - DNA, 934 bp, Cucumis melo
tccccctgtttttagatctgaaaccgctctccttctcgagccttcctctctccgattctcattttcttttccactaatctctcgcaatttcattacctttgccataactttgctttgatataaattttccacttcaacttcccggggagagttgattcaaagaaccatcttttttaactttctctcctttcaatctcttttagctacactccgatcccctctctctcggctttcaaattcttccggtatcttcattcacccgccgacaaggaaattttccagacaaaaaatgcccaagatcaagacaaaccgtgtcaagtatccggagggatgggagctaattgaaccaactctccgagaattgcaagctaagatgagagaagccgagaatgacccacacgatggtaagagaaagtgcgagactttatggcctatattcaaaatagcacatcagaaaagccgctatatctttgatctttatcatcgaaggaaggaaatatctaaggaattatttgaattctgtttggaccaaggctatgctgatcgtaacttaattgcaaaatggaagaagcctggttatgaacgtttgtgctgtctaagatgcatgcaacctcgagatcacaactttgcgacaacatgcgtgtgccgggttcccaagcacctgagggaggagaaagttattgagtgtgtgcattgtggttgcaggggctgtgcaagtggagattgataccttctcctcgtagtttgtttctctgattatgactacagacgcttggatgctgtgttcatactcttggcttgtaatttggtaaaagctcaaattctaacatttgcactagaaacttactctgttcatacttgttaggggcatcgagttgccgttaactgggaaagatgatagttcgtataaaatattctttttctcttgggtatg

SEQ ID NO: 1254 - DNA, 625 bp, Acacia harpophylla
ggtgttctcaaactgccattttttccaaatctcctcttctcttcctcgagaaaggatttttccgccgcgggcgccgtcagcctcagccctgtcacggctgccaacttgtacctgaaccctagctagaccacagtcgaccgccgacaacctacagcagaagagtttcttgatttttcatcgattcaggaaaatgccaaaagtaaagacaaatcgcgttaaatatccagagggttgggaattaattgagcctacccttcgtgaacttcaagcaaaaatgagggaagcggagaatgatccacatgatggtaaaagaaaatgtgagacattatggcctatatttaagattgcgcatcagaagagccgctacatatttgacctctaccaccggagaaaggaaatttcaaaggaactgtatgaattttgtttagatcaaggatacgctgaccacaacttgattgcaaaatggaagaagcctggctatgaacgtttgtgttgcttgaggtgcattcagccgcgggatcataactttgccaccacttgtgtttgccgagtacccaagcaactgagggaggaaaaggttatagagtgtgttcattgtggttgtaggggttgtgcgagtggggac

SEQ ID NO: 1255 - DNA, 714 bp, Quercus alba
atggggatcagagttttcttttaaacaagaattcggacccatcatcatcacaactcgaccgtgtggactcgttgatcctcttctttactctctccctaaattgcttcaaaccctaaccctagcttattcaatttgcaggtagaacaatgccaaaggtgaaaacaaaccgtgttaaatacccagagggatgggaactaattgagcctactcttcgtgatttgcaaggaaagatgagagaagctgagaatgatccccatgatggtaagagaaaatgcgaggcattatggcctattttcaaattagcacatcagaagagtcggtacatttttgacctttaccaccggaggaaggaaatatccaaggaattgtacgagttctgtttggatcaaggatatgctgaccgcaatctaattgcaaaatggaaaaagccgggttatgaacgtctctgctgcttaagatgcatccaaccaagggatcacaattttgccaccacgtgtgtgtgccgagtgccgaagcacctgagagaggagaaggttatagagtgtgtacattgcggttgcaggggctgtgcaagtggggattaattcttctctttctcacagatcttggtgccttgtaatctttcaactgtgtaaaccatctattggtttcaattatcctgaactgggcctttgctgtgacaaattattgttataattaagtatggtttggaaa

SEQ ID NO: 1256 - DNA, 820 bp, Helianthus annuus
gaattatgtggtttggttcctcacggctcagagaaaaactggttgatttgatgatacactgaatcatttgcggtagagtggtgatcattatacgcaacgattgacagctttcgatcaactttcggagcatagttaagctagaagaatgcctaaggtgaaaacaaaccgtgttaaatacccagagggatgggaacttattgaacctactcttcgtgaattacagggaaagatgcgcgaagctgagaatgacccacacgacgggaaaagaaaatgtgaggcgttgtggcctatcttcaaaatcgcacaccagaagagtcgctacatctacgacctttattatcgcaggaaagaaatatcaaaggagttgtttgagttttgcttggatcaagggtatgctgaccgtaatatcattgccaagtggaagaagcctgggtatgaacgactatgctgtttaagatgcattcaaccacgtgatcacaacttccagacgacatgcgtttgcagagtccccaagcacctgcgtgaggaaaaggtaattgagtgtgtgcattgcggttgcaagggttgtgcaagcggagattgaccactttatcttgcgccaaacgtttgtatgagtgactgcaagtgttttatccgttatcatcatgtgttgctgtcaaacctaacctgcttgagtattgttaaacaggcttaacagtctgttgggtattaaatggttatcatttagcttatgtgcttgtaaaatagacccgaaactgacagtttgaccttcatgaattcgcaatcattctgttggtatatgcatgtttgttgagaggag

SEQ ID NO: 1257 - DNA, 965 bp, Vitis vinifera
atttgaatcagggaggggattttggaagaacgccataaaggaattcaggtcatcgactcatcgcgtagcttcgatcgcgccgagtctcgattttgattttctctcgcatagaataatgccgaaggtgaagacaaaccgtgtcaagtacccagagggctgggaattgatagagcccactcttcgtgaactacaaggaaagatgagagaagctgaaaatgacccacatgatggtaagagaaaatgtgaggcactatggccgattttcaaaatagcacatcagaagagccgttatatttttgatctttaccaccggaggaaagaaatatctaaggagctgtatgagttctgcatggatcaaggctatgcagaccgcaatctaattgcaaagtggaagaagccgggttatgaacgtctctgctgcttgagatgcatgcaaccacgggatcacaactttgccaccacatgtgtgtgccgggtccccaagcacctaagggaggagaaggttatagagtgtgtgcattgcggttgcaggggctgtgcaagtggcgactgatgggtatctctccttcctaccatgaaatagatgcttggactgccattgttgtattcaagttatcatatcaacatggtttacctggcaatctttgtagacggtaactgaatcctctctcccctagttgagcccttgcaactcaagttaccatgtatttttattaaccagcttccggttactgaatggtatgcatgattatgatcaaacatgatgtgaagcatataattcagaaactcaacttagagttctaatgttgcagcagatgatgtttaatattttccttttcaaatgttggtaagcattacttgtcttagtggtttaacttagttgagatatattattaagtaatatattttcaaagaaacagaactacattctttgaaccttgaatatttaggtggacagtgcccta

SEQ ID NO: 1258 - DNA, 696 bp, Brassica napus
cgtccttctcctgagccccgatctctcctcctcaaactccatcgtcgcctctgtcgattagtttctccgaagagaagatgccgaagattaagactaaccgagtcaagtacccagaagggtgggagttgatcgagcctactcttcgtgagcttgacgccaagatgagagaagctgagatggatgaacatgatggcaagagaaagtgtgaagctttatggccaatcttcaaactctctcatcagaggagtcgctatgtttatgacctttattacaggaggaaggagatatctaaagagctctatgagttctgcttggaccagggctatgctgatcgtaacctcattgccaaatggaagaagtcagggtatgagcgtctatgctgcttgcgatgcatacagccaagagaccacaactatggaacaacatgtgtatgtcgtgttcccaaacacttgcgtgaagagaaagccattgaatgcgttcactgcggttgtcaaggatgcgccagtggcgattaatctctcagactgttttcttcaccattataactctctcgatgtattctatatatttgtcaaatctggattatgtacccctgataccttgactaatttccctttgcagagcttctaattgtcaactcttgtgttgttgaaattagaaagacaggtttggtatataaatgaattatgaagatgc

SEQ ID NO: 1259 - DNA, 725 bp, Brassica napus
ggaacgacgtgggttcgttctttcatcagcgtccttctcctgagccccgatctctcctcctcaaactccatcgtcgcctctgtcgattagtttctccgaagagaagatgccgaagattaagactaaccgagtcaagtacccagaagggtgggagttgatcgagcctactcttcgtgagcttgacgccaagatgagagaagctgagatggatgaacatgatggcaagagaaagtgtgaagctttatggccaatcttcaaactctctcatcagaggagtcgctatgtttatgacctttattacaggaggaaggagatatctaaagagctctatgagttctgcttggaccagggctatgctgatcgtaacctcattgccaaatggaagaagtcagggtatgagcgtctatgctgcttgcgatgcatacagccaagagaccacaactatggaacaacatgtgtatgtcgtgttcccaaacacttgcgtgaagagaaagccattgaatgcgttcactgcggttgtcaaggatgcgccagtggcgattaatctctcagactgttttcttcaccattataactctctcgatgtattctatatatttgtcaaatctggattatgtacccctgataccttgactaatttccctttgcagagcttctaattgtcaactcttgtgttgttgaaattagaaagacaggtttggtatataaatgaattatgaagatgc

SEQ ID NO: 1260 - DNA, 820 bp, Gossypium hirsutum
ccgcgcaggtgtatcaacgcagagtacatgggggactctcatcttttgatccctctcctccaccgccaccagtccctgacccgagccttctcttgccttcaagtttcgtacagacgatatcgggaaattgtataaggtagaacaatgccgaaggtgaaaacaaaccgtgtaaaatatccggaaggatgggaattgattgagcctaccctccgtgaactacaagcaaagatgagagaagctgagaatgatcctcacgatggtaagcgaaaatgtgagacgttgtggcctattttcaaaattgcacatcagaagagccgctacatttttgacctataccatcggaggaaggaaatatcaaaggaattgtatgagttctgcttggaccaaggctatgctgaccgcaaccttattgctaaatggaagaagccgggttacgagcgtttgtgctgcttgagatgtatgcagccacgggatcacaactttgctacaacttgtgtctgccgagtgcccaagcacttaagggaggaaaaggttattgaatgtgtccattgtggatgcaagggctgtgcaagcggagattagattcaccttgttctttttccctagttttctaagtcaatgagagaagtttaaactgtagttgctgccacactgctcattaatttctgtaattttatttgcactgctgtagtttctgaatctgaatccttgcgatgatgctatgtcttggagatcctgtgtcacaactttgctgaaagagctatctgatttaattgttatcatattgtattactttggtgacagtgattcatgtttaaaa

SEQ ID NO: 1261 - DNA, 850 bp, Gossypium hirsutum
  misc_feature (849)..(849): n is a, c, g, or t
gagcgactctatctttctcctttcttttgatccctctcctccaccgccaccagtccctgacccgagccttctcttgccttcaagtttcgtacagacgatatcgggaaattgtataaggtagaacaatgccgaaggtgaaaacaaaccgtgtaaaatatccggaaggatgggaattgattgagcctaccctccgtgaactacaagcaaagatgagagaagctgagaatgatcctcacgatggtaagcgaaaatgtgagacgttgtggcctattttcaaaattgcacatcagaagagccgctacatttttgacctataccatcggaggaaggaaatatcaaaggaattgtatgagttctgcttggaccaaggctatgctgaccgcaaccttattgctaaatggaagaagccgggttacgagcgtttgtgctgcttgagatgtatgcagccacgggatcacaactttgctacaacttgtgtctgccgagtgcccaagcacttaagggaggaaaaggttattgaatgtgtccattgtggatgcaagggctgtgcaagcggagattagattcaccttgttctttttccctagttttctaagtcaatgagagaagtttaaactgtagttgctgccacactgctcattaatttctgtaattttatttgcactgctgtagtttctgaatctgaatccttgcgatgatgctatgtcttggagatcctgtgtcacaactttgctgaaagagctatctgatttaattgttatcatattgtattactttggtgacagtgattcatgtttaaaactcgagtgtgttagaaatacctgtatttcttctccaggttttgctgtnc

SEQ ID NO: 1262 - DNA, 718 bp, Brassica rapa
gatacgaacgacgttggttctttcaccatcgtcgtcctcctgagccccgatctctcacctcctcaagctccctcgtctctgtcgattagtttctccaaagagaagatgccgaagattaagacaaaccgagtcaagtacccagaagggtgggagttgatcgagcctactcttcgtgagcttgacgccaagatgagagaagctgagatggatgaacatgatggcaagagaaagtgtgaagctttatggccaatcttcaaactctctcatcagaggagtcgctatgtctatgacctttattaccgcaggaaggagatatctaaagagctctatgagttctgcttggaccagggctacgcagatcgtaacctcattgccaaatggaagaagtcagggtatgagcgtctatgctgcttgcgttgcatacagccaagagaccacaactatggaacaacatgtgtatgtcgtgttcccaaacacttgcgtgaagagaaagccattgaatgcgttcactgcggttgtcaaggatgcgccagtggcgattaatctctcagactgttttcttcaccattatccctctctcgatgtattctatatatttgtcaaatctggattatgtacccctgacttatttccagttgcagaacttctaattgttgtcaactcttgtgttgctgttgaaattagaaagacagttcccggtttggtatataagtgaatt

SEQ ID NO: 1263 - DNA, 789 bp, Brassica napus
gatacgaacgacgttgcttctttcgccatcgtcctcctcctgagccccgatctctcacctcctcaagctccctcgtctccgtcgattagtttctccaaagagaagatgccgaagattaagaccaaccgagtcaagtacccagaagggtgggagttgatcgagcctactcttcgtgagcttgacgccaagatgagagaagctgagatggatgaacatgatggcaagagaaagtgtgaagctttatggccaatcttcaaactctctcatcagaggagtcgctatgtctatgacctttattaccgcaggaaggagatatctaaagagctctatgagttctgcttggaccagggctacgctgatcgtaacctcattgccaaatggaagaagtcagggtatgagcgtctatgctgcttgcgctgcatacagccaagagaccacaactatggaacaacatgtgtatgtcgtgttcccaaacacttgcgtgaagagaaagccattgaatgcgttcactgcggttgtcaaggatgcgccagtggcgattagtctctcagactgttttcttcaccattatcactctcgatgtattctatatatttgtcaaatctggattatgtaccccctgttaccttgactaatttccctttgcagaacttctaattgtcaactcttgtgttgctgttgaaattagaaagacagttcccggtttggtatataagtgaattatgagaatgattctcggctcgacttgagttgactattgagtattgacgatccaattgcagttttacg

SEQ ID NO: 1264 - DNA, 715 bp, Brassica napus
gatacgaacgacgttgcttctttcgccatcgtcctcctcctgagccccgatctctcacctcctcaagctccctcgtctccgtcgattagtttctccaaagagaagatgccgaagattaagaccaaccgagtcaagtacccagaagggtgggagttgatcgagcctactcttcgtgagcttgacgccaagatgagagaagctgagatggatgaacatgatggcaagagaaagtgtgaagctttatggccaatcttcaaactctctcatcagaggagtcgctatgtctatgacctttattaccgcaggaaggagatatctaaagagctctatgagttctgcttggaccagggctacgctgatcgtaacctcattgccaaatggaagaagtcagggtatgagcgtctatgctgcttgcgctgcatacagccaagagaccacaactatggaacaacatgtgtatgtcgtgttcccaaacacttgcgtgaagagaaagccattgaatgcgttcactgcggttgtcaaggatgcgccagtggcgattagtctctcagactgttttcttcaccattatcactctcgatgtattctatatatttgtcaaatctggattatgtaccccctgttaccttgactaatttccctttgcagaacttctaattgtcaactcttgtgttgctgttgaaattagaaagacagttcccggtttggtatataa

SEQ ID NO: 1265 - DNA, 670 bp, Malus domestica
gtataaaatgccgaaggtaaagactaacagagtcaaatacccagaaggttgggaactaattgagcctacgcttcgcgaactgcaagctaagatgagagaagctgagaatgatactcatgatggtaagagaaaatgtgagaccttgtggcctattttcaaaatagcacatcaaaagagccgctacattttcgacctttaccaccggagaaaagaaatttccaaggagttatatgagttttgtctggaccaaggctatgctgatcgcaatctaattgcaaaatggaaaaagcctggttatgaacggctctgctgtttaagatgcatgcagccccgggaccataactttgccaccacgtgtgtttgccgagttcctaagcatctgagggaggagaaggttatcgagtgtgtgcattgcggctgtaggggctgtgccagcggagattgaatagtggtcgggtctgttcttcaaaatgtaattcaaatgatgcttgaaccaggttatcctcggtaccatgaattgtggggaatttgtaacatgtagctgatcgtaatcttcatgtatcttgctatggatgagtttaaagtgttcctaaccggtttgttgtttcggaaactttgctcttgatgaatgattatgaattccgattgcacatggatcgtgttttctttt

SEQ ID NO: 1266 - DNA, 867 bp, Helianthus annuus
  misc_feature (752)..(752): n is a, c, g, or t
tcctccggcgtagagaaaactggtgattttgaagaggttgatttgatgttacacttgaatcaataatttgcgatagagtggtgatcattatacgcaacgattgacagctttcgatcaactttcggagcataattaagctagaagaatgcctaaggtgaaaacaaaccgtgttaaatacccagagggatgggaacttattgaacctactcttcgtgaattacagggaaagatgcgcgaagctgagaatgacccacacgacgggaagagaaaatgtgaggcgttgtggcctatcttcaaaatcgcacaccagaagagtcgctacatctacgacctttattatcgcaggaaagaaatatcaaaggagttgtttgagttttgcttggatcaagggtatgctgaccgtaatatcattgccaagtggaagaagcctgggtatgaacgactatgctgtttaagatgcattcaaccacgtgatcacaacttccagacgacatgcgtttgcagagtccccaagcacctgcgtgaggaaaaggtgattgagtgtgtgcattgcggttgcaagggttgtgcaagcggagattgaccactttatcttgcgccaaacgtttatatgagtgactgcaagtgttttatccgttatcatcatgtgttgctgtcaaacctaacctgcttgagtattgttaaacaggcttaacagtctgttgggtattaaatggtcatcatttatgctcatgtgcttgtaaaatagaccngaaaccgacagtttgaccttcatgaattcgcaatcattctgttggtatatgcatgtttgttgagaggagctaatctatatcgtttaatcatgaataggatatgttttaattttca

SEQ ID NO: 1267 - DNA, 693 bp, Castanea mollissima
gttgactcgttgatcctcttctttactctcgatctctctctccctaaattgcttcaaaccctaaccctagctttttcaacttgctggtagaacaatgccaaaggtgaaaacaaatcgtgttaaatacccagagggatgggaactaattgagcctactcttcgtgatttgcaaggaaagatgagagaagctgagaatgatccccatgatggtaagagaaaatgtgaggcattatggcctattttcaaattagcacatcagaagagtcgttacatttttgacctttaccaccggaggaaggaaatatccaaggaattgtacgagttctgtttggatcaaggatatgctgaccgcaatctaattgcaaaatggaaaaagccgggttatgaacgtctctgctgcttaagatgcattcaaccaagggatcacaattttgctaccacgtgcgtgtgtcgagtgccgaagcacctgagagaggagaaggttatagagtgtgtacattgcggttgcaggggctgtgcaagtggggattaattcttctctttcttccaagaatgacagatcttggtgccttgtaatctttcaactgtgtaaaccatctattggtttcaattatcctgaattgggcctttgctgtgacaaattattgttataattaagtatggttcagaaatctgactcaaaatttctaagtt

SEQ ID NO: 1268 - DNA, 827 bp, Manihot esculenta
cctcgcttccgtagtccttcaccggtactggtctcgatcatattgcctgaaattgtgtgttcatatcgttctttcttcgctctcattttaaatttgaaggaaaatgccgaaggttaagacgaatcgtgtcaagtaccctgagggttgggagttgatcgagcctactttacgtgaactacaagcaaagatgagagaagctgagaatgacacgcatgatggcaaaagaaaatgcgaagctttgtggccaatttttaagatagcacatcaaaagagccgctacatttttgacctttaccatcgtaggaaggaaatatccaaggaattatatgagttctgtttggaccaaggttatgctgatcgtaatcttattgcaaagtggaagaagccgggttatgagcgtctttgttgcttaagatgcatgcaaccacgggatcacaactttgcaactacatgtgtgtgccgagtgcccaagaacctgagggaggagaaggtcatagaatgcgtccattgcggttgcaggggctgtgcaagtggggattgattgatttcattttccctttgcatgcaggagatgccaagttgccttgtactattttcattattgaactggactatgttcaggttttagtgttaccatttggagaggcctaacttgagttgtgatatttagaccttttctatgaaaaaggaatagttctcttgtgtagtgtctaacggatcttttatacttgccgaaaatgttatgtaattgagcaagttggagagttactgtgtaattgactatttgtttatgtttttttagcaaatttagcgtttaattttatgta

SEQ ID NO: 1269 - DNA, 766 bp, Lotus japonicus
ctattttatttttgaaatcgaaggacgacgcggtgctccgaaagttccagaaaaacccccaaactctccgtccgcccacaacaccgccgtctcgccgccggtagagtgacccgtgccgcctgagctgcaaaaatgcctaaagtgaagacgaaccgtgttaaatacccagagggatgggaattaatcgagcccacgatccgtgaacttcaagcaaagatgagggaagctgagaatgatccacatgatggcaaaagaaagtgtgagactttgtggcctatatttaaaattgcacaccagaagagccgatacatatttgacctctaccatcggaggaaggagatttctaaggagttatatgaattctgtttagatcaaggatacgctgaccgcaacctgattgcaaagtggaagaagcctggttatgaacgtctgtgctgcttgaggtgcatgcaaccgcgcgatcacaattttgccaccacatgtgtttgtagagtacccaagcaacttagggaggagaaggtaatagagtgtgtccattgtggttgcaagggctgtgcaagtggggactgatgggacatcgattttgcagcattaaatgcccagggaggttttgtaagaatgatgtgtttgtgcttttatctttctgttgtctgagactatcaggggctcagcttatgcttgtattactgtttactaactttaagtagctatacatttggaacatttaactaattaccagcattaatcatctgcttatttcataaag

SEQ ID NO: 1270 - DNA, 474 bp, Brassica oleracea
  misc_feature (407)..(407): n is a, c, g, or t
  misc_feature (431)..(431): n is a, c, g, or t
aagagaagatgccgaagattaagactaaccgagtcaagtacccagaagggtgggagttgatcgagcctactcttcgtgagcttgacgccaagatgagagaagctgagatggatgaacatgatggcaagagaaagtgtgaagctttatggccaatcttcaaactctctcatcagaggagtcgctatgtttatgacctttattacaggaggaaggagatatctaaagagctctatgagttctgcttggaccagggctatgctgatcgtaacctcattgccaaatggaagaagtcagggtatgagcgtctatgctgcttgcgatgcatacagccaagagaccacaactatggaacaacatgtgtatgtcgtgttcccaaacacttgcgtgaagagaaagccattgaatgngttcactgcggttgtcaaggatgngccagtggcgattaatctcacccgacatcttcaccagtttcac

SEQ ID NO: 1271 - DNA, 820 bp, Ricinus communis
attccagtcgcttcttttttctcgcgggtcgcctcgcttattaccggtatctagcactttccctctcctaaattcaatttacaactataccctcattcattctcttctgaaaaaagaaattgactcaccagcaatccctagtcactgccttgcttaatttttgattaagagaatgccgaaagtgaagacaaatcgtgtcaactatcctgagggctgggaattgattgagcctaccctacgtgaattacaagccaagatgagagaagctgaaaatgacccgcatgatggtaagagaaaatgtgaggctttgtggcctatttttaagatagcgcatcaaaaaagccgatacatttttgacctttaccatcgtagaaaggaaataagcaaggagttatacgagttttgtctggatcaaggctatgcggaccgcaatcttattgcaaagtggaagaagccgggttatgaacgtctctgctgtttaagatgcatgcaaccacgggatcacaactttgcaactacctgcgtatgccgagtgcccaagaacctgagggaggagaaggtcatagagtgtgtccattgcggttgcaggggatgtgctagtggagattgatcgaatatcttttctttcttgcacagcacactatggatccctatttactgtgtacccagttccttgtcgcactgtttatgtaaactttaacaacaatttggatgctggagatgttggcttttgatacagatttttaccattttcaggagtctgtctcactatcaggcatttgtgataattagacataaattttaactgtcaggatttagt

SEQ ID NO: 1272 - DNA, 616 bp, Brassica juncea
agggaatatgccgaaggtgaagactaaccgagtcaagtacccagaagggtgggagttgatcgagcctactcttcgtgagcttgatgccaagatgagagaagctgagatggatacacatgatggcaagagaaagtgtgaagctttatggccaatcttcaaactctctcatcagaggagtcgctatgtctatgacctctattaccggaggaaggagatatctaaagagctctatgagttctgcttggaccagggctatgctgatcgtaacctcattgccaaatggaagaagtcagggtatgagcgtctatgctgcttgcgctgcatacagccaagagaccacaactatggaaccacatgtgtatgtcgtgtacccaaacacttgcgtgaagagaaagccattgaatgcgttcactgcggttgtcaaggatgcgccagtggcgattaatctctcgactgttttcttcaatcattatcactctctccatgtattctatatatttgtcaaatctggattatgtaccgttataccctgactaatctccctttgcagaacttctaattgtatacacttgtgtttgctgttgagaatgaactatgagaatgattctcggttcga

SEQ ID NO: 1273 - DNA, 761 bp, Hevea brasiliensis
cccagtcccatcaccgttactggtctcgatcatattgtgtgttcttatcgatctctcttcgctctcatttaaatttgaagaaaatgccgaaggtgaagacaaatcgtgtcaagtaccctgagggctgggaattgattgagcctaccttacgtgaactacaagcaaagatgagagaagctgagaatgacacgcatgatggtaaaagaaaatgcgaggctttgtggcctatttttaagatagcacatcaaaagagccgctacatttttgacctttaccatcgtcaaaaggaaatatccaaggaattatatgagttctgtttggaccaaggttatgctgatcgtaatcttattgctaagtggaagaagccaggttatgagcgtctctgttgcttaagatgcatgcaacctagggatcacaactttgcaactacatgtgtgtgccgagtgcccaagaacctgagggaagagaaagtcatagagtgcgtccattgtggttgcaggggctgtgcaagtggggattgattgatttcattttccccttgcatgcaggagatgcccagttgctttttacttgtctcgttgttgaactggattgtaaactaaacaactatttggatgccagggatgctggcatttgcctcaggtattaccgtaatagtgttactatttggagaggcctaactgtcaggcagttgtgataattttagacattttactgtgacagtgaatggttggcttgtgtcataacagtgcttttatact

SEQ ID NO: 1274 - DNA, 776 bp, Ipomoea nil
gggctcttttcctctcatcgagaatcgaagtctccagcctcgccggacaatcctataacctaactccatcggtccatgccgccgactttttccgccggaaaactttgcttcttaacgagagaagttcttcaaatcttcactcacaggagtcaccgcccagtcgcactcttgcagacttgctcgggttcctccaactctccaagggttcaataatcaaagataaaaccatgccgaaggtgaagacaaaccgtgtcaagtacccagagggatgggaattgattgagcccactctaaatgaactacaagccaagatgagagaagcggagaatgacccgcatgacgggaaaagaaagtgtgaagctttgtggcctatctttaaaatttgtcatcagaagagccgctacatttttgacctttaccacaggaggaaggagatctccaaggaattatatgagttctgcttggatcagggttatgcagaccgtaatttaatcgcgaagtggaaaaagcctggctatgaacggctctgttgtttgaggtgcatgcaacctcgggatcacaacttccaaaccacatgtgtttgccgagttcctaagcatctaagggaagagaaggttatagaatgtgtgcattgtggttgcaaaggttgtgctagtggagattgattgagtccttataatagaatgcatgtacggattgaatagtagtgctactttatctgctacttacctcactcaatggcttgcttcagtcaaaccaatgttgaaactgtctga

SEQ ID NO: 1275 - DNA, 793 bp, Tropaeolum majus
tcaacgcagagtggtacggccggggagcctcttcgagattacacaatatcgctcttcctagtttacgaatctaactcctttctccatctaccttgttcatctgctgcttgacgaaagcatccctagtaattacacaacaaatcgaacattttgtggagttaccccctacagggaacatcaagcatcaactaaaatgcctaaggtgaaaacaagtcgtgttaaatatccagaggggtgggaattgattgagcctacacttcgtgagttaggagctaagatgagagaagctgagaacgatccaaatgacggaaagagaaagtgtgaatcgttgtggcctatttttaaaatcgcacatcaaaagagccgctacatatttgacctttattacaagaggaatgaaatatccaaagagctctatgaattctgcttggatcaaggctacgccgaccgcaacctgattgcaaagtggaaaaagccaggatacgaacgcctctgttgcttacgctgcatacaaccaagggaccataactttgccacaacctgtgtatgccgagttcccaagcacctgagagaagaaaaggtcgtagaatgcgtgcattgtggttgtggaggctgtgctagtggagattgaagcattggatgtatcaaaaaactgacctctttgtacgggttccccatatcatatattttcgtgaggtgtgacgatataagttgtaatcgctattattaatgtcttcactacttttgaatgacaattacttggaatataatgggattggtatggattttatta

SEQ ID NO: 1276 - DNA, 818 bp, Fragaria vesca
ataacagcataaatcgcgaaatcccaaaccctgccatcttctctcagcaacgccgtcgtatctgctcaccgctcaccaggtagaaaatgccgaaggtaaagactaatcgagttacctacccagaaggctgggaactaatcgagcctactcttcgtgaactgcaagcaaagatgagagaagctgagaatgatactcatgatggtaaaaggaaatgtgaaaccttatggcccattttcaagatagcacatcaaaagagtcgctacatttttgacctttaccatcgccgaaaagaaatttccaaggaattgtatgagttctgcctggaccaaggttatgctgaccgcaatctaattgcaaagtggaagaagccgggttatgaacgcctttgctgtttaaggtgcatgcagcctcgggatcacaactttgcaaccacatgtgtctgccgagtgcccaagcatctgagggaggagaaggttatagagtgcgtgcactgtggctgcaggggctgtgccagtggagattgattactgttctcttcttcaagttcaaatggtttgcccagtttagcctttgtccatgtgtagtgattgtaccccccttaactgaccttgaatcttttcggctgggagttgtaatagtatgtctcatcttgcaagaacaaattgttgtgatgtttaaccaaatgcaaacttgaaagcttagaaaaagcatgccgtcgtgcattatttgttttggtttgtcacgagtttgcttattgataatgttgcatgtgtgggatggattttttattttctcagtaatttccagagtgacaatgt

SEQ ID NO: 1277 - DNA, 789 bp, Fragaria vesca
  misc_feature (429)..(429): n is a, c, g, or t
  misc_feature (438)..(438): n is a, c, g, or t
  misc_feature (486)..(486): n is a, c, g, or t
  misc_feature (492)..(492): n is a, c, g, or t
  misc_feature (789)..(789): n is a, c, g, or t
ataacagcataaatcgcgaaatcccaaaccctgccatcttctctcagcaacgccgtcgtatctgctcaccgctcaccagggtagaaaatgccgaaggtaaagactaatcgagttacctacccagaaggctgggaactaatcgagcctactcttcgtgaactgcaagcaaagatgagagaagctgagaatgatactcatgatggtaaaaggaaatgtgaaaccttatggcccattttcaagatagcacatcaaaagagtcgctacatttttgacctttaccatcgccgaaaagaaatttccaaggaattgtatgagttctgcctggaccaaggttatgctgaccgcaatctaattgcaaagtggaagaagccgggttatgaacgcctttgctgtttaaggtgcatgcagcctcgggatcacaactttgcnaccacatgngtctgccgagtgcccaagcatctgagggaggagaaggttatagagtgngtgcantgtggctgcaggggctgtgccagtggagattgattactgttctcttcttcaagttcaaatggtttgcccagtttagcctttgtccatgtgtagtgattgtaccccccttaactgaccttgaatcttttcggctgggagttgtaatagtatgtctcatcttgcaagaacaaattgttgtgatgtttaaccaaatgcaaacttgaaagcttagaaaaagcatgccgtcgtgcattatttgttttggtttgcttattgataatgttgcatgtgtggaatggattttttattttctcagtn

SEQ ID NO: 1278 - DNA, 865 bp, Ipomoea nil
gggctcttttcctctcatcgagaatcgaagtctccagcctcgccggacaatcctataacctaactccatcggtccatgccgccgactttttccgccggaaaactttgcttcttaacgagagaagttcttcaaatcttcactcacaggagtcaccgcccagtcgcactcttgcagacttgctcgggttcctccaactctccaagggttcaataatcaaagataaaaccatgccgaaggtgaagacaaaccgtgtcaagtacccagagggatgggaattgattgagcccactctaaatgaactacaagccaagatgagagaagcggagaatgacccgcatgacgggaaaagaaagtgtgaagctttgtggcctatctttaaaatttgtcatcagaagagccgctacatttttgacctttaccacaggaggaaggagatctccaaggaattatatgagttctgcttggatcagggttatgcagaccgtaatttaatcgcgaagtggaaaaagcctggctatgaacggctctgttgtttgaggtgcatgcaacctcgggatcacaacttccaaaccacatgtgtttgtagagtccctaagcatctaagggaagagaaggttatagaatgtgtgcattgcggttgcaaaggttgtgctagtggagattgattgagtgcttctttcttattgagtgagtagtccagtgcttctttatctgctactgactatgccaaccttcagtcaagccaatgttgaaactgtaacttgtttattgcaactcgatctgcactattatattactgtatttctgtgtctaaagatgtttattataacttatgaaaatatggcaagtgttaggcccttcaagt

SEQ ID NO: 1279 - DNA, 712 bp, Rosa hybrid cultivar
gttcgtaaaaagtagggattaaaacgacgtcgtaggagtgctctttccatataaatcccgaacctgagagatcgagtccctctcgtctctgcaacgccgtcgactctgctcaccgtcaccaggtagaaaatgcctaaggtaaagactaatcgagtcaactacccagaaggctgggaactgatcgagcctactcttcgcgaactgcaagcaaagatgagagaagctgagaatgatactcatgatggtaagaggaaatgtgaaaccttatggcctattttcaaaattgcgcatcaaaagagccgttacatttttgacctttaccatcggagaaaagaaatttccaaggaattgtatgagttctgcctggaccaaggttatgcagaccgcaatctaattgctaagtggaagaagcctggttatgaacgtctctgctgtttgaggtgcatgcagcctcgggatcacaactttgccaccacatgtgtctgccgagtgcccaagcatctgagagaggagaaggttatagagtgcgtgcattgtggctgcaggggctgtgccagtggagattgattactggtctcttattcaaccttgaatgctttgcgtagattatcctttgtaccatgtatagagactgtacccctttaactgaccttgaaccttctcaagctgggacttataatagtatgtcttctcttgcaagaaaaaaaaaaaa

SEQ ID NO: 1280 - DNA, 1416 bp, Theobroma cacao
cctctccaattgctgcgcgtgtgggggtatttatagattccctctctcactctctccacttgaagcccgtaggttgtagatccaaacaccgcaaaatcaaaagcacaagggtgccatcagcaggccgccgcgtaaaccgacatagttctgtttgaaatcccaattcgtgacgcaaacgacccagatcgacttctctcgttgattgacgactattcccttcgcctaattcctctttctctcaccctcaagctccgtacttttcaggtcgaacgatgccgaaggtgaagactaaccgtgtaaaatatccggaaggatgggaattgattgagcctacgcttcgtgaactacaagcaaagatgagagaagctgagaatgatcctcatgacggtaagagaaaatgcgagacattgtggcctattttcaaaattgcacaccagaagagccgctatatttttgacctttaccaccggaggaaggagatatccaaggagttgtatgagttctgcttggaccaagcctatgctgaccgcaatcttattgcaaagtggaagaagccgggttatgaacgtttgtgttgcttgagatgcatgcagccacgggatcacaactttgctacaacttgtgtctgccgtgtgccaaaacacttgagggaagaaaaggttattgaatgtgtccattgtggatgtaaaggctgtgcaagcggagactagatttgccttgttcttttggcctctccttcttagttaccaaggggggcttagaatgtagttgctgctgccccctgattacctatttctgtaaattttccttgcgctactgtacctctgaacctgaatttttgctacgaatgttatgtcttggattgagatatttttgctgtggcaattaaccatagataagacattgaattgacttatacttctgtcattatgaggcaaactaatgtgctttgcaactttgctgaacgagcaatcagaattgattttggacttactgtagcattttagtcacctgtgtgatttgtggttcaaactgagtgtttaacaaatggctatatgcctcctggttttggtgccggagctagaattgaaaacaaaaaaagcttatggcgtcctgatggtataattgttgcattcatcaggaacatttgagcaacaagaatacttgttcatggcaaacctcgtactgatttttctttccattttaggtaggataggattagcacttggtagtatagtagcaaaagcattataggggagcgtaggcctgatatgattcatgaagtccattctatctacaagtgtcctagtgccctctcaacaaggaatgcttgaaagaaaagagataaagaaggatagaaaagggtagagaaaatgatatgatagggacatattctaatacagtatcctccatatt

SEQ ID NO: 1281 - DNA, 856 bp, Theobroma cacao
  misc_feature (855)..(855): n is a, c, g, or t
cgggggaagcccgtaggttgtagatccaaacaccgcaaaatcaaaagcacaagggtgccatcagcaggccgccgcgtaaaccgacatagttctgtttgaaatcccaattcgtgacgcaaacgacccagatcgacttctctcgttgattgacgactattcccttcgcctaattcctctttctctcaccctcaagctccgtacttttcaggtcgaacgatgccgaaggtgaagactaaccgtgtaaaatatccggaaggatgggaattgattgagcctacgcttcgtgaactacaagcaaagatgagagaagctgagaatgatcctcatgacggtaagagaaaatgcgagacattgtggcctattttcaaaattgcacaccagaagagccgctatatttttgacctttaccaccggaggaaggagatatccaaggagttgtatgagttctgcttggaccaagcctatgctgaccgcaatcttattgcaaagtggaagaagccgggttatgaacgtttgtgttgcttgagatgcatgcagccacgggatcacaactttgctacaacttgtgtctgccgtgtgccaaaacacttgagggaagaaaaggttattgaatgtgtccattgtggatgtaaaggctgtgcaagcggagactagatttgccttgttcttttggcctctccttcttagttaccaaggggggcttagaatgtagttgctgctgccccctgattacctatttctgtaaattttccttgcgctactgtacctctgaacctgaatttttgctacgaatgttatgtcttggattgagatatttttgctgtggcaattaaccatagataagacattgaattna

SEQ ID NO: 1282 - DNA, 707 bp, Raphanus sativus
tcctcctcctcctgagccgcgatctcctccttcaactccatcgtctctgtcgattagtttctccaaggagaaggatgccaaaggttaagacaaaccgagtcaagtacccagaagggtgggagttgatcgagcctactcttcgtgagcttgatgccaagatgagagaagctgagatggatacacatgatggcaagagaaagtgtgaagctttatggccaatcttcaaactctctcatcagaggagtcgctatgtctatgacctttattaccgcaggaaggagatatctaaagagctctatgagttctgcttggaccagggctatgctgatcgtaacctcattgccaaatggaagaagtcagggtatgagcgtctatgctgcttgcgctgcatacagccaagagaccacaactacggaacaacatgtgtatgtcgtgttcccaaacacttgcgtgaagagaaagcgattgagtgcgttcactgcggttgtcaaggatgcgccagtggcgattaatctctcaagactgttttcttcaccgttgtcactctcttggatgtatttctatatatttgtcaaatctggattatgtaccctgactaatttacctttgcagaacttttaattgtcaagtcttgtgttgctgttgagattagaaagacagttcccggtttggtgtataaatgaattatgagatgattctcggttcga

SEQ ID NO: 1283 - DNA, 732 bp, Prunus persica
cctctttccttctgctcagcctgcctcagctcccgccacaacgccatcgtctccacagccttctcttctctccgtcaggtagaaaatgcctaaggtgaagaccaaccgagtcaaatacccagaaggttgggaactgattgagccaactattcgcgagctacaagcgaagatgagagaagctgagaatgatactcatgatggtaagaggaaatgtgagaccttgtggccgatcttcaaaatagcacatcaaaagagccgctacatttttgacctgtaccatcggagaaatgagatatccaaggagttgtacgagttctgtctggaccaaggctatgctgaccgcaatctaattgcaaaatggaaaaagcctggttatgaacgcctctgctgtttaagatgcatgcagcctcgcgatcataactttgccacaacatgcgtgtgtcgtgtgcccaagcatctgagggaggagaaggttatagagtgtgtgcattgtggctgtaagggttgtgccagtggggattgattagcgtgttcttcttcaaatgtaatattagatggatctttgtaatattaagctaatcttaattttcttgaatctgagccctttgcaaatgatattagtaatttagtagtatgtttctcttgttgtgaaccacggttgtgatattcaactaactgcaacttgaaagctgaaagaaatcagtaccttggaacttccaagtgtgctatgga

SEQ ID NO: 1284 - DNA, 742 bp, Prunus persica
  misc_feature (562)..(563): n is a, c, g, or t
  misc_feature (566)..(567): n is a, c, g, or t
  misc_feature (571)..(571): n is a, c, g, or t
  misc_feature (580)..(580): n is a, c, g, or t
  misc_feature (591)..(593): n is a, c, g, or t
  misc_feature (600)..(600): n is a, c, g, or t
  misc_feature (605)..(607): n is a, c, g, or t
  misc_feature (612)..(612): n is a, c, g, or t
cctgcctcagctcccgccacaacgccatcgtctccacagccttctcttctctccgtcaggtagaaaatgcctaaggtgaagaccaaccgagtcaaatacccagaaggttgggaactgattgagccaactattcgcgagctacaagcgaagatgagagaagctgagaatgatactcatgatggtaagaggaaatgtgagaccttgtggccgatcttcaaaatagcacatcaaaagagccgctacatttttgacctgtaccatcggagaaatgagatatccaaggagttgtacgagttctgtctggaccaaggctatgctgaccgcaatctaattgcaaaatggaaaaagcctggttatgaacgcctctgctgtttaagatgcatgcagcctcgcgatcataactttgccacaacatgcgtgtgtcgtgtgcccaagcatctgagggaggagaaggttatagagtgtgtgcattgtggctgtaagggttgtgccagtggggattgattagcgtgttcttcttcaaatgtaatattagatggatctttgtaatattaagctaatnntanntttnttgaatctnagccctttgcnnntgatatnagtannntagtngtatgtttcctctagctgggaccacggctgtgatattcaactaactgcaacttgaaagctgaaagaaacattacctagaacttccaaggtgctatggagaagaaacgtacctgcaagctttttttgttcc

SEQ ID NO: 1285 - DNA, 1209 bp, Citrus sinensis
ccatcgatacgacaccatttcattcactcatccgaaagtattaataatcgccgccgcctccgcctccgcctgcatccagactcgccgtctccgacaaccgggaaactcaaggtcagatgcggttttccaatatttcaatctctttcattgtgatctgacgtctgattattatgtatagctttaactttgagaagattcacagagagaaaaaaaaaaaaaaaaagagtttcgggtacggttcggtttaacgctaaacccggtcggttcaaaccaaccgacttgaaactatatacgcatccatataaggcaaaaaaccggaacgcaatccctagtcccccttctctttcttcttctttatcgtgaaagagagagaatacctgcgcccacgctgcagccgcgccgccgctaacaaacgccgacgccgacgccaactcccgcgcccacggtctagtttctctaaccctaagctaacaaaacaatccgaggataatacgtagctgaacaggtagaaaaatgccaaaggtaaagacaaaccgtgtcaagattccggagggatgggaattgattgagcctacacttcgtgaattacaggcaaagatgagagaagccgagaatgatccccatgatggcaagaggaaatgtgagacattgtggcctatttttaaaatagcacatcagaagagccgctatatttttgacctttactatcgaaggaaggaaatatctaaggagctatatgagttctgcttggatcaaggctatgcagaccgcaatttaattgcaaaatggaaaaagccgggttatgaacgtctgtgttgcctaagatgcatgcagccgcgtgatcacaacttccaaacaacatgtgtgtgccgagtacccaagaacctgagggaggagaaggttatagagtgtgttcattgtggttgcaggggctgcgcaagtggtgattaatcaactggtatctgcttcttttaatcggcaagttgatgttctgagtttagactgtttgctacttgatgtcaaatatagcataacaatctctgtaactttaggttggttttgcagactttgctattgcaaatgattatgatatatctaatcaagcatgaaatgtgattccaaaatttggttccgactttatcattagagagtggactgtttagatgagtgatagcgtaacatcatagacaagaaattggaatagttttg

SEQ ID NO: 1286 - DNA, 837 bp, Senecio madagascariensis
ctcatttacaccaaacatatccgatatattatgaaccataccgtcaagctcttataaaacgctaaaatcgccgttcccccacaataaaacgctaaaatcaccaaacatactctctgttaaaatcggcgttcccccacaataaactccggtgactctactcgtcggacggccaactactccggcaagccctcttttttgttcagtctgaaagaatgcctaaggtgaagacaaaccgcgttaaatacccagagggatgggaactcgtggagccaactcttaatgaattacaagcaaagatgagagaagctgagaatgacccacatgacgggaagagaaaatgtgagactctgtggccaattttcaaaattgcacaccagaagagtcgctacatctttgatctttattatcgtaggaaagaaatttcccaggaactgtacgaattttgcttggatcaaggatatgctgaccgtaacattattgctaaatggaaaaagcctggatatgaacgactttgctgtttaagatgcattcaaccacgtgatcacaacttccaaacaacgtgtgtttgtagagtgcccaaacacctgagagaggaaaaggtaatcgagtgtgtgcattgtggttgcaaaggctgtgcaagtggagattaatcacttattttgtacgaaaccgaacgttccatcatctatggtaagcttaataatgatcttgctttggttatatgtaaacttcttgaaacttagtttccgtcttgccgatcacactgttaacctatgtattttgtaagcaactatctggtctaaagacgaccatgtattatgtacttgactttgtgat

SEQ ID NO: 1287 - DNA, 1048 bp, Vigna unguiculata
  misc_feature (273)..(273): n is a, c, g, or t
  misc_feature (876)..(876): n is a, c, g, or t
  misc_feature (998)..(998): n is a, c, g, or t
  misc_feature (1000)..(1000): n is a, c, g, or t
cggacgcgtgcgctgcaactgcgagactgcaactcttcttctccgctctcttgtctgcgccacacacatactcgcttctcctccacccacgtcgccgctggccaccacgaaacacgctggccaccacgtcgccgctggccatacctgcttctcctccaccgtgacatccaccacgtcgctggcagcagcgagaaaacagcgcagtgcacggagaacgcagagccaccatcggactgcgattggcgaacgattccgaccgccacgaccaccgcnaagacagatataaaaatgccaaaagtaaagacaaatcgtgttaaatacccagagggttgggagttaattgagcctacactccgggaacttcaagcaaagatgagggaagctgagaatgatccacatgatggtaaaaggaaatgtgagacattgtggccaatatttaagattgcacaccagaagagccgctacatatttgacctctaccatcggaggaaagaaatttctaaagaactgtatgaattctgtctagatcaaggatatgctgaccgcaatctaattgctaagtggaagaagcctggttatgaacgtctatgctgcctgaggtgcatgcagccacgcgatcacaattttgccaccacttgtgtttgcagagttccgaagcaacttagggaggagaaggtgattgagtgtgttcattgtggatgcaagggttgtgcaagtggagactgattggacaacaattcttgtattggtgttagtggagggtttcttagcctactaatttcgtcgatcctttattttctgttgtccgaaactcagatgggacacaatttctccatttgtattgctgtctactacatgagtgttatgtattaggtntattagttatatgtctagttcagaatctgacttagttttgtgcctattcatctttgttagcctaacatggtgcaacttaatcaatgggcttagaagaatcttattattattattactattantnttcgaagtaaactatttttgtgaggaaaaaaataaaggaaaagggcgg

SEQ ID NO: 1288 - DNA, 1026 bp, Glycine max
tacacccgtggggattatttcagtagcgtgaaacttccataataactcaaaatcagttctcttctgcctgcgctctttcgcttcctgcgaatctttccgagaatcgagtcacagagtagagcgaaatcggcgtagagatacaaaaatgccaaaagtaaagacaaatcgtgttaaatacccagagggctgggaattgattgagcctacactccgtgaacttcaagcaaagatgagggaagctgagaatgatccacatgatggcaaaagaaaatgtgagacattatggccaatatttaagattgcacaccagaagagccgctacatatttgacctctaccatcggaggaaggaaatttctaaagaactgtatgaattctgtttagatcaaggatatgctgaccgcaatctaattgcaaaatggaagaagcctggttatgaacgtctttgctgcctgaggtgcatgcagccacgtgatcacaattttgccaccacttgtgtttgcagagttcccaagcaacttagggaggagaaggtcatagagtgtgttcactgtgggtgcaagggttgtgcaagtggggactgattgaataccgattctagttttagttgccaatggagggtttcttagaattactttctttgtgcttttagctttctgttgtctgaaatcctcaccatgggacaccacttctcctggttgtattactgtctactaaatgagtgctatatatattgggaatattggtttcatattagtcatctgcctagttcaaaatctgactggagctttgtacctttacattgattagcctaatatggtgtacttttgctcgatacttctcagcttaaacattgggcttaaaataatcgaaggttagtgtaaacttttaatgctgctttggttaagattggagtcaagctaaatatttttgtgaggtaaagattgtaaaaggcaaagcattattcttagatgaatatatttttgtgtcatccatctcccagtcaactcatttgatgagtaaatag

SEQ ID NO: 1289 - DNA, 838 bp, Glycine max
ggggattatttcagtagcgtgaaacttccataataactcaaaatcagttctcttctgcctgcgctctttcgcttcctgcgaatctttccgagaatcgagtcacagagtagagcgaaatcggcgtagagatacaaaaatgccaaaagtaaagacaaatcgtgttaaatacccagagggctgggaattgattgagcctacactccgtgaacttcaagcaaagatgagggaagctgagaatgatccacatgatggcaaaagaaaatgtgagacattatggccaatatttaagattgcacaccagaagagccgctacatatttgacctctaccatcggaggaaggaaatttctaaagaactgtatgaattctgtttagatcaaggatatgctgaccgcaatctaattgcaaaatggaagaagcctggttatgaacgtctttgctgcctgaggtgcatgcagccacgtgatcacaattttgccaccacttgtgtttgcagagttcccaagcaacttagggaggagaaggtcatagagtgtgttcactgtgggtgcaagggttgtgcaagtggggactgattgaataccgattctagttttagttgccaatggagggtttcttagaattactttctttgtgcttttagctttctgttgtctgaaatcctcaccatgggacaccacttctcctggttgtattactgtctactaaatgagtgctatatatattgggaatattggtttcatattagtcatctgcctagttcaaaatctgactggagctttgtacctttacattgattagcctaatatggtgtacttttgctcgatacttctcagctt

SEQ ID NO: 1290 - DNA, 670 bp, Raphanus sativus
  misc_feature (630)..(630): n is a, c, g, or t
ctccttaaactccatcgtctcttgtcgattatttctccaaagagaaggatgccaaaggttaagacaaaccgagtcaagtacccagaagggtgggagttgatcgagcctactcttcgtgagcttgatgccaagatgagagaagctgagatggatacacatgatggcaagagaaagtgtgaagctttatggccaatcttcaaactctctcatcagaggagtcgctatgtgtacgacctttattaccgcaggaaggagatatccaaagagctctatgagttctgcttggaccagggatatgctgatcgtaacctcattgccaaatggaagaaatcagggtatgagcgtctatgttgcttgcgctgcatacagccgagagaccacaactacggaacaacatgtgtatgtcgtgttcccaaacacttgcgtgaagagaaagcgattgagtgcgttcactgcggttgtcaaggatgcgccagtggcgattagtctctcggactgttttcttcaccactgtcactctcttggatgtatttctatatatttgtcaaatctggattatgtaccctgactaatttccctttgaagaacttctaattgtcaagtctttgtgttgctgttgagattagaaanacggttttcggtttggtaaataaaggaattatgagaatga

SEQ ID NO: 1291 - DNA, 883 bp, Arachis hypogaea
taaatcagaaacttccatagaactcaaaaacaaaaaacagcgttgttgtggtttttgtgagcggtgcgcggtggtgggtgcggaggtggttgtgggcgagctcggttccgaaagttatcgctctacaacaatctcaatcttcatatttgaatcgctactcagttcctcagtgctcagatactaagaaaagataaaaaagggaaatgccgaaggtaaagactaaccgtgttaagtacccagagggatgggaactcattgagcctacactccgtgaacttcaagcgaagatgagggaagctgagaacgaccctcacgatggcaaaagaaaatgtgagactttatggcctatattcaagattgctcaccagaagagtcgctacatatttgacctttaccaccggaggaaagaaatttccaaagagttgtacgagttctgtttggatcaaggatatgccgaccgcaatctgatcgcgaaatggaagaagcctggttatgaacgtctgtgttgcctgaggtgcatgcagcctcgtgatcacaattttgccaccacttgtgtttgcagagtgcccaaacaacttagggaggagaaggttatagaatgtgttcattgtggttgtaagggttgtgctagtggggactgatttgggcacaactctagtgtatcacttataagggtttcttattagaattgtgttgccaatagcttctgttttctgcaactcttatggtgcttagtgctcacttcccaaggttgtattatcagctcaatgactcttgtactaatagacgatatattatgtacctttagattcgagagctgatatcatttgctactaaactaatttaacactcgcctgagagtgaatgaaatatttaatgttaa

SEQ ID NO: 1292 - DNA, 861 bp, Arachis hypogaea
aaaaacaaaaacatcgttgttgtggtttttgtgagcggtgcacggtggtgggcgcggaggtggttgtgggcgagctcggttccgaaagttatcgctctacaacaatctcaatcttcatatttgaatcgctactcagttcctcagtgctcagatactaagaaaagataaaaaaggaaaatgccgaaggtaaagactaaccgtgttaagtacccagagggatgggaactcattgagcctacactccgtgaacttcaagcgaagatgagggaagctgagaacgaccctcacgatggcaaaagaaaatgtgagactttatggcctatattcaagattgctcaccagaagagtcgctacatatttgacctttaccaccggaggaaagaaatttccaaagagttgtacgagttctgtttggatcaaggatatgccgaccgcaatctgatcgcgaagtggaagaagcctggttatgaacgtctgtgttgcctgaggtgcatgcagcctcgtgatcacaattttgccaccacttgtgtttgcagagtgcccaaacaacttagggaggagaaggttatagaatgtgttcattgtggttgtaagggttgtgctagtggggactgatttgggcacaactctagtgtatcacttattggggtttcttattagaattgtgtcgccaatagcttctgttttctgcaactcttatggtgcttagtgctcacttcccaaggttgcattatcagctcaatgactctagtactaatagacgatatattatgtaccttcagattcgagagctgacatcatttgctactaaactaatttaagcctgagagtgaatgaaatatttaatgttaatcgaacacg

SEQ ID NO: 1293 - DNA, 1509 bp, Glycine max
gtaaactccttcatgttattgtaactgaggacactctctctgccacgtactcttaaatttaattcacatttcattgatcgtcttacacacgtggggattatttcagtggcgtgaaacttccagaagaactcaaagtcactcctcttctgcttgccctctttcgcttcctgcaaatctttctgagaatcgagtcacagactagagctaaatcagcatagagatacaaaaatgccaaaagtaaagacaaatcgtgttaaatacccagagggctgggaattaattgagcctacactccgtgaacttcaagcaaagatgagggaagctgagaatgatccgcatgatggcaaaagaaaatgtgagaccttatggcctatatttaagattgcacaccagaagagccgctacatatttgatctataccatcggaggaaggaaatttctaaagaactgtatgaattctgtttagatcaaggatatgctgaccgcaatctaattgcaaaatggaagaagcctggttatgaacgtctttgctgcctgaggtgcatgcagccacgtgatcacaattttgccaccacttgtgtttgcagagtacccaagcaacttagggaggagaaggtcatagagtgtgttcactgtggatgcaagggttgtgcaagcggggactaattgaatatcgattctagttttagttgccaatggaaggtttcttagaattactttctttgtgcttttagcttaatgttgtctgaaaccctcaccatgggacaccacttctccaggttgtattactgtctactaaatgagtgctatatattgggaacattggttacatattagggtgtgtttggtttgcattttcattttctgttttcatttcctgtttttattttttgaaaattgtttttattttcaaaagatttaaattctgaaaatatgtttggtttgatttcttgttttctgtttttatgaaataaaaatactgaaaatttatgatatattgacttattgtctttttgtatttttagatttgcttaaaactacatttattgtcaccgcaatttcattttaaccaaaatgaggtttctgttctcaactgaaaatactgaaaacgaaaattttttgttttcattttctagttgtttactgttttcatttttaccgaaaatgttttcagaaatcaaaccaaacacattttcatcaccgttttttattttcagtgaaaataaaatcaaaaaacaaccaaactaaacactcccttagttatctgcctagttcaaaatctgacgggagctttgtaccttttcattgattagcctaatatggtgtacttttgctctatacttcaaagctttaatgctgctttggttaagattggagccaagctggacaaactccaaagtttttattttttattttttaaagagatcaattttgtgaggggaacattgtaaaagtcaaagcattattctgagataaatatatttttatgtcattctcccagtcaaatca

SEQ ID NO: 1294 - DNA, 829 bp, Glycine max
aaactccttcatgttattgtaactgaggacactctctctgccacgtactcttaaatttaattcacatttcattgatcgtcttacacacgtggggattatttcagtggcgtgaaacttccagaagaactcaaagtcactcctcttctgcttgccctctttcgcttcctgcaaatctttctgagaatcgagtcacagactagagctaaatcagcatagagatacaaaaatgccaaaagtaaagacaaatcgtgttaaatacccagagggctgggaattaattgagcctacactccgtgaacttcaagcaaagatgagggaagctgagaatgatccgcatgatggcaaaagaaaatgtgagaccttatggcctatatttaagattgcacaccagaagagccgctacatatttgatctataccatcggaggaaggaaatttctaaagaactgtatgaattctgtttagatcaaggatatgctgaccgcaatctaattgcaaaatggaagaagcctggttatgaacgtctttgctgcctgaggtgcatgcagccacgtgatcacaattttgccaccacttgtgtttgcagagtacccaagcaacttagggaggagaaggtcatagagtgtgttcactgtggatgcaagggttgtgcaagcggggactaattgaatatcgattctagttttagttgccaatggaaggtttcttagaattactttctttgtgcttttagcttaatgttgtctgaaaccctcaccatgggacaccacttctccaggttgtattactgtctactaaatgagtgctatatattgggaacattggttaca

SEQ ID NO: 1295 - DNA, 760 bp, Glycyrrhiza uralensis
ctcgttaatcgattactcggtggatcggagaaatcgcgagagtatttcagtagcgtgaaaccaaagaaggacgttgtgctgcctctgctcctccaacgttccagaaaactctcgagtcagttctcttttgcgtccggccgcgactgcctgagcaacacctctgcaccgccgtagttgtcgccgccggcagcgtgacccatccgtgtgagaatcgcgtctcagagcaaagtgaaatcggcaaagagagataaaaaatgccaaaagtaaagacaaaccgagttaaataccctgaaggatgggaattaattgagcctacgctacgcgaacttcaagcaaagatgagggaagctgagaatgatccacatgatggcaaaagaaaatgtgagactttgtggcctatatttaaaattgcacaccagaagagccgctacatatttgacctctaccaccggaggaaggaaatttccaaagaattatatgaattctgcttagatcaaggatatgctgaccgcaatctaattgcaaaatggaagaagcccggttatgaacgtctatgttgcttgaggtgcatgcagccacgcgatcacaattttgctaccacttgtgtttgcagagtacccaagcaacttagggaggagaaggttatagagtgtgttcattgtggttgcaagggctgtgcaagtggggactgattggagtatcaggatcactagggtttgttggaatccgttctgttgtgctgttagaattctgttgtctg

SEQ ID NO: 1296 - DNA, 2982 bp, Brachypodium distachyon
atcaggtggacggccccaggtaaccaacatcggtcgcagaatatacaaaaccgtctcagaagaagagagaacgacggccacaaccccagcccccgggtccaaagccaaacccgcctcatctcccgtccaccttgccatagccggaggcgaaggcgagcggcggcggcctctcggagtcacggatctcagcttacggcttctatcaggaggcagcaaactcctaaggtttgtattcaaagacagcactaggacatccctttggacagcatgcctaagataaagacaagccgtgtcaaatatcctgaaggatgggagcttatcgaaccaactatccgcgacttggatgccaaaatgagagaagctgaaaacgatacacatgacgggaagagaaagtgtgaagcactctggccaattttccgcatttctcatcaaagaagccgctacatatatgatctttattatcgaaggaaggaaatatcaaaggatctgtatgaattttgcctggaccagggttatgcagaccgtaatctgattgcaaagtggaaaaagcctggttacgagcgcctttgctgccttcgatgcatacagacacgagatcacaactttgcaaccacttgtgtctgccgggtccccaaacacctcagggaggagcaagttgcggagctggaggagcaggtcctggcggtgacggcgcagcggcagcaagcggagcgggagacagacgaggtgctggccatcctggagtcgcggggcttttccggcagccagctctcggaagtcctcgactcgggctccgacaacgacgaggaggagctacgggacaccaaggccaacggcgacgtagcgagctcccacggggaggtggaaccggagcaggagccggcagcgcagcgcgaagcggaggaggacgcgcagcccgagcccgagcccgggggactgtcgtggaaaggccggagcgtgagcccgcggaaggcgaggcagctgaagcagcggcaccggaggagctacttctacctcctggcctcggaaccggacccctcgcgctgtaagtaccggatgggccagtcttgccgcaagaacaagcgcacggagctcaggtcgccggctccagtagtagtggaggatggcacaggtctcgcagtatctgcggagagtcggaaggggaagcagcagcaagatgacgagcgggacgacgacttggacggcgaggtgggtggagacgagaggagctcgggagatggccgtggccagtacgtgatcaggtgtcggaaagatggggagatggagagggtgctggagaagcaggccgagctgattggccagttcgaggcagaggagaaagctcagagggactgggagaagcaattcaacgacaaccggcgttcacccaaggatttgaaaccttggcagcatggatattgccgacccatgtttttgttttccaaattccagggtgacgttaaggcagccgcgtatcggcttgatagtggtcgagggcaaagcaaccgaagaagctccaaggttgaggaacaagaagcaagctcccaagtacaggccaattcaagtggaaaatccctcccctgttccaaacaacccgaaagcacggccacgagacggaaccaagacgaacaaggagacgcaaattcagacgcctgctcaagctacagcataaatgcccggccttctcggcaccgtgccatggtcaaatcgtcttcagaatcgacggacactcgcatcagcaaagtctcagactggagctcgtcacgcttccacgatcattcccataccgacggccggcagctgatggacacgcgtttggatcgtcagccgagcaacaacgacatcgacgtggagagtgttcttcaagccctgcagcgtgcaaagatctccttgacaaagaagctgctaagcaagccactcccacccagccaggtgacgctggcgcttccggcaccgggggacgagtaccgcacagaagaggatttctacgacggcaacgattcctacaggggagaagaacacagcggctcgagtccatctcgtcaggaaatactagccctcccagcgccagaggaccaccgtacggatttttcttcgttcgcggagaaatcgatcagttcaagtccgcctcgccaggagatcctggctctcccagccccgggcgacgattgctccggcgagagagaggatgtcagtgacctgaagatccttatgagcagcccgggcctgctccggctgccgacagactcgtttccaccggacgagatgctgtcaacaagtaatggtcatgattcagagctcggattgagagagactgctcgatacgatccgcacggttctgcgacgctcgcgctgcctaattccggtaagtgcaacgttccgagctcggccttttcagtagggagcgccgcttcttttctctccggagttcctgaactcccggaggatttgagaaggggaagaaagccacttgcagacgtgaattcgttcatgcagcgcggctgtgattacaccgtttctaataagtggatgttgtagcgtgcaagtgtaactacacgttgttctgtccactgttaatgtctagtgtgtcgttcgtcgacctttcctgtggtgatgtggtccgataagcaatgtcgtgcgtgttgtgaaaggttgtcaagcaccaccacttgtctgcaggcagcatcggctatggaggcatggagatttatatcctgtgaaaagggacttgagaccagtgaaggttaccttgcccaagactagaaaagtgcatcgcctttcgccaattttatgcctaggtgcaaaccctgcagcctgcaggcctgaccggaaacagtaaagtttgagtggtgtccggcacaggacagtgcctgcggcaaggcactcggtcctggcatgcccatgctcctttctggctcgaactcgctgtttgtaaaggcatgcatgcacgacattcatgatgataccgaagggtgacctttg

SEQ ID NO: 1297 - DNA, 456 bp, Aquilegia formosa
aatgccaaagattaaaactaaccgtgtcacatatccagttggatgggagctaatcgagccaaccctccgagaattggaagcaaagatgagagaagctgaaaacgatccacatgatggaaagagaaaatgtgaaggattatggcccatctttcgaattgctcatcagaagagtcgctacatatatgatctgtactaccgacgaaatgaaatatcaagggagctgtatgagttctgcttggaacagggctatggtgaccgcaatctaattgcaaagtggaagaagtcaggttatgagcggctttgttgcctacaatgtatacagccacgggatcacaattttgccaccacgtgtgtgtgcagagttcccaagcacttgagggaagagaaagttatcgaatgtgttcactgcggttgtgggggttgtgccagtggagattgactgattcctccaattac

SEQ ID NO: 1298 - DNA, 774 bp, Artemisia annua
gactataaagaaacatccccttaaattaacactttccttgacactctcacatctaatcccatcattcaccggaactaccacaacaacgccgccttatcagtcagtaacatgcctaaggtgaagacaaaccgtgtcaagtacccagagggctgggagctcgtagagcctacacttcgtgaattacaggcaaagatgagagaagctgagaatgatccacatgatgggaaacgaaaatgtgaagctctgtggccgatctttaaaattgcacatcagcagagtcgctacgtctttgatctttaccatcgtaggaaagaaatttcagctgaactgtttgagttttgcttggatcaaggctatgcagaccgtaatctcattgccaaatggaagaagcctgggtatgaacgactttgctgcttaagatgcattcagccacgtgatcacaacttccagacaacgtgtgtttgtagagtgccaaagcacctaagggaggaaagcgtaatagagtgtgttcattgtggttgcaagggctgtgcaagtggagactgatcagttatcttttacagtaccaaactttacatctattaggaggtattcttaatgatcttgcttttgttatttgcaaacttctaagaatgcatctatgagcattgttagccctgtattttgttgttaagtatttggtcttaagtaaaccgtgtaatgtactagatgctcatatgcttcttgatattttccctgaagaacactgaacatgttgtgctttttgttatttta

SEQ ID NO: 1299 - DNA, 655 bp, Brassica juncea
gaagattaagaccaaccgagtcaagtacccagaagggtgggagttgatcgagcctactcttcgtgagcttgacgccaagatgagagaagctgagatggatacacatgatggcaagagaaagtgtgaagctttatggccaatcttcaaactctctcatcagaggagtcgctatgtctatgacctttattaccgcaggaaggagatatctaaagagctctatgagttctgcttggaccagggctatgctgatcgtaacctcattgccaaatggaagaagtcaggatatgagcgtctatgctgcttgcgctgcatacagccaagagaccacaactatggaacaacatgtgtatgtcgtgttcccaaacacttgcgtgaagagaaagccattgaatgcgttcactgcggttgtcaaggatgcgccagtggcgattagtctctcagactgttttcttcaccattatcactctcgatgtattctatatatttgtcaaatctggattatgtaccctgactaatttccctttgcagaacttctaattgttgtcaactcttgggttgctgttgaaattagaaagacagttcccggtttggtatataagtgaattatataccaaaccgggaacttctaattgttgtcaactcttgggttgacaac

SEQ ID NO: 1300 - DNA, 614 bp, Brassica napus
ctccctcgtctccgtcaattagtttcttctccaaagaaaaagaaatgccaaaggtgaagacaaacagagtaaagtacccagaaggttgggagttgatcgagcctacgcttcgtgagcttgatgccaagatgagagaagctgagatggatgaacatgatggcaagagaaagtgtgaagccttgtggccaatcttcaaactctctcatcagaggagtcgctatgtttatgacctttattaccgcagggaggagatatctaaagagctctacgagttctgcttggaccagggctatgctgatcgtaacctcattgccaagtggaaaaagtcaggatatgaacgtctatgctgcttgcgatgcatacaaccaagagaccacaactatggaacaacatgtgtgtgtcgtgttcctaaacacttgcgtgaagagaaagtggttgaatgcgttcattgcggttgtcaaggatgcgctagtggcgattaatctctctctctctctctctttttttgaaaacccctcactgttgctatgttctatatcttgtcagatctggattatgtaccctgaagtccctgtctaaattccctttgcaaaacttctactttatcaacattc

SEQ ID NO: 1301 - DNA, 611 bp, Cleome spinosa
gagaaatcttcatatccgacaagacggttcgacgatctcgcaccgacgagcctggagaaaatgccaaagattagaacaaatcgagtcaagtacccagaagggtgggagctgattgagccgacacttcgggagctggatgccaagatgagagaagctgagactgatccacatgatgggaagagaaagtgtgaaggcttgtggccaatcttcaaaatctctcatcagaggagccggtatttgtatgacctttactacagaaggaatgaaatatctcaagagctatacgagttctgcttggatcagggatatggggacagaagcctgattgcaaagtggaaaaagtcagggtatgaacgtctttgctgcttacgatgcatacaaccaagagaccacaacttcgggacaacttgtgtctgtcgtgtccccaaacacttgcgagaagagaaagccgttgaatgtgttcactgtggatgtcaaggttgcgctagcggggattgattcccgatccatctacgctttacgagagaggcactttgttttctcttatggaatccatgacttttgtattgtaatgcctaactagatctccttggggccaagatatgggcaag

SEQ ID NO: 1302 - DNA, 737 bp, Cyamopsis tetragonoloba
  misc_feature (548)..(549): n is a, c, g, or t
  misc_feature (568)..(568): n is a, c, g, or t
  misc_feature (594)..(594): n is a, c, g, or t
  misc_feature (611)..(611): n is a, c, g, or t
  misc_feature (614)..(614): n is a, c, g, or t
  misc_feature (660)..(661): n is a, c, g, or t
  misc_feature (668)..(668): n is a, c, g, or t
  misc_feature (683)..(683): n is a, c, g, or t
  misc_feature (688)..(688): n is a, c, g, or t
  misc_feature (690)..(690): n is a, c, g, or t
  misc_feature (693)..(694): n is a, c, g, or t
  misc_feature (701)..(701): n is a, c, g, or t
  misc_feature (705)..(705): n is a, c, g, or t
  misc_feature (712)..(713): n is a, c, g, or t
  misc_feature (724)..(725): n is a, c, g, or t
  misc_feature (735)..(735): n is a, c, g, or t
  misc_feature (737)..(737): n is a, c, g, or t
cacgagggttacttctagaaaaacccaaaatctctgcgttcgtgcaaactgcctgaggagcaagttgctccattctctctcttctctccggagtcccgtcacagagctgagcgaaatcgccacagatacaaaaatgccaaaagttaagacaaaccgtgttaaatacccagagggctgggaattaatcgagcctacactacgtgaacttcaagcaaagatgagggaagctgagaatgatccacatgatggaaagaggaaatgtgagacattatggccaatatttaagattgcacatcagaagagtcgctacatatttgacctctaccatcggaggaaggaaatatctaaagaactgtatgagttctgtttagaccagggatatgctgatcgcaatctgattgcaaaatggaagaagcctggatatgaacgtctgtgttgcttgaggtgcatgcagccacgcgaccacaattttgcgacaacttgtgtttgccgcgtaccaaagcaacttagggaggagaaggttatagagtgtgttcattgtggttgcnngggctgtgcaagtggggantgattgaacactgattcttgtatcanttgctcagagggtttcntanatatttgtttatgcatttagctttctgctgtctgaaaccctcaccnngggctcnacttgatctgattgnattgnantannattgatngacntactggnnattaacttcannatggccactngn

SEQ ID NO: 1303 - DNA, 823 bp, Solanum melongena
ttttccaaattcacaatttccattttgcatcaaatcgggtcgtctcttttatctaaggtcatgcctaaggtaaaaacaaaccgtgtcaaatatccagagggatgggagttaattgaacctactcttagtgaactgcaagctaaaatgagggaagctgagaatgatcctcatgatggcaaaagaaaatgtgaggctttgtggcctattttcaaaattgcccatcagaagagccggtatatttttgatctctatcacaggagaaaagagatctccaaggaattgtacgagttctgcatggatcaaggatatgctgatcgaaatttgattgcgaaatggaaaaagcctggttatgaacgtctctgctgtttgaggtgcatccaaccacgggatcacaactttcaaacaacctgtgtctgccgagttccacagcatctaagggaggagaaggttatagaatgtgtccattgcggctgtaaaggttgtgcaagcggagattgacctgttccttagaatcagctagtgccttgttttagatgttcatgtactcgtagtaaacctccatctatttaaagtgctgatcaaacgacgtgtctagcacatcacagtcagtaaaatgcctagaggctgtgtctgatgagataactgtgattgtaacctgtgtaacctatttatcgaaaactatttgtgttaaaaataactttgatatgattgctacagccatatctgaattgtcacattccatgtgtacaaaagttatttctgactttcagaaaaaggcagtaggaatagtcgtatttacattctgtcatttgtttttcgttag

SEQ ID NO: 1304 - DNA, 986 bp, Cajanus cajan
cttcttacattatttatcacgcaggagggttcatttgggtagtgagactttcagaaaaactcaaaatcaccactcttctgcttctgcctgcaatctttctcgagaatcgagtcgcagagtaccgcgaaataggcgaagaggggagttgcttaggcgcggtagctctctcgctcgttcgagctctctttctaacaattcgcttgctcaagttctctctctgatacaaaaaatgccaaaagtgaagacaaatcgtgttaaatacccagagggctgggaattaattgagcctacactccgtgaacttcaaggaaagatgagggaagctgagaatgatccacatgatggtaaaagaaaatgtgagacattatggcctatatttaagattgcacaccagaagagtcgctacatatttgatctctaccatcggaggaaggaaatttctaaagaactgtatgaattctgtttagatcaaggatatgctgaccgcaatctaattgcaaaatggaagaagcctggttatgaacgtctatgttgcctgaggtgcatgcagccacgtgatcacaattttgccaccacttgtgtttgcagagttcccaagcaacttagggaagagaaggtcatagagtgtgttcattgtggatgcaagggttgtgcaagtggggactgattggacatcaattctagtatttgttgccaatggagggtttctttgaattgcttttagctttctgttgtctgaaaccctcgccatgggacaccactagttgtattattgtctactaacttcaagagtgctatatgttgggaatattggttaaatattagttatctgcctagttcaaaatctgactggagttttgtacctttacattgattagcctaacatggtctacttttgcttgatcgcagtctaatcatcgggttgagaataatcgaacaatggttagtgtaaacaacttctaatgttgctttaattccatgtaata

SEQ ID NO: 1305 - DNA, 622 bp, Salvia sclarea
gctttatgcagtttcttttattcagagtgaaactatactcgcccaaaactgcatcggaaaaaattatcattgcatgtggagtaaggaaccatgccaaaggtgaagacgaaccgagtaaagataccagaggggtgggagttgattgaacctactctacgtgaactgcaagccaagatgagagaagctgagaatgacccacatgatggtaaaaggaaatgcgaggccttgtggcctattttcaaaatagcccatcagaaaagcagatatatatttgacctctttcacagaaggaaggaaatctccaaggaattatatgagttctgtttggatcagggatatgcagatcgtaacttaattgcaaagtggaaaaagcccggttacgaaaggctttgttgcctgaggtgcatgcaacctcgagaccataactttcaaactacatgtgtctgtcgagttccaaagcatctgcgcgaggagaaggttattgaatgtgtgcattgtggttgtaatggttgtgcaagcggggattaaggactgcgctcaatcccgactaacagagtcgaagctgaatcaacgagcacaatgcatttgtactgaagttaaagagccttgatatctgaggagc

SEQ ID NO: 1306 - DNA, 747 bp, Helianthus annuus
gcgggggcctccaattggatgcaccatataaggaccttttaactcaacgggctccggtaacacgatcatcttccggccagtctactcgacggaaccaccacaaccgcacctccgtcggactcatgcctaaggtgaagacgaatcgggtcaagtacccggagggttgggaactcgtggagccgactcttaatgaattgcaggctaagatgagagaagctgagaatgatccacatgacggaaagagaaaatgtgaggctttgtggccaatctttaaaattgcacaccagaagagccgctacatctttgatctttatcatcgtaggaaagaaatttcggctgagctgtatgaattttgcttggatcaggggtacgctgatcgtaatatcattgccaaatggaaaaagcccgggtatgaaagactttgttgtttaagatgcattcaaccacgcgatcacaacttcaacacgacgtgtgtttgtcgagtacccaaacatctgagagaagaaaaggtgattgagtgtgtgcattgcggttgcaagggatgtgcaagtggagattgatcatcatttcaaattctagtgctcttgcttttgttatatgcaaaccatcacttgttaaacatgtatttgaattgaaagtctagttctcttgtttttgttattctagttctctagccaatgttatgtactcttaattatttctcttagttggaccttcaaggacttggggttgtttcgtagtcaaaaa

SEQ ID NO: 1307 - DNA, 686 bp, Papaver somniferum
cagacaatttgttctcgccgtgctgaatcttgagcgggaaactagggttttccttgagagaagaagaagaaccaaaggctcaaaagatgcctaagataaagaccaaccgtgtcagatatccagagggctgggagctgatagagcccactctacgtgaattggaagcaaagatgagagaagctgaaaatgacccacatgatggaaagagaaagtgtgaagcattatggcccatttttaatatcgcacatcagaagagtcgatatatctatgatcttttctacagaaggaaggatatttccaaggagctgtatgagttctgtttggaccaagggtatgctgatcgcaacctaattgccaagtggaagaagtcgggatatgaacgcctatgctgcctgcaatgcatccagccacgggaccacaacttcggcaccacttgcgtatgtagagttcccaagcacctgagggatgaaaaggtcattgaatgtgtacattgcggatgcaatggttgtgctagtggtgactaactcctactttttgtaagttattttctgtctctttctaagtaatgtaaaacaaaaagtgctgaagattggtccctcttttctacgggcattaatcagtaattgtaaacttaatgagattacaatcaaagccgtaatctagtattcaggtattgaacattttag

SEQ ID NO: 1308 - DNA, 785 bp, Mimulus guttatus
aaatattcgaagtgtcgcttacttagatcctcctctactccgccgttgccttccgcctctcctgaccgacgccgttgcccgactctaattcatctggaaaccatgccgaaggtgaagactaacagggtgaagtacccagagggatgggaattgatcgaacccaccctacgtgaacttcaagcaaaaatgagagaagctgagaatgacccacacgatggacaaagaaaatgcgaggccttgtggccaatcttcaaaatagcccatcagcagagccgatacgtttttgacctttaccacaggaggcatgagatttccagggaactatacgagttctgcttggaccagggctatgcagatcgtaacttaattgcaaagtggaaaaagcctggttatgaaaggttgtgctgtctgaggtgcattcagccacgggaccataactttcagacgacttgtgtttgccgagtgccaaagcatctgcgagaggagaaggttatagaatgtgtgcactgtggctgtggtggttgtgcaagtggagattaagggattgtatctgtaaaaacacttatgaactaattctagaagagtatttgcaatccacaatacgagaagggtatgacctttcttgttttctagactagtatttggtaagacaacttgtgcaaagctaaaaacttgatgacatgcacaccttccgttatctcgcactctcttcgtttgaaatggcaatgtaatgaaattagcctcttgcttgatgtgtaacaatgatattacaactgtttcatgtt

SEQ ID NO: 1309 - DNA, 918 bp, Mimulus guttatus
gcgcgcctttactcttatttgtagttttacggaaagaacgcaacttttatctgcctgtgtaaataaatattcgaagtgttgattacttcgatcctcctctactccgccgttgcctcccgcctctcttgaccgacgccgtcgcccaactctaattcatctgaaaaccatgccgaaggtgaagactaatagggtaaagtacccagagggatgggaattgatcgaacccaccctacgtgaacttcaagcaaaaatgagagaagctgagaatgacccacacgatggacaaagaaaatgcgaggccttgtggcctattttcaaaatagcccatcagcagagtcgatatgtttttgacctttaccacaggaggcatgagatttccagggagttatacgagttctgcttggaccagggctatgcggatcgtaatttaattgcaaagtggaaaaagcctggttatgaaaggctgtgctgtctgaggtgcattcagccaagggaccataactttcagacgacttgtgtttgccgagtgccaaagcatctgcgagaggagaaggttatagaatgtgtgcactgtggctgtgggggttgtgcaagcggagattaagggattgtatctataaaacacttgtgaactaattcgagaagagtctttgcaatccacaatacgagaagggtatgacctttctcgttttctagactagtatttggtaagacaactcgtgctaagctaaaaacttgatgacagtgaccttccgttatctcgcactctcttcgtttggaatggcaatgtaatgaaattagcctcttgcttgatgtgtaacaatgatattacaactatttcatgttactattaagacataattggtaattttttgttatttttccatttagtattggaaagtgttgatcgttacgctt

SEQ ID NO: 1310 - DNA, 657 bp, Raphanus sativus
  misc_feature (116)..(116): n is a, c, g, or t
  misc_feature (199)..(199): n is a, c, g, or t
  misc_feature (274)..(274): n is a, c, g, or t
  misc_feature (283)..(283): n is a, c, g, or t
  misc_feature (308)..(308): n is a, c, g, or t
  misc_feature (350)..(350): n is a, c, g, or t
  misc_feature (494)..(494): n is a, c, g, or t
  misc_feature (496)..(496): n is a, c, g, or t
  misc_feature (507)..(507): n is a, c, g, or t
  misc_feature (553)..(553): n is a, c, g, or t
ctcctccttaaactccatcgtctcttgtcgattagtttctccaaagagaaggatgccaaaggttaagactaaccgagtcaagtacccagaagggtgggagttgatcgagcctactnttcgtgagcttgatgccaagatgagagaagctgagatggatacacatgatggcaagagaaagtgtgaagctttatggccaatnttcaaactctctcatcagaggagccgctatgtgtacgacctttattaccggaggaaggagatatccaaagagctntatgagttntgcttggaccagggatatgctgatngtaacctcattgccaaatggaagaaatcagggtatgagcgtntatgctgcttgcgctgcatacagccgagagaccacaactatggaacaacttgtgtatgtcgtgttcccaaacacttgcgtgaagagaaagcgattgaatgcgttcactgcggttgtcaaggatgcgccagtggcgattaatctntntgactgttttnttcaccactatcactctcttgatgtattctatatatttgttaaatntggattatgtaccctgactaatttccctttgcagaactttgtaattgtcaaagtctttgtgttgctgttgagattagaaaagacagttcccggtttggtatata

SEQ ID NO: 1311 - DNA, 763 bp, Antirrhinum majus
gcaaaacagaaatagaaatagaaatttggaagaagaactccttttgccctccaccgtgaatcgccgtaccggagatttaaccgtttacggcttctctctctcgaatttgagctttatccgattaccgagcagaaatcatgcctaaggtgaagacaaaccgggtaaagtacccagagggatgggagttgattgaaccaacgttacgtgaattacaggcaaaaatgagagaagctgaaaatgatccacatgatggtaaaaggaaatgtgagggcatgtggcctatttttaaaatagcccatcagaagagtcggtacatttttgacctttatcacagaaggaaggagatttccaaggagttatatgagttttgcttggatcagggatatgctgatcgcaatttaattgcaaagtggaaaaagcctggttatgaaagactttgctgcttaaggtgcatgcagcctcgggaccataactttcaaacgacatgtgtgtgccgtgtgcctaagcatttgcgagaggagaaggttatagaatgcgttcattgcggctgcggtggctgtgcaagtggagattaagctctgcatttcaaacagataattgaaactgattgtaccttacgactctgatgataagaggctctcacatctctttgaaaggtcaggagatggtctctagtattgagaatagtatttttgaaccatgttatgcttagttaaacttgatgacttgatttcaacgcgagagttacttggcaagacttaat

SEQ ID NO: 1312 - DNA, 714 bp, Brassica napus
ctttctctactgggagaagttgcttctttcatcctcgtcctcctgagccgccatctctcctcctccaaactctcgattactttctccaaaaggacaatgccgaagattaagactaacagagtaaagtacccagaaggttgggagttgatcgagcctactctccgtgagcttgacgccaagatgagagaagctgagatggatgaacatgatggcaagagaaagtgtgaagccttgtggccaatcttcaaactctctcatcagaggagtcgctatgtttatgacctttattaccgcagagaggagatatctaaagagctctatgagttctgcttggaccagggctacgcagaccgcagcctcattgccaagtggaaaaagtcaggatacgagcgtctatgctgcttgcgctgcatacagccgagagaccacaactatggaacaacatgtgtatgccgtgttcccaaacacttgcgtgaagagaaagttgttgaatgcgttcactgcggttgtcaaggatgcgccagtggcgattgatctccacatatgttttcttcacgattcctcactgttgctgtattctatatcttgtcaaatctgaattgtgtacccttaaaaacccttaagaaactccctttcagaacctctacttgttaactctacgttgttgaaactagaaaggcgttcccggtttggtatataaatgatttgagagaa

SEQ ID NO: 1313 - DNA, 683 bp, Brassica napus
gcttctttcatcctcgtcctcctgagccgccatctctcctcctccaaactctcgattactttctccaaaaggacaatgccgaagattaagactaacagagtaaagtacccagaaggttgggagttgatcgagcctactctccgtgagcttgacgccaagatgagagaagctgagatggatgaacatgatggcaagagaaagtgtgaagccttgtggccaatcttcaaactctctcatcagaggagtcgctatgtttatgacctttattaccgcagagaggagatatctaaagagctctatgagttctgcttggaccagggctacgcagaccgcagcctcattgccaagtggaaaaagtcaggatacgagcgtctatgctgcttgcgctgcatacagccgagagaccacaactatggaacaacatgtgtatgccgtgttcccaaacacttgcgtgaagagaaagttgttgaatgcgttcactgcggttgtcaaggatgcgccagtggcgattgatctccacatatgttttcttcacgattcctcactgttgctgtattctatatcttgtcaaatctgaattgtgtacccttaaaaacccttaagaaactccctttcagaacctctacttgttaactctacgttgttgaaactagaaaggcgttcccggtttggtatataaatga

SEQ ID NO: 1314 - DNA, 755 bp, Mimulus guttatus
cttccgcctctcctgaccgacgccgttgcccgactctaattcatctgaaaaccatgccgaaggtgaagactaacagggtgaagtacccagagggatgggaattgatcgaacccaccctacgtgaacttcaagcaaaaatgagagaagctgagaatgacccacatgatggacaaagaaaatgcgaggccttgtggcctattttcaaaatagcccatcagcagagccgatacgtttttgacctttaccataggaggcatgagatttccagggaattatacgagttctgcttggaccagggctatgcagatcgtaacttaattgcaaagtggaaaaagcctggttatgaaaggctgtgctgtctgaggtgcattcagccaagggaccataactttcagacgacttgtgtttgccgagtgccaaagcacctgcgagaggagaaggttatagaatgtgtgcactgtggctgtgggggttgtgcaagcggagattaagggattgtatctgtaaaaacacttatgaactaattcgagaagagtatttgcaatccacaatacgagaagggtatgacctttcttgttatctagacctagtatttggtgcaaagctaaaaacttgatgacatgcactgttcgttatcccgcactctcttcgtttggaatggcaatgtaatgaaattagcctcttgattgatgtgtaacaatgatattactactatttcatgttactattgaagacataattggtaagtatttgtt

SEQ ID NO: 1315 - DNA, 858 bp, Nuphar advena
  misc_feature (465)..(465): n is a, c, g, or t
  misc_feature (700)..(701): n is a, c, g, or t
  misc_feature (733)..(733): n is a, c, g, or t
  misc_feature (743)..(743): n is a, c, g, or t
  misc_feature (748)..(748): n is a, c, g, or t
  misc_feature (789)..(790): n is a, c, g, or t
  misc_feature (792)..(793): n is a, c, g, or t
  misc_feature (796)..(799): n is a, c, g, or t
  misc_feature (801)..(801): n is a, c, g, or t
  misc_feature (805)..(805): n is a, c, g, or t
  misc_feature (809)..(809): n is a, c, g, or t
  misc_feature (812)..(813): n is a, c, g, or t
ctcctttttccaactctctctctctctctctcttcctccggcgggcgtttctacccaaacccaaacgctaccgttccccttctcttccagcgaattcatcacgacaaggttgcttaaaggattggtggcataaccgaggttgggaaaatgccaaaaataaagacaaatcgtgtcaaatatccaagtggttgggagcttattgagccaactcttcgggatttggaaggtcaaatgagagaagctgaaaatgatccacatgatggtaagcgaaaatgtgagggactatggccaatttttcgaatagcgcatcaaaagagccgttacatatttgatctctatcatcgaagaaaagagatttcaaaggagctgtatgaattctgcttggaccaaggctacgctgatcgcaatctgattgccaaatggaaaaagcctggctatgaacggctctgttgcttaagatgcatncagcctcgtgatcataacttctctaccacatgtgtgtgccgagtgcccaagcacctgagagaagaaaaggttatagagtgtgtccattgtggttgcgggggatgcgcaagcggagattgatatcaatcttgatcttaatctgatatattaccatatgggagacagggatttcatcccctagaactgtgatggtgcacattggatttgtgcatggtgcttcccccaccctctaatnngttgatgttataacatactgttttaatggttntacattgccngaagnatgcttcctaggggagccatgtctgatgctgcatgtttacnntnnacnnnncntatntttnctnntcttcatttcacttagacatcctcacttatctttttccattactg

SEQ ID NO: 1316 - DNA, 932 bp, Petunia hybrida
tgataattcccattctttaagctttacccaacggtctcttttccgtcgattcgaagctatcacctcttaaccggagcttcgtctatttatatcatcgtcaccgccaccgccaccgccacctctacctccgtcaccgcttctttgtttaaactgcaaaggtcatgcctaaagtaaaaacaaaccgtgtcaaaattccagagggatgggaattgattgaacctactcttagtgaactacaagcgaaaatgagggaagctgagaatgatcctcatgatggcaaaagaaaatgtgaggctttgtggcctattttcaaaattgcccaccagaagagccggtacatttttgacctctatcacaggaggaaggagatctctaaggaattatatgagttctgcctggatcaaggctatgcggatcgtaatttgattgctaagtggaaaaagcctggttatgaacggctctgctgtttgaggtgcatgcaacctcgggatcacaactttcaaacaacctgtgtctgccgagttccaaagcatctacgggaggagaaggttatagaatgcgtgcattgcggctgtaaaggttgtgcaagtggagattgacctgttatttagaatctacctaccaaagctttgtttctagatacattttgtaaacgtgtattcgatctagcacagagccactgctagaggttatgttggataagatagcaattgtggtcgcagtacctattgttgcctgtgtaacctatgtatcaagaacatttaacttttctttgaataacttcgatatggttggttgcaaccaatcatgagttacagcttgggtattaaagtgtctggggatggaagctgtaagagatttgcatagtactggtgaaacctaaactttctaattcagggctgtttggtttgcagataaaaaaaacaaccatc

SEQ ID NO: 1317 - DNA, 796 bp, Helianthus annuus
  misc_feature (712)..(712): n is a, c, g, or t
  misc_feature (719)..(719): n is a, c, g, or t
  misc_feature (728)..(728): n is a, c, g, or t
  misc_feature (730)..(730): n is a, c, g, or t
  misc_feature (733)..(733): n is a, c, g, or t
gggggcacatataggaccttttactcacggtctccggtaatacgatcatcgtccggccagtctactcgacggaaccaccacaaccgcacctccggtaatacctccgtcggactcatgcctaaggtgaagacgaatcgggtcaagtacccggagggttgggaactcgtggagccgactcttaatgaattgcaggctaagatgagagaagctgagaatgatccacatgacggaaagagaaaatgtgaggctttgtggccaatctttaaaattgcacaccagaagagccgctacatctttgatctttatcatcgtaggaaagaaatttcggctgagctgtatgaattttgcttggatcaggggtacgctgatcgtaatatcattgccaaatggaaaaagcccgggtatgaaagactttgttgtttaagatgcattcaaccacgcgatcacaacttcaacacgacgtgtgtttgtcgagtacccaaacatctgagagaagaaaaggtgattgagtgtgtgcattgcggttgcaagggatgtgcaagtggagattgatcatcatttcaaattctagttctcttgcttttgttatatgcaaaccatcacttgttaaacatgtatttgaattgaaagtctagttctcttgtttttgttattctagttctctagccaatgttatgtactcttgatgttttctcttagttggaccttcaangacttgnggttgtttngnagnctcttaatgattccattaagaggtagattaagttgaatcagtcaacattaagtatgtttggcc

SEQ ID NO: 1318 - DNA, 883 bp, Coffea canephora
ctctgcactttcccctttctggctctccaacgctgtttcagaagaagccctgtgttcccaggtttctgctctaatcgacagttaaaatgccaaaggtgaagactaatcgggttcgataccctgaaggttgggagttgattgaacccactcttaatgagttacaagccaagatgagagaagctgaaaacgatccaaatgataataaaagaaaatgtgaggcattatggcccatttttaagatagcccatcagaagagtcgctacatctttgacctttattacaggaggaaggaaatctccaaggaattgtatgagttttgcttggatcagggctatgctgaccggaacttaattgcaaagtggaaaaagcctggatatgaacgtctctgctgtctacgctgcatgcaacctcgtgatcataatttccagacgacatgcgtttgcagagtacctaagcatctaagggaggagaaggttatagagtgtgtacattgtggctgcaggggttgtgccagtggggattgagcagagcagatagtttgacttgatcttggccgatatgtcatgaaaggtgtgatcaactctcttcaactgccccattaagaatagatgctgtaattgtatttgccttgttggcaatccctgtacatcaaggaggttagagactctaaagtgccgagttatggcagctctgttttggtatttgattagctgtttgtcaatggcaaacacttgaatttattaatcatgcatttgctcattgttcaaacatctgagtcttatcgggttacattttcttgttgcccagtgaaatatgtgccattctacctgataatttatcgggttagtggagggcatgctatagatggtgggcttcgatttaa

SEQ ID NO: 1319 - DNA, 748 bp, Coffea canephora
  misc_feature (741)..(741): n is a, c, g, or t
aacgctgtttcagaagaagccctgtgttcccaggtttctgctctaatcgacagttaaaatgccaaaggtgaagactaatcgggttcgataccctgaaggttgggagttgattgaacccactcttaatgagttacaagccaagatgagagaagctgaaaacgatccaaatgataataaaagaaaatgtgaggcattatggcccatttttaagatagcccatcagaagagtcgctacatctttgacctttattacaggaggaaggaaatctccaaggaattgtatgagttttgcttggatcagggctatgctgaccggaacttaattgcaaagtggaaaaagcctggatatgaacgtctctgctgtctacgctgcatgcaacctcgtgatcataatttccagacgacatgcgtttgcagagtacctaagcatctaagggaggagaaggttatagagtgtgtacattgtggctgcaggggttgtgccagtggggattgagcagagcagatagtttgacttgatcttggccgatatatcatgaaaggtgtgatcaactctcttcaactgccccattaagaatagatgctgtaattgtatttgccttgttggcaatccctgtacatcaaggaggttagagactctaaagtgccgagttatggcagctctgttttggtatttgattagctgtttgtcaatggcaaacacttgaatttattaatcatgcatttgctcattgttcaaanaaaaaaa

SEQ ID NO: 1320 - DNA, 629 bp, Raphanus sativus
  misc_feature (330)..(330): n is a, c, g, or t
  misc_feature (335)..(335): n is a, c, g, or t
  misc_feature (368)..(368): n is a, c, g, or t
  misc_feature (371)..(371): n is a, c, g, or t
  misc_feature (377)..(377): n is a, c, g, or t
  misc_feature (422)..(422): n is a, c, g, or t
  misc_feature (431)..(431): n is a, c, g, or t
  misc_feature (443)..(443): n is a, c, g, or t
  misc_feature (472)..(472): n is a, c, g, or t
  misc_feature (474)..(474): n is a, c, g, or t
  misc_feature (487)..(487): n is a, c, g, or t
  misc_feature (497)..(497): n is a, c, g, or t
  misc_feature (561)..(561): n is a, c, g, or t
  misc_feature (574)..(574): n is a, c, g, or t
  misc_feature (584)..(584): n is a, c, g, or t
tctcttgtcgattagtttctccaaagagaaggatgccaaaggttaagacaaaccgagtcaagtacccagaagggtgggagttgatcgagcctactcttcgtgagcttgatgccaagatgatagaagcggagatggatacacatgatggcaagagaaagtgtgaagctttatggccaatcttcaaactctctcatcagaggagtcgctatgtgtacgacctttattaccggaggaaggagatatctaaagagctctatgagttctgcttggaccagggatatgctgatcgtaacctcattgccaaatggaagaagtcagggtatgagcgtntatgntgcttgcggtgcatacagccgagagaccacaantanggaacnacatgtgtatgtcgtgttcccaaacacttgcgtgaagagaaagcnattgagtgngttcactgcggntgtcaaggatgcgccagtggcgattaatntntcagactgttttnttcaccattntcactctctctatgtatttctatatatttgtcaaatctggattatgtaccctgactaatttccntttgcagaacttntaatgtcaantcttgtgttgctgttgaaattagaaaagacagttcccggtttggt

SEQ ID NO: 1321 - DNA, 774 bp, Brachypodium distachyon
gttttgttccatcttttcccaattcctccgaccactgcccacttcctcggttcctccccttcttctgcccccaacccccgccgggcgccgccgaccccctcctggtgcattcccgctgcggatccgaagaacccaagaagcatcatgcccaaggtaaagacgagtggtgtcaagtatcctgatgggtgggaggtcatagagcccaccctctcagagctccactcaaagatgagggaagctgagaacgatccgcacgatggcaagcggaagtgtgaggcgttatggcccatcttcaagatcaatcaccagaggagccgatacctgtatgacctctactacaacaggaaggagatctcccgggagctgtatgagttctgccttgatcagggccatgctgaccgtaacctcatcgccaagtggaagaagccaggctatgaacgtctttgctgcctgcactgcatccagacacgagatcataacttcgcaaccacctgtgcctgtagggttcctaagcatctgagggaggaacaggtcatagaatgtgttcactgtggatgcaagggctgcgctagtggtgactgagcacggtgtgttcagacttcagacactaccaaggtgaagttaaggtcgatagggtaaactggtgatatcagcgatctactttgtcaaaatgtgtagcgtgttttctactctgtcagttcgataagccacatgtgcttgtaagacgctgcttttggtaatgcaaagaatttgagtttgcactcccagttttta

SEQ ID NO: 1322 - DNA, 948 bp, Taraxacum officinale
gtcatcggtttaacggtcgacttcttgaaactggtgttttgaaagggaacctaaaccttccttgctcgcgtaagcctcatcttcgagatcgctgataatacaatcatcatccggtgcctctactcagcggtacgaccacaactgcagcttcggttctttcctctcctttagccctacgtctcctcttccaacgtcaggaacatgcctaaggtgaaaacaaaccgcgtcaaatacccggagggctgggaactcatagagccgactcttcgtgaactacagggaaagatgcgagaagctgagaacgatccacatgatggtaagagaaaatgtgaagccctgtggccaatcttcaaaattgcacaccagaaaagtcgctatatctttgatctttaccaccgtaggaaggaaatttctccagaactatacgagttttgcttggatcaagggtatgctgaccgtaacatcattgccaaatggaaaaaggctggatatgaaagactttgctgtttaagatgcattcaaccacgtgatcacaactttcagacaacatgtgtttgtagagttcccaaacacctgagagaggaaaaggtgatagagtgtgtgcattgtgggtgcaaaggttgtgctagtggagattgatcacttacgggttgtttgataaaaactgaaccatttactgctgaatgattccaacctcttaatggttcagagaatgtagggttagttaaccttccagagttttatatttgtccagatgtcattcaaagactgtatcaaacatgacatttcagaggaaatgcgttttaggcaatccttaagttcttgaatttggtatactttttaggcaactatttggtgtaaaattagtcaatgaccatgttatgtatttcctatgtgtttcttgatgtttattcttggttacaactttgaacattatatggttttata

SEQ ID NO: 1323 - DNA, 946 bp, Taraxacum officinale
gtcatcggtttaacggtcgacttcttgaaactggtgttttgaaagggacctaaccttccttgctcgcgtaagcctcatcttcgagatcgctgataatacaatcatcatccggtgcctctactcagcggtacgaccacaactgcagcttcggttctttcctctcctttagccctacgtctcctcttccaacgtcaggaacatgcctaaggtgaaaacaaaccgcgtcaaatacccggagggctgggaactcatagagccgactcttcgtgaactacagggaaagatgcgagaagctgagaacgatccacatgatggtaagagaaaatgtgaagccctgtggccaatcttcaaaattgcacaccagaaaagtcgctatatctttgatctttaccaccgtaggaaggaaatttctccagaactatacgagttttgcttggatcaagggtatgctgaccgtaacatcattgccaaatggaaaaaggctggatatgaaagactttgctgtttaagatgcattcaaccacgtgatcacaactttcagacaacatgtgtttgtagagttcccaaacacctgagagaggaaaaggtgatagagtgtgtgcattgtgggtgcaaaggttgtgctagtggagattgatcacttacgggttgtttgataaaaactgaaccatttactgctgaatgattccaacctcttaatggttcagagaatgtagggttagttaaccttccagagttttatatttgtccagatgtcattcaaagactgtatcaaacatgacatttcagaggaaatgcgttttaggcaatccttaagttcttgaatttggtatactttttaggcaactatttggtgtaaaattagtcaatgaccatgttatgtatttcctatgtgtttcttgatgtttattcttggttacaactttgaacattatatggttttata

SEQ ID NO: 1324 - DNA, 787 bp, Malus domestica
atgcttattcgtaccgattacgaaagcccattttgttccatcagtcctgccaacagtgcctttcctcctccacactgcagcgctccactgctcctccgctcctcattcccttcctcacctgtaactgtagaaaatgcccaaggtgaagactaaccgagtgaaatacccacaaggttgggaactgattgagcctactcttcgcgagctacaagctaagatgagagaagctgagaatgatactcatgatggtaagagaaaatgtgagaccttatggcctattttcaaaattgcacatcaaaagagccgctatatttttgacctttaccatcgaagaaaggaaatttccaaggaattatatgacttctgcctggaccaaggctatgctgaccgcaatctaattgcaaagtggaaaaagcctggatacgaacgcctctgttgtttaagatgcatgcaacctcgggatcataactttgccaccacatgtgtttgccgagtgcccaagcatctgagggaggagaaggttatagagtgtgtgcattgtggctgtaggggctgtgccagtggagattgattagtggtatgtcgttcaaattgtaatacaagtgagatgttgaatcacattatccttggtgttgtggattgttgggaatctgtaacatttagctgatcttaattaatcgaggcgatccctttagaaatggtaatagtagtatgttgtctctgtaacttttccttaggcccaaagttttacttgtaattgagtaaagtttgaattttttacgcttca

SEQ ID NO: 1325 - DNA, 1944 bp, Brassica rapa
gactccggatccaacccaaacctaaaagaggccttctctactgggagaagatcttctttcatcatcgtcctcctgagccgccatctctcctcctccaaactcctctctctcgattactttctccaaaaggacaatgccgaagattaagactaacagagtcaagtacccagaaggttgggagttgatcgagcctactctccgtgagcttgacgccaagatgagagaagctgagatggatgaacatgatggcaagagaaagtgtgaagctttgtggccaatcttcaaactttctcatcagaggagtcgctatgtttatgacctttattaccgcagagaggagatatctaaagagctctatgagttctgcttggaccagggctacgcagaccgcagcctcattgccaagtggaaaaagtcaggatacgagcgtctatgctgcttgcgctgcatacagccgagagaccacaactatggaacaacatgtgtatgccgtgttcccaaacacttgcgtgaagagaaagttgttgaatgcgttcactgcggttgtcaaggatgcgccagtggcgattgatctccacatatgttttcttcacgattcctcactgttgctgtattctatatcttgtcaaatctgaattgtgtacccttaaaaacccttaagaaactccctttcagaacctctacgtgttaactctacgttgttgaaactagaaaggcgttcccggtttggtatataaatgaattgagcttcgaagaaaaaaaaaaacccccaaatagcgtaaggataagcctcgccggcgacgaaatcagggtttcatcgaacaagaagatggctcacgcttgcgtctccacatcagcttcctctctcaggtttacagccggattcgtctccgcgagtcccaacgcctcctctttcgattctcagaagctttccctccctttcgagcctcttcgttcaagaaagacgaagaagttggttagcggcagaaagacggctccgaaggctgtatactccggcaatgtctggactccggagactccttcgcctcaaggagtttggtccatcagagatgatttacaagtcccttcttcgccgtattttcctgtgtacgctcaaggacaaggaccacctcccatggtgcaagagcgtttccagagtatcataagccagctcttccaatataggattattcgttgtggtggtgctgtggatgatgatatggccaacataatcgtagctcagcttctttacctcgatgctgttgatcctactaaggatattgttatgtatgtgaactctcctggtggatcagttacagctggcatggctatattcgacactatgaggcatatccgacctgatgtctccactgtttgtgtcggtctagctgctagtatgggagcctttctgcttagtgctggaaccaaagggaaaagatacagtctgccaaactcaaggataatgatccatcagccgcttggtggagctcaaggtggccaaaccgatatcgacattcaggcaaatgaaatgcttcatcacaaggcaaacctaaacggttacctcgcttaccagactggtcaaagcctagagaagataaaccaggacacagaccgtgatttcttcatgagtgctaaagaagcaaaagattacgggcttatcgatggtgttatcatgaaccctcttaaagcccttcagccacttgcagcagcttgatcgcctgaaggtagtgtttcggcttagcacatctattttgatgggtttccataaaatgtgcgtttgattctagaaagaaatcaaaatcagtagctgatacatacatgaagaacaagtaaagttttctttatctgctgtttgattgaacaatgactttgtaatgttttgttactttgtaatcgaattattggccattcttatatcgcgtatcagtatactagtgtcgtact

SEQ ID NO: 1326 - DNA, 1012 bp, Mimulus guttatus
acgcgcgcctttactcttatttgtagttttacggaaagaacgcaacttttatctgcctgtgtaaataaatattcgaagtgttgattacttcgatcctcctctactccgccgttgcctcccgcctctcttgaccgacgccgtcgcccaactctaattcatctgaaaaccatgccgaaggtgaagactaatagggtaaagtacccagagggatgggaattgatcgaacccaccctacgtgaacttcaagcaaaaatgagagaagctgagaatgacccacacgatggacaaagaaaatgcgaggccttgtggcctattttcaaaatagcccatcagcagagtcgatatgtttttgacctttaccacaggaggcatgagatttccagggagttatacgagttctgcttggaccagggctatgcggatcgtaatttaattgcaaagtggaaaaagcctggttatgaaaggctgtgctgtctgaggtgcattcagccaagggaccataactttcagacgacttgtgtttgccgagtgccaaagcatctgcgagaggagaaggttatagaatgtgtgcactgtggctgtgggggttgtgcaagcggagattaagggattgtatctataaaacacttgtgaactaattcgagaagagtctttgcaatccacaatacgagaagggtatgacctttctcgttttctagactagtatttggtaagacaactcgtgctaagctaaaaacttgatgacagtgaccttccgttatctcgcactctcttcgtttggaatggcaatgtaatgaaattagcctcttgcttgatgtgtaacaatgatattacaactatttcatgttactattaagacataattggtaattttttgttatttttccatttagtattggaaagtgttgatcgttacgcttagttcgctgtatttcaaatactgaaaaatccggaagatggatgccagtgttccaaattctaaattggtagatataaataaactttgaattca

SEQ ID NO: 1327 - DNA, 637 bp, Brassica juncea
agaaaaagaaatgccaaaggtgaagacaaacagagtaaagtacccagaaggttgggagttgatcgagcctactcttcgtgagctagacgccaagatgagagaagctgagatggatacacacgatggcaagagaaagtgtgaagccttgtggccaatcttcaaactctctcatcagaggagtcgctatgtttatgacctttattaccgcagagaggagatatctaaagagctctatgagttctgcttggaccagggctacgcagaccgcagcctcattgccaaatggaaaaagtcaggatatgagcgtttatgctgcttgcggtgcattcagccaagagaccacaactatggaacaacatgtgtatgccgtgttcccaaacacttgcgtgaagagaaagttgttgaatgcgttcactgcggttgtcaaggctgcgccagtggggattaatctccacatatgttttcttcacgattcctcactgttgctgtattctatatctttgtcaaatctggattgtgtaccctaaaaccctgaagaatctccctttcaaaacctctacttgttaactgtgtgttgagattagaaggacgttctggtttggtatataaatgaattgagagaaatgattctcggtta

SEQ ID NO: 1328 - DNA, 660 bp, Taraxacum officinale
ctcaggaacatcacgactctagctccggcgccaccttcgcaagagacagttcccactctggtggtgacgacttttggattttctacgaccaaacagaagaatgcctaaggtgaagacaaaccgtgttaaatacccagagggatgggagctcatcgaacctacccttcgtgaattacaaggaaaaatgagagaagctgaaaatgatccacacgatgggaagagaaaatgtgaagcactgtggccaattttcaaaattgcacaccaaaagagtcgatacatctttgacctttaccatcgaaggagagaaatttcaaaggaactgtttgaattttgcttggatcaaggctatgctgaccgtaacattattgcaaagtggaaaaagccgggatatgaacgactttgctgtttaagatgcattcagccacgtgatcataacttccagacaacatgtgtgtgtagggtccccaaacacctgcgggaggaaaaggttatagagtgtgtgcattgtgggtgtaaggggtgtgcaagtggtgattgatttgactgtttattttgcactaaattacttaccgattctcttgtggtttactagttgctaaaaatactgtaatatgatcaaatatatatacatatggaagttttagcaaaaaaaaaaaaaaa

SEQ ID NO: 1329 - DNA, 726 bp, Guizotia abyssinica
ctacggccggggatccgccgctgctcttttcactctcagttctagcagtctccggtaacacaataaccgtctggcgtgtctactcgacggaacgatcactactgcacctccgttactaccttatctggaataagaagtgcatagttgttatatatgcctaaggtgaagacgaaccgggccaaatacccggagggatgggaacttgtggagccaactcttaatgaattgcaagcaaagatgagagaagctgagaatgatccacatgatggaaagagaaaatgtgaggccctgtggccaatcttcaagattgcgcaccagaagagtcgttatatctttgatctttatcatcgtaggaaagaaatttcagctgagctgtatgaattttgcttggatcaaggatatgctgatcgtaatatcatcgccaaatggaaaaagcccgggtatgaaagactttgctgtttaagatgcattcaaccacgcgatcacaacttcaacaccacttgtgtttgccgtgtgcccaaacatctgagggaagaaaaggtgatcgagtgtgtgcattgcggttgcaagggctgtgcaagtggagattgatcatcatttcaaattctaattctctttcttttgttatttacaaaccaccacctgttaaacatgtatttgtagctgatattttctcttatgggtggaacttggaatcgtttgtagaccgacttacgcttcgttgat

SEQ ID NO: 1330 - DNA, 506 bp, Lolium multiflorum
agcgtggtcgcggccgaggtaccctgaaggatgggagcttattgaaccaactctccgtgatttggaagccaaaatgagagaagccgagaatgatacacatgatgggaagaggaagtgtgaggccctctggccaatcttccgcatttctcatcaaaagagccgttacatatatgatctctattaccgaaggaaggaaataaaaaaggagttgtatgagttttgcttggaccaaggttatgcagacaaaaatctgattgctaaatggaaaaagccaggttatgaacgcctttgttgcctccgttgcatacagacacgagaccacaacttcgcaaccacttgtgtctgccgggtccccaagcacctcagggaagaaaaggtgatagagtgcgtccattgcggctgcaaggggtgcgccagcggagactgaagttggccaactcgcggttgagaataatctgaaactaatcgctcgaggatgttgtttgatttgatccctggtgaaaaca

SEQ ID NO: 1331 - DNA, 860 bp, Tragopogon dubius
aggagaaaacaaataaaccctctctcgtctctacaaaatccttcttgttcagctagaaggaacaatcacgactctagctccggcaccaccttcgcagcagacacttcttactcctgccgttaccaccttttgaatcttctaatatcaatcagaagaatgcctaaggtgaagacaaaccgtgttaagtacccagagggatgggagctcatagaacccacccttcgtgaattacaaggaaagatgagagaagctgagaacgatccacacgatgggaagcgtaagtgtgaaaccctttggcctatattcaaaatcgcacaccaaaaaagtcggtacatttttgacctttatcatcgtagaagagaaatttcaaaggaattgtacgaattttgtttggaccagggttatgcagaccggaatattattgccaagtggaaaaagccggggtatgaacgactttgctgtttaagatgcattcagccacgcgatcataactttcagacaacatgcgtttgtagagtccccaagcacttgcgggaggaaaaggttatagagtgtgtgcattgcggttgcaaggggtgtgcaagtggagattaatttcttatcttttaggtacttaatgctaatgatctcgtgttcttgttgacatcatcaaactatttcaagctttatcctttactcgggtgctgttaaaaattgataaaccatttggtattaaaaatgggtgtcatgtagtaatcatgtgattgtatatttgaaaacttatgttaaagggacaaaaatacgtgaatgcccttttcatcttaattatcaaaaatataaaccaattcctgtagcaataaaaaaaaaaaaaaaaaaaggta

SEQ ID NO: 1332 - DNA, 616 bp, Brassica napus
  misc_feature (545)..(547): n is a, c, g, or t
ggctctatctttcctcctcttcctccgccgagatccctccctcgtctccgtcaattagtttcttctccaaagaaaaagaaaaaatgccaaaggtgaagacgaacagagtaaagtacccagaaggttgggagttgatcgagcctactcttcgtgaccttgatgccaagatgagagaagctgagatggatgaacatgatggcaagagaaagtgtgaagccttgtggccaatctttaaactttctcatcagaggagtcgctatgtttatgacctttattaccgcagggaggagatatctaaagagctctacgagttctgcttggaccagggctatgctgatcgtaacctcattgccaagtggaaaaagtcaggatatgaacgtctatgctgcttgcgatgcatacagccaagagaccacaactatggaacaacatgtgtgtgtcgtgttcctaaacacttgcgtgaagagaaagttgttgaatgcgttcattgcggttgtcaaggatgcgccagtggcgattaatctttctcttttcttttctttttnnntgaaaacccctcgctgttgctatgttctatatcttgtcaaatctggattatgtaccctgaagtcttgcc

SEQ ID NO: 1333 - DNA, 916 bp, Medicago truncatula
acgaaattgtttggtgtaaaaattgaagacgaaaaaacctattcactccacttataaaaccggacaaattcgatggtttggtcctacctttacaacttttaaagattaagcgattaatttgaaaactgcagagctaacttctcttctattttgcctacgcccgcgacgccccgatcaacaccaccgtctttatccaccgcggatcgtgagataaaaaatgccgaaagtaaagaccaaccgagttaaatacccagaaggctgggagttaattgagccgacactccgcgaacttcaaggaaagatgagggaagctgagaatgatccacatgatggaaaaagaaaatgcgagactttatggcctatatttaaaattgcacaccagaagagtcgctatgtgtttgacctttaccatcggaggaaggaaatttctaaagaattgtatgaattctgtttggatcaaggatatgctgatcgcaatctaatcgcaaaatggaagaagcctggttatgaacgtctatgttgcttgaggtgcatgcagccacgcgatcacaattttgccaccacttgtgtgtgcagagtaccaaaacaacttagggaggagaaggttatagagtgcgtccattgtggttgcaagggatgtgcaagtggggactgattgaacatcaattctagtatcaggagggttattttgttgtgcttttttatctctgctgttgaaaccctcacggagctcaaagttcttctggttgtattattgtttactaacttcacaagtgctattcgttgagatgttagttaattattattaatcatcagcaccatctgcatagttcaaaacttgactctgtactttaacattgataatctgtgttgtgtacttttgctcgattcttgatgatttcaatatctggcataa

SEQ ID NO: 1334 - DNA, 822 bp, Populus trichocarpa
accttctttcgcgttcccgtacaagctcaaataaaatccagagctgcggtttctaactaagcagtgtcaaaatgccgaaagtgaggacaaacagggtcaaatacccggagggatgggagttaatcgagcctacgcttcgcgaactcgatgggaagatgagggaagcggaacttgatccacatgatggaaagagaaagtgtgaggctctgtggcctattttcaaaatcacacatcaaaagagccgatatgtttatgatctttattatagaaggagtgagatatctaaggagctttatgagttctgcttggaccaaggttatggggatcgtaacctaatcgctaaatggaagaagccaggatatgaacgactgtgctgtctacgctgcatccagcccagggatcacaactttggcacaacttgtgtgtgcagggttcccaagcatttgagggaagagaaggttgttgagtgtgtgcattgtggttgtggaggctgtgcaagtggagattgattgctactttatgtgagccttctttttttatgctacaacctttctgcttatctgaagcccaggtgtggcatttgttgtagtaactaatgtagtactcgatgtagaaaaagatactcggacggccacctgaagaagaatgagacttttgttgtatttagttctgctcgtcatgagcaggctgtgtttttcagagcctactttttttactgagaaactgaaattgatagcatgtgcaaccaaaactcgcaaggcacagcataatttcttcatgaaggttgaaactaagcattttgttcgtagtgtttttcagacc

SEQ ID NO: 1335 - DNA, 791 bp, Populus trichocarpa
cttctttcgcgttctcgtacaaactcaaataaaatccagagcagcggtttctaactaagcagtgtcaaaatgccgaaagtgaggacaaacagggtcaaatacccggagggatgggagttaatcgagcctacgcttcgcgaactcgatgggaagatgagggaagcggaacttgatccacatgatggaaagagaaagtgtgaggctctgtggcctattttcaaaatcacacatcaaaagagccgatatgtttatgatctttattatagaaggagtgagatatctaaggagctttatgagttctgcttggaccaaggttatggggatcgtaacctaatcgctaaatggaagaagccaggatatgaacgactgtgctgtctacgctgcatccagcccagggatcacaactttggcacaacttgtgtgtgcagggttcccaagcatttgagggaagagaaggttgttgagtgtgtgcattgtggttgtggaggctgtgcgagtggagattgattgctactttatgtgagccttctttttttatgctacaacctttctgcttatctgaagcccaggtgtggcatttgttgtagtaactaatgtagtcctcgatgtagaaaaagatactcggacggccaactgaagaagaatgagacttttgttgtatttagttatgctcgtcatgagcaggctgtgtttttcagagcctactttttttactgagaaactgaaattgatagcgtgtgcaaccaaaactcgcaaggcacagcataatttcttcatgaaggttgaaacta

SEQ ID NO: 1336 - DNA, 809 bp, Populus trichocarpa
aaataattttccttattttattttatttttcagcaaaaggaaacctcagcactttgttggcttcttttgcattatcgaggaaaccctaatcaaatccagagctgcgtgtaaaaatgccgaaagtgaggcgaagccggatcaagtacccggagggatgggagttaatcgagcctacgcttcgcgaactggatgggaagatgagagaagctgaacttgatccacatgacggcaagagaaagtgtgaggctctgtggcccattttcaaaattacacatcaaaagagccgatacatttacgatctttattacagaaggaatgagatatctaaggagctttatgagttctgtttggaccagggttatggggatcgtaacctaattgcgaaatggaagaagccaggatatgaacgattgtgctgtctccgctgcatccagcccagggatcacaactttggcacgacttgtgtgtgcagggttccaaagcatctcagggaagagaaggttgttgagtgcgtgcattgtggttgtggaggctgtgcaagtggtgattgattgctgctttgtctgagccctcttttttttgctacaatctttctgctaatcggaagcccaggtatggcatttgttgtagtaacttatgtagtcaatgtaggaaagatacttggacggccaattgaagaaggatgagatttgtctgtatttagttatgaccctcatgagcaggcaatgtatgtcaaaggccacctttttactgacaaactgaaattgatagaaattggtaatgtgtgcaaccaaaactcatgtgtgttt

SEQ ID NO: 1337 - DNA, 726 bp, Populus trichocarpa
tttgcattatcgaggaaaccctaatcaaatccagagctgcgtgtaaaaatgccgaaagtgaggagaagccggatcaagtacccggagggatgggagttaatcgagcctacgcttcgcgaactggatgggaagatgagagaagctgaacttgatccacatgacggcaagagaaagtgtgaggctctgtggcccattttcaaaattacacatcaaaagagccgatatatttacgatctttattacagaaggaatgagatatctaaggagctttatgagttctgtttggaccagggttatggggatcgtaacctaattgcgaaatggaagaagccaggatatgaacgattgtgctgtctccgctgcatccagcccagggatcacaactttggcacgacttgtgtgtgcagggttccaaagcatctcagggaagagaaggttgttgagtgcgtgcattgtggttgtggaggctgtgcaagtggtgattgattgctgctttgtctgagccctcttttttttgctacaatctttctgctaatcggaagcccaggtatggcatttgttgtagtaacttatgtagtcaatgtaggaaagatacttggacggccaattgaagaaggatgagatttgtctgtatttagttatgaccctcatgagcaggctttttactgacaaactgaaattgatagaaattggtaatgtgtgcaaccaaaactcttcgtagtgttt

SEQ ID NO: 1338 - DNA, 784 bp, Ocimum basilicum
tcttcccggcgccctcgccgcgacttccttcgtcgtcgccggagctcgcaggtcgcaactcgccgccgctctcccgccggtcttgttctgccgttgcttgtccggtgcctcctctcccctgacgtcgcttcacctccttctttgctcccaaaaaagtctccgttcaccgccgtttgttaaggaaccatgccaaaggtgaagactaaccgcgtgaagtacccggaggggtgggagttgatcgaacccactcttcgtgaactgcaagcaaagatgagagaagctgaaaatgacccgcatgatggtaaaaggaaatgtgaggggttgtggcctattttcaaaatagcccatcagaagagcagatatgtctttgacctctatcacaggaggaaggaaatctctaaggaattatatgagttctgcttggatcagggatatgcagatcgtaacttgattgctaagtggaaaaagcctggttatgaaagactttgctgcttgaggtgcatgcagccgcgtgaccataactttcaaaccacttgtgtctgccgtgtcccacgtcatctgcgggaggagaaggttatagaatgtgtgcattgcggttgcaatggctgtgcaagtggtgattaaagggtctacttaattggagtggagtggcggcatcagaactggatctataaggagttaaatccattgtgtgaaatttttaactgaaaaacacgagtactttctccaacttattttgattgtaactggattcaaagtaatgaaatagcctattggatgtgtc

SEQ ID NO: 1339 - DNA, 785 bp, Ocimum basilicum
  misc_feature (12)..(12): n is a, c, g, or t
  misc_feature (50)..(51): n is a, c, g, or t
  misc_feature (718)..(718): n is a, c, g, or t
  misc_feature (756)..(756): n is a, c, g, or t
  misc_feature (758)..(758): n is a, c, g, or t
tcttcccggcgncctcgccgcgacttccttcgtcgtcgccggagctcgcnngtcgcaactcgccgccgctctcccgccggtcttgttctgccgttgcttgtccggtgcctcctctcccctgacgtcgcttcacctccttctttgctcccaaaaaagtctccgttcaccgccgtttgttaaggaaccatgccaaaggtgaagactaaccgcgtgaagtacccggaggggtgggagttgatcgaacccactcttcgtgaactgcaagcaaagatgagagaagctgaaaatgacccgcatgatggtaaaaggaaatgtgaggggttgtggcctattttcaaaatagcccatcagaagagcagatatgtctttgacctctatcacaggaggaaggaaatctctaaggaattatatgagttctgcttggatcagggatatgcagatcgtaacttgattgctaagtggaaaaagcctggttatgaaagactttgctgcttgaggtgcatgcagccgcgtgaccataactttcaaaccacttgtgtctgccgtgtcccacgtcatctgcgggaggagaaggttatagaatgtgtgcattgcggttgcaatggctgtgcaagtggtgattaaagggtctacttaattggagtggagtggcggcatcagaactggatctataaggagttaaatccattgtgtgaaatttttaactgaaaaacacgantactttctccaacttattttgattgtaactggattcanantaatgaaatagcctattggatgttgtc

SEQ ID NO: 1340 - DNA, 792 bp, Carthamus tinctorius
gaggagggttctgtagtcctgatcgttcagaataaaccctcttcttcatccctctgcacagagaatattgtcgttcgctccgaaggaatcatcacgactctatctccggcgccagagacgcttttctgatcaacttggaactcttctcttccattaccagtcggaagaatgcctaaggtgaagacaaatcgtgttaaatacccagaaggatgggaacttatagaacctactcttcgtgaattacaaggaaagatgagagaagctgagaacgatccacatgatgggaagagaaaatgtgagaccctgtggcctattttcaaaattgcacaccagaagagtcgctacatctttgacctttaccatcgtaggagagaaatttcaaaggaattgtatgagttttgcttggatcaagggtatgctgaccgtaatatcattgccaagtggaagaagcctggctatgaacgactctgttgtttaagatgcattcagccacgagatcacaacttccagacaacgtgcgtgtgtagagtccccaagcacctacgggaggaaaaggttatagaatgtgtgcattgtggttgcaagggctgtgcaagtggagattaaccgcttatcttacaccaaccatctataggtactgctgaacgctctcatgttttggtagttaccatcaccatatgtattatcttcaaaacttatttgaacttcgttacttgttttgagcattgttaaccatgttttacgcgctaatgtttggtataaaatggtcatgtgcttgtgaatctgttacgc

SEQ ID NO: 1341 - DNA, 799 bp, Catharanthus roseus
  misc_feature (400)..(400): n is a, c, g, or t
  misc_feature (467)..(467): n is a, c, g, or t
gatccaaagaattcggcacgagggtttctctcctctggaacgccgaggaccccagcgggagcacgaacgtccattaaaccctcagcctcgtcgccggcgcggcaggtctcccactttatcgacttccaattatctcggtctcctactgttgctgtcatgcctaaggtgaagacaaaccgtgttaaataccccgagggatgggagttgattgagcctactcttcgtgaattacaagccaagatgagagaagctgagaatgatccacatgatggtaaaagaaaatgcgagacattgtggcctattttcaagatagcccaccagaaaagtcgatatgttttcgacctttatcataggagaaaggagatatccaaggaattgtatgaattttgtatggaccagngctatgcagatcgcaatttgattgcaaagtggaaaaagcctggatatgagcgtctttgctgtttaanatgcatgcaaccgcgtgatcacaactttcaaacaacatgtgtttgtcgcgttcctaaacatctgagggaggagcaggttattgagtgtgtgcattgcggctgtaggggttgtgccagtggtgattgatcttgatcagtctcataccaatcagtgactatctggctagttgaagataagtgctatcatcttactcctattcctactgttttttaccatctgtaaaatgtgggcatcttcataatctaccatagtttagtctctgctatgaagaaatgtgacttaattaactgctgttgccaaggcagtgtgatgtacttacttactattaatg

SEQ ID NO: 1342 - DNA, 762 bp, Centaurea maculosa
cgggatcttgtcgttcgctttaaggaatcatcacaactctctctctatcttcaccagagacgctttgctgatcaacaactttcgaactcttccattagcagtcgaaagaatgcctaaggtgaagacaaatcgtgttaaatacccagaaggatgggaactcatagaacctactcttcgtgaattacagggaaagatgagagaagctgagaacgatccacatgatgggaagagaaaatgtgagaccctgtggcctattttcaaaattgcacaccagaagagtcgctacatctttgacctttaccatcgtaggagagaaatttcaaaggaattgtatgagttttgcttggatcaagggtatgctgaccgtaatatcattgccaagtggaagaagcctggctatgaacgactctgctgtttaagatgcattcagccacgtgatcacaacttccagacaacgtgcgtttgtagagtccccaagcacctacgggaagaaaaggttatagaatgtgtgcattgtggttgcaagggctgtgcaagtggagattaaccgcttatcttataccaaccatctctataggtactgctgaacgctctcatgttttggtagttacccatcatcatatgtattatcttcaaaactacttatttcaacttaattgcttgtttgagcattgttaaccatgttttaccgctaatgtttggtataaaatggtcatgtgcttgtgaatctattacggaaataggggagtagtttgttgctac

SEQ ID NO: 1343 - DNA, 747 bp, Brassica napus
ggaacctaaaagaggcctttctttctctactgggagaagaagcttctttcatcctcgtcctcttgagccgccatctctcctcctccaaactctcgatttctttctccaaagaggacaatgccgaagattaagactaacagagtaaagtacccagaaggttgggagttgatcgagccgactctccgtgagctcgacgccaagatgagacaagctgagatggatgaacatgatggcaagagaaagtgtgaagccttgtggccaatcttcaaactctctcatcagaggagtcgctatgtctacgacctttattaccgcagggacgagatttctaaagagctctacgagttctgcttggaccagggctacgcagaccgcagcctcattgccaaatggaaaaagtcgggatatgagcgattatgctgtttgcgctgcattcagccaagagaccacaactatggaacaacatgtgtatgccgtgttcccaaacacttgcgtgaagagaaagttgttgaatgcgttcactgcggttgtcaaggatgcgccagtggcgattaatctctacatgtgttttcttcacgattccccactgttgctgtattctatatcttgtcaaatctgatttgtgtacccttaaaaaaaccttaagaaactccctttcagaacctctacttgttaactcttacgttggtgacactagaaaggcgttcccggtttggtatgtaaatgaattgagagaatgattttcga

SEQ ID NO: 1344 - DNA, 760 bp, Brassica napus
ggaacctaaaagaggcctttctttctctactgggagaagaagcttctttcatcctcgtcctcttgagccgccatctctcctcctccaaactctcgatttctttctccaaagaggacaatgccgaagattaagactaacagagtaaagtacccagaaggttgggagttgatcgagccgactctccgtgagctcgacgccaagatgagacaagctgagatggatgaacatgatggcaagagaaagtgtgaagccttgtggccaatcttcaaactctctcatcagaggagtcgctatgtctacgacctttattaccgcagggacgagatttctaaagagctctacgagttctgcttggaccagggctacgcagaccgcagcctcattgccaaatggaaaaagtcgggatatgagcgattatgctgtttgcgctgcattcagccaagagaccacaactatggaacaacatgtgtatgccgtgttcccaaacacttgcgtgaagagaaagttgttgaatgcgttcactgcggttgtcaaggatgcgccagtggcgattaatctctacatgtgttttcttcacgattccccactgttgctgtattctatatcttgtcaaatctgatttgtgtacccttaaaaaaaccttaagaaactccctttcagaacctctacttgttaactcttacgttggtgacactagaaaggcgttcccggtttggtatgtaaatgaattgagagaatgattttcgattagatttgtgtt

SEQ ID NO: 1345 - DNA, 706 bp, Cucumis sativus
gtgaaactgaagactgaacctaactccaaggtgttggagaaatgcctaaagtcaagaccagcaagatcaaatacccaaatgggtgggaattgattgaaccaaccctacgagagcttgatgctaaaatgagagaagctgaaaatgatccacaagatggcaagcggaagtgtgaagcgttatggcctattttcaagatttcacatcaaaggagccgatacatttttgaccttttctataaaagaagtgaaatatcaagggagctctatgaattttgtttggaacaaggctatgcagatgccaatctcattgctaaatggaaaaagccgggatacgaacgtctttgttgcctccgttgcatacagccccgtgaccataacttcggcacaacgtgtgtctgtcgagtgccgaaacacttgagagaagagaaagttgtggagtgtgtgcattgtggttgcaggggatgtgccagtggggattgattttgtttcacatcgcagaagcttgggttatatataatgcgatctttgcagctaagttgtaagttgtattgaaatcactcaaatgtttaatctatttgtccaaggtagatgtgatcctcttatgtaccgtggattcttgttgtggttagttggaactggtgattctttttctaacttttgtaccttcctccatgtggtgcaacagaacagaaggcctttcttcgtct

SEQ ID NO: 1346 - DNA, 726 bp, Cynara scolymus
ggggtcagctttggaggatcatcacgactctatctccggcgctaccttcaccagaaacagtttctactccgccgctgaccgactttgcaactcttccattagcagtcggaagaatgcctaaggtgaagacaaatcgtgttaaatacccagaaggatgggaactcatagaaccaactcttcgtgaattacagggaaagatgagggaagctgagaatgatccacatgatgggaagagaaaatgtgagaccctgtggcctattttcaaaattgcacaccagaagagtcgctacatctttgacctttaccatcgtaggagagaaatttcaaaggaattgtatgagttttgcttggatcaaggatatgctgaccgtaatatcattgccaagtggaagaagcctggctatgaacgactttgctgtttaagatgcattcaaccacgtgatcacaacttccagacaacatgtgtttgtcgagtccccaagcacctacgggaggaaaaggttatagaatgtgtgcattgtggttgcaagggctgtgcaagtggagattgaccgcttatcttgcaccaaccatctataggtactgctgatgctctcatgttttggtagttgccatcatcatatgtattatcgtcaaacataattgaaccatatcacatgtttgagcattgttaaccatgttttacgggctaatgtttggtataaaatggtcatgtcatctatgctc

SEQ ID NO: 1347 - DNA, 604 bp, Gerbera hybrid cultivar
gaacgatcacgactgcaactccggttacaccttcaacggagacggttttcacgccggcgccgaccaccgttttatcttgtattagcaatcagaagaatgcctaaggtgaagacaaaccgcgttaaatacccagagggctgggaacttatagaacctactcttcgtgaattacagggaaagatgagagaagctgagaatgatccacacgatggaaagagaaaatgtgagaccctttggccaatcttcaaaattgcacaccaaaagagtcgctacatctttgacctttaccatcgaaggagagaaatttcaaaggaattgtatgagttttgcttggatcaaggctatgccgaccgtaatattattgctaagtggaaaaagcccgggtatgaacgactttgctgtttaagatgcattcaaccgcgcgatcacaacttccaaacaacatgcgtttgtagagtccccaagcacctgcgcgaggaaaaggtaattgagtgtgtgcattgtggttgcaaaggctgtgcaagtggtgattaatcacttgtctcgtaccaaatatatatatataggtacgcccaagactcttgaattttaatatttgcccgta

SEQ ID NO: 1348 - DNA, 667 bp, Raphanus sativus
ctcctccttaaactccgtcgtctctgtcgattagtttctccaaagagaaggatgccaaaggtgaagactaaccgagtcaagtacccagaagggtgggagttgatcgagcctactcttcgtgagcttgatgccaagatgagagaagctgagatggatacacatgatggcaagagaaagtgtgaagctttatggccaatcttcaaactctctcatcagaggagccgctatgtctatgacctttattaccggaggaaggagatttctaaagagctctatgagttctgcttggaccagggctatgctgatcgtaacctcattgccaaatggaagaaatcagggtatgagcgtctatgttgcttgcggtgcatacagccgagagaccacaactacggaacaacttgtgtatgtcgtgttcccaatacttgcgtgaagagaaagcgattgagtgcgttcactgcggttgtcaaggatgcgccagtggcgattaatctctcaagactgttttcttcaccgttgtcactctcttggatgtatttctatatatttgtcaaatcaggattatgtaccctgactaatttacctttgcagaacttttaattgtcaagtcttgtgttgctattgagattagaaaaacagttctcggtttagtaaataaaggaattatgag

SEQ ID NO: 1349 - DNA, 507 bp, Brassica juncea
aatcgtcctcctgagccccgatctctcacctcctcaagctccctcgtctctgtcgattagtttctccaaagagaagatgccgaagattaagaccaaccgagtcaagtacccagaagggtgggagttgatcgagcctactcttcgtgagcttgacgccaagatgagagaagctgagatggatgaacatgatggcaagagaaagtgtgaagctttatggccaatcttcaaactctctcatcagaggagtcgctatgtctatgacctttattaccgcagggaggagatatctaaagagctctatgagttctgcttggaccagggctatgctgatcgcagcctcattgccaagtggaaaaagtcaggatatgaacgtttatgctgcttacgctgcatacagccaagagaccacaattacggaacaacatgtgtatgccgtgttcccaaacacttgcgtgaagagaaagttgttgaatgcgttcactgcggttgtcaaggatgcgccagtgg

SEQ ID NO: 1350 - DNA, 634 bp, Lactuca sativa
gctccggcgccccttcacaggagacgattcttattccggcgtcagaagaatgcctaaagtgaagacaaaccgtgttaaatacccagagggatgggagctcatagaacctacccttcgtgaattacagggaaaaatgagagaagctgagaatgatccacacgatgggaagagaaaatgtgagacactgtggcctattttcaaaattgcacaccaaaaaagtcgttacatatttgacctttatcatcgaaggagagaaatttcaaaggaattgtttgaattttgtttggatcaagggtatgcagatcgtaatatcattgccaagtggaaaaagccaggatatgaacgactttgctgtttaagatgcattcagccacgtgatcataacttccagacaacatgcgtttgtcgagtcccgaagcatctgcgagaggaaaaggttatcgagtgtgtgcactgcggctgcaagggctgtgcaagtggagattaaccgcttatcttgcattaattattaccgatgctttagttgctcacatactgtattatggccaaatttatttcaactttatcacttgttgtggtgttgttaacaagatgattaaccttttggtatgaaaatggttgtcatgcaaaaaaa

SEQ ID NO: 1351 - DNA, 753 bp, Cucumis melo
cacttaattctcagtcgaacttcgagcaatcgatgggaccattctattctgtgtgagttggagaaatgcctaaagttaagaccagcaagatcaaatacccaaatgggtgggaattgattgaaccaaccctgcgagagcttgatgctaaaatgagagaagctgaaaatgacccacaagatggcaagcggaagtgtgaagcgttatggcctattttcaagatttcacatcaaaggagccgatacatttttgaccttttccataaaagaagtgaaatatcaagggagctatatgagttttgtttggaacaaggctatgcagatgccaatctcattgctaaatggaaaaagccgggatacgaacgtctttgttgcctccgctgcatacagcctcgtgaccataacttcggcactacgtgtgtctgtcgagtgccaaaacacttgagagaagagaaagttgtggagtgtgtgcattgtggttgcaggggatgtgctagtggggattgattttgtttcacattgcagaagctggggttatatataatgcgatctttgcagctaacttgtaatttgtattgatatcaatcaaatgtttaatctatttgtccaaggtagatatgatcctgttacgtaccatggacccttgttgtggtaagttggaactggtgattctttttctaacttttgtaccccttaaacttgtgttagttttacatttttacttaggattgaacaagtattttaatttttacctcaa

SEQ ID NO: 1352 - DNA, 642 bp, Brassica napus
tcctcctcttcctccgccgagatccctccctcgtctccgtcaattagtttcttctccaaagaaaaagaaaaaatgccaaaggtgaagacgaacagagtaaagtacccagagggttgggagttgatggagcctactcttcgtgaccttgatgccaagatgagagaagctgagatggatgaacatgatggcaagagaaagtgtgaagccttgtggccaatctttaaactttctcatcagaggagtcgctatgtctatgacctttattaccgcagggaggagatatctaaagagctctacgagttctgcttggaccagggctatgctgatcgtaacctcattgccaagtggaaaaagtcaggatatgaacgtctatgctgcttgcgatgcatacagccaagagaccacaactatggaacaacatgtgtgtgtcgtgttcctaaacacttgcgtgaagagaaagttgttgaatgcgttcattgcggttgtcaaggatgcgccagtggcgattaatctttctctttcttttttttgtttgaaaacccctcaccgttgctatgttctatatcttgtcaaatctggattatgtaccctgaagccctgtctaaattcccctttgcaaaacttctatttttatcaacattc

SEQ ID NO: 1353 - DNA, 634 bp, Brassica oleracea
ggggagaagaagcttctttcatcctcgtcctcttgagccgccatctctcctcctccaaactctcgatttctttctccaaaggacaatgccgaagattaagactaacagagtaaagtacccagaaggttgggagttgatcgagccgactctccgtgagcttgacgccaagatgagacaagctgagatggatgaacatgatggcaagagaaagtgtgaagccttgtggccaatcttcaaactctctcatcagaggagtcgctatgtctatgacctttatcaccgcagggacgagatatctaaagagctctacgagttctgcttggaccagggctacgcagaccgcagcctcattgccaaatggaaaaagtcgggatatgagcgattatgctgtttgcgctgcattcagccaagagaccacaactatggaacaacatgtgtatgccgtgttcccaaacacttgcgtgaagagaaagttgttgaatgcgttcactgcggttgtcaaggatgcgccagtggcgattaatctctacatgtgttttcttcacgattccccactgttgctgtattctatatcttgtcaaatctgaattgtgtacccttaaaaaacccttaagaaactccccttcagaaccgc

SEQ ID NO: 1354 - DNA, 864 bp, Lactuca sativa
  misc_feature (145)..(145): n is a, c, g, or t
  misc_feature (674)..(674): n is a, c, g, or t
  misc_feature (686)..(686): n is a, c, g, or t
  misc_feature (689)..(689): n is a, c, g, or t
  misc_feature (693)..(693): n is a, c, g, or t
  misc_feature (695)..(695): n is a, c, g, or t
  misc_feature (699)..(700): n is a, c, g, or t
  misc_feature (706)..(706): n is a, c, g, or t
cgggggacataaccgcctttacattcttcccctcaatccgcatgtattgattctcatcttcaagatcgcctataacacaatcatcgtctggtgactctattcggcagaacgaccacgaccacgaccacgaccataactgcagctncgattctacattctccggtgaaggttctttcctctgcttccgcccaacgtctcctcttccaataacaatcgtaaacatgcctaaggtgaagacaaaccgcgtgaaataccccgagggctgggaactcatagagccaactcttctcgaattacaggcaaagatgagagaagctgagaatgatccacatgatgggaagagaaaatgtgagaccctgtggccaatcttcaaaattgcacaccagaaaagtcgctatgtctttgatctttatcatcgtaggaaggaaatttctccagaactgtatgaattttgcttggatcaagggtatgctgatcgtaacatcattgcaaaatggaaaaaggctggatatgaaagactttgctgtttaagatgcattcaaccacgtgatcacaactttcaaacaacgtgtgtttgtagagtgcctaaacatctgagggaggaaaaggtgatagagtgtgtgcattgtgggtgcaaaggctgtgctagtggagattgatcacttattttgtancaaattgaacanttnttangnaatnntgatgnttttgtgtttgttattatacttttagacaaacatttgggtctaaaatgaccttgctatgtactcttatgtgcttcatgatgttttctcttagttaaaagtttgaacattcatttttaaaaaagacccttttatttgacaaaaagtttattttggacca

SEQ ID NO: 1355 - DNA, 966 bp, Solanum tuberosum
cagattcagacctcaccggagattcctccgcctctgacgacgtcgtcttcactgtcaccgtcgttaagtttgatcggaagttaatattcgacaccgtttgctgttttattttctcacgatcatcctgcgtcggatacttttcttttgagccaagagtccgtcggaaacaacctccttaccccacaagtgtagggtgcatcctatcatcgctggaccccacagggattaattggctaaggtcatgcctaaagtaaaaacaaaccgtgtcaaatatccagagggatgggagttgattgaacctactcttagtgaactacaagcaaaaatgagggaagctgagaatgatcctcatgatggcaaaagaaaatgcgaggctttgtggcctattttcaaaattgctcatcagaagagccggtatatttttgatctctttcacaggaggaaagagatctccaaggaattatatgagttttgcatggatcaaggatatgctgatcgaaatttgattgcgaaatggaaaaagcctggttatgaacgtctctgctgtttgaggtgcatgcaaccgcgggatcacaactttcaaacaacctgtgtctgccgagttccacagcatctgagggaggagaaggttatagaatgtgtccattgcggctgtaaaggttgtgcaagcggagattgacctgttccttagaatcagcaagtgcattgttttagatgttattgtacttgtaaacctccgtctattcaaagcactgatcaaacgatgtctagcacatcacggtcagtaaaatgctagaggcagtgcttgatgagataacaattatgattgcagtacctactgtaaactgtgtaacctatttatcgcaaactacctaacttgcgttgaaatattttcgatatgcttgtttgcaagtaaatcatatgttacagccatatcaggatccatgtttaaaacaagaaaaaaaa

SEQ ID NO: 1356 - DNA, 968 bp, Solanum tuberosum
cagattcagacctcaccggagattcctccgcctctgacgacgtcgtcttcactgtcaccgtcgttaagtttgatcggaagttaatattcgacaccgtttgctgttttattttctcacgatcatcctgcgtcggatacttttcttttgagccaagagtccgtcggaaacaacctccttaccccacaagtgtagggtgcatcctatcatcgctggaccccacagggattaattggctaaggtcatgcctaaagtaaaaacaaaccgtgtcaaatatccagagggatgggagttgattgaacctactcttagtgaactacaagcaaaaatgagggaagctgagaatgatcctcatgatggcaaaagaaaatgcgaggctttgtggcctattttcaaaattgctcatcagaagagccggtatatttttgatctctttcacaggaggaaagagatctccaaggaattatatgagttttgcatggatcaaggatatgctgatcgaaatttgattgcgaaatggaaaaagcctggttatgaacgtctctgctgtttgaggtgcatgcaaccgcgggatcacaactttcaaacaacctgtgtctgccgagttccacagcatctgagggaggagaaggttatagaatgtgtccattgcggctgtaaaggttgtgcaagcggagattgacctgttccttagaatcagcaagtgcattgttttagatgttattgtacttgtaaacctccgtctattcaaagcactgatcaaacgatgtctagcacatcacggtcagtaaaatgctagaggcagtgtttgatgagataaccaattatgattgcagtacctactgtaaacttgtgtaacctatttatcgcaaactacttaacttgcgttgaaatattttcgatatgcttgtttgcaagtaaatcatatgttacagccatatcaggatccatgtttaaaacaagaaaaaaaa

SEQ ID NO: 1357 - DNA, 802 bp, Artemisia annua
atatcgcgagaagcagtggatcaacgcagtactccgacggggacaaataatcttgttcgtctgttgataggatagtcgttcagcatcaacccactgtagctacgtccagcgccaccgtcactcgtgacccacccttggttttatatttcttcttcgtttatctgtaagaataatgcctaaggtgaagacaaaccgtgttaagtatccagagggatgggaactcattgagcctactcttcgtgaattacaaggaaagatgagagaagctgagaatgatccacacgatggaaagagaaaatgtgagacgttatggcctatcttcaaaattgcacaccagaagagtcgctatatatttgacctgtaccatcgcaggagagaaatatcgaaggaattgtttgagttttgcttggatcaagggtatgctgatcgtaatatcattgctaagtggaagaagcccggctatgaacgactttgctgtttaagatgcattcaaccacgtgatcacaacttccagacaacatgtgtctgtagagtcccgaagcacttgcgtgaagaaaaggtaatagagtgtgtgcattgtggttgcaagggctgtgcaagtggagattaacagccagcatacatctctaggtactcttgacacactcattttctggtagtttccaacatcatatgtattattgtcaaacctatttgaaccttattacctgcttttaagcattgttaatcatgttcaacagttaacgtgtgatatgaaatggttatattaagtatgttcatttgctaaaaaaaaaaaaaaaaa

SEQ ID NO: 1358 - DNA, 747 bp, Artemisia annua
aaatacaaataatcttgttcgtctgttgattggatagtcgttcagcatcaacccactgtagctacgtccagcgccaccgtcactcgtgacccacccttggttttatatttcttcttcgtttatctgtaagaataatgcctaaggtgaagacaaaccgtgttaagtatccagagggatgggaactcattgagcctactcttcgtgaattacaaggaaagatgagagaagctgagaatgatccacacgatggaaagagaaaatgtgagacgttatggcctatcttcaaaattgcacaccagaagagtcgctatatatttgacctgtaccatcgcaggagagaaatatcgaaggaattgtttgagttttgcttggatcaagggtatgctgatcgtaatatcattgctaagtggaagaagcccggctatgaacgactttgctgtttaagatgcattcaaccacgtgatcacaacttccagacaacatgtgtctgtagagtcccgaagcacttgcgtgaagaaaaggtaatagagtgtgtgcattgtggttgcaagggctgtgcaagtggagattaacagccagcatacatctctaggtactcttgacacactcattttctggtagtttccaacatcatatgtattattgtcaaacctatttgaaccttattacctgcttttaagcattgttaatcatgttcaacagttaacgtgtgatatgaaatggttatattaagtatgttcatttgct

SEQ ID NO: 1359 - DNA, 787 bp, Cichorium intybus
tcggcacaggccctgagccaccaatcacggctctactcggcgctaccttccaagagacggttcttactccggcgggtgccagctttcgaattatcgactagcaaaagaatgcctaaagtgaagacaaacggcgttaaatacccagagggatgggagctcatagaacctacccttcgtgaattacaaggaaaaatgagagaagctgaaaatgatccacatgatgggaagaggaaatgtgagaccttgtggccaattttcaaaattgcacaccaaaagagtcgatacatctttgacttataccatcgaaggagagaaatttcaaaggaattgtatgaattttgtttggatcaagggtatgctgaccgtaatatcattgccaagtggaaaaagccgggatacgaacgactttgttgtttacggtgcattcaaccacgcgatcataactttcaaacaacatgcgtttgtcgagtcccgaagcatttgagagaggaaaaggttatagagtgtgtgcattgtggatgcaagggttgtgcaagtggagattgatattctcttatattacactagttaatgacaatggttgtgtgtttgttagttgctcacatacttgtattatgctaaaatatatttgaattttatcacttgggttggtgtttgttaaacagatgattaccatttggtatataaatgggtgtacgtgtatgttaagttattaattgtattttttgggaggtcctggtggacccttatgaccttctattatggtcctaaattcattgatttttct

SEQ ID NO: 1360 - DNA, 917 bp, Triphysaria pusilla
gttgctctatttgtatctgagaaaccctaaattacttttttccgccgcaccagcttcttttgttccgccgtctcgttgccggaggctaagtctatttcccgccaatcaatgccgaaggtgaaaacgaatcgagttaactaccccgaaggatgggagttaatcgaacctacgctccgggacctccaagcgaagatgagagaagctgagaacgatccgcacgatgacaaaagaaaatgcgaagccctgtggccaattttcaaaatcgcgcatcagaggagccgatacgtttttgatttgtatcataggaggaaagagatttcgaaggaattgtacgagttctgtttggatcagggttatgcggatcggaatctgattgcgaagtggaaaaagcctggttacgagaggctttgctgcctgaggtgtatgcagcctcgggatcataatttccagaccacctgcgtttgccgtgttccgaagcatctgcgagaagagaaggtcgtcgagtgtgtgcattgcggctgtggaggttgcgcaagtggagattgaggatagcgttacaaactgcctgctaagaaactgctgtttagcgttcagtctgccatggtcgttgcggatctcatatgtcaacttgtttcttctgatttgtaagaggctccaataaatcgagcatgaatgggatgtgatcgtcactttgaattattgaatagacctactacataaacatattgcagagctgctaactgttgtgtattatgtctgatgcagaaaactgtaactttgaagtcaaatttgctttttcatgttgtaaaaattatgtgttgatcccgcaagtgaactattcatgatcctatggaaactaaaactcatgtattatttgtgatatatttggaatttcataaccaaacattatctttgta

SEQ ID NO: 1361 - DNA, 947 bp, Triphysaria pusilla
  misc_feature (780)..(780): n is a, c, g, or t
  misc_feature (866)..(866): n is a, c, g, or t
cagtttcaaccccattttccactgttgctctatttgtatctgagaaaccctaaattacttttttccgccgcaccagcttcttttgttccgccgtctcgttgccggaggctaagtctatttcccgccaatcaatgccgaaggtgaaaacgaatcgagttaactaccccgaaggatgggagttaatcgaacctacgctccgggacctccaagcgaagatgagagaagctgagaacgatccgcacgatgacaaaagaaaatgcgaagccctgtggccaattttcaaaatcgcgcatcagaggagccgatacgtttttgatttgtatcataggaggaaagagatttcgaaggaattgtacgagttctgtttggatcagggttatgcggatcggaatctgattgcgaagtggaaaaagcctggttacgagaggctttgctgcctgaggtgtatgcagcctcgggatcataatttccagaccacctgcgtttgccgtgttccgaagcatctgcgagaagagaaggtcgtcgagtgtgtgcattgcggctgtggaggttgcgcaagtggagattgaggatagcgttacaaactgcctgctaagaaactgctgtttagcgttcagtctgccatggtcgttgcggatctcatatgtcaacttgtttcttctgatttgtaagaggctccaataaatcgagcatgaatgggatgtgatcgtcactttgaattattgaatagacctactacataaacatattgcagagctgcttactgttgtgtattatgtntgatgcagaaaactgtaactttgaagtcaaatttgctttttcatgttgtaaaaattatgtgttgatcccgcaagcgaactattcangatcctatggaactaaaacagtaaaactcatgtattatttgtgatatatttggaatttcccaaccaaacattttttttgga

SEQ ID NO: 1362 - DNA, 814 bp, Solanum lycopersicum
taagaaatcgaagtttccagattcagacctcaccggcgctgcctccgcatctggcgacgtcgttctcactgacaccggcgttaagtttgatcggaagttaatattcgacaccgagtcatgcctaaagtgaaaacaaaccgtgtcaaatatccagagggatgggagttgattgaacctactcttagtgaactccaagcaaaaatgagggaagctgagaatgatcctcatgatggcaaaagaaaatgcgaggctttgtggcctattttcaaaattgctcatcagaagagccggtatatttttgatctctttcacaggaggaaagagatctccaaggaattatatgagttttgcatggatcaaggatatgctgatcgaaatttgattgcgaaatggaaaaagcctggttatgagcgtctctgctgtttgaggtgcatgcaaccgcgggatcacaactttcaaacaacctgtgtctgtcgagttccacagcatctaagggaggagaaggttatagaatgtgtccattgcggctgtaaaggttgtgcaagcggcgattgacctgttccttagaatcagaaaatgcattgttttagatgttattgtacttgtagtaaacctctgtctattcaaagcactgatcaaacgatatctagcacatcacgatcagttaaaacgctagaggcaatgtttgatgagataacaattatgattgcggtacctgttgtgaactgcgtaaccatagcgttaaaatactttggatattcttgtttgcaagtaatcatatgttacagctatattaggatacatatttgtgaca

SEQ ID NO: 1363 - DNA, 805 bp, Lactuca sativa
cgactctgcttcggcgccaccttcacaggagacggttcttgttccggcggtaaccaacttccgattttctactaacaatcagaagaatgcctaaagtgaagacaaaccgtgttaaataccctgagggatgggagctcatagaacctacccttcgtgaattacaaggaaaaatgagagaagctgagaatgatccacacgatgggaagagaaaatgtgagacactatggcctattttcaaaattgcacaccaaaaaagtcgttacatatttgacctttatcatcgaaggagagaaatttcaaaggaattgtttgaattttgcttggatcaaggatatgctgatcgtaatatcattgccaagtggaaaaagccaggatatgaacgactttgttgtttaagatgcattcagccacgtgatcataacttccaaacaacatgtgtttgtagagtcccaaagcatcttagagaggaaaaggttatagaatgtgtgcattgtggctgcaaaggttgtgcaagtggagattaacaacttatctttcatcaagtattacttatgcttagttgctcacatattgtattatgcttgaatttatttcaactttatcacttatgatgatgttaagaaggtgattaacctttttgctataaaaatggttgtcatgtatgctaaatgtgattggaaattagtttatgtatggacaataaactacgaagacaaaacaacagttgtactttgtttggtatgtattggactgaaactgaaaataacagatagaactaaaactagaacagctgtttttgtttgat

SEQ ID NO: 1364 - DNA, 825 bp, Lactuca sativa
tgttcgcttgaagaaaatcacgactctgcttcggcgccaccttcacaggagacggttcttgttccggcggtaaccaacttccgattttctactaacaatcagaagaatgcctaaagtgaagacaaaccgtgttaaataccctgagggatgggagctcatagaacctacccttcgtgaattacaaggaaaaatgagagaagctgagaatgatccacacgatgggaagagaaaatgtgagacactatggcctattttcaaaattgcacaccaaaaaagtcgttacatatttgacctttatcatcgaaggagagaaatttcaaaggaattgtttgaattttgcttggatcaaggatatgctgatcgtaatatcattgccaagtggaaaaagccaggatatgaacgactttgttgtttaagatgcattcagccacgtgatcataacttccaaacaacatgtgtttgtagagtcccaaagcatcttagagaggaaaaggttatagaatgtgtgcattgtggctgcaaaggttgtgcaagtggagattaacaacttatctttcatcaagtattacttatgcttagttgctcacatattgtattatgcttgaatttatttcaactttatcacttatgatgatgttaagaaggtgattaacctttttgctataaaaatggttgtcatgtatgctaaatgtgattggaaattagtttatgtatggacaataaactacgaagacaaaacaacagttgtactttgtttggtatgtattggactgaaactgaaaataacagatagaactaaaactagaacagctgtttttgtttgat

SEQ ID NO: 1365 - DNA, 599 bp, Gerbera hybrid cultivar
aaggtgaagacgaaccgcgtcaaatacccggagggctgggaactcatagagcctactcttcgtgaattgcaaggaaaaatgagagaagctgagaatgatccacatgacgggaagaggaaatgtgagaccctgtggcctatcttcaaaattgcgcaccagaagagtcgctacatctttgatctttaccatcgtagaaaagaaatttccgtggaattatacgagttttgcttggatcaaggctatgctgaccgcaatattattgccaagtggaagaagccagggtatgaacgactttgctgtttaagatgcattcaaccacgtgatcataatttccagacgacgtgtgtttgtagagtccccaagcacctgagggaggaaaaggtgatagagtgcgtgcattgtggctgcaaaggctgcgcaagtggagattaatcatttttcttgcgctaaaccttctattaaggtactactaatgttcatcgtttattataatcgaacctctttaaaccgttaatcatgtattttgtagccagttatttggtctaaaatgactctgttaaggatctgcatctttgggccatatgctatgctgtttcaag

SEQ ID NO: 1366 - DNA, 834 bp, Solanum phureja
aagaatcgaagtttccagattcagacctcaccggagcttcctccgcctctgacgccgtcgttaagtttgatcggaagttaatattcgacaccggccatgcctaaagtaaaaacaaaccgtgtcaaatatccagagggatgggagttgattgaacctactcttagtgaactacaagcaaaaatgagggaagctgaaaatgatcctcatgatggcaaaagaaaatgtgaagctttgtggcctattttcaaaattgctcatcagaagagccggtatatttttgatctctttcacaggaggaaagagatctccaaggaattatatgagttttgcatggatcaaggatatgctgatcgaaatttgattgcgaaatggaaaaagcctggttatgaacgtctctgctgtttgaggtgcatgcaaccgcgggatcacaactttcaaacaacctgtgtctgccgagttccacagcatctgagggaggagaaggttatagaatgtgtccattgcggctgtaaaggttgtgcaagcggagattgacctgttccttagaatcagcaagtgcattgttttagatgttattgtacttgtagtaaacctccgtctattcaaagcaccgatcaaacgatgtctagcacatcacggtctgtaaaatgctagaggcagtgtttgatgggataacaaatatgattgcagtacctactgtaaactgtgtaacctatttatcgcatactacttaacttgcgttaaaatattttccatatgcttgttagcaagtaaatcatatgctacggccatatcaggatccatgtttaaaaaagttatttgacactttcatag

SEQ ID NO: 1367 - DNA, 801 bp, Arabidopsis thaliana
ttcgtaagagcggcccaagataaaccactcgttataccgatttccgaacacaaccctaaagaggcttcttcgacgacgttggttcttcttcctttgtcctgcgccgcgatctctccttctccaacttccctcgtcctgtccaaagaaaatgccaaaggttaaaactaaccgagtcaagtacccagaaggatgggagttgatcgagcctactcttcgagagcttgatgccaagatgagagaagctgagactgattcacatgatggtaagagaaagtgtgaaactttatggccaatcttcaaagtttctcatcagaggagtcggtatgtatatgacctttattaccgaagggaagaaatatctaaagagctctatgaattctgcttggaccagggctatgcagatcgcagtctgattgccaaatggaaaaagtcgggatacgaacgtttatgctgcttgcgctgcatacagccaagagaccacaactatggaacaacatgtgtatgccgtgttcccaaacacttgcgtgaagagaaagtggtcgaatgcgttcactgcggctgtcaaggatgcgcgagtggcgattaaattcaacatagctttattcgctatctctgactgtttgttacaatcttgtcacttgttaaatctggattatgtattattccataaaggctaaaaaccctgactaaaaatctccttgctcttacttatcaactctgggtggtattgcaaataaaaagaacgttccggtttggtatatagttgaaacttgaaagtagaaagacgtttcccggtttggt

SEQ ID NO: 1368 - DNA, 682 bp, Arabidopsis lyrata
aagaccggcccaagataaaccactcgttaataccgatttccgaacacaaccctaaagagaggcttctacgacgttggttcttcttccttgtcctgcgccgcgatctctccttgtccaacttccctcgtcctgtccaaagaaaatgccaaaggttaaaactaaccgagtcaagtacccagaaggatgggagttgattgagcctactcttcgagagctggacgccaagatgagagaagctgagacagattcacatgatggcaagagaaagtgtgaaactttatggccaatcttcaaagtttctcatcagaggagtcgttatgtatatgatctttattaccgacgggaagaaatatctaaagagctctatgagttctgcttggaccagggctatgcagatcgcagtctgattgccaaatggaaaaagtcgggatatgaacgtttatgctgcttgcgctgcatacagcctagagaccacaactatggaacaacatgtgtatgtcgtgttcccaaacacttgcgtgaagagaaagtggtcgaatgcgttcactgcgggtgtcaaggatgcgctagtggcgattaaattccacacagctttattcgcaatgcctgactgtttgttacaatcttgtcacttgttaaatctggattatgtattctaaaaggctaaaaccctaactaaaaa

SEQ ID NO: 1369 - DNA, 736 bp, Capsicum annuum
gtttccacattccgccggagcttccgccgtctctgccaccgtagccgtcgacatcgtcgtcgttgctggtcggaagttggacattcgtaccgctaaggtcatgcctaaagtgaaaacaaaccgtgtcaaatatccagagggatgggaattgattgaacctactcttagtgaactgcaagcaaaaatgagagaagctgagaatgatcctcatgatggcaaaagaaaatgcgaggctttgtggcctattttcaaaattgcccatcagaagagccggtatatttttgatctctttcacaggaggaaagagatttccaaggaattatatgagttctgcatggatcaaggatatgctgatcgaaatttgattgcgaaatggaaaaaacctggttatgaacggctctgctgtttgaggtgcatgcaacctcgggatcacaactttcaaacaacctgtgtctgccgagttccacagcatctaagggaggagaaagttattgaatgtgtccattgcggctgtaaaggttgtgcaagtggagattaacctgttcgttagaatcagtcaaatacttcgctttagatgctgttgtactcgtgtagtaaacctccgtctattctaagcactgataaaacgatgtcttgtacatcacggtcagttcaatactagaggctgtgtttgatgagataacaattgtgatcacagtacctactgtaacctgtgtaacctattaatggcaaacta

SEQ ID NO: 1370 - DNA, 729 bp, Medicago truncatula
gataaaaatgccaaaagtaaagacaagccgagttaaatacccagaaggctgggaattaattgagcctacacttcgtgaacttcaaggaaagatgagggaagctgagaatgacccacatgatggcaaaagaaaatgtgagactctgtggcctatatttaaaattgcacaccagaagagccgctatgtatttgaactctaccataagagaaaggaaatttctaaagaattgtatgaattctgtttagatcaaggatatgctgatcgcaatctcattgacaaaatggaagaagcctggttatgaacgcctatgctgcttgaggtgcatacagccacgcgatcacaatttcgccaccacttgtgtatgcagagtgcccaaggagctcagggaggagaaggttatagagtgtgttcattgtggttgcaagggttgtgcaagtggggattgattggacctcaattatattaatctggaggatttgttggaatcattttgttcttgttttctgaaaccctctacgttgtatcacaaccgtttactaacttcacaagagctatgcattgggaatatctttagttaattatcatatcatccgcatagttcaaaacttgacttgagttttgtaacatttggagtagaataattgaacaacttgtaatactcttacgccccatgtgtattattattaattaattgttagacttcttctacctttgctcaatagtcaatac

SEQ ID NO: 1371 - DNA, 3119 bp, Oryza sativa
acctccgcctccccaatccgtcccgtctcctcgcccgccgccctcgactcccgtctcctcgcctgccgctggcgccgatctccatcctgctagcagaggtggcgccggcgtcctcctgctcccgcctcattcgctcaccggtgagcatcctaatccatcccatccggcctcggcctcgaatttcgtctcctcgcccgccgcttgcgccgatccccatcctgcgagcagaggtggcgcccggcgtcctccttcttccaccgcatcgtcgctcgccgcacagttggtgtcccgttttgattcttgaggcccatgtagcaaatactactcctaccagaggagaaaaccgtgaaaccggcatagctcctctcaaaaaacaaaaaggaggggaaaaagaatcacgacatatagctgatagctccggtccaaactccaaacccggccgtctttgctcgaccggagcggagcgcagcgcagcgcagaccagcggcgcggacgacgcgcgccccctctggatcgccgctcccccgcgcgccacagcttccatccggcgactgcaaggccgcccaagccaagagggtttctttgcaagctttagcccctcgacgttcattgagagaacatgcctaaaataaagacaagccgtgtcaaatatcctggaggatgggagcttattgaaccaactatccgtgagttggatgccaaaatgagggaagctgaaaatgacacgcatgatgggaagagaaagtgcgaagccctctggccaattttccgtatttcccatcaaagaagtcgctacatatatgatctttattacagaaggaaggagatatcaaaagagttgtatgagttttgcctggaccagggttatgcagaccgtaatctgattgcaaagtggaaaaagccaggctatgagcgcctttgctgtcttcgatgcatacagacacgagaccacaactttgcaactacatgtgtctgccgggtccccaagcatctcagagaggagaaggttgcggagctggaggagcaggtccaggcggtgacggcgcagaggcggcaggcggagcgggcggcgacggaggtgctgggtattctggagtcacatggcttcggcggcaacctctcagacgtgctcgactcgggctccgaacacgatggcgaggaggatgacgacccacgcgacgggaggagcgacggcgacacggcaggctcccgcggggaggagcagccgccggcgcagtgcgaagcggcggaggacgcgctgtccgggacggccgagcccggcggcgggctgtcgtggaaaggccgcagcacggcgccggaagagcagcgcggcgacgtcgaggaactcgcctggagtcagaaggggcagcaagatggatcggattgcaccgacgacggccaggcggacatggacggcgaggatactggtggtcagtatgtgatcaggtacgagaaggacggcgagatggagagggtgctcgagaggcaggccgagctgatcggccagtatgaggcggaggaagaagctcagaggcagtgggagaagcagttcaacgagaatcggagctcagccaaggttcatgttgaggcagagaataaggcgtgccagatagaaaatggttgggagcagagcaaggagcatgctaggctcgcggatcaagcggtacattgcaacgaagaggcaaaaccaggcgttaaaaatcaccccagcgccagcaacaaccgctctgctggccttctgttgaatgattcccttcctgaatcacacgcatcaggacaagaagctgctgccgaccaacgtgacgcgcacgaggagcatcacgaccactgtcatgcacagtctcaaggaagctctaatgtcgccggcacaatgacagggaagaatcaagaacaaggaaacgagaatccggatggatgttcaagctactgtgacatcaaagcgccatcagatggaagcccgtcaatgagtgatgccaccctgaacagcaaggtctctgactggagctcatcaagcttccatgaccatggcgacaaccaggtcgatgcagggccagatcaacagccaacaagcaacatggacatagagagtgttcttcaggcacttcagcttgccaggatttccctgagtcagaagctgagcaagccagttccacccagccaggtgacgctggcgcttcctgcaccaggggacgatgaacattcagaagacgacggctactcccccgtcgacgacgagttcacttctgcaagagatgagctctgcagctcaagccaatctcctgagcaggagatactggctctccctgcaccagaggactaccatgacagggagaatttgcctgtcaatgacgacgctaccatttcactgacagaggaacagaccagttcaagcccacaccggcaggagatcctggctctcccggctccggtagatgattaccacagagagatagtggatgacatcaagatacctatctgcattgccgggttgtttcggttgccaacagactcatttccaaaggacgagacgctctcaacttgcagcatttgcttgatatccttgcataaaccggaggaagatcggattatacacgttctcttggattcgatacctttggaatactccgtaggggaagtgctacatcggtatattcgtgcgcttgtggattttatctgtgattgtaagaaataccaacagcgccctactcgtcgtcgctcccggtcgctgcgaacccatcacccaatgccacagctgcccccaccgccgcctacatgcccaggtgcggtacccgttgcctggtcaggctgggggatgacgttggagaacgacccttcatcggtgttgtggtggccgtgtcggcatcctccgcgacatccttgtcattgctcctggtcgctgcggacctgtcacccggtgtcgcggccaaccccaccgccacctccatgcccaagcatcgcatcaagccgctagcctgcaatttatgaacaatttatcatgtgcatacctttttgacatgtggcttcgattgttggaatgatcagatgaacgatgagattgcttttgtgtagagcactctatgtaatttaactgtgggaatatatacgtgcattgatatgtg

SEQ ID NO: 1372 - DNA, 662 bp, Guizotia abyssinica
agggaatttccaacgaccggaaattaatagcaacataaggttcgtatttcgtcagtgattagccgtcctggtaactccgatcttcatccatcgtttctacttgacggaacggaaacgaccgcagctccgtccgccgttgctaccttcgccagcgacgttctctccgcaacttccggctaactgaccaccttttcaatcgcagtcagaaacatgccaaaggtgaagacgaatcgggtcaaataccctgagggctgggaactcgtggagccaactcttaatgaattacaggcaaagatgagagaagctgagaatgatccacatgatgggaagagaaaatgtgaggcactgtggccaatcttcaagattgcacaccagaagagtcgttatatctttgatctttatcaccgtaggaaagaaatttctgctgagctgtatgagttttacttggatcaagggtatgctgaccgtaatctcatcgccaaatggaagaagcctgggtatgaaagactttgctgtttaagatgcattcaaccacgcgatcacaacttccaaaaacatgtgtttgtagagtgccgaaacacctgagggaagaaaagtgatagagtgtgtgcattgtggttgtaagggctttgcagcggagattgattcatatcttgtaacaa

SEQ ID NO: 1373 - DNA, 811 bp, Cichorium intybus
gggacctgaacggtcgagttcttgaagttggggttttgaaattgaacgcgaaccgcccttcctctcttcccctcatcttcgagatcgccataacacaatcatcgtctagtcactctactcaacggaagggccacaactgcagctccggttttacattctccactgatagtgctttcctctgcttcctcccaacttctcctcttccataacaggaacgtgcctaaggtgaagacaaaccgcgtcaaataccctgaaggctgggaactcatagagccgactcttcgtgaattacagggaaagatgagagaagctgaaaacgatccacatgatgggaagagaaaatgtgagaccctgtggccaatcttcaaaattgcacaccagaaaagtcgctatgtctttgatctttaccatcgtaggaaggaaatttctccagaactgtacgagttttgcttggatcaaggctatgcagaccgtaacatcattgcaaaatggaagaaggctgggtatgaacgactttgctgtttaagatgcattcaaccacgtgatcacaactttcagacaacgtgtgtttgtagagtgcctaaacacctgagggaggaaaaggtgattgagtgtgtgcattgtggttgcaaaggctgtgctagtggagattaattactaattttgtaccaaattgaggatctattaggtaatcatgattctcttgcatatgttattatacttttttaggcaactatttggtctaaaatgaccatgctatgtacccttccatgtgtttcttgatgtttttttgttctattattgcatcttc

SEQ ID NO: 1374 - DNA, 556 bp, Euphorbia esula
  misc_feature (492)..(494): n is a, c, g, or t
cgtccttcaccgggtatatcagaggaatcgacgcatctatctaagttaggagaaaatgcctaaggtgaagacaagcagggtgagatatccagatggttgggaattgatcgagcctactcttaccgagctgggtgccaagatgagtgaagctgagaatgatccacatgatggcaagagaaaatgtgagggattgtggccaattttcaaaattgctcatcaaaggagccgatatatttttgacctgtactacaaaaggaaagaaatttctagagagctctatgaattctgcttggatcaaggctatggtgacagcaatttgatagcgaaatggaagaagcctggatatgagcgattatgctgtctccgatgcatccagccaagggatcacaactttggcactacttgtgtgtgtagagtccccaatcatcttcgagaggagaaggttattgagtgtgttcattgtggttgtaagggttgtgcaagtggcgattnnntgctacttttatgtttaattcctctgttcaaggtaccatgtttactcttgtcaatatactat

SEQ ID NO: 1375 - DNA, 465 bp, Brassica juncea
cgcggggccactctctcgattactttctccaaaaggacaatgccgaagattaagactaacagagtcaagtacccagaaggctgggagttgatcgagcctactctccgtgagcttgacgccaagatgagagaagctgagatggatgaacatgatggcaagagaaagtgtgaagccttgtggccaatcttcaaactctctcatcagaggagtcgctatgtctatgacctttattaccgcagggaggagatatctaaagagctctatgagttctgcttggaccagggctacgcagaccgcagcctcattgccaaatggaaaaagtcaggatacgagcgtctatgctgcttgcgctgcatacagccgagagaccacaactatggaacaacatgtgtatgccgtgttcccaaacacttgcgtgaagagaaagtttttgaatgcgttcactgcggttgtcaaggatgcgcc

SEQ ID NO: 1376 - DNA, 832 bp, Solanum melongena
ataaaaagttaaggggatatttatgtaatttgctcctatttttttctcttcgtcgccgaacacaaaaaacggagcagcatacttcctgcagttgtagcagctcgccggtgccggtgatcggagatactttcttccataaccgaagctgaaaaatgcctaaagttaagacaaatcgtataaaataccctgagggttgggagctgattgagcctacccttattgaactggatgctaaaatgagagaagctggcaatgactctaatgatggtaaaagaaagtgtgaagcactctggcccattttcaagattgcacatcagaggagcagatatgtgtatgacctttactatggaaggaatgaaatatctaaagagctgtacgaattctgtttggatcaaggctatgcagatcgcaacctggttgcaaagtggaaaaagcctggatacgagcgtctctgctgcttgcactgcatacagcctcgggatcacaactttgcaactacgtgcgtttgtcgtgtccccaagcaccttagggaagttgctgttattgagtgtgtacattgtggatgtcaaggttgtgcaagtggtgactaatttgctttccccatggcagtatgttatgagaacagacatatcttgaaacaccttgactttttctatcttcctggaatttcgaaatattagaaacctttgtctgtaatagtctagttgatatgcttttaacttgcttttttggaaatcctctcatgtcctttaggaatgggatggtgcttttatttgatcttgtacaatcttcgtccgtttctttatcatggtatcaaagtcagattcatttc

SEQ ID NO: 1377 - DNA, 762 bp, Podocarpus macrophillus
attacaagcctcatcttttttgcagaagagatctgtgcaggttaactttgccgatctgtttgctgattttcaaagcaagtgcagctagggtttcttcatagctttggttttttgtttaatcgaatttggtgcccattcaccatgccgaagattcgaaccaaccgcgtcaagtacccaaacggatgggagctcattgagcccacactcagggaattggagaccaagatgcgcgaagcggagaatgagtcacatgagggtaaaaggaagtgtgaaactctgtggcctatttttaagattgcacatcagaaaagtcgatatatatatgacctgtatttccgccgcaaggagatctccaaggaactctatgaattctgcctggaccaaggttacggagatcgtaatttgatagcaaaatggagaaagcctggatatgagcgcctttgttgtttgcgatgcatgcaacctcgggaccacaactttgctacaacttgtgtctgcagagtccctaagcatcttagggaggagaaggtcatagaatgtgtccactgtggttgtaggggatgtgcgagtggagattgattattgatccattaaaatgttaggtaatgtgtgaaacctgacaactgtaccattgctagagagtttattatatgtcactttggtaagtgtaacaagctggacaaaacaaatatctttatggatacaaaaatttacaatatattcatttagttgtcctattgcaatttatatgatgcttatata

SEQ ID NO: 1378 - DNA, 684 bp, Tragopogon dubius
taacacaaccaccgtctggtgactctactcgaccgatcaaccacgactgcagctcgggttctaccttctccggttcacggttcttttccttgcttccacccaacgtcatcttttccattagcagtcgggaacatgcctaaggtgaagacaaatcgcgtcaaatacccggagggctgggaactcatagagccgactcttcgtgaattgcaaggaaagatgagagaagctgagaatgatccacatgatgggaagagaaaatgcgagaccctatggccaatcttcaaaattgcacatcagaagagtcgatatgtctttgatctttaccatcggaggaaggaaatttctccagaactgtacgaattctgcttagatcaagggtatgcagaccgtaatataatcgctaagtggaagaaggctggatatgagcggctttgctgtttgagatgcattcaaccacgtgatcacaactaccagactacgtgtgtttgtagggttccgaagcatctgagagaagaaaaggtgatagagtgcgtgcattgcgggtgtaaagggtgcgcgagtggagattgatcacttgtattaaactgaacgtctattttggtaatcttgatgcttttgctatcattgttattatacttttaggttactatttggtctaaaatgattatgctatatgcttcttga

SEQ ID NO: 1379 - DNA, 827 bp, Lactuca sativa
cgggggacataaccgcctttacattcttcccctcaatccgcatgtattgattctcatcttcaagatcgcctataacacaatcatcgtctggtgactctattcggcagaacgaccacgaccacgaccacgaccataactgcagcttcgattctacattctccggtgaaggttctttcctctgcttccgcccaacgtctcctcttccaataacaatcagaaacatgcctaaggtgaagacaaaccgcgtgaaataccccgagggctgggaactcatagagccaactcttctcgaattacaagcaaagatgagagaagctgagaatgatcaacatgatgggaagagaaaatgtgaaaccctatggccaatcttcaaaattgcacaccaaaaaagtcgctatatctttgatctttatcatcgtaggaaggaaatttctccagaactgtatgaattttgcttggatcaaggatatgctgatcgtaacatcattgcaaaatggaaaaaggctggatatgaaagactatgctgtttaagatgcattcaaccacgtgatcacaactatcaaacaacatgtgtttgtagagtgcctaaacatctgagggaggaaaaggtgatagagtgtgtgcattgtgggtgcaaaggctgtgctagtggagattgatcacttattttgtaacaaattgaacaattattaagcaatcatgatgcttttgtgtttattattatagttttagacaaacatttgggtctaaaatgaccttgctatgtactcttatgtgcttcaggatgttttctcttagtttaaagtttgaacattcatttttaaaaa

SEQ ID NO: 1380 - DNA, 869 bp, Lotus japonicus
actcactcgactcgaccctcagtgcccgagtccctaattcgtctcctcgcacagcgccaccgtcaagaagtctttcaacgacggcgccgcttaacacgccggcgaagcctttgacggtgattcaatccgtcgcctccactgcttcgtgcaaagatgcctaaagtaaagacaaaccgtgtgaaatacccagagggatgggaattaattgagcccacgctctgtgaactacaagcaaagatgagggaagctgagaatgatccacatgatggcaaaagaaaatgtgagactttatggcctatatttaaaattgcacaccagaagagccgctacatatttgacctctaccatcggaggaatgaaatttctaaagagttgtatgaattctgtttagatcaaggatatgctgaccgcaacctgattgcaaaatggaagaagcctggttatgaacgtctgtgttgcttgacatgcatgcaaccgcgggatcacaattttgccaccacttgtgtttgtagagtacccaagcaacttagggaggagaaggtaatagagtgtgtccattgtggttgcaaaggctgtgcaagtgggaactgattggacatcaattgtagttgcataaaatgcccaaggaggttttgtaagttgagaaggggacatggcaagagtatggagtcagtattcctatttgcctttcaaaatattgtttgaaactaaaggaccaagttctctattcctgccaggagtgaacagacaaactgaagtttctctcctttcatcattcaatgtgtgaaagagaaaagaaaaagaaaaggttacttgtaaacagtaatggagattgttgtcagttactctccataacgtttgagaagctt

SEQ ID NO: 1381 - DNA, 741 bp, Actinidia deliciosa
  misc_feature (598)..(599): n is a, c, g, or t
  misc_feature (610)..(610): n is a, c, g, or t
  misc_feature (619)..(619): n is a, c, g, or t
ttgaggctgagcacgtttcgaatcgaagggtctctggtgacctagccactttccggcggagctccggcaagtctacagttcagaataatgccaaaggttaagacgaaccgtgtcaaataccctgaggggtgggaactaatagagccaactctccgtgacctacaaacaaagatgagagaagctgagaatgatccacatgatggtaaaagaaaatgtgaagcactgtggcctattttcaagatagcacatcagaagagtcgctatgtctttgatctttaccaccggaggagggagatttccaaggagttgtatgagttctgcttagagcaaggctatgccgatcgtaatctgattgctaaatggaagaagcctggttatgaacgtctatgctgtttaaagtgcatacaaccccgggatcacaacttccaaacgacatgcgtttgcagagtccccaagcatctgagggaggaaaaagttatagaatgcgtgcactgcggttgtaaaggttgtgcaagcggggactgagcggtcttctacaatccagtgcaaggtagatcctcttacttccatgtttctactatttggcactaacgcggcnntaggcaactgntgtgtaaanttgtggaaggtctgaaccattctcagtatggcgattcttaaatgggtgagtaaccccttttttataatagttcgctgaccctatgtaccaaagtttagtaataactttttgtttgcaaaaaa

SEQ ID NO: 1382 - DNA, 587 bp, Castanea mollissima
caaaaaagtgggcttgcagttgaaggtggaagaatgccgaaggttaagaccaaccgtatcaagtacccagcggggtgggagttgattgagcctactcttcgtgaactagatgctaagatgagagaagctgaacttgatccacatgatggcaagagaaagtgtgaagcattatggccaattttcaaaattgcgcatcaaaagagccgctacatttttgatctttaccacaaaaggactgacatatctaaagagctgtatgagttctgcttggatcaaggttatgcagaccgcaacctaattgcaaagtggaaaaagccaggatatgaacgtctttgctgcctacgttgcatacagccaagggatcacaactttgccacgacttgtgtgtgccgagttccgaagcatttgagggaagagaaagatgtggagtgtgtgcattgtggatgtatgggttgtgcaagtggggattgagtgtttatatcgcattcaaagttatgagtttccccttgtcacagcctagttgcaactgctgtagctaaactgtttatggtcctgaatgtatgacaaacttatttattttagctgaa

SEQ ID NO: 1383 - DNA, 985 bp, Arachis hypogaea
gaactgtaaatcagagtgagaaaccctcaattcttccagtgttgtgtgctcgtgcttcttcttttgtttcggcgttctgctgctccgctctcattctcgcctgcgtcgtttcgttcttcttctgttccgcctcaaccgtctgccttcgtgaacaaaacatgccaaaagtgaagaccaatcgtgttaagtacccagagggctgggaactcattgagcctacactctctgaacttcaagtgaagatgagggaagctgagaatgacccccatgatggcaaaagaaagtgcgagacgttatggcctatattcaagattgcataccagaagagccgctacatatttgacctttaccatcagaggaaggaaatttctagagagttgtatgagttttgcttggatcaaggatatgctgaccgcaatcttattgcaaaatggaagaagcctggttatgaacgattgtgttgcttgagatgcatgcagacgcgtgatcacaatttcgccactgcatgtgtttgcagagtaccaaaacaactcagggaggagaaggttatagagtgtgttcattgtggttgcaagggttgtgctagtggggactgatttggccacaattctagtgcgtcagttgttgtgattttcttgttataaatatattgtcaaatagctttctcttgtaatgtttatcttatgatttgtattaagatgaatcttgttttgattttttattttggcacttactatatggctgttggaggaatgctgcacatccaagtctttttataaactaagtctaaccaagttaaataataagactttgaacaatgttagtcataactgattttgttatcttagatcaattggttggacttagttataaaaaaatttggatgtgtagcattattcagcgaattccacttatgaaagcaagctcaattaagttgttttcaaatcgtgcatgattgacacgcaattagaactaaattacccat

SEQ ID NO: 1384 - DNA, 824 bp, Arachis hypogaea
aattctttcagtgttgtgtgctcgtgcttcttctcttgtttcggcgttctgctgctccgctctcattctcgcctgcgtcgtttcgttcttcttctgttccgcctcaaccgtctgccttcgtgaacaaaacatgccaaaagtgaagaccaatcgtgttaagtacccagagggctgggaactcattgagcctacactctctgaacttcaagtgaagatgagggaagctgagaatgacccccatgatggcaaaagaaagtgcgagacgttatggcctatattcaagattgcataccagaagagccgctacatatttgacctttaccatcagaggaaggaaatttctagagagttgtatgagttttgcttggatcaaggatatgctgaccgcaatcttattgcaaaatggaagaagcctggttatgaacgattgtgttgcttgagatgcatgcagacgcgtgatcacaatttcgccactgcatgtgtttgcagagtaccaaaacaactcagggaggagaaggttatagagtgtgttcattgtggttgcaagggttgtgctagtggggactgatttggccacaattctagtgcgtcagttgttgtgattttcttgttataaatatattgtcaaatagctttctcttgtaatgtttatcttatgatttgtattaagatgaatcttgttttgattttttattttggcacttactatatggctgttggaggaatgctgcacatcctagtctttttataaactaagtctaaccaagttaaataataagactttgaacaatgttagtcataactgatttttgttatcttagatc

SEQ ID NO: 1385 - DNA, 706 bp, Raphanus sativus
  misc_feature (149)..(149): n is a, c, g, or t
  misc_feature (170)..(170): n is a, c, g, or t
  misc_feature (195)..(195): n is a, c, g, or t
  misc_feature (437)..(437): n is a, c, g, or t
  misc_feature (591)..(591): n is a, c, g, or t
  misc_feature (604)..(604): n is a, c, g, or t
  misc_feature (610)..(610): n is a, c, g, or t
  misc_feature (622)..(623): n is a, c, g, or t
  misc_feature (640)..(640): n is a, c, g, or t
ggaaacacacattaaacccaacccaaacctaaaaggggcttcaacgacgacgctggttcttatctctcctcctcctcctcaaactccctcgttctccgtcagttagtttctccaagaaaaagatgccaaaggtgaagacaaacagagtnaagtacccagaaggttggganttgatcgagcctactcttcgtgagntcgaagccaagatgagagaagctgaggtggatacacatgatggcaagagaaagtgtgaagccttgtggccaatctttaaactttctcatcagaggagtcgctatgtttatgacctttattaccgtagggaggagatctctaaagagctttatgagttctgcttggatcagaactatgctgatcgtaacctcattgccaagtggaaaaagtcaggatatgaacgtttatgctgcttgcgatgnattcagccaagagaccacaactatggaacaacatgtgtatgtcgtgttccaaaacacttgcgtgaagagaaggtggttgaatgcgttcattgtggttgtcaaggatgcgctagtggcgattgatctctctccctctctctcctttttctttganaaaccctcactgntgttanttatggattatnnaccctaaaaccctgtcnaaatttcatttgcaaatcaactcttttgttgttgaaatcagaaagatgttcccggtttggtttaca

SEQ ID NO: 1386 - DNA, 598 bp, Raphanus sativus
ttagtttctccaaagaaaaagatgccaaaggtgaagacaaacagagtaaagtacccagagggttgggagttgatagagcctactcttcgtgagctcgaagccaagatgagagaagctgaggtggatacacatgatggcaagagaaagtgtgaagccttgtggccaatctttaaactttctcatcagaggagtcgctatgtttatgacctttattaccgtagggaggagatctctaaagagctttatgagttctgcttggatcagaactatgctgatcgtaacctcattgccaagtggaaaaagtcaggatatgaacgtttatgctgcttgcaatgcattcagccaagagaccacaactatggaacaacatgtgtatgtcgtgttccaaaacacttgcgtgaagagaaggtggttgaatgcgttcattgcggttgtcaaggatgcgctagcggcgattaaccaatctatctctctttttcctctgacaaaccctcactcttgttaattctggattatgtacaccctaaaaccctgtccaaatttcatttgcaaaacctctatcacttgtcgaaatcagaaaagacgttcccggtttggt

SEQ ID NO: 1387 - DNA, 803 bp, Triphysaria pusilla
tctccgctccttttctgcttcgcaactctatttcttaccatgccgaaggtgaagacgaatcgggttaactacccagaaggatgggagctaatcgaacctactctccgcgacctccaagcgaaaatgagagaagctgagaacgatccgcacgacgacaaaagaaaatgcgaagccctatggccgatcttcaaaatcgcgcatcagaggagccgatacgttttcgatctatatcaccggaggaaggatatttcgaaggaactgtacgaattctgtttggatcagggatacgcggaccgtaacttgatcgcgaagtggaaaaagcctgggtacgagaggctttgctgcttgaggtgtatgcagcctagggaccataattttcagactacctgcgtttgccgtgtgccgaagcatctgcgagaggagaaggtcgtcgagtgcgtgcattgcggctgtggaggttgtgctagtggagattgaggactacatttcaaactggttgctaagaaaagtgttgtgtaggctaccttggttgttgcagatctcctgtgtagatcgatgtcaacttggttcttctggtttataagcgactctaataaatcgagtattaattggatatattcaaacctttgtacgtgattgtctttctaatagcgaagaaggaactgtaacttagaagtggaatctacattattatgttgtaaaactcttccgttaatcccacaagtgaattgttcacaaaactatgattatacgaaaaagataatgctaccatatggtagaatactgaaaaaaaaaaaaaaaaa

SEQ ID NO: 1388 - DNA, 818 bp, Triphysaria pusilla
  misc_feature (742)..(742): n is a, c, g, or t
gatctaaatctgagaaaccctaaattgatcactctccgctccttttctgcttcgcaactctatttcttaccatgccgaaggtgaagacgaatcgggttaactacccagaaggatgggagctaatcgaacctactctccgcgacctccaagcgaaaatgagagaagctgagaacgatccgcacgacgacaaaagaaaatgcgaagccctatggccgatcttcaaaatcgcgcatcagaggagccgatacgttttcgatctatatcaccggaggaaggatatttcgaaggaactgtacgaattctgtttggatcagggatacgcggaccgtaacttgatcgcgaagtggaaaaagcctgggtacgagaggctttgctgcttgaggtgtatgcagcctagggaccataattttcagactacctgcgtttgccgtgtgccgaagcatctgcgagaggagaaggtcgtcgagtgcgtgcattgcggctgtggaggttgtgctagtggagattgaggactacatttcaaactggttgctaagaaaagtgttgtgtaggctaccttggttgttgcagatctcctgtgtagatcgatgtcaacttggttcttctggtttataagcgactctaataaatcgagtattaattggatatattcaaacctttgtacgtgattgtctttctaatagcgaagaaggaactgtaacttagaagtggaatctacattattatgttgtaaaactcttcngttaatcccacaagtgaattgttcacaaaactatgattatacgaaaaagaaatgctaccatatggtagaatactga

SEQ ID NO: 1389 - DNA, 943 bp, Quercus alba
aagaaggaaaataatttggtaaatactctcttctcttctcttcacttctcttcaccgctgctcaattcactcttcccatacgtacgcagattcctgcgaaaaagtgggcttgcagttgaaggtggaagaatgccgaaggttaagaccaaccgtatcaagtacccagctgggtgggagttgattgagcctactcttcgtgaactagatgctaagatgagagaagctgaacttgatccacatgatggcaagagaaagtgtgaagcattatggccaattttcaaaattgcccatcaaaagagccgctacgtttttgatctttaccacaaaaggactgacatatctaaagagctgtatgagttctgcttggatcaaggttatgcagaccgcaatctaattgcaaagtggaaaaagccaggatatgaacgtctttgctgcctacgttgcatacagccaagggatcacaactttgccacaacttgtgtgtgccgagttccgaagcatttgagggaagagaaagatgtggagtgtgtgcattgtggatgtatgggttgtgcaagtggggattgagtgtttatatggcattcaaagttatgagttttccccttgccacagcctagttgcaactgttgtagctaaactatttatgttcctgaatgtatgacaaacttattatggtagctgaaattaatgactctttaacttgtgactctggccaacatgaagcaaacgtgtgaatgctatctaaagctggtttgacaaaaatcatagtcctattatccaagttctttatatgtatggtcaaattaagcattcttgcaccaactcagtatttcaagcattgtccccatcagtttctccttccaacttccaagctatcaggtagcccaattaataataagggtaatgctacaaagacaacatttttcaaaaaaaacgcactcgt

SEQ ID NO: 1390 - DNA, 900 bp, Cajanus cajan
tttgaagtcgaagctaatgtatgtctcattctaatattaattctagaagataaaattgagaaaataaaaataaaaatatgcaacattatgtctgaattaggtaacatgtacatcttcgtctaattggatttgtttgccttctcacccggtgttaacccatatctgagatacaaaatgccaaaagtaaagacaaaccgtgttacatacccagagggctgggaattaattgagcctactctccgtgaacttcaagcaaagatgagggaagctgagaatgatccacatgatggcaagagaaaatgtgagactttatggcctatatttaagattgcacaccagaagagccgctatatatttgacatctaccatcagaggaaggaaatttctaaagaattgtatgaattctgcttagatcaaggatatgctgatcggaatttaattgcaaaatggaagaagcctggttatgaacgtctatgttgcttggggtgcatgcagccacgcaaccacaattttggcaccacttgtgtttgcagagttcccaagcaacttagggaggagaaggttatagagtgtgttcattgtggttgcaggggttgtgcaagtggcgactgattggacatcaattattgaaccaataccatggttataagaaaaatatataatatcagttgccaaaaagggatttcttaggatgattttctgtgctttttacctttctgttgtttgaaactgaaacccctcagtttctccagtttgtattactaattactaacttaatgataagttgaatactatgtattgaaaaatattagttgattgttaattgactgcctagttcaaaatctgaatggaaactgagtaaaatgtcaattctgctaaatagaaataattggtgagaac

SEQ ID NO: 1391 - DNA, 693 bp, Lactuca sativa
  misc_feature (61)..(61): n is a, c, g, or t
  misc_feature (76)..(76): n is a, c, g, or t
  misc_feature (85)..(85): n is a, c, g, or t
  misc_feature (185)..(185): n is a, c, g, or t
  misc_feature (245)..(245): n is a, c, g, or t
  misc_feature (275)..(275): n is a, c, g, or t
  misc_feature (341)..(341): n is a, c, g, or t
  misc_feature (410)..(410): n is a, c, g, or t
  misc_feature (449)..(449): n is a, c, g, or t
  misc_feature (465)..(465): n is a, c, g, or t
  misc_feature (473)..(473): n is a, c, g, or t
  misc_feature (483)..(483): n is a, c, g, or t
  misc_feature (500)..(500): n is a, c, g, or t
  misc_feature (512)..(512): n is a, c, g, or t
  misc_feature (515)..(515): n is a, c, g, or t
  misc_feature (524)..(524): n is a, c, g, or t
  misc_feature (547)..(548): n is a, c, g, or t
  misc_feature (564)..(564): n is a, c, g, or t
  misc_feature (567)..(567): n is a, c, g, or t
  misc_feature (606)..(607): n is a, c, g, or t
  misc_feature (670)..(670): n is a, c, g, or t
gcgggctcacctcttcacagaatccttgttcagcttgaacgaacaatcacgactctagctncggcgccaccttcanaggagacgnttcttattccggcgtcagaagaatgcctaaagtgaagacaaaccgtgttaaatacccagagggatgggagctcatagaacctacccttcgtgaattacanggaaaaatgagagaagctgagaatgatccacacgatgggaagagaaaatgtgagacactntggcctattttcaaaattgcacaccaaaanagtcgttacatatttgacctttatcatcgaaggagagaaatttcaaaggaattgtttgaattttgnttggatcaagggtatgcagatcgtaatatcattgccaagtggaaaaagccaggatatgaacgactttgntgtttaagatgcattcagccacgtgatcataacttccanacaacatgcgtttgtngagtcccnaagcatctgngagaggaaaaggttatngagtgtgtgcantgnggctgcaanggctgtgcaagtggagattaacnncttatcttgcattaantantaccgatgctttagttgctcacatattgtattatggctnnaatttatttcaactttatcacttgttgtggtgttgttaacaagatgattaaccttttggtatnaaaatggttgtcatgtatgctaa

SEQ ID NO: 1392 - DNA, 773 bp, Raphanus sativus
  misc_feature (52)..(52): n is a, c, g, or t
  misc_feature (595)..(595): n is a, c, g, or t
  misc_feature (747)..(747): n is a, c, g, or t
ggaacacactcgttatacccaacccaaacctaaaagaggcttataccgaggnttctacttctttcatcctccttactgagccgccatctatcctcctccgacctccgtcgtctctttcgctaagcttctccaaagggacaatgccgaagattaagactaacagagtaaagtacccagaaggttgggagttgattgagcctactcttcttgagatagaggccaagatgagagaagctgagatagatacacatgatggcaagagaaagtgtgaagccttgtggcctatcttcaaactctctcatcagaggagtcgctatgtctatgacctctattaccgtagggaggagatctctaaagacctttatgagttctgcttggatcagaactatgctgatcgtaacctcattgccaagtggaaaaagtcaggatatgagcgtttgtgctgcttgcgctgcatacagccaagagaccacaactacggaacaacatgcgtatgccgtgttcccaaacacttgcgtgaagagaaagtggttgaatgcgttcactgcggttgtcaaggatgcgccagtggcgattaatctccaccattaggttntttttcacattcctcactgttgctgtattctatatcttgtcaaaatctgaatcatgtaccctaaaaacaccctgaagagactaccttttgaaacctctactcgttaactatgttgttgaaactataaagacgttcccggttttggtatatanatgaatttagagaatgattttcggtt

SEQ ID NO: 1393 - DNA, 977 bp, Manihot esculenta
acaaaagcaatttatggaaaaagggcaattctttgaattgggtcgaacttctcgctatttgagcttcacagagtacgctggtgagtcgttgcttgtacggtctggctaagaaaatccagcttctggtgcgctgttgctgaatctgtctctctcagtctcactaaaatgccaaaagtgaagacaaatcggatcaaatatccggatggatgggaattgatcgagcctactcttcgcgagctagatgccaagatgagggaagctgaaaatgattctcatgatggcaagagaaaatgtgaaacgctctggcctattttcagaattgcccatcaaaggagccgctatatttttgacatttattataaaacaaatgaaatttctaaagagctttatgagttctgcttggaacaaggttatggcgaccgtaacctcattgcaaaatggaaaaagccaggatatgaacgactctgctgcctacgctgcattcagccaagggatcacaactttggcactacttgtgtgtgcagggttcccaagcatctgagagaggaaaaggttgttgagtgtgtccattgtggttgtaagggctgtgcaagtggggattgatagctacaatgtgtaaaatcctccattgtttaagggcctacctgtttgatgggaactgagaagcgagaagtctaaggtggacttgaccaaatctcacactcatcaaattttcttctcaagtattcaaactgagaatatggcacatagttagttatctttccatacccttgccagataggaatttgtgcgcaactattgtgtgaatctgggagctctattcaactaatgtttgatgagatttgaactaaagtagattattaactagcattatttcctttttttttgggaaaacattaatatccgtgaacctgcctcttttatcatgatatttgtatgactgcttatcatttctctgcacctctttattaattttt

SEQ ID NO: 1394 - DNA, 432 bp, Brassica rapa
  misc_feature (30)..(30): n is a, c, g, or t
  misc_feature (60)..(60): n is a, c, g, or t
aagacaaacagagtaaagtacccagaaggntgggagttgatcgagcctacgcttcgtgancttgatgccaagatgagagaagctgagatggatgaacatgatggcaagagaaagtgtgaagccttgtggccaatcttcaaactctctcatcagaggagtcgctatgtttacgacctttattaccgcagggaggagatatctaaagagctctacgagttctgcttggaccagggctatgctgatcgtaacctcattgccaagtggaaaaagtcaggatatgaacgtctatgctgcttgcgatgcatacaaccaagagaccacaactatggaacaacatgtgtgtgtcgtgttcctaaacacttgcgtgaagagaaagtggttgaatgcgttcattgcggttgtcaaggatgcgctagtggcgattaatctctc

SEQ ID NO: 1395 - DNA, 768 bp, Liriodendron tulipifera
  misc_feature (152)..(152): n is a, c, g, or t
  misc_feature (202)..(202): n is a, c, g, or t
  misc_feature (204)..(204): n is a, c, g, or t
  misc_feature (240)..(240): n is a, c, g, or t
  misc_feature (245)..(245): n is a, c, g, or t
ttgttattgatttttctagggttttttttttttctcttttcctacttccccgattttctcactctctagtaaggttgcttaccattacttggcagatcgtatggttaatatttctcacttgagaggacaaggtaaaaactgattgcagctanaagaatgccaaagataaagactaaccacgtccaatatcccaatggatggnanttaattgagcctactcttcgtgagctggaagctaanatganagaagctgaaaatgatccacatgatggtaagagaaagtgtgaagcgctgtggcccattttccgaattgcacatcagaagagccgctacatctacgacctgtactacagaaggaatgaaatatccaaggagctatatgaattctgcttagatcaaggctatgccgaccgcaacctaatcgccaaatggaagaagaccggttatgaacgactgtgttgcctccgatgcatgcagccacaggaccacaacttccaaaccacgtgtgtttgcagagtgcccaagcaccttagggaagagaaggtcatagaatgtggacactgcgggtgcaaggggtgtgccagtggagattgataggatcttcttccaagtaaaatgacgggaagatcaatccctcttaattcatgtaagcaatccgattttagattttgggatggttcagatgaatctccaaaggctctaccatattcatgtaactatgtattgaacagattagtgccccaatatggaagcttcttgagttcttgc

SEQ ID NO: 1396 - DNA, 592 bp, Brassica juncea
caaagcgagttaagtacccagaaggctgggagttgatcgagcctactcttcgtgagcttgatgccaagatgagagaagctgagatggatacacatgatggcaagagaaagtgtgaagctttatggccaatcttcaaactctctcatcagaggagtcgctatgtttatgacctttattaccgcagggaggagatatctaaagagctctacgagttctgcttggaccagggctatgctgatcgtaacctcattgccaaatggaaaaagtcaggatatgaacgtctatgctgcttgcgatgcatacagccaagagaccacaactatggaacaacatgtgtgtgtcgtgttcctaaacacttgcgtgaagagaaagtggttgaatgcgttcattgcggttgtcaaggatgcgctagtggcgattgatctccacatatgttttcttcacgattcctcactgttgctgtattctatatcttgtcaaatctgaattgtgtacccttaagaaacttcctttcagaacctctacttgttaactctacgttgttgacactagaaaggcgttcccggtttggtatataaatgaattgagagaa

SEQ ID NO: 1397 - DNA, 957 bp, Gnetum gnemon
tgcgcttcaaaacctgttaaacagatcttggtttgcaaggctgctttatttcgtttcatctgtggttttagttagggttttcggtgaatttttctgggcagaaccaatattctgcgatgccgaaagttcgaaccaatcgaattaagtaccctagcggatgggaactgatcgagcctacactccgagacctggacaacaaaatgcgagaagcggaacaggagtcgcatgagggcaaaagaaagtgtgagagcctgtggcctatttttaaaatcgctcatcaaagaagcagatacatatacgacttgtattacagaagaaaagatatctccaaggagctctacgaattctgccttgatcagggctacgctgatcggaatttgattgccaaatggcgtaagccgggctatgagaggctgtgttgcttgaggtgtatgcagcctcgggaccacaattttgctacaacatgtgtctgtagagttcccaagcatctcagagaagaaaaagttattgaatgcgtccactgtggttgcaaaggatgcgctagtggtgattaaccatgtgtgtttgccgttagtgaccttatttgcttgtttactgtttgcgttgcaaacagtttatcagtgtgtaaactgaatcaatgagattagtattaacaagcacatctgatatttatcatcagctgaaaggagattgttcatggcaacgtaatgttgtacacttttattttgcaacaagtgatttgcagatattaatttggagctttagattatttgcaggaattcagcacaaatatctgtaaaaccaaatataggtccttagttccgagcatggagatgattctgttattcttgaaacaaactttcttctgtaccaatatatagcagaatttgaaattgctatagattttgtttgtttaaatatttgcttgtagctttatatgaaaggcatttcagtttt

SEQ ID NO: 1398 - DNA, 733 bp, Sequoia sempervirens
aagggactctgtattgatgtaacaggttatagctgaagccagttagcctgtaatatgcgtggtatttgaagcaactgggttcttctcttttttctcctttctctaattgattgaagatagagactagaagatgccgaaggttcgaacaaaccgcgtcaagtaccccaacggatgggagctcatcgagcccactctcagggatttagagaccaagatgcgagaagcggagaatgagacacatgagggtaaaaggaagtgtgagactctatggcctatttttaagattgcacatcaaaagagtcgatatatatttgacttgtattaccgccgaaaggagatatccaaggaactctatgaattttgcttggaccaaggctatgcagatcgtaatctgatagcaaaatggagaaaatctggatatgagcgcctttgttgtttgcgatgcatgcaacctcgtgatcacaacttcgctacaacctgtgtctgcagagttcccaaacatcttagagaagaaaaggtcattgagtgtgtccactgtggttgtagaggatgtgccagtggagactgatggcacagcaacaactcaaaaggcagctacagacagtgtgaaacttaacaattataacattagaagacaggtgaaagttactggcacaaatgataaatgagtgctttaatgtatcttatggataacgacagttactttatctctaaacatgctttttacggggcc

SEQ ID NO: 1399 - DNA, 998 bp, Taxus baccata
tatagaaaaatctgtatctgattcaatggcaggacgagaatataggcgtggggaacgctgtgctatttttttatcgttgaaatcctagagtaggagaaatcagaggaatattcgttaccagcaccttaagaaaatggtggtgtctgttggcagcatttaaagaaaaataagagttcaatagaaagtattcagctgttctaatttgtaaagagttatctcgcataaatatttaagtgagttgtcaaagtcctttctgtcttctctaaaattaagaaatctgtgcgttcaagtataaggccagaccagaatcaatttagcttgtgttttgcctgatcttggaagcaagtagggtttcgtatattttgggctgaattaatcgaagatatcgaggaaatgcccaaggttcgaacaaaccgcgtgaagtaccccaacggatgggagctcatcgagccgactctgagggatttagagaccaagatgcgggaagcggagaacgaaactcatgagagcaaaaggaagtgtgaaactctatggccaatttttaagattgcacatcaaaagagccgatatatatttgacttgtattaccgccgaaaggagatatccaaggaactctatgaattctgcctggagcaagggtatgcagatcgtaatctaatagcaaaatggagaaagcctggatatgaacgcctttgttgtttgcgatgtattcaaccccgtgaccacaactttgctacgacatgtgtctgcagagtccccaaacatcttagagaagagaaggtcattgagtgcgtccattgtggttgtagaggatgtgctagcggagactgattgtgtagcaacatgttaaatgtcagctacaatccatatgaaacgtgacagttgtaactttagcagagagttgaaagtatatttcaatggcacaaatgataattaactaccttaacgaatctttatggataattacagttactttatctctaatggtatttctgctg

SEQ ID NO: 1400 - DNA, 1064 bp, Pinus taeda
tcagccttcaaggatatcggaggttatcggggtttgaaattaagttactcctcggagactggctaaggctaagctctcgccctcaaacgaaatcgcaagctgtcggtatcggaaattatctgcgagttcattcgaggtctttcggggttggggagggaatcggaagctctcaggtttgggaattatctgtgagttcattcgaggtctttcgggggtgggaagggaatcggaagctctcaggtttgggtaatttttttttggtatttgcgatgccgaaggttcgaactaaccgcgttaagtatccgaatggatgggaactcatcgagcccactctcagagacttggagactaagatgcgcgaagcggagcaagaaactcatgaaggcaagaggaagtgtgaaaccctctggcctatttttagggccgcacatcagaaaagtagatatgtgtatgatttgtattaccgccgtaaggaaatatccaaggagctgtatgaattctgcctagaccaaggctatgcggatcgcaatttaattgcaaaatggagaaagcctggttatgagcgcctttgttgtttgcgatgtatgcaacctcgcgaccacaactttgctactacttgtgtctgcagagtccccaagcatctaagggaggaaaaggtcatcgagtgtgttcattgtggttgcagaggatgtgctagtggggattgattggatcacaaaaatttgaatagcagatcttcttcggtatgacatataattgtgacacaaattgtggcgtttgacacctgtaaatttattctagtcgggtggtgggggcggcgaagtagaacttacacaaatcataatcatgtcaacaaatttgcctattatagattgcagcaattaatgtacctcttaaaacattgcaatttactcctttcccattttgcatggttctaacttgttatattctactatttcaaaaaacaagttgtgaattgttctctttttagcttattccttggaaatgaacattttgcaacaatattgttttaaaaatacgttaaatccattttttaaatgttg

SEQ ID NO: 1401 - DNA, 653 bp, Capsicum annuum
gcacgaggaaaaaacggagcaactcgccggagtcaccttgccggagccggcgatcggagaaaattccgtccataaccgaagctgaaaaatgcctagggttaagacaagtcgtataaaatatcccgagggttgggagctgattgagcctaccctagctgaactggatgctaaaatgagagaagctggcaatgactctaatgatggtaaaagaaagtgtgaagcactctggcctatattcaagattgcacatcagaggagtagatacttatatgacctttattatgtaaggagtgaaatatctaaagagctgtacgagttctgtttggaacaaggtcatgcagatcgcaacctgattgcaaaatggaaaaagcctggatacgagcgtctctgctgcttgcactgcatacagccccgggatcacaacttcgcgactacttgtgcttgtcgtgttcccaagcaccttagggaagctgctgtaatagagtgtgtacattgtggatgtcaaggttgtgcaagtggtgactaatttgctttcccttagctgtatgttatgagatcagacattatcttgaaacaccttagctttttccttctggattttcacaacattagaaacctttgtctgtagtagtctagttgatatactagcttta

SEQ ID NO: 1402 - DNA, 769 bp, Carthamus tinctorius
gcgggggggtttttgaatatataaaccgcctttgccatctccccgatagctccgatcaccgtccggcgactctactcggcggaaccaccaccaccacttcagatctcgctgctactttctccgttcacggttctttcctcagtttccggccaaccttctcctcatcatccaatatcaatcacaaaaacatgcctaaggtgaagacaaatcgcgttaaatacccggagggttgggaactcatagagcctactcttcgtgaattacaaggaaagatgagagaagctgagaatgatccacatgatgggaagagaaagtgtgagaccatgtggcctatcttcaaaattgcacaccagaagagccgctacatctttgatctttaccatcgtagggaagagatctcgaatgaattgtatgagtttagcttggatcaaggatatgcggatcgtaatatcattgccaaatggaagaagcctggttatgaacgactctgctgtttacgatgcattcagccacgtgatcacaacttccagacgacgtgtgtttgtagagtgcccaaacacctgagggaggaaaaggtaatcgagtgtgtgcattgcggttgcaagggctgctcaagaggagattgatcgtttaatctcgttctgaatggaatatcaagtaatccaaatgcgcccacgtttattattagcagacctcgagttgatacctgttaacactgtactatgtagacaactatatggtttaaaacatcgtgacatatagtcggatg

SEQ ID NO: 1403 - DNA, 695 bp, Thellungiella halophila
  misc_feature (40)..(40): n is a, c, g, or t
  misc_feature (49)..(49): n is a, c, g, or t
  misc_feature (56)..(56): n is a, c, g, or t
  misc_feature (59)..(60): n is a, c, g, or t
  misc_feature (65)..(67): n is a, c, g, or t
  misc_feature (359)..(359): n is a, c, g, or t
atcggccatcacgaatccctctctccctcaaaactttttnatcttgtcntcgcttnatnnctctnnnaagaatatgccaaaggttaagacgaaccgagtcaagtacccagaagggtgggagttgatcgagcctactcttcgagagctagatgcccagatgagagaagctgagatggattcacatgatggcaagagaaagtgtgaaaccttatggccaatcttcaaagtctctcatcagaggagtagatatgtatatgacctttactaccgaagggaagaaatatctaaagagctttatgagttctgcttggatcaaggctatgcagatcgtaacctgattgctaaatggaaaaagtcangatatgaacgtttatgctgcttgcgctgcatacagccaagagatcacaactatggaacaacatgtgtatgtcgtgttcccaagaacctgcgtgaagagaaagcggttgaatgcgttcactgcggttgtcaaggatgcgcgagtggcgattaatctcatagctttcttcacaatcgctcactgcttggatcgattttaaaaacagtttgagtttattgtacgtgtaacgaagaagcctcttttacttgtcaacatcgaatctctctcctttattatacattgagatgtatgtagaaatttctggtttaactgaaggaagaacataaattcatctgac

SEQ ID NO: 1404 - DNA, 718 bp, Petunia hybrida
gcggggctgacacttaaaaatatctttctacctatccaaacgggctctgaattggctgcgcgttgcatagttttgcaaaaagagcctgtaaaaacaggctatttcccgaaaacaaaaacagtaggcgggtaaacaaaacggagcagttccagttgttgcaactgactggagccggcaattccagccataaccaaagctgaataatgcctagggttaagacaaatcgtataaaataccccgagggttgggagctcattgagcctaccctacttgagctggatgctaaaatgagagaagctggcaatgatcctcatgatggtaaaagaaagtgtgaaggactctggcccatattcaagattgcacatcagaggagcagatatgtctatgacctttactatggaaggaatgaaatatctaaagagctgtacgagttctgtttggaacaaggttatgcagatcgcaacctcatcgcaaagtggaaaaagcctggatatgagcgtctgtgctgcttgcactgcatacagccccgggatcataacttcgctacgacttgtgcacgtcgtgtccccaagcaccttagggaagctgctgtaatagagtgcgtacattgtggatgtcaaggttgtgcaagtggggactaattgcttacccataactgtatgtcatgagatcaaagttttcttacgttggctttgtctagcttgctgacttttcaagg

SEQ ID NO: 1405 - DNA, 1716 bp, Theobroma cacao
taaatgccactaatcctttgatttgcccttcaaaatggtattaaaaagaagataaaggaggaaaagagtatttggtaatttgcggaaaaataaaattgttccatgaaatttaaaatctgacaattaattaataaatctgcatttttttcattaaattttgttgacactcaaaaataaaataataggaacatcactcattttattaaaattaatattagtaataaaatttgaaaattcttgaaaataaagttaaaagtattcaatagacaaaataattaaatatcaaatttttaaattttaaaaaataaactattttatttcaaaccacaatatgttttgtaatttataaaagggtcaggtcgaatgctgcgttttaggtagagcccggcggaggttccgtaatgttcttccctagttggtgaggagcgtagttcgggaggttctcttgcagagttacttacattacattcactcatctcaagacaagggtacttagctgtttaaaaatgcctaaggtgaggacaaattgggtcaaatatccagatggatgggaattgattgagcctactcttagggagctggatgccaaaatgagagaagctgaaattgatccacatgatggcaagaggaagtgtgaaggattgtggcctattttcaaaattgcacatcagaggagccgctacattttcgaccttcactataagagaaacgaaatatctaaagagctgtatgagttctgcttggaacaaggctatgcagaccgcaacttaattgctaagtggaaaaagcttggatatgaacgtctctgttgccttcgttgcatacagccgcgggatcacaatttcagcacaacttgtgtttgccgcgttcctcagcatttaagggaagagaaagtagtggagtgtgtgcattgtggatgtaggggctgtgctagtggggattgattgacttttccaggtataatatttctctcttgcgagagcttagcatttgcatatcttgttcctaaaccttatttgtggtctatgtagaatggatgtttgttacattcaactgaactagaatatgtaaggtatttctgactcatgaccaccagggattgcattcaagcttactttcaacagaaactgtgcatgtgtagaatttatgtacgaattatccaaacattaaggatcactcgatcatgcatcaaatttctagtcagctatttgtgaaaaccatcctaattctgaacatcctcattttctcatataatacccaagaaaacatctttggagacttttcattcaaagaattggattattaatcataacagctatactctatgttgttggatatcagtaaatcaaattatcatcaatcttgcagattgattctggtttggaactagcaacattgatttgggagtttgtgactactggtgctgccataggtggtcttctcctgttctctttctccccttctcaatctctctctttctcatatataatgttagtggaccattcattcaattttcaaacagccctttggttttgcatgatgggacattgattatataccttataagtttgatctttaggcactctacgtcaatttttctggggcccaagtaagtttggtgctggaaaatttacctgatgtaaccagggtttcaaattcttgcttgctgcctttctagtcctatcaatcccagactaatatacaaagattgccgtc

SEQ ID NO: 1406 - DNA, 860 bp, Theobroma cacao
  misc_feature (13)..(13): n is a, c, g, or t
  misc_feature (705)..(705): n is a, c, g, or t
  misc_feature (718)..(718): n is a, c, g, or t
  misc_feature (734)..(734): n is a, c, g, or t
cggggagagcccngcggaggttccgtaatgttcttccctagttggtgaggagcgtagttcgggaggttctcttgcagagttacttacattacattcactcatctcaagacaagggtacttagctgtttaaaaatgcctaaggtgaggacaaattgggtcaaatatccagatggatgggaattgattgagcctactcttagggagctggatgccaaaatgagagaagctgaaattgatccacatgatggcaagaggaagtgtgaaggattgtggcctattttcaaaattgcacatcagaggagccgctacattttcgaccttcactataagagaaacgaaatatctaaagagctgtatgagttctgcttggaacaaggctatgcagaccgcaacttaattgctaagtggaaaaagcttggatatgaacgtctctgttgccttcgttgcatacagccgcgggatcacaatttcagcacaacttgtgtttgccgcgttcctcagcatttaagggaagagaaagtagtggagtgtgtgcattgtggatgtaggggctgtgctagtggggattgattgacttttccaggtataatatttctctcttgcgagagcttagcatttgcatatcttgttcctaaaccttatttgtggtctatgtagaatggatgtttgttacattcaactgaactagaatatgtaaggtatttntgactcatgaccnccagggattgcattcnagcttactttcaacagaaactgtgcatgtgtagaatttatgtacgaattatccaaacattaaggatcactcgatcatgcatcaaatttttagtcagctatttgtgaaaaccatcctaattctgaac

SEQ ID NO: 1407 - DNA, 510 bp, Salvia sclarea
ctactagaccttggctgtcactcaaaggtgaagacaaaccgagtaaagataccagaggggtgggagttgattgaacctactctacgtgaattacaagcaaagatgagagaagctgagaatgatccacatgatggtaaaaggaaatgcgaggccttgtggcctattttcaaaattgcccatcagaaaagtagatatatctttgatctctatcacaggaggaaggaaatttccaaggaattatacgagttctgcttggaccagggatatgcagatcgtaacttaattgcaaagtggaaaaagcctggttatgaaaggctctgctgcctgaggtgcatgcagcctcgagaccataacttccaaacgacttgcgtctgtcgagttccaaagcatttgcgcgaggagaaagttattgaatgcgtgcattgtggttgtaatggttgtgcgagcggggattaaggagcagagccgaagccaaatctacgagcacaatgcatttgtactgaagttaag

SEQ ID NO: 1408 - DNA, 780 bp, Glycine max
gctctcctctcaagtctcacttcaccgtaacgcgcatgcctttgtttgaagctagccttcgtcgaattcaatttgttttccctctcacgcggtcctaagtgctaacctgtatctgagatacaaaatgccaaaagtaaagacaaaccgtgttacatacccagagggctgggaattaattgagcctactctccatgaacttcaagcaaagatgagggaagctgagaacgatccacatgatggcaagagaaactgtgagacattatggcctatatttaagattgcacaccagaagagccgctacatatttgacctctatcatcaaaggaaggagatttctaaagaattgtatgaattctgtttagatcaaggatatgctgaccacaatctaattgcaaaatggaagaagcctggttatgaacgtctatgctgcttggggtgtatgcagccacgcaatcacaattttgccaccacttgtgtttgcagagttcccaagaaccttagggaggagaaggttatagagtgtgttcattgtggttgcaagggctgtgctagcggggactgagtggacatcaattctattatcagttgccaaaaagggggtttcttaggattattttgttggtgtttttagcattctccagattgtgttaactatttactacatgaatactatactatgtaatgaaaaatattagttaattgttaactatctgcatagttcaaaatctgaatggaaaatgagtaaaccttacgatctattaaataaaaaataattggtga

SEQ ID NO: 1409 - DNA, 648 bp, Mesembryanthemum crystallinum
gaattcgtgagcccgccacggtgatcgtcctacatccgaagacaaaccgctctttcgaaccccgattgattttctactgctttcttctctcttcttcttcttcttcttctttcaaagatctctcttctgttgcagtcctcgaaatccctcatcttcgacccgaacagttcaaagatgcctaaggtaaggacgaatcgggtgaaatacccacaaggatgggaattgattgaacctacactccaggagctagagtccaagatgagagaagctcaattagactcacatgatgggaagagaaagtgtgaaaccttgtggcctattttcagaattgctcatcagaagagccgctatgttttcgatctttatcatagaagaaaggagatctcgaaagagctgtatgagttctgcttggatcaaggctatgctgacagaaacttaattgcaaagtggaagaagcctggatatgagcgtctttgttgccttcgctgcatacaaccgcgagatcataactttggaactacttgtgtgtgccgagtccccaagcatctaagggaagagaaggttgtggaatgtgttcactgtggatgtaaaggctgtgccagtggggattgatttgtttaggattatgctataattggttgcataact

SEQ ID NO: 1410 - DNA, 636 bp, Adiantum capillus-veneris
ccaagttctgtttcctacgcttcctacgttattcgattcttgttcagaacttcagggatgcctaaggtgaggaccagtcgcgttaaatacccctctggatgggagctgatcgagcctactctcagagaccttgaaaataaaatgcgagaagctgaaactgaaacccatgaaggcaagaggatatgtgagtcactatggccgatatttaaaatatctcatcagaaaagcagatatatatatgatttgtactatcgacgggaggcaatctcaaaggagctgtacgagttttgcttagatcaagggtatgccgatcgaaatcttattgccaaatggaagaagcctggatatgagcgtctttgttgcttgagatgcatacaaccgcgtgatcacaattatggcaccacgtgtgtttgccgtgtgcccaagcacttgcgggaggagaaggtgattgagtgcgtgcattgtggatgcggaggatgtgcaagtggagattgatgaggaaattaaagggagcagtgaactgaagccaggtcaaaggactacccatgtaatgcaggtgaaggtgtaataactttcacattgcatgaaagctttttctatatgggagaatggtgtcagatgcgtttttatctgttg

SEQ ID NO: 1411 - DNA, 936 bp, Cryptomeria japonica
ggagggactccttacacaatcgctgataaagcccttgaatgaaatccaaaatccaatctccttcagcgttcatgtgatgtgaagagacggtgcagcgcaaaccgtgaagacaattacagagctctaccctctgttcagcaccataatttttcaagctatagctgaaaaccacttcgcctgtaatttgcgtggtatttgaagtaactggggtcctcccttttatctgttttcctgaattaattgaagatagagccgagaaaatgcccaaggttcgaacaaaccgcgtcaagtaccccaatggatgggagctcatcgagcccactcttagggatttagagaccaagatgcgagaagcggagaatgagacacatgagggtaaaaggaagtgtgagactctatggcctatttttaagattgcacatcaaaagagtcgatatatatttgacttgtattaccgcagaaaggagatatccaaggaactctacgaattttgcttggaccaaggctacgcagatcgtaatctgatagcaaaatggagaaaatctggatatgagcgcctttgttgtttgcgatgtatgcaacctcgtgatcacaacttttccacaacctgtgtctgcagagttcccaaacatcttagagaagaaaaggtcatcgagtgtgtccactgtggttgtagaggatgtgccagtggagactgatggcacagcaacaattcaaaaggcacctacagacaatgtgaaacttgacaattataacattagcagagaggtgaaagccaattgcacaaatgataatcgagtgctttaatgtatcttatggataatagcagttactttatctttaaacatgtttttttactgggacatgctttccaaattcatatgattcatatattttactattttaattattttaatcagtaacgtgttctggaat

SEQ ID NO: 1412 - DNA, 696 bp, Solanum phureja
gtcgccgaacacagaaaacggagaagcatacttcccgcagttgtagcagtagcttgccggaaacggcgatcggagatacttccgttcataaccgaagctgaaaaatgcctagagttaagacaaaccgtataaaataccctgagggttgggagctgattgagcctaccttagctgaactggatgctaaaatgagagaagctggcaatgactctaatgatggtaaaagaaagtgtgaagcactctggcccatattcaaggttgcacatcagaggagcagatatgtatatgacctttactatggaaggaatgaaatatctaaagagctgtacgaattctgtttggaacaaggttatgcagatcgcaacctgattgcaaagtggaaaaagcctggatacgagcgtctctgctgcttgcactgcatacagccccgggatcacaactttgcgactacttgtgcatgtcgtgtccccaaacaccttagggaagcttctgtaatagagtgtgtacattgtggatgtcaaggttgtgcaagtggtgactaatttgcttttccaatagctgtatgttatgagatcagcagatgttctttctggcttttcaaagcattagaaacctttgtctgtaatgaccaaagatagtgatggattattcagcctttaaccttttatcctacttgactttcagactatttttaaa

SEQ ID NO: 1413 - DNA, 735 bp, Solanum tuberosum
aagcagtggtatcaacgcagagtggcccattacggccgggggtcgccgaacacagaaaacggagaagcatacttcccgcagttgttgcagtagcttgccggagccggcgatcggagataattccgtccataaccgaagctgaaaaatgcctagagttaagacaaatcgtataaaataccctgagggttgggagctgattgagcctaccttagctgaactggatgctaaaatgagagaagctggcaatgactctaatgatggtaaaagaaagtgtgaagcactctggcccatattcaaggttgcacatcagaggagcagatatgtatatgacctttactatggaaggaatgaaatatctaaagagctgtacgaattctgtttggaacaaggttatgcagatcgcaacctgattgcaaagtggaaaaagcctggatacgagcgtctctgctgcttgcactgcatacagccccgggatcacaactttgcgactacttgtgcatgtcgtgtccccaaacaccttagggaagctgctgtaatagagtgtgtacattgtggatgtcaaggttgtgcaagtggtgactaatttgcttttccaatagctgtatgttatgagatcagcagatgttctttctggcttttcaaagcattagaaacctttgtctgtaatgaccaaagatagtgatggattattcagtctttataccttttatcctacttgacttttagactattttt

SEQ ID NO: 1414 - DNA, 753 bp, Solanum tuberosum
ggtcgccgaacacagaaaacggagaagcatacttcccgcagttgttgcagtagcttgccggagccggcgatcggagataattccgtccataaccgaagctgaaaaatgcctagagttaagacaaatcgtataaaataccctgagggttgggagctgattgagcctaccttagctgaactggatgctaaaatgagagaagctggcaatgactctaatgatggtaaaagaaagtgtgaagcactctggcccatattcaaggttgcacatcagaggagcagatatgtatatgacctttactatggaaggaatgaaatatctaaagagctgtacgaattctgtttggaacaaggttatgcagatcgcaacctgattgcaaagtggaaaaagcctggatacgagcgtctctgctgcttgcactgcatacagccccgggatcacaactttgcgactacttgtgcatgtcgtgtccccaaacaccttagggaagctgctgtaatagagtgtgtacattgtggatgtcaaggttgtgcaagtggtgactaatttacttttccaatagctgtacgttatgagatcagatgttctttctggcttttcaaagcattagaaacctttgtctgtaatgaccaaagatagtgatggattattcagtctttaaccttttatcctacttgactttcaagactattttttttaaaaaaataatatcttttcgtttttcaaaacagacacgaacacacaaaacactcgcag

SEQ ID NO: 1415 - DNA, 1011 bp, Pinus taeda
tcgtttcactcatacagaaggaaaatctgcgtgagctgagccatgtgggtctctcgacactttgcttaggtaacggaacacgaaaatcggcgtgagcgggtcgtgtgagtccctcgacccttcagttcgataatagagcatgagaatctttctttcgggacgtactctctacctttcttgcccttgccccccttctcagccttgaggaaatacaagttcttggagttggatattagctgcaagttctttcgagtttttctcaggtaaaatttgtatttgtattgatatttgcgatgccgaaggttcgaactaaccgcgttaagtatccgaatggatgggaactcatcgagcccactctcagggatttggagactaagatgcgcgaagcggagcaagaaactcatgaaggcaagaggaagtgtgaaaccctctggcctatttttagggccgcacatcagaaaagtagatatgtgtttgatttgtattaccgccgaaaggaaatatccaaggagctgtatgaattctgtctagaccaaggctatgcagatcgcaatctaattgcaaaatggagaaagtctggttatgagcgcctttgttgtttgcgatgtatgcaacctcgcgaccacaactttgcgactacttgtgtctgcagagtccccaagcatctaagagaggagaaggtcatcgaatgtgtccattgtggttgcagaggatgtgctagcggggattgattggataataacaatttgaatagttcttcggtacgacatataattgtgaaacagaatgtgacatttcacagctgtaaatttagtccagggggaacctggagctttacacaaatcatagtcacgtccacaaatttgcctattatagatcacaacaaccaatttactcttttttgaatttgcacggttcttatattttactatttcaaaaaacgagtgtaaattgctctcttagctttttttctgggaaattgaacattttgcagcaataatgtatcaaaaa

SEQ ID NO: 1416 - DNA, 697 bp, Solanum lycopersicum
tttcgtcgccgaacacagaaaacggagaagcatacttcccgtagttgtagcagtagcttgccggagccggcgatcggagatacttccgtccatagccgaagctgaaaatgcctagagttaagacaaaccgtataaaataccctgagggttgggagttgattgagcctacgttagctgaactggatgttaaaatgagagaagctggcaatgactctaatgacggtaaaagaaagtgtgaagcactctggcccatattcaaggttgcacatcagaggagcagatatgtatatgacctttactatggaaggaatgaaatatctaaagagctgtatgaattctgtttggaacaaggttatgcagatcgcaacttgattgcaaagtggaaaaagcctggatacgagcgtctctgctgcttgcactgcatacagccccgggatcacaactttgcgactacttgtgcgtgtcgtgtccccaaacacctcagggaaactgctgtaattgaatgtgtacattgtggatgtcaaggttgtgcaagtggtgactaatttgcttttccaatagctgtatgttatgagatcagatgttcttactggcttttcaaagcattagaaaccttttgtctgtaatgaccaaggatagtgatggattattcagtctttaaccttttatcctacttgactttcagactatttttttt

SEQ ID NO: 1417 - DNA, 791 bp, Solanum tuberosum
aagcagtggtatcaacgcagagtggccattacggccgggggtcgccgaacacagaaaacggagaagcatacttcccgcagttgttgcagtagcttgccggagccggcgatcggagataattccgtccataaccgaagctgaaaaatgcctagagttaagacaaatcgtataaaataccctgagggttgggagctgattgagcctaccttagctgaattggatgctaaaatgagagaagctggcaatgactctaatgatggtaaaagaaagtgtgaagcactctggcccatattcaaggttgcacatcagaggagcagatatgtatatgacctttactatggaaggaatgaaatatctaaagagctgtacgaattctgtttggaacaaggttatgcagatcgcaacctgattgcaaagtggaaaaagcctggatacgaccgtctctgctgcttgcactgcatacagccccgggatcacaactttgcgactacttgtgcatgtcgtgtccccaaacaccttagggaagctgctgtaatagagtgtgtacattgtggatgtcaaggttgtgcaagtggtgactaatttacttttccaatagctgtacgttatgagatcagatgttctttctggcttttcaaagcattagaaacctttgtctgtaatgaccaaagatagtgatggattattcagtctttaaccttttatcctacttgactttcagactattttttttaaaaaaataatatttttttgtttttcaaaacagacacgaacacacaaaacactcgcag

SEQ ID NO: 1418 - DNA, 522 bp, Actinidia deliciosa
ctcctcaccgccaaaaactgaacatctttcccggcggcgcaaccaccgcttcaccgacgctcacccggtcgaactccggcggttcaccaaaagaatgcctaaggttaagactaaccgtatcaaataccccgaggggtgggaactgatagaaccaactctccgtgacctacaagcaaagatgagagaagctgagaatgatccacatgatggcaaaagaaaatgtgaagcactttggcctattttgaagatagcacatcagaaaagtcgctatatctttgatctttaccaccggaggaaggaaatatccaaggagctgtatgagttctgcttagatcaaggctatgcagaccgtaatctgattgcaaaatggaagaagcctggttatgaacgtctatgctgtttaaagtgcatacaaccccggggtcacaacttgcagacaacatgcgtttgcggagtccccaagcatctgagggaggaaaaggttatagaatgcgtgcactgcggatgcaaaggttgtgcaag

SEQ ID NO: 1419 - DNA, 490 bp, Panax ginseng
attcgaattcggttaacttcgctgaaaataatgccgaaggtgaggacaaaccgtgtcaaagtcccagagggttttgaactgatcgagcctactctctgcgaattacaaggaaagatgagagaagccgaaaatgatacacatgatggaaaaagaaaatacgagactttgtggcctatttttaaaatagcgcatcagaagagtcgctatgttttcgatctttatcaccgaaggaaggaaatatccaaagaattgtatgagttctgcttggatcaaggctatgctgatcgcaatctaattgctaagtggaagaagcctggttacgaacgtctttgttgtttgagatgcatgcaaccacgggatcacaacttccagaccacttgtgtgtgtacagttcccaaacacctgagggaggagaaggttatagagtgtgtacattgtggttgtggaggctgtgcaagtggagattaattaataacttcatgtccgatga

SEQ ID NO: 1420 - DNA, 1034 bp, Pinus taeda
  misc_feature (10)..(10): n is a, c, g, or t
  misc_feature (12)..(12): n is a, c, g, or t
ccgacagttngnttcactcatacagaaggaaaatctgcgtgagctgagccatgtgggtctctcgacactttgcttcggtaacggaacacgaaaatcggcgtgagcgggtcgtgtgagtccctcgacccttcagttcgataatagagcatgagaatctttctttcgggacgtactctctacctttcttgcccttgccccccttctcagccttgaggaaatacaagttcttggagttggatattagctgcaagttctttcgagtttttctcaggtaaaatttgtatttgtattgatatttgcgatgccgaaggttcgaactaaccgcattaagtatccgaacggatgggaactcatcgagcccactctcagggatttggagactaagatgcgcgaagcggagcaagaaactcatgaaggcaaaaggaagtgtgaaaccctttggcctatttttagggccgcacatcaaaaaagtcgatatgtgtttgatttgtattaccgccgaaaggaaatatccaaggagctgtatgaattctgtctagaccaaggctatgcagatcgcaatctaattgcaaaatggagaaagtctggttatgagcgcctttgttgtttgcgatgtatgcaacctcgcgaccacaactttgcgactacttgtgtctgcagagtccccaagcatctaagagaggagaaggtcatcgaatgtgtccattgtggttgcagaggatgtgctagcggggattgattggataataacaatttgaatagttcttcggtacgacatataattgtgaaacagaatgtgacatttcacagctgtaaatttagtccagggggaacctggagctttacacaaatcatagtcacgtccacaaatttgcctattatagatcacaacaaccaatttactcttttttgaatttgcacggttcttatattttactatttcaaaaaacgagtgtaaattgctctcttcttagctttttttctgggaaattgaacattttgcagcaataatgtatcaaaaataagttcaattc

SEQ ID NO: 1421 - DNA, 1163 bp, Marchantia polymorpha
  misc_feature (1125)..(1125): n is a, c, g, or t
gttgccaattgagctcgttgacgaagacgaaggcttgccggacttgcctctacgctgtgttcatcgttcgtgccaaatcggaccgagagcgactcgaacgcgattgtgggaaaatcagaagcgcgcaatttccggccatttggaagagaagatccaggaactcatggccgtctagaaacagacttatcagagagattgctggtgaaagcaccatgccaaaagttcgcacaaatcgcacgcgctacccgcaaggatgggaactcatcgaacctacccttcgtgacttggacatgaaaatgcgcgaagctgagaacgaatctcacgaggggaagagaaagtgcgaggcactgtggcctattttcaaaatctctcaccagaagacgagatatatctatgatctttattatcgacggaaggccatttcgaaggagctcttcgagttttgcttagatcaggggtatgccgacaaaagcctgattgccaagtggaaaaaggctggttacgagaagctttgctgcctgagatgcatacagccccgggaccacaatttcaacacgacatgcgtttgtcgtgttcctaagcatttgcgcgaggagaaggtgattgaatgcgtacattgtggttgcagagggtgtgcaagtggggactagaagctgtcgcttagttgtgcatggaacaggttttatacgatccttgtgactcgtagacctcaccgtaggttgtataatttgtagggattgactactactaggcagatcgaaggaaatgtacctctcatatgggttgccggaatatagcagagaaggaggtctcgatttgaggaaggatacaggattgtatctggatttcgccagtttgtggagagtttgttgccgatgagctaatataccacagagatcacaaattagcgtcttatccaaaatttgccattcaattccccaacgagaaagaagcggggaatgtgtatcgaagagtgcaagtatgttttgctttatcttcgccggttggtgttgccgattcttcttatctcatgttctgaggaagtgtgggcattatccagtttttgtggggggacgttttcgtaaatgctgcgtttaggcagtatacagggaggatacgcctacngtttgtaaaccaaaccatttgttgctaacttgtgtgac

SEQ ID NO: 1422 - DNA, 762 bp, Citrus sinensis
gaagacgggaactgcgggacgggtccggattcccgggtcgaccccgcgtccgcatatctacactaggaagaaccaaaagggcaaatcgagcaacaaattgatctatttataacttatgtcacttggatgtgtaagttggaggaggctcttgaaactctgtgccttttagcctgtagattcagtcggttgatttgatcaagctacaggttgcaaaatgcctaaagtgaggacaaaccgtaccaagtatccagatgggtgggagttgattgcgcctacgcttcgtgagatggaggctaagatgagagaagctgaaaatgatccacatgatggcaagagaaagtgtgaaacactgtggcccatcttcaaaattgcgcatcagaggagccagtacatatttgacctttattacaaaaggaatgagatttccaaggaattgtacgagttctgcttggatcaaggatatggtgacagcaacttaatcgctaagtggaaaaagcccggatatgaacgactctgctgcctacgatgcatacagccaagggatcacaactttggcacaacatgtgtgtgcagagttcctaagcacctgagggaagagaaacatgttgagtgtgtgcattgtggctgtaagggctgcgcaagtggggattaatttgagtactttgtctagctttcttttttgcattcgatgtagcttaactcttggaggactgatagtatcgacaatcagttgagcatgcgtgactttctaacttgcaaaca

SEQ ID NO: 1423 - DNA, 643 bp, Sciadopitys verticillata
ggcagaggaagaggagcacaagccgtggaagaggagagaaggcggtagagacagaagtcaagcaatcaggagtttttggcctggaatttgggtgatgtttgaatcgactgaggttttttgttagaaatcgttcatcattttcaatgccgaaggttcgaacaaaccgtattaagtatcccgaaggatgggaactcattgagcccactctcagggatttggagagtaagatgcgagaagcggagaatgaaacacatgaaggtaaaagaaaatgtgaaactctatggcctatttttaaggttgcacatcaaaagagtcgatatctatttgacttgtattaccgccaaaaggaaatatccaaggagctctatgaattctgcctggatcaaggttatgcagatcgtaatctaatagcaaaaatggagaaagtctggatatgagcgcctttgttgcttgcgatgtatgcaacctcgcgatcacaactttgccacgacttgtgtctgcagagtccccaagcatctcagggaagagaaggttattgagtgtgtccactgtggttgtagagggtgtgctagcggagattgattttgcaacaatggtttaaatgtcacgtgtttcatggagacactaaaagccttgtttaagc

SEQ ID NO: 1424 - DNA, 1347 bp, Pseudotsuga menziesii
aaatctctagaatcgactagatttcaataatcttaacggcaaccagaacccagaaaatatttgtgcatctgaaacctgaacctttgttatgaagcacagaggcaaggcataaattcttcctatcttacgggcaattgagaagaggctatcaatattgcattagcagtagctttgactatcgatgatgtggtcttgtgcatgttcttctttccatggatgatggtagggcagagtagagtagcttttagggattaccgcctccacgccttctgctcgcaaaactgtcgttgctgtgcctcgagcctctgattaccctcttaatcgacctccgaaacccccggattaaacgaaactcccttaacaacaacacaaataacggacatcatcaatcagtcaatctttctttttcgtaggggccgcgcggaagaacgatcgatcgatcgaattgctgccttcattatttttggctggcaaagtcgttcctacttggcatatacgatgcacaacaaagattaggaagccatcggcgttaaagaaatcagaagttttgggggttggaaattcgattcgagttcattcgtggtatttttgtgtgaaaatttgattgatatttgcgatgccgaaggttcgaactaaccgggttaagtatccaaatggatgggaacttattgagcccactctcagagatttggagactaagatgcgtgaagcggaacaagaaactcatgaaggcaaaagaaagtgcgaaaccctttggccgatttttaaggccgcacatcaaaaaagtcgatatgtgtttgatttgtattaccgccgaaaggaaatatccaaggagctgtttgaattctgcctagaccaaggctacgcagatcgcaatctaattgcaaaatggagaaagtctggttatgagcgcctttgttgtttgcgatgtatgcaacctcgtgaccacaactttgctaccacttgtgtctgcagagtccccaagcatctaagagaggagaaggtcatcgaatgtgttcattgtggttgtagaggatgtgctagtggggattgattgtttaacaatttgcatagcaggttttctttggaattgtaacaaaaaaaaatgtgattttgacagttgtaaatttagttgtgggatgaaacctagaacttacataagtcatagccatgtccacaaactttcctattatagatcacagcagttaatgtacctctcagaacatttgcaatatactcttttccaaatttgcatagttcttacattctactatttcagaaaacaagttgtgaatttctctctttagcttctttattggaaatgaagtttgaacattttgtgaaaat

SEQ ID NO: 1425 - DNA, 641 bp, Leymus cinereus x Leymus triticoides
ctcactctccctacatcccgctcccttgccctaccctagtccgatccaacgcggctctagtgctgccgccgtgccctaacctctcctccgcggctccaaactcgtcaccaccccgcacccctccgcctttcacgcgagtcgccgccatcgccgttcccgttcaaccccaccgcgttgccctgccgctacaaccccgtccgcgatttcggccatcggtttctgaggtttgtgcattccaagccagccctagggtaccccttgtgacagcatgcctaagataaagacaagccgtgtcgaatatcctgaaggatggatgcttattgaacccacaatccgtgagctggatgccaaaatgagagaagctgaaaatgatacacatgacgggaagagaaagtgtgaagcactctggccaatttttcgcatttctcatcaaagaagccgttacatatatgatcttttctatagaaggaaggaaatatcaaaggagctctatgagttctgcctggaccagggttatgcagaccgtaatctgattgcaaagtggaaaaagccgggttatgagcgcctctgctgccttcgctgcatccagacccgagaccacaactttgcgacgacttgtgtgtgccgggtccccaagcacc

SEQ ID NO: 1426 - DNA, 540 bp, Lolium multiflorum
cgccgcccccacctccaccccctacgcccgcgcgtcgccgccatcgccgctccccttcaacctcatagctgcccgccgtctcaaccccgtccgcgatttcggcccttggttttccgagatttgtgcgttccaaaccagccctaggagggagaccccttgtgacagcatgcctaagataaagacgagccgcgtcgaataccccgaaggatgggcgctcattgaaccaacaatccgtgagctggatgccaaaatgagggaagctgaaaacgatacgcatgatgggaagaggaagtgcgaagcgctctggccgattttccgcatctctcatcagagaagccgttacatatacgatctcttctatagaaggaaggagatatcaaaggagctgtacgagttctgcctggaccagggttatgcagaccgtaatctgattgcaaagtggaaaaagccgggttacgagcgcctctgctgcctccggtgcatccaaacacgagaccacaactttgcgaccacttgcgtgtgccgggtccccaagcacct

SEQ ID NO: 1427 - DNA, 511 bp, Adiantum capillus-veneris
ctgctatcttgtgccgagatgccgaaggtgcgtagaagccgtttgaaatacccttccggatgggagctcatcgagcctactctgcgagatctcgactccaaaatgagagaagcggaaacggaaactcatgaaggcaaaagaaaatgcgagtctctgtggccaatattcaaaattttacatcaaaagagcagatacttatttgatttgtattaccgccggaaggccatatcaaaagagctttacgagttttgcttagagcagggctatgcagaccgaaatctcattgccaagtggaaaaagcctggttatgagcgactttgctgcttgtgttgcatacaaccgcgagaccacaactatggcactacatgtgtctgccgtgtgccaaagcacttgagagaagagaaggtcattgagtgtgtgcattgtgggtgtagaggttgcgccagtggagactaatggcctgaagccatgtgggaagatacgtcatgactgcagttcagcagatagttgc

SEQ ID NO: 1428 - DNA, 534 bp, Cleome spinosa
ccgagcaaaaacccttcgttttcggctctaaattaaatcccgtttccaggttctcgagtttctcagaagaatccttttcgcgcttcagttccgcgacggaagtactgggagaaaaaatgccaaaggttagaacgaatcgggtcaaatacccagaagggtgggagctgattgaacctacacttcgggagctggatgccaagatgagagaggctgagaccgatccacatgatggaaaaagaaagtgtgaaaccctgtggccaatcttcaaaatctctcatcagaggagccggtatttgtatgacctttactacagaaggaatgaaatatctaaagagttgtatgagttctgcttggatcagggatatggggaccgcagcctgattgcaaagtggaaaaagtcgggatacgaacgtctctgctgcttacgctgcatacagccgagagaccacaactttgggcgacttgcgtatgccgagttcccaaacacttgcgagaagagaaagccgtggaatgcgttcactgtggatgtcaagg

SEQ ID NO: 1429 - DNA, 930 bp, Ceratodon purpureus
cttcggagctctggagcttgattgctgatcgcagttcctcgcacgggttcgtctcttacagtgttgctgcgtcgtccgctcgcacgtcattctcttcttcacctcgtcagctttccaacgagccctctcacgcgcgatctgcctttgtgtgcgaggagaacgactggggttttggtccagggtttaggactactcgagcgccatgccgaaggtgcgcaccaatcgcacggtgtatccggagggatgggagctcatcgagcccactctgcgcgacttggagactaagatgcgggaagctgaaaacgagacgcatgagggcaagaggaagtgcgaggctttgtggccaatctttaagatttcgcatcagaagagccgttatatttatgatctcttttacaggcggaaggcgatttcgagagagctgttcgacttctgcttagatcaggggcacgcggataagaacttgatcgctaagtggaagaaatccggttacgagcgcttatgttgtttgcggtgcatccaacctcgtgatcacaactatggaacgacttgcgtatgtcgggtgcccaagcatctgcgagaagagaaggtgatcgagtgcgttcattgtggttgtcatggatgtgcaagtggagactagtaacttaggcgcatcgcttgtcctgcctttaaattgtatttaatcggacaggctaggtttttttgtacaattttagactcttatagtccctcgattctggcgaagcaaaaattgcgtagttttcaatgccagtcgcttagttatgtcaggggttttggaaagtacagagcctcactttgctggcaggcagtgtgtcagactcatgcaggcagattttgaagtgcaacagtgcggttcctgctgagtaaccaactaatgtattatgattcttgctttaagctcatgggtcc

SEQ ID NO: 1430 - DNA, 734 bp, Ricinus communis
gggagtgttaagactcctcttttattgcagggtctgtcctttactactttttgaataatctctgaattctacagtgtagtgtgtactagggtttggcaaaggaaaatccaacaattgcacttgtaccatgccgaaggtgaggacaaaccgcatcaaatacccagatgggtggcaattaattgtgcctactctgcgtgacctagatgccaagatgagagaagctgaaaatgatccacatgatggtaaaagaaagtgtgaggctttatggccgatcttcaaaattgcccatcaaagaagccgttacatttttgacctttataaaaccaaccaaatttctaaagagctttatgagttctgcttggaacaaggctatggtgatcacaacttaattgccaaatggaaaaagccgggttatgaacgactctgctgcctacgctgcattcagccaagggatcataattttggcacaacttgtgtgtgcagagtccccaaggaattgagagaagaaaaggttgttgagtgtgttcattgtggttgtaagggctgtgcaagtggggattgattgatggctattttatgtaatattctctgttcaaggtacaaagttcccccttgtcccaaagccaatcttaagcacattttgtagctgaatttatgatattatttgatggatgaggcatctgaggatcaagaacctattaaaagagaattaatgaaatctatggtgcattcat

SEQ ID NO: 1431 - DNA, 1039 bp, Physcomitrella patens
agctggttttagcgaagctttggtgtgtctgtagcggttgcgggatctgctgctcttctacgaatagttgatgcttggcctcagtagcgactcctttggacttgcgacctctctctctatcgaattgtgaaagaacaggggagaggaagaagcgccacttggagagggggttagtcgattgagggcaagatgcccaaagtgcgcactaatcggacggtgtatcccgagggatgggagctcatcgagcctactctgcgcgaactggaaactaagatgcgtgaagctgaaaatgagactcatgagggcaagaggaaatgtgaggctttgtggccaatattcaagatctcacaccagaagagccgttacatttatgatctattttacagacgaaaggccatttctagggcgttatttgatttctgcttagaacaaggtcacgcagataagaatttgattgccaaatggaagaaatctggttacgagcgcttatgttgtttgcggtgcattcaaccccgcgaccataactttggaacaacatgcgtatgccgggtacccaagcatctgcgagaggagaaggtgatcgagtgcgtccattgtggttgtcacggatgtgcaagcggagactaattatgtagactctacgcttgccttgacttcaactagtttttaatcagacaagaattatggagtcaagtgacttttatgaagtgtacaaggtcaactcatttaaattgtcatgataaggagttatcaccactgcagtgctccctcggcactggtcaatcccctcgtgctgctgcacttttttcactcaactttccgtgcaccagcagtgtgacaacgcacttgcttttctctttgtcgatcaattagcatgggtaagcatcaaacacttgaatcgaatggagagctttgaagtagtggatttaaggctcctgatgtaaaagctcctccacgcccgtccttcttgatgctgcttgacgagttggggcattgtatcacacggtggaaactcaatttgattcttttctaaaaactc

SEQ ID NO: 1432 - DNA, 453 bp, Orobanche aegyptiaca
ctcaaccctcgccggacactcaaattcctccacaagaccatatgccgaaggtgaaaaccaaccgcgtcaaatatcccgaaggatgggaactcatggaacccactctcctcgaactacaagcaaagatgcgagaagccgagaacgatccacacgacaacagacgaaaatgcgaagctctctggccgatcttcaaaatcgcgcatcagaggagccgttacgtcttcgatctgtatcaccggaggaaggagatctcgaaggagctgtacgatttctgtctggatcagggacacgccgatcggaacctgatcgcaaagtggaagaagcctggttacgagaggctctgctgcctgaggtgtatacagcctcgcgatcataattttcagacgacctgcgtttgcagagtaccgaagcatctgagagaggagaaggtcgtggagtgcgttcattgtggct

SEQ ID NO: 1433 - DNA, 882 bp, Saccharum officinarum
acccaacccacgcgaccggcggaggtgccaccggcttctgcacagattttggatagcatgccttaagatcaagacaacgccgtgtgagggatcctgaacgatgggagcttccccacccaacgcttcgggatctggacgccaaaatgagggaagccgaggatgatccacatgatacggaagaagaaatgtgaagctctttggccagtcgtccaaagattttatgaaaagagtaatttacttgctgaaaatgtactatcgaaggaaggaaatatcgaaagagttatatgagttttgcttagaccaaggttatgcagatcgcaatctgattgcaaagtggaaaaagccaggttatgagcgcctctgctgccttcgctgcatccagacacgagaccacaactttgcaaccacttgcgtctgcagagtgcccaagcacctcagggaggaaaaggtgatagaatgtatccactgcggatgcaggggctgtgccaacggtgattaaagttgatatcctgcggttgtgggataacctctaagctgttcgaaatgtgccattatatttgggccccgatgttgtgaaccaaccccgtataatcaggtggccagcggtgaataccaggtcccatcttgtgggctgcaaataatggtcgacaaattggtcgaggggggccgttgtattattaaatctggtgaggacaagcaccgggtaatcaggttaatttcaaccctatgcaatgttttgtaaaatgccaaaaatcaaggttaattcaggcctttacttccaggggacagtttacaaaatttggggacttttttggcgacacactattttggcacataaacggtttatatgggcctctttttcgcattagtggccaaaaaatt

SEQ ID NO: 1434 - DNA, 983 bp, Mesembryanthemum crystallinum
  misc_feature (826)..(826): n is a, c, g, or t
  misc_feature (904)..(904): n is a, c, g, or t
  misc_feature (910)..(910): n is a, c, g, or t
gcacgagccaattcctagtgccctaatcctttcgggtatccctgcgctctctctctctctccccctgacgtccaccggcgccggcgatattccgccattaacgcctctctaagttcgctcgcgattctctactcactgttgcggttcttttttccttcttcttccccactttccgacaaatcgacaacaccacagttgagaaatgcctaaggtgaggacgaatcgggtgaagtaccctgaaggatgggaattgattgaacctacactacaggagctagagtccaagatgagagaagctcaaatggattcccatgatgggaagagaaagtgtgaaactttgtggcctattttcaaaattgctcatcagaagagccgctatattttcgatctttatcatagaagaaatgaaatttctaaagagttgtatgagttctgcttggatcaaggctatgctgacagaaaccttattgctaagtggaagaagcctggatatgagcgtctttgttgcctccgctgcattcaaccacgagatcataattttggaactacttgtgtatgtcgagtccccaagcattctgagagaggagaaggccgtcgaatgtgttcactgtggatgcacacgctgtgccacgcggggaatgatgtgccctagctccacgtggaactcggttgggtaactggaccattcaactgctatcctggataatattaagctaggctctaatttgtaaggctagaagcgttacttgctgaattaatctccaagtgaaaattgctttcgtttctagggggtcttacaaatttcatttacaacggctccaaaaanatataactctccgctctttctcttctccccccctccaaatatccttctctcccctccaccgcttccttcccctcaaantaatanttcctctctggggggggcgccgcgccccacattcctctttagggaggctttaacccccccccacgtgccggct

SEQ ID NO: 1435 - DNA, 458 bp, Fragaria vesca
aaaatgcccaaggtaaagactaaccgaatcaagcacccagaaggctgggaactgattgagcctactcttcatgagctagaagcaaagatgaaagaagctgataatgacacccatgatggtaagagaatatgtgagactttatggcctattttcaaaataacacatcaaaagagccgctacatttttgatctttaccatcggagaaaagaaatacccaaggaattgtatgaattctgcttggaccaacgtcacgcagacagcaagctaattgcaaagtggaagaagcctggttacgaacgcctctgctgtttagggtgcatgcaacctggggatcataattttgcgactacctgcgtctgccgagtgcccaagcatctaagagaggagaaagtcatagaatgcgtccactgtggctgcaagggctgtgccagtggagattgattactccttacaaggat

SEQ ID NO: 1436 - DNA, 751 bp, Physcomitrella patens
atgcccaaggtacgcaccaatcggacggtgtatcccgagggatgggagctcatcgagcctactctgcgcgaactagaaactaaaatgcgtgaagctgagaatgaaacccatgagggtaagagaaaatgtgaggcattgtggcccatattcaaaatttcacatcaaaagagtcgttatatttacgatctcttttacaggcggaaggccattacaagaaagctattcgacttctgcttagaacaaggccacgcggacaagaatttaattgccaaatggaagaaatctggttacgagcgcttgtgttgtttgcggtgtattcaaccccgtgatcacaactatggaacaacatgtgtatgccgggtgcccaagcatctgcgagaagagaaggttatcgaatgcgtgcattgtggttgtcatggctgtgcaagtggagactaattatgtaggtgattcggttgtcttgcttatgatcagtttaaaaacaaataggttaggatttctgtacagtttgtgactttcatgtatcctcaattttggcgaagcaagactaatatgtcactgaggccagcggcatggaaagtgttagattttagaattcccagagcctccaattttgcgggcaggtagtcaggcatggaaagtgttagcttgtagaattcccagagcctttaattttgcgggcaggtagtcaggcaggaagatttatatttgtgatgtgtggcagtagttcctgccaagtaatcttacatca

SEQ ID NO: 1437 - DNA, 2343 bp, Sorghum bicolor
atgcctcggaagtcgcacaagccgaggggcgcggccgcgcacgcccccgttggtctcacggccgggccgaggcctcccctgaaggccgcggccccaaaccctagccccgcgtccgagcttccccaggctggcgtagcagaggccgagggccttaaggcacctgacgccggggcgtccgccgccgctgaggccctggagcgcctccacgtcggccctgcttctgatggtgacccgccgtcgctgccgccttctgagcccgtggacgaggcctccgcgccgcctcagccgccgccggtcgaggcgtcgtcttccgggaggtctgcggcgggcgggagttgggaggaggaggctgtaaggaagctgcacgagctggcggaggttggtggggatgaggtggagttgaccgaggaggaggtgcgcgccaatgatcagaggcaggaggacgagatctgtgccctcgaagcaatttttggagatgctgtagtgattttggacagaaagggaggccagcggtctttccaggttcttgtgcatattgagatcccagattctatagatgtatcaacaaagctcaattatggtgatggaacattaaattatggggcaacatgtgatgatgatgatgaccttttctacaagttcagagttgagcatttgcctccaatcctgctaacatgtctcctgcctacatcatacccaagtcaccgtcctccctttttcactatatccacatattggcttgataaacggatgatttcattgttatgtcgcatgcttgatatgctttgggaagagcaacaagggatggaagtagcatatcaatgggtgcaatggctccaaagttcttccctttctcacttagggtttgataatggagtaattttgagcaagagtgatgtgacatgtgatgcagatggtgaagataagcgtgcttgtccagacaatgctccaccagatgttataattccaaggctgatgagatacaatgacaataagcatcatgaagctttcttacatgctatccatgattgcatgatttgtttcagcgagtgtcctggtgttgatttcatcaaacttccgtgtcatcatttcttttgctggaaatgcatgcaaacatactgcaaaatgaatgtcaaggaaggaaatgtagtgaagttgctatgtcctgatacaaaatgtgaaggtgctgttcctccgaatgtattgaaaaggctgcttgaagaggatgaatatgaacgttgggagggattactgcttcagagaactcttgatgccatgaaagatgttgtgtactgtccaagatgtcaaactgcttgcttggaggatgtaggtaatgaagcagtgtgttcaagttgtttgttcagcttttgcaccctttgtagaaatcgccgccatgttggagagcaatgtatgtctccagaagaaagacttatgatcttggagaaacgccaagaatctgggaatgtgcaaggagatcagatgaaaattctagaggaactacgcagcctgaaggaaattatgaaggattcaaaacagtgcccaaaatgcaggatggccatatctaagacagaaggatgcaataagatgcattgtgggaactgtggggagtacttttgctatcaatgcaaccgtgcgatcactggatatgagcatttcaggggttcttgtgtgcttttccctcaagaggaactggacagatgggaattgcaaatgaatcaaagggtccgacgccaagttgttgcacatgcgcatgctgaaatgcatgggcgggatggtcaagctcatccttgccctacttgtcggcaaccgtctccaaagatcggaaacaacaaccacctcttctgttgggcatgccagaagcatttttgtgccctgtgccataagactgtccaaaagcctgcacagcattatggtcccaaaggatgcaagcaacattcggcggatccctgaacgaggttttcccatatgtgcatcaacaccatggtggcagtgcaatttccaagtgttttgtgcaagtgcacatatatacttatcctgggacgtactttactcctggattccaatttttggctgcgagcatgttttgaagcttccattgtcattgtacctacactaacagttcggcagtttacattcgtgaacatgaaggaactattcattcattcagtaccggatgaattttttagattactctgtatattgaagatgcgattgaacaccaagtcaaaaaccaatagaaccttgcagaattctgagagggaagattatttgttgtactgttggattgatcaatatatacaaagaatatgctacatgttttcttattttaacttggcgttccca

SEQ ID NO: 1438 - DNA, 1796 bp, Saccharum officinarum
tctgcctctgcgtataagttcctttcttccttggccgcttctgcgctcgcctcccttctccagttctcttccaccccacgtctcccactctcccttctagatccactcctccccgtgctcacggctcatctgcgagcagattgagcggggagccgggagggggaggctgaggagcggcgagagggagccagattgagccatggcctcctcttgggctcttcttgccctggttcttgcgctgtcggtctgtgcaagcgtggcgcgtggctccgagccctggtggaacgagacacagcaggtgtacgccaccaccgccagctccggtggtagcaacggcgtcttcgtcggcctcaccctcatccagtcggcggcggccaagggagcggtgtgcttggatggaagcttaccaggttaccacctgcacagagggtttggatcaggagcaaacagttggcttgtcaatctcgagggtggaggctggtgcaatgatgtcagcagctgtgtgttccgcaagggcagtcgtcgtggatcatcaaatcacatggagaggcaactccagtttacagggataatgagtaacagacctgaagagaatcccgatttctacaactggaacagagtgaaggtccggtactgtgacggtggatctttcactggtgatggttctgatgcggctgcaggcctttatttccgaggtcagcgcatttggcaggccactatggatgacctaatggtccaaggaatgcgttatgctaatcaggcccttctttctggatgctctgctggtggtgtttctaccatacttcactgtgatgaattctgtggattgtttccatcaaataccagagtcaaatgcctggctgatgctggaatgtttcttgacactgttgatgtttctggccgtcgggaaatgagatcttttttcaatggcattgtgagattgcagggttctggaagaagcttgcctaggtcttgcacctcacgcatggacaaaacctcgtgctttttcccgcagaacgtgttgccaaccattcaaaccccaacttttgttttgaacactgcctatgacgtgtggcagctccaacaaagtgtggcccccagaacagctgatcctcaaggtctttggtcaaagtgtaggacaaaccatgccttctgtaatagcaaccagcttcagtttttgcaagggttcaggaaccaaatgcttgatgccgtgaggggtttctctgcgtcaaggcaaaatggtttgttcatcaactcatgttttgctcattgccagagtgagagacaggatacttggtacgcgaacaactcaccacgtcttggtaacaagaaaatcgctgacgctgtcggggattggttcttcgagaggggagacgcgaagtacacagactgcccgtacccttgcgatggcacttgccatcatctagtgttcaggggagaccattaagattattcttcaacaccaacagttcagatggtaaaaggaacagagaccccaatgccaatgggtacagaatcaaaaacaaggtatagatacagagaaggtgcaagtggtcggcttgcccatgtatgttcatccgtcgatcatatgattgataggacagggacctcgcccgtgaattcgcggcggcctctgcattagcttcacatatatcatcatgatatcgattcgtttcattggaaaaatgtccatgattatgtgcaacaacatttggaccctatcgcctatctgttaatctgtataacactataacgttacgtacgttacatattcatttgtggaacgtggaagaagt

SEQ ID NO: 1439 - DNA, 1796 bp, Saccharum officinarum
  misc_feature (750)..(750): n is a, c, g, or t
  misc_feature (925)..(925): n is a, c, g, or t
  misc_feature (969)..(969): n is a, c, g, or t
  misc_feature (1163)..(1163): n is a, c, g, or t
  misc_feature (1698)..(1699): n is a, c, g, or t
  misc_feature (1702)..(1702): n is a, c, g, or t
  misc_feature (1704)..(1704): n is a, c, g, or t
  misc_feature (1706)..(1706): n is a, c, g, or t
  misc_feature (1726)..(1726): n is a, c, g, or t
tctgcctctgcgtataagttcctttcttccttggccgcttctgcgctcgcctcccttctccagttctcttccaccccacgtctcccactctcccttctagatccactcctccccgtgctcacggctcatctgcgagcagattgagcggggagccgggagggggaggctgaggagcggcgagagggagccagattgagccatggcctcctcttgggctcttcttgccctggttcttgcgctgtcggtctgtgcaagcgtggcgcgtggctccgagccctggtggaacgagacacagcaggtgtacgccaccaccgccagctccggtggtagcaacggcgtcttcgtcggcctcaccctcatccagtcggcggcggccaagggagcggtgtgcttggatggaagcttaccaggttaccacctgcacagagggtttggatcaggagcaaacagttggcttgtcaatctcgagggtggaggctggtgcaatgatgtcagcagctgtgtgttccgcaagggcagtcgtcgtggatcatcaaatcacatggagaggcaactccagtttacagggataatgagtaacagacctgaagagaatcccgatttctacaactggaacagagtgaaggtccggtactgtgacggtggatctttcactggtgatggttctgatgcggctgcaggcctttatttccgaggtcagcgcatttggcaggccgctatggatgacctaatggtccaaggaatgcgttntgctaatcaggcccttctttctggatgctctgctggtggtgtttctaccatacttcactgtgatgaattctgtggattgtttccatcaaataccagagtcaaatgcctggctgatgctggaatgtttcttgacactgttgatgtttctggccgtcgggaaatgagatcttttttnaatggcattgtgagattgcagggttctggaagaagcttgcctangtcttgcacctcacgcatggacaaaacctcgtgctttttcccgcagaacgtgttgccaaccattcaaaccccaacttttgttttgaacactgcctatgacgtgtggcagctccaacaaagtgtggcccccagaacagctgatcctcaaggtctttggtcaaagtgtaggacaaaccatgccttctgtaatagcnaccagcttcagtttttgcaagggttcaggaaccaaatgcttgatgccgtgaggggtttctctgcgtcaaggcaaaatggtttgttcatcaactcatgttttgctcattgccagagtgagagacaggatacttggtacgcgaacaactcaccacgtcttggtaacaagaaaatcgctgacgctgtcggggattggttcttcgagaggggagacgcgaagtacacagactgcccgtacccttgcgatggcacttgccatcatctagtgttcaggggagaccattaagattattcttcaacaccaacagttcagatggtaaaaggaacagagaccccaatgccaatgggtacagaatcaaaaacaaggtatagatacagagaaggtgcaagtggtcggcttgcccatgtatgttcatccgtcgatcatatgattgataggacagggacctcgcccgtgaattcgcggcggcctctgcattagcttcacatatatcatcatgatatcgattcgtttcattggaaaaatgtccatgattnngtncnanaacatttggaccctatcgcntatctgttaatctgtataacactataacgttacgtacgttacatattcatttgtggaacgtggaagaagt

SEQ ID NO: 1440 - DNA, 2127 bp, Hordeum vulgare
cagcatccgagatgctttgcctcccaaccgtgacgacgcggcaaccagtaacacctccgggttcacactgaaccagccacagcagtagtaaacacatcgcaccgcagcaccgaatctccggaagcggccctgccttttcctttcctttgtccgtcagcggccattgccagccagctgcgcttgcactcggccgcgtataagtacctttctctgctttggccacttccgcgatcctttctccttctccctctcctcttccagatccattcctctcccagtcccgggcgaggagcgagagagcttgaggggaagggcggatggccatgggttcttggccccttcttgccctgctcctcgggttcttggcgggagcggcgcgcggctccgagccgtgggcgaatgacacgcgggtctactccaccaatgccaactccggcagcggcagcaacggcgccttcgtcgccctcaccctcatccagtccgccgccgccaagggagccgtatgcttggatggaagcttaccaggttaccacctacaccgaggatctggatcagggtcaaacaattggcttgtcaatctggagggtggaggctggtgcaatgatgttaaaagctgtgtgttccgcaagggcagtcggcgtggttcatcaaaccacatggagaggcagctccagtttacaggcataatgagtaacagacctgaagaaaacccagatttctacaactggaacagagtgaaggttcggtattgtgatggtggatccttcaccggtgatggggctgacgcggcttcaggcctttatttccgaggtcagcgtatttggcaggctgccatggatgacttgatggcccagggaatgcgttctgctagtcaggcccttctttctggatgctctgctgggggtgcttctgctatacttcattgtgatgagttcaatggaatgtttccctcaaataccagagtcaagtgcctcgctgatgctggaatgtttcttgactctgttgatattgctggtcgtcgagaaatgagagaattattcaatggcattgtgagattgcagggttctggaagaagcttgcctcggtcttgtacctcccgcatggacaaaacctcatgctttttcccgcagaacgtgttgccaaacattcaaactccaacttttattgtgaacactgcttatgacgtgtggcagcttcaagagagtttggctcccaaaacggctgatccccaaggtctatggcaaagatgcaagcagaattacgcgtcttgtaatagcaatcaacttcagtttctaaatggctttaggaatgaaatgcttaacgccgtgaagggtttctccgcgtcagggcagaatggggtatttatcaactcatgttttgcccattgccagagcgagaggcaggatacatggtactcgagcaactctcctcgtcttggcaacaagagaatcgcagaagcggtcggtgactggttcttcgagaggggcaacgccaagtacaccgactgtgcgtacccttgcgacggcacatgccatcaccttgtgttcaaggggaggcatctttaataccatcatatcctttgacaccagcagctgatgtgctgaaaacccaatgagtgggtacaaccaaaaaggaaggtatagatagaagaagatgggtgcaagtttgcggcttgcccggcgtccatcacctgagatatgatatgatagggcagggcctcgcacgcaaaagcggcaaggccctctgcgttattttagtttcacgtatcgtcgattctttccattgccaattgctcttcgctcgatgtatctgaacatttggaccacactgctgtataaccttacacattcatgcattgaatgtgataatacgaaattataaataatgtgcttacatttggagcggccgctggtatttacatcttgttttttagcttccatcccaaacttttggttcttaacatcaagagacctccagcaaccagccaacaatagccaatcgtgcagatccagccattgaggccagtgcaaacgagaaaagaagcaggcttgtatcctccgtggtagggactggtaccgagaacgctgtctcccatccacaatggtccggaaacgcctagaacatccc

SEQ ID NO: 1441 - DNA, 1739 bp, Hordeum vulgare
cggcacgaggctccctctcctcttccagatccattcctctcccagtcccgggcgaggagcgagagagcttgaggggaagggcggatggccatgggttcttggccccttcttgccctgctcctcgggttcttggcgggagcggcgcgcggctccgagccgtgggcgaatgacacgcgggtctactccaccaatgccaactccggcagcggcagcaacggcgccttcgtcgccctcaccctcatccagtccgccgccgccaagggagccgtatgcttggatggaagcttaccaggttaccacctacaccgaggatctggatcagggtcaaacaattggcttgtcaatctggagggtggaggctggtgcaatgatgttaaaagctgtgtgttccgcaagggcagtcggcgtggttcatcaaaccacatggagaggcagctccagtttacaggcataatgagtaacagacctgaagaaaacccagatttctacaactggaacagagtgaaggttcggtattgtgatggtggatccttcaccggtgatggggctgacgcggcttcaggcctttatttccgaggtcagcgtatttggcaggctgccatggatgacttgatggcccagggaatgcgttctgctagtcaggcccttctttctggatgctctgctgggggtgcttctgctatacttcattgtgatgagttcaatggaatgtttccctcaaataccagagtcaagtgcctcgctgatgctggaatgtttcttgactctgttgatattgctggtcgtcgagaaatgagagaattattcaatggcattgtgagattgcagggttctggaagaagcttgcctcggtcttgtacctcccgcatggacaaaacctcatgctttttcccgcagaacgtgttgccaaacattcaaactccaacttttattgtgaacactgcttatgacgtgtggcagcttcaagagagtttggctcccaaaacggctgatccccaaggtctatggcaaagatgcaagcagaattacgcgtcttgtaatagcaatcaacttcagtttctaaatggctttaggaatgaaatgcttaacgccgtgaagggtttctccgcgtcagggcagaatggggtatttatcaactcatgttttgcccattgccagagcgagaggcaggatacatggtactcgagcaactctcctcgtcttggcaacaagagaatcgcagaagcggtcggtgactggttcttcgagaggggcaacgccaagtacaccgactgtgcgtacccttgcgacggcacatgccatcaccttgtgttcaaggggaggcatctttaataccatcatatcctttgacaccagcagctgatgtgctgaaaacccaatgagtgggtacaaccaaaaaggaaggtatagatagaagaagatgggtgcaagtttgcggcttgcccggcgtccatcacctgagatatgatatgatagggcagggcctcgcacgcaaaagcggcaaggccctctgcgttattttagtttcacgtatcgtcgattctttccattgccaattgctcttcgctcgatgtatctgaacatttggaccacactgctgtataaccttacacattcatgcattgaatgtgataatacgaaattataaataatgtgcttacatttggaccacactgctgtataaccttacacattcatgcattgaatgtgcataacacgaaattaaaacaatgtgctta

SEQ ID NO: 1442 - DNA, 2718 bp, Sorghum bicolor
gacctctccttgttttccccttttccttctttccccaactccactctccccagtagagaaccctaaacccccatcccaaaccttgacgccggcgatctccgccgccgccgccgccgccatgttcgggaccccatctaccactcccgtcttcgggaacccctccaccaccccggttttcggcacgccttccaccaccccggcatttggcgcgacatcgtccaccccggccttcggcaccccctcgtcgacgcccgccttcgggaccccgtcgtcgacgccagcgttcgggaccgcttccacgaccccggccttcggtgcatcgacgtcggcgccagcgttcgggaccgcttccacgagctcggcgttcggctcgctcaacttcgggacgccctcgtcgacctcagcattcggcacgccatcctcggctccggcgttcggcgcgctgaatttcgggacgccctcgtcgacctcggcattcggcacgccctcctcggcgccggcgttcggcggaactccttcgccctcgccctttgggttccagcagcagcaggcgacgccgtccccgtcgccgttcggcttgctaggaggtggcggcgcgcaaatcaccacccagatggcccccgtcgcgccgctgccgctctccccgtctgaccgcgacatccaggccatcgttgatgcgtacaaggaggaccccggtaacccccgttatgctttcaggcatctgttgttcagcgtgacagagccttcccaaagggtgaagccagttgctgcatcagatattatgtgggcagaagcaatggggaaacttgaatgcatggatagcgcagatagggagaggctctggcctcagcttgtgcagggttttaaagacctttcccatcggcttaagcttcaagacgaagtccttgtttcagatactgatagattgagcatgactcactctaacgtcaaaaagctgcaaaggcatttccaagctgacacgtatccatggatccaacgattgaagcaacaagagctggttattcagagacgtcttttaaggtttgttagaatagtggaggcgttggagaatcggggttaccgcagtcctttaacaaaggaggaagctgacttgtatgaaagattggttgctatattaaagcggctaaaaggacctagtgctgatctgtctaagagggttaatacacttctttcgacgtcacgtcttctagctagcactggtggtgctggtggttctgtttatattcctagttcagccaaagttgatgaacggagtgttacagagcttcttgaggccttacaactacaaacagaggcagttgccaagctaggtaacgtgttgaagagggatatcagggacctcgagatcatccagtcagaagacacggatatggctgaagacagtgtggggagaagggcacagaaaatataagatcgtctttgtcgaagctagtaataagcagaggatgatggatagactcattagaaggatccgagcctcccaactgatttggagcatcgactagacgaatgacgtccgtgtgtaactgctgcaggcaagcttgactcagcattcttttggaagctaaccatggtcaggtagtagtttgtatgtgtagatcctgtgttgaactgaggcggtattcttagaactcagctttctcctcgcgccaactacattttgcagtcctgttttcttgctcaccgtgatcctgatgagctgttgtaaccccctgtttccatgatcatgagtggatgtaatgcttgtaaaatacatttcggattttgtacatcaatcttggctgtaggcggccttgcatatgcttactccttgcccttggacgttgcatttcaattttcagatatgctcgcattcgaatgaaatatggtggtgtttgcgtcactaataatataataattctatatacattacaaaaaaaaaaaagcttcgcatgtatatgtactcactagaaaaacaaatgagctacagctgttgcatctggccaacaatcagaaatgagctcaacccctccagtcagtgtatgcatctcccgggcacccgccaggagaatccctgcgcgttgccggctctggcgcgcgccctgtacgtcttccagtcctggagcacgttcttgaggtcgaagagcttgttttccagcccgacgcagcagttggcgtgcatggtggccaccttccctaggtcgtcgccgtgctggcagaacccgccgaagacggccgtgtcgaggaactgcacccgggcgccgggggcggcggcggcgtacgacccttccttgacgatcttgtcgaagacgtactgctcgtggtggcccgggaacctcgccctcgacgcctgccagtggcggtagaaccccacggtggccggcgacgaccggacgtagaggagcccgccgttggggtagttgtggggcgagtcgacgtcgccgacgaagaagtcggacgacatgacgacctgcgcgccccgcggcaggcgcgggaacggcggccggaaccacaggatgtccacgtccgtgaagaggaagctgtagcccagctccagcacggcctgctgcagcgcgttccggcgccacatcatctccaggtagtcccccttcatgtacttctgctccgccgcgaagtccttgccgtcgccggcgcggaaccagtagcagaacgggtgcacggcggtgcaccgcgccaaggctttggcgtccatggcca

SEQ ID NO: 1443 - DNA, 1748 bp, Panicum virgatum
  misc_feature (28)..(28): n is a, c, g, or t
  misc_feature (30)..(30): n is a, c, g, or t
  misc_feature (39)..(39): n is a, c, g, or t
  misc_feature (97)..(97): n is a, c, g, or t
  misc_feature (114)..(114): n is a, c, g, or t
  misc_feature (123)..(123): n is a, c, g, or t
  misc_feature (126)..(126): n is a, c, g, or t
  misc_feature (129)..(129): n is a, c, g, or t
  misc_feature (133)..(133): n is a, c, g, or t
  misc_feature (141)..(141): n is a, c, g, or t
  misc_feature (144)..(144): n is a, c, g, or t
  misc_feature (151)..(151): n is a, c, g, or t
  misc_feature (154)..(154): n is a, c, g, or t
  misc_feature (156)..(157): n is a, c, g, or t
  misc_feature (159)..(159): n is a, c, g, or t
  misc_feature (168)..(168): n is a, c, g, or t
  misc_feature (171)..(171): n is a, c, g, or t
  misc_feature (178)..(178): n is a, c, g, or t
  misc_feature (180)..(181): n is a, c, g, or t
  misc_feature (184)..(184): n is a, c, g, or t
  misc_feature (186)..(186): n is a, c, g, or t
  misc_feature (189)..(189): n is a, c, g, or t
  misc_feature (192)..(192): n is a, c, g, or t
  misc_feature (195)..(195): n is a, c, g, or t
  misc_feature (204)..(204): n is a, c, g, or t
  misc_feature (213)..(213): n is a, c, g, or t
  misc_feature (219)..(219): n is a, c, g, or t
  misc_feature (222)..(222): n is a, c, g, or t
  misc_feature (225)..(225): n is a, c, g, or t
  misc_feature (274)..(274): n is a, c, g, or t
  misc_feature (351)..(351): n is a, c, g, or t
  misc_feature (353)..(353): n is a, c, g, or t
  misc_feature (372)..(372): n is a, c, g, or t
  misc_feature (408)..(408): n is a, c, g, or t
  misc_feature (448)..(448): n is a, c, g, or t
  misc_feature (465)..(465): n is a, c, g, or t
  misc_feature (468)..(468): n is a, c, g, or t
  misc_feature (474)..(474): n is a, c, g, or t
  misc_feature (537)..(537): n is a, c, g, or t
  misc_feature (1293)..(1293): n is a, c, g, or t
  misc_feature (1300)..(1300): n is a, c, g, or t
  misc_feature (1677)..(1677): n is a, c, g, or t
  misc_feature (1679)..(1679): n is a, c, g, or t
  misc_feature (1681)..(1681): n is a, c, g, or t
  misc_feature (1687)..(1692): n is a, c, g, or t
  misc_feature (1695)..(1695): n is a, c, g, or t
  misc_feature (1697)..(1698): n is a, c, g, or t
  misc_feature (1701)..(1701): n is a, c, g, or t
  misc_feature (1703)..(1703): n is a, c, g, or t
aaaaaacccctaaaccctatcgcccccncnccgccggcnatctccgccgccgccgccgccatgttcgggaccccttcctcctctcccctcttcgggnccccatcctccacaccngccttcggnacnccntccnccaccccngcnttcggcncgncnncntccaccccngcnttcggcncnncgncntcnacnccngccttcggnaccccgtcntcgacnccngcnttcgggaccccggcgttcgggaccccatcgtcgaccccggcgttcgggncgccgtcgtcgactcccgcgttcggggccgcgtcctcggccccagcgttcggcgggctgtcggctttcgggacgccntngtcgacctcggcgttcggngcgccctcctcgacgccggcattcggcgcgagtccntcgccctcgcccttcgggttccagcagcaggcgacgccgnccccgtcgccgttcggnttnctcggnggagggggcgggcaaatcaccacccagatggcccccgtcgctcccctgccgctctccccgtcngaccgcgacatccaggctatcgtggatgcgtacaaggaggaccccgggaacccccggtatgctttcaggcatctgttgttcagcgtgacagagccttcgcaaagggtgaagccagttgcagcatcagatattatgtgggcggaagcaatggggaagcttgaatgcatggacactgcagatagggagaggctgtggcctcagcttgtgcaggggtttaaagacctttcccaccggcttaagcttcaagatgaagtcatagtttcggatactgacagattgagcatgactaactctaatgttaaaaagctgcaaaggcatctccaagctcacacatgtccatggatccagcgattgaagcagcaagagctggttattcagagacgtcttttaaggtttgttagaatagtggagacattggagaataggggttaccgcagtcctttaacgaaggaggaagctgacttacgtgaaagattggttgccatattaaagcagctaaaaggacctggtgctgatctgtctaagagagttaatacacttctttcaacatcaaatcttctggctagcactggtggccctgtatatattcctaattcggccaaagttgatgaacgtagtgttacagatcttcttgagaccttacagcagcaaacagaggcaattgccaagttaggtaatgtgttgaagagggatatcagggacctggagatcatccagtcaaatgacacagatatggctgaagacagcgttgggagnagggcantgaagatataagattgaagcaaggtcttcatcaaagctaccaataagcagagtttgaaagggagattcatctcgtacaaggatccgagcctccgaatggtttgaagtatcaactagagaaatctactgtgtatctggccagtcaagattgatttctgcattcttttggaagctaaccattgtctggtaggttgtgtcggaatgaggcggtattcctgaactttgtcctcgcgctaactacactttgagtgttgtcatggtggaaactacgccttgggttgctgagctcttgtaacttcccctggggatggatgattttgatttcggcagatggaccataagtcgatgtaatcttgaccatgcgtggatgaccatgcntngntgtaannnnnnttntnnatncngtagatcaaccatggctgtggcctgtagccttgaatggttcatgc

SEQ ID NO: 1444 - DNA, 1778 bp, Zea mays
ggtttagtcccttttagcacatatgtgaaggactaaagactaaatcattttagtccatattttagtcctagtgtttgacaaaaaagagactaaataagactaaaaactagagactaatctttagtccctctaaccaaacaccccttgagaaacagggtcgaaaatctctgctcatttcacatcgaacgctccgcctacaatcctgtactgcacgcgctccccatccgcacaacttcccgcctcccatggcggcgccggcgccgggggccacccgcctccaccccccgttcctcctgcttccttccccgccgcgaccccatcctccactccggctccgcttcctcctgccgtccccgccgcctctccgcctccgccgccgcttcccgctgctcgctgccgccgccgtctccgccggcggcggcggtggaggggaggaagccgccggcaggaaggccgataaggccaggcagctgcagaagcgggtcctcgtgggcgtcgccatcggggtgggcgcaggcggcatcgtggtcgccggcggctgggtgttcgcagccgccgtcgcagctgctgtccttgccggctcccgggagtacttcgagctcgtccgcagcactgccagcggaggcgggaccccgccgccgcgatacgtgtcccgcgcgtgctccgccatctgcgctctcatgcccatccttacgctgtactatggacgcatggatgttactgtggcattttctgcattcgttattgccatagcattgcttttacaaagaggaaatcctcgttttgctcagctaactagttcagtttttgggttgttttactgtggctatctaccttctttctgggttaagctccggtcaggattagctgcccctgccttaaatacaagtatagcataccgttggccaattcttctcggtggacaagctcactggacagttggacttgtagcaaccttgatggctattagtagcatcattgctgctgatacatctgctttcctttgtggaagggcatttggtcgtacccctttgactaacataagccctaagaaaaccttggagggtgctttagctggcctagctggctgtgtgctgaccactgtgctgctgtcaactgccttacgctggccaagatcactgttgagtgccacagcttatggaatcctgatctttctgggttcattgtttggggatcttgtcgagtctctgatcaagcgtgacgctggtgtcaaggactctggatcactcattcctggtcacggtgggattctcgaccgagttgacagctacgtgttcacaggggcactctgttactcttttgtcagagtagctctaccctcgtatggggtctgaataaagcacctggatgtttgctggtttgtctctcctgccatcagcaatgcggtaaccgtattttaacataatgttgagtattgcttagaatgccctagacagacaatgtgatcctcctatccaagcaaattgggcgtccgagtttctgactgttgaagatagaaccgaagatcaacgtcgacagtgttacggacttggggcttgagatggcctttccagctcaaccagtctgttgcagacttgtagctttgggtgtacatagtttatcttttttttcatagggtagaaaggaaagcgtaattatccgtcgcaaaagctgttaactgtgtattgaggcagcttatgtcaatatgtactatacctgttggtatcgattgttttaatgatccaatgcatttgattggtaactaagttccctactca

SEQ ID NO: 1445 - DNA, 1661 bp, Sorghum bicolor
aaaatctctgttcatttcacatcgaaatctccgcctccggtccgtccagcgctcccgacccccacacttcccacctgccatggcggcgccggcgccggcggccacccgcctccacgccccgttcctcctgtttccttccccgccgcgaccgcaccctccactacgcctccgcttcctcctgccgtccccgccgccggtccgcctccgccgccgcttcccgctgctcgcggcggccgctgtctccaccgccgccgctggcggcgatggcggcggcggggaggacgccaccgcttccgccaggaaggccgaaaaggccaggcagctgcagaagcgggtcgtcgtcggcgtcgccatcggggtgggcgccggcggcgtcgtggtcgccggcggctgggtgttcgccgccgccgtctcggccgccgtacttgccggctcccgggagtacttcgagctcgttcgcggcactgctggcggaggcgggacgccgccgccgcgctacgtgtcccgcgcgtgctccgccatctgcgctttcatgcccatccttgcgctgtactatggacgcatggatgttactgtgacattttctgcattcgtcattgcaatatcattgcttttacaaagaggaaatcctcgttttgctcagctaactagttcagtttttgggttattttactgcggctatctaccttctttctgggttaagcttcgatcaggactggctgcccctgccttaaatacaagtatagcatacagttggccaattcttcttggtggacaagctcactggacagttggacttgtagcaaccttgatggctattagtagcatcattgctgctgatacatctgctttcctttgtggaagggcatttggtcgtactcctttgactaacataagccctaagaagaccttggaaggtgctttagctggcctagctggctgtgtactgaccactgtgctgctgtcaaccgtctttcgctggccaagatcgctgttgagtgctacagcttatggaatcctgatctttctgggttcattatttggagatcttgttgaatctctgattaagcgtgatgctggtgtgaaggactctggatcactcattcctggtcatggtggaattcttgaccgagttgacagctacgttttcacaggggcactttgttactcttttgtcagagtagctctacccttgtatggggtctgattaaagcacctggctttttgttgctgtctttctcctgccatcagcaatgcagtcaccatattttaacataacgatgagtattgctgaggtgccctagatcagtcttcatctcaggataacgtgctccaactatccaagcgaatttggtggccgagtttctgacaggatagaaccaaagattacggctgctaactcgacatcgacagtagtgtttctttggatttgagatggtctttccagctcaaccagttcgttgcaaacttgtaactttggatgtacatagtttatttttttatagagtaaaaaggaaaggataattattcatcacaaagctgttaacggtgtattgaggcagctatgtcaatatgtaccaaactatacttgttgatatcgatcatttgattgtcgaccgatgatgtgtttggtttaaggaataaggtgattcatctgcttc

SEQ ID NO: 1446 - DNA, 1648 bp, Setaria italica
cgttcccacctcccatggcggcgccggcgccggcgccggcggccacacacctccagcgcccgttcctcctacttccttccccgccgcgaccccaccctcctcttcgcctccgcttcctcctgccgtccctccgcctgcgccgccgcttcccgctcctcgcggccgccgccgtctccgcgggcggcgggggcggggaggaagcctccaggaaggccgacaaggcccggcaactacagaagcgggtcctcgtgggcgtcgccatcggggtgggagctggcggcatcgtggtcgccggcggctgggtcttcgcgccgccgtggcagctgccgtccttgccggctcccgagagtacttcgagctcgtccggagcaccgccggcgtaggcgggaccccgccgccgcgttacgtgtcccgcgtgtgctccgccatctgcgctctcatgcccatccttacgctgtactacgggcgcatggacgttactgtgacgttttctgcatttgttattgcaatatcattgctattacaaagaggaaatcctcgttttgctcagctaactagctcagtttttgggttattttactgcggctatcttccttctttctgggttaagcttcgctcgggactagctgcgccagccttgaatacatttctctgttacgaattgcatacagttggccaattcttagctcactggacagttggacttgtagcaaccttgattgctattagtagcatcattgctgcagacacttcagctttcctttgtggaagggcatttggtcgtacacctttgactaacataagccctaagaagaccttggagggtgctttagctggtctagctggctgtgtactgaccactgtgctgctgtcaactttcttacgctggccaaggtcgctgttgagtgctacagcttatggaatcctgatctttctgggctcattatttggggatcttgttgaatccctgatcaaacgtgatgctggcgtgaaggactctggatcactcattcctggtcatggtggaattcttgaccgagttgacagctacgttttcacaggggcactttgttactcttttgtcagagtagctctacccttgtatggagtctgattacagcagctagtcgttcactgtcaacatgtctttattctacccgttgtatgggtctgattacagtagctcgccgtttgttgtcaacatgtctttcttcgaccatcagcaatgtggtcttgaagttttacataatgattagtgtcgcggagatgccacagatcaatcttcatcgcgggacaatgtcgtgtcctgcccaagcaaatttagtggcaagcgcctgactgttaaagatacaacagttgtattacaaccagagaatgcggctgctaacttggacagtttcttacgttgggtttgagctgttcttcccggctcaaccagtttgccaaacttgtcacttcgggtgtagatagtttgtttttttagagtaaaagggtaaggctaattcttcaccacaaaagttgttaaagtgtattaaggaggcttatgttgatagctctagtagaccaaatcatacttgttgacatccgttgttttcatgattcaaggtatctgattgacatttaaaggcaggcatggagatcggaagag

SEQ ID NO: 1447 - DNA, 1619 bp, Zea mays
gaaaatctctgctcatttcacatcgaacgctccgcctacaatcctgtactgcacgcgctccccatccgcacaacttcccgcctcccatggcggcgccggcgccgggggccacccgcctccaccccccgttcctcctgcttccttccccgccgcgaccccatcctccactccggctccgcttcctcctgccgtccccgccgcctctccgcctccgccgccgcttcccgctgctcgctgccgccgccgtctccgccggcggcggcggtggaggggaggaagccgccggcaggaaggccgataaggccaggcagctgcagaagcgggtcctcgtgggcgtcgccatcggggtgggcgcaggcggcatcgtggtcgccggcggctgggtgttcgcagccgccgtcgcagctgctgtccttgccggctcccgggagtacttcgagctcgtccgcagcactgccagcggaggcgggaccccgccgccgcgatacgtgtcccgcgcgtgctccgccatctgcgctctcatgcccatccttacgctgtactatggacgcatggatgttactgtggcattttctgcattcgttattgccatagcattgcttttacaaagaggaaatcctcgttttgctcagctaactagttcagtttttgggttgttttactgtggctatctaccttctttctgggttaagctccggtcaggattagctgcccctgccttaaatacaagtatagcataccgttggccaattcttctcggtggacaagctcactggacagttggacttgtagcaaccttgatggctattagtagcatcattgctgctgatacatctgctttcctttgtggaagggcatttggtcgtacccctttgactaacataagccctaagaaaaccttggagggtgctttagctggcctagctggctgtgtgctgaccactgtgctgctgtcaactgccttacgctggccaagatcactgttgagtgccacagcttatggaatcctgatctttctgggttcattgtttggggatcttgtcgagtctctgatcaagcgtgacgctggtgtcaaggactctggatcactcattcctggtcacggtgggattctcgaccgagttgacagctacgtgttcacaggggcactctgttactcttttgtcagagtagctctaccctcgtatggggtctgaataaagcacctggatgtttgctggtttgtctctcctgccatcagcaatgcggtaaccgtattttaacataatgttgagtattgcttagaatgccctagacagacaatgtgatcctcctatccaagcaaattgggcgtccgagtttctgactgttgaagatagaaccgaagatcaacgtcgacagtgttacggacttggggcttgagatggcctttccagctcaaccagtctgttgcagacttgtagctttgggtgtacatagtttatcttttttttcatagggtagaaaggaaagcgtaattatccgtcgcaaaagctgttaactgtgtattgaggcagcttatgtcaatatgtactatacctgttggtatcgattgttttaatgatccaatgcatttgattggtaactaagttccctactca

SEQ ID NO: 1448 - DNA, 1463 bp, Panicum virgatum
gctgtctccgccggcggcgggggcggggaggaagccgccaggaaggcggacaaggcccggcaactacagaagcgggtccttgtgggagttgccatcggggtgggcgcaggcggcatcgtggtcgccggcggctgggtcttcgccgccgccgtgtcagctgccgtccttgctggctcccgagagtacttcgagctcgtccgcagcactgccggtggtggcgggaccccgccgccgcgctacgtgtcccgcgtgtgctcagccatctgcgctctcatgcccatcctgacgctgtactatggacgcatggatgttaccgtgacgttttctgcattcgttattgcaatatcattgctattgcaaagaggaaatcctcgttttgctcagctaactagttcagtttttggattattttactgtggctatcttccttctttctggtataagcttcgctcaggactagctgcccctgccttgaatacaagaatagcatacaattggccaattcttctaggtggacaagctcactggacggttggacttgtagcaaccttgatggctattagtagcatcattgctgcagacacatcagcttttctttgtggaagggcatttggccgtacgcctttgactaacataagccctaagaagaccttggagggtgctttagctggtctcgctggctgtgtactgaccactgtgctgctgtcaactgtcttacgctggccaagatctctgttgagtgctacagcttatggaatcctgatctttctgggttcattatttggggatcttgttgaatctctgattaagcgtgatgctggtgtgaaggactctggatcgctcattcctggtcatggtggaatacttgaccgagttgacagctacgttttcacaggggcactttgttactcttttgtcagagtagctctacccttgtatggggtctgattacagcagcttcccgttcattgtcaacatgtctttcttctacatctacccttgtatgggatctgattacagcagctggccgttcgttgtcaacatgtttttcttctaccatatcactccatcagcaatgtggttgcgaagtgtcgcctagatgccccagatcaatcttcatcactgtacaatgcagtactgcccaagcgaattaagtatcaagtgtcttgactgttaaatgattcaaccagagaaggcttctaactcagacagtttcttacattgggtttgtgctgttcttcccagctgtaatctgtttgttgcgaacttttcagtttggttgtacatagtttgtttttatagagtaaagggaaaatgctaatttttcgtcagagaaaagtgtataatttttcatctcaaaagttgttaaagtgtattaaggtgggttttgtcaatggctctaaaggaccaaagtaccaaaccatatcagtcgatttctgttgttttcatggttatctgctaac

SEQ ID NO: 1449 - DNA, 1528 bp, Pseudoroegneria spicata
  misc_feature (1526)..(1527): n is a, c, g, or t
cgaaaattccttgctcacatcgaactctccgcccgacctgacccccacccatctcccatggctgcggcggcggcggcggcggcggtgacggccacccgcctccaccctcctctcgtcctccactccgccgcacggccccagcccccgctccgcctccgcctccgcctcctcctccccaccccaccgccactccgccttcaccgccgcttcccgctcctcgccgtcgcctccgcggaagaaggccgtgcggaggaggccgccgagaagagcgacaaggcccgtcagctacagaggagggtgctcgtgggcatcgccatcggggtcggcgcaggcggcgtcgtggtcgccggcggctgggtgttcaccgccgccatgaccgccgtcgtcctcgccggtgcccgcgagtacttcgggctcgtccgtggcaccgccagcggcggcagcacccctccgccgcgctacgtgtcccgcgtctgctccgccatctgcgctctcatgcccatccttacgctgtactatggccgcatggatgttcccctgacgttatcggcatttattattgcaatatctttggtattgcaaagaggaaacccccgtttcgcgcagctaactagttcagtttttggtttattttattgtggctatcttccttctttctgggttaagctccgttgcggattagcagctcctgccttaaatacaagtatagcacataactggccagtacttcttggtgggcaagctcactggacagttggacttgtagcaaccttgatatctattactagcattattgctgctgatacatcagctttcctttgtggaagggcatttggccgtactcctttgactaatataagccctaagaagaccctggagggtgctttagctggtctgactggctgtgtgcttaccactgtgcttttgtcgattctctttcgctggccaagatcgctgttgagtgctacagcttatgggatcctaatctttctgagttcattattcggggatctcattgaatctctgattaagcgcgatgctggtgtgaaggactctgggtcactcattcctggccatggtggtattcttgaccgggtcgacagctacgtcttcacaggggcgctttgttattccttcgtcagagtagctctgcccctgtatggggtctgatttaccgcagcgagaaaaatcggtctccgtgtgccttccttgtaccttcgacgacattgtcacccaatgtaacgccgcgacggggccatgatgagatggccaggatcatctccctcggctgcacaatatgagaattcggtggctggctgtaaagtgagacagatcataggatgtggctgctaactaagcggtgtttcttcttcatacggaatcgagctgtttcttcttcggcaccagaatggtgaaaacctgtcactttggtgtacatagttttttcttttctttttgttgagtaaaaagggaactgatgattggatacaagctactacatatcttaaaaagtgtattaatgttgnna

SEQ ID NO: 1450 - DNA, 932 bp, Sorghum bicolor
gcacttcgcgcagttcagaatgcatataaatgtgggaagatggactgtgtgctctgatcaatcaggttccatatcaaggtgagacctgtatagagagagcgttaacaatgaaaggatccagcgagcatggcgagacctcgaaggcggcgcccctgggcaggggtggtgtcagtaaaggagtgtccgtgcttgatcttatacttcgcttcattgccatcatcggcacccttgctagtgccattgcaatgggcaccaccaacgagacgctgcctttcttcacacagttcatccgcttcaaggcgcagtacagtgatctccctactctcacgttctttgtcgtggcaaattctattgtctgcgcctacctcatcctttcgctcccactatctatagtgcacatcatcaggagcagggctaaatacagcaggctgctcttgatctttcttgacgcggcaatgctagcattggtgactgcgggagcatctgcagcagcggctattgtgtacttagcacacaaaggcaatgtcagggcaaactggcttgccatctgccagcagttcgactcattctgcgagcgtatctctggatccctcattggttcgttcggagccatggttatgctgatactgctgatattactctccgccattgccctagccaggcgctaggccaaatagtgggatcatttgtttccagcagtgtgaagtgtggtatcatggtgtggttattcgactactctgctatctttatgtaatcatatgtgtgcctattattacctcttgctatgatcctctcctatatatcccaattgttgacttgattctgagcttctccttttcttctgatggtgtgtgcaacatcatgtatatagaagccacagaaaatgagtatggatgaactattatgtatggatcatggatcaccatagtttc

SEQ ID NO: 1451 - DNA, 888 bp, Setaria italica
gctgagcaatcaggtcccataagggtgagatctttagaacgttcacaatgaagggctccagtgagcatggtgagacatccaaggcgcccctgagcaggggcgtcagcaaaggactgtctgtgctagatctcatacttcgcttcattgccatcatcggcactcttgctagcgccattgcaatgggcaccaccaacgagacactgcctttcttcacacagttcatccggttcaaggcacagtacagtgatctccctactctcacgttcttcgtcattgcaaattctattgtctgtgcctatctcatcctctcacttccattatcaatagtgcacatcattaggagcagggccaaattcagcaggctgctcttgatctttcttgacgcggcaatgctagcactggtgactgcgggagcatctgcagcagcggccattgtgtacttagcacacaagggcaatgtcagggcaaactggcttgctatttgccagcagtttgactcattctgcgagcgtatctctggatccctcattggttcattcggagccatggttctgctgatcctgctgatattactctccgccattgccctcgcgaggcgctagaccaaatcatgcatcatttgcttccagcagtgtgaagtatatgatataatagtgtggtcatcgggcttgctatctttatatagccatccatgtgcctattacctcttgctatgatcctcctatcctatctcaaatgttgccttaagcccttaattctgtacctcctattttatcttgacggttgacggtgtgtaccatcatatatagaagctactgaaaatgaatatgcatgcactgttatggatgaatcacaatagtttctgaaagagttggtaaaaatattttc

SEQ ID NO: 1452 - DNA, 857 bp, Panicum virgatum
gagcaatcaggtttcacagagtgagagctttagagcgctcgcaatgaaagaatccagtgagcatggtgagacatccaaggcgcccctaagcaggggggtcagcaaaggactgtctgtgcttgatctcatacttcgcttcattgccatcatcggcacccttgccagtgccattgcaatgggcaccaccaacgagacgctgcctttcttcacacagttcatccggttcaaggcgcagtacagtgatcttccaactctcacgttcttcgttgttgcgaattcaattgtctgcgcctacctcatcctctcacttccattatcaattgtgcacatcattaggagcagggccaaattcagcaggctgctcttgatctttcttgatgcggcaatgctagcactggtgaccgcgggagcatctgcagcagcggctattgtgtacttagcacacaagggcaatgtcagggcaaactggcttgctatttgccagcagtttgactcattctgcgagcgtatctctggatcactcattggttcgtttggagccatggttgtgctgatactgctgatattactctccgccattgcccttgcaaggcgctagatcgaattgtgcatcatttgcttccagcagtgtgaagtgtatgatataatagtgtggtcattgtgcctctatctttatgtaatcgtctatatgcatataagcctattacatcttgctatgattctctgctacctcaagtgttaccatgaatctgtacctattcctttatctcgaaagttgatgctttgtaccttcatttatacaagctacagaaaatgaacatgtatgaactattatggataaatcaaattagtttctg

SEQ ID NO: 1453 - DNA, 825 bp, Panicum virgatum
gaaattagctggagcaatcaggtttcacagagcgagagcttcagagagttcgcaatgaaagaatccggggagcatggcgagacatccaaggcgcccctgaacaggggggtcagcaaaggactgtctgtgcttgatctcatacttcgtttcattgccatcatcggcacccttgccagtgccattgcaatgggcaccaccaacgagacacttcctttcttcacacagttcatccggttcaaggcgcagtacagtgatcttccgactctaacgttcttcgtcgttgcgaattcaattgtctgtgcctatctcatcctctcacttccattgtcaattgtgcacatcattaggagcagggccaaattcagcaggctcctcttgatctttcttgatgcagtaatgctagcactggtgactgcgggagcatcagcagcagcggctattgtgtacttagcacacaagggcaatgtcagggcaaactggcttgctatttgccagcagtttgactcattctgcgagcgtatctctggatcgctcattggttcgtttggagccatggttgtgctcatacttctgatattactctccgccattgcccttgcgaggcgctagatcaaatcgcacatcatttgcttccacatgaagtatacaatataatagtgtggtcatcaggcttctatctttatgtaaccgtctatgtgcctataagcctattacatcttgctatgattctctgctatctcaagtgttgccgtgattctgtacctgttctttcatcttgatgattgatggtgtgcaccttcatataaagaagctgcagaaaatgaa

SEQ ID NO: 1454 - DNA, 851 bp, Pennisetum glaucum
gattaaaaccagctgaggaatcaggttccacttccaccagggtcaaatctttagaacgttcacaatgaagggatccagtgagcatggcgagacatccaaggcgcccctgagcaggggagtcagcaaagggctgtctgtgcttgatctcatacttcgcttcattgccatcatcggcacccttgctagcgccattgcaatgggcaccaccaatgagactctgcctttcttcacacagttcatccagttcaaggcgaagtacagtgatctcccgactctcacgttcttcgtcgttgcaaattctattgtctgtgcctatctcaccctctcacttccattatcagttgtgcacatcattaggagcagggccaaattcagcaggctgctcttgatctttctcgacgcggcaatgctagcactggtgactgcgggagcatctgcagcagcggccattgtgtacttggcacacaagggcaatgccagggcaaactggcttgctatttgccagcagtttgactcattctgcgagcgcatctctggatccctcattggttcattcggagccatggttctgctgatcctgctgatattactctccgccatcacccttgcgaggcgctagaccaaattgcatcatttgcttccagcagtgtgaagtatataatataacagtgtggtcgggctttctatctctatgtaatcatccatgtggctattatgccttgctataaacccctatacaatctcaaatgcttcttaagcccttaattctgtacctcttcttttatcttgacggttggcggtgtgtaccatcatatatagaagctacagaaaatgaatatgcatgcactatt

SEQ ID NO: 1455 - DNA, 672 bp, Pennisetum glaucum
gattaaaaccagctgaggaatcaggttccacttccaccagggtcaaatctttagaacgttcacaatgaagggatccagtgagcatggcgagacatccaaggcgcccctgagcaggggagtcagcaaagggctgtctgtgcttgatctcatacttcgcttcattgccatcatcggcacccttgctagcgccattgcaatgggcaccaccaatgagactctgcctttcttcacacagttcatccagttcaaggcgaagtacagtgatctcccgactctcacgttcttcgtcgttgcaaattctattgtctgtgcctatctcaccctctcacttccattatcagtgtgcacatcattaggagcagggccaaattcagcaggctgctcttgatctttctcgacgcggcaatgctagcactggtgactgcgggagcatctgcagcggccattgtgtacttggcacacaagggcaatgccagggcaaactggcttgctatttgccagcagtttgactcattctgcgagcgcatctctggatccctcattggttcattcggagccatggttctgctgatcctgctgatattactctccgccatcacccttgcgaggcgctagaccaaattgcatcatttgcttccagcagtgtgaagtatataatataacagtttgtca

SEQ ID NO: 1456 - DNA, 714 bp, Saccharum officinarum
  misc_feature (577)..(577): n is a, c, g, or t
  misc_feature (676)..(676): n is a, c, g, or t
  misc_feature (706)..(706): n is a, c, g, or t
aatttggcaagagtggctacaaagggtttcgaaagctctgaaggagaccgtgtcacactgctcagcatgcatataaatgtgggaagatcgatgggctgtgctctgcaaatcagctgagcgaccagcaggttccatatcaaggtgagaccagtatagagagagcgttaacaatgaaaggatccagcgagcatggcgagacctcgaaggcggcgcccctgggcaggggtgtcagcaaaggagtgtccgtgcttgatctcatacttcgtttcatcgccatcatcggcacccttgctagtgccattgcaatgggcaccaccaacgagacgctgcctttcttcacacagttcatccggttcaaggcgcagtacagtgatctccctactctcacgttctttgtggtggcaaattctattgtctgcgcctatctcatcctttcgctcccactatctatactgcacatcatcaggagcagggctaaatacagcagactgctcttgatctttcttgacgcggcaatgctagcattggtgactgcgggagcatctgcagcagcggctattgtgtacttagcgcacanaggcaatgtcagggcaaactggcttgccatctgccagcagtttgactcattctgcgagcgtatctctggatccctcattggttcgttcggagccatggntatgctgatactgctgatattactctccgncattgccc

SEQ ID NO: 1457 - DNA, 809 bp, Oryza sativa
aaaacctcttgagcaatttgagtttcacaggttcaagagctgtagaatctcaccatggaagggtctgaggagcatggtgagacctcaaaggcacccctgagcaggggggtcagtaaaggagtgtctatactcgatgttatacttcgctttgtcgcgatcattggcaccctcgcgagtgccattgccatgggcaccaccaatcagacgctgcctttcttcacccagttcatccggttcaaggcgcaatacagcgatctcccaactctcacgttttttgtggtggcaaactctattgtctctgcctatctcatcctttcactcccactgtcaattgtgcacgtcattaggagcagggctaagtatagcaggctcatcttgatctttttcgatgcggcaatgctagctctggtgaccgcgggggcatctgctgcagcagctattgtgtacttagcacacaagggaaatgccagagcaaactggcttgctatttgccagcagtttgattccttctgtgagcgcatctctggctccctgattggctcatttgcagccatggttgtgctggtactgctcatattcctctcggctattgcattagccaggcgatagaccaaattgccaactgtttgcttcctgtagtgtgaagtatcatattatggcgaggttcttgcacttacttgcctatgtaataatctgtgtgcctatttttctcttgctatcaacctcttctatcttgtgtatccccttgattgtacacttcatatatgaatgctacagaaaatgaaatatagatgtggtgttatggattt

SEQ ID NO: 1458 - DNA, 2383 bp, Saccharum officinarum
  misc_feature (97)..(97): n is a, c, g, or t
  misc_feature (99)..(99): n is a, c, g, or t
  misc_feature (120)..(120): n is a, c, g, or t
  misc_feature (132)..(132): n is a, c, g, or t
  misc_feature (134)..(134): n is a, c, g, or t
  misc_feature (139)..(139): n is a, c, g, or t
  misc_feature (149)..(149): n is a, c, g, or t
  misc_feature (181)..(181): n is a, c, g, or t
  misc_feature (192)..(192): n is a, c, g, or t
  misc_feature (273)..(274): n is a, c, g, or t
  misc_feature (309)..(309): n is a, c, g, or t
  misc_feature (402)..(402): n is a, c, g, or t
  misc_feature (440)..(440): n is a, c, g, or t
  misc_feature (708)..(708): n is a, c, g, or t
  misc_feature (952)..(952): n is a, c, g, or t
  misc_feature (1279)..(1279): n is a, c, g, or t
  misc_feature (1313)..(1313): n is a, c, g, or t
  misc_feature (2000)..(2000): n is a, c, g, or t
  misc_feature (2005)..(2005): n is a, c, g, or t
  misc_feature (2026)..(2027): n is a, c, g, or t
  misc_feature (2050)..(2050): n is a, c, g, or t
  misc_feature (2057)..(2057): n is a, c, g, or t
cgcgaaacgaagaagacccagctcgaaaacgaaggcgccaaaccattccccaaaggcgccccgcgcccgtgcccgcccgcccagctccgcccccgcntnccattccgccgccgccggggncactcgcccccncnccggngaagttcctntcgcgcggacgccgcgccgccccgcgggcggngtcggcggtcngttcccggcctcgcggaggctccatcccgtgtcgaatcgaggcaggatcctaggccaaatgcctctctttgataagaaacnnttctccttactggagccccctaaggacttggattnaaaggagaaggtgttccaaattcgattcacaaaggagatattccgagattatgaagaatacctaaagaggctaaacctttatcgccaaagagnttggacatgtaagatatctggaaaatctaatttaactnttgaagaagctttggtatctgagcataaagcgatggagaaggctcaaaatttgcccactgagctaatggctcatgttcttcggatgactcaatacagcactcttggtttacatgaacttatcaataggatatatgccagtctgctggaagaagtatttgaaggaatagaactatatgctaataaggatggtgctgtggcaccttgcaagattttgaagattttagattctggtggcacaaagatgtgtgaagttggttggattcggcngggtaaggttgtgaccaacacatcagtaatcaaagctgcagatctgttttaccggagggcacctgttagcaggaatacgctgaagatttttattagagatgctacatcacaaagtaatccatgggttatccatgagaatctcgccaaaatttttggcatatctatggaccccccagacagcgtaatgaagaaaggtagaaaaagacaagagaatggaaccattgaagatgggaggaaaaagctnaagacagatgaagaacaggcatatgtaatgattaagtatccaatagatgatctgctagtaaggcccaatgcagatgatccagctttatttaagaggcctcctctggctacagattttagagtaccaagatgttctgtgggagatctccttatggtatgggacttctgctcgtcttttgggagggctctgaatctgtccccgtttccgctaacagatctggagaatgcaatttgccacaaagaaagcaatgttcttctcgtggaaatacatgcagctatgtttcacttgcttatgaaggatgaaggtgactatttcactgttctgcanaacaagaagcggaagtcaaaggtaagttcagtancatgggttgagtatctatgtgatttcttggaaatgacaaaaaatgaagaactatccactaacattgcaacagtaagaaggggttattatggtcttattgacactgagataaagcttaagatcctccgggaactagtggaagaagctattcaaacctctgccataagggagatactaagcgaccgtgtggaccagaaacaagtccttaatgcaacaaaaagagagaacaccagaaaggacaaacaagagcaaaatctgaacactgaaattgccatgaaaaaggaggagaatcagacagatgctgtgcaaggtggccatgagggtgtagatgagctggttaggggaaaagaaaatgacaagagcaatatttctcggagtaggacagaagggaaacaacacctggtacgacaccttgagacggagatagagaaattatccatccgttccagccctcttggtaaagacaggcagtataataggtactggtttttcaagcgtgaaggaaggctttttgttgaaactgcagattccagagaatggggttactacagcactaaggaagagcttgatgcgctcatgggctcattgaatgtgaaaggtataagggagagagctttgaaacggcaactagagaagttctatagtaagataagtaatgccctagagaaacgatcaaaagatatcgcanacaanatgttgcttgaagagggtgtnntgcgccgttcacacgtgtccggnctaaccnaaaggacaacccgtccatggcattcctcaagtatgtcaacaagtggaaggataactgatgtactctgagatggcggccagtctgccagcgggtgggaggataactgagccactgggtgactgggtttgcagtagtaagttatgtaggcttttgcttggttagggacttaggtcgtcggagtggctcgccatactcatggctgctggtttattgacacctccgtagctagtgaaacctgtatcagaatccggttttcttctttttctttttcccctttgctttgcatgtgtcgaacactggttttcaatgaaaaccctttgctcctt

SEQ ID NO: 1459 - DNA, 2446 bp, Zea mays
aacgctctcgcgtccgcccgacagctcgcctgcctgcctctccgtcgtcgccgagtccctcgccggctctaccaggcggtggcgaaggcacttcggcggggacgctcaaccgccccgcgggcggcgtcgacggtcggttcccggcggcctcgcggaggttgcatcccgtgtcgaatcgaggtatttgtcggcaggatcctacgccaaatgcctctctttgataagaaacctttctccttgctggagccccctaaggacttggattcaaaggagaaggtgttccaaattcgattcacgaaggagatattccgagattatgaagaatacctgaagaggctaaacctttatcgtcaaagagtttggacatgtaatatatctggaaaatctaatttaacttttgaagaagctttggtatctgagcacaaagcgatggagaaggctcaaaatttgccaactgagctaatggctcaagttcttcggatgactcaatacagccctcttggtttatatgaacttgttgataagatatatgctagtctgctggaagaagtatttgagggaatagaattacatgctaataaggatggtaatgtggcaccttgcaagattttgaagattttagattctggtggcacaaagatgtgtgaagttggttggattcggaagggtaaggctataaccaacacatcagtaatcaaagctgcagatctgttttaccggagggcacctgttagcaggaatacgctgaagttttttattagagatgctacgtcacaaagtaatccatgggttatccatgagaatcttgccaaaaaatttggcataaccatcgagccccctgatagtgtaatgaagaaagggagaaaaagacaagagaatgaaactgttgaagatggaaggaaaaagctcaagacagatgaagaacatgcttatgtgctgattaagtatccaatagatgatctgctagtaaggcccaatgcagatgatccgtctttatttaagagacctcttctggctacagattttagagtaccaagatgttctgtgggagatctccttatggtatgggacttctgctcgtcttttgggagggctctgaatctgtccccatttccgctaacagatctggagaatgcaatttgccacaaagaaagcaatgttcttcttgtggaaatacatgcagctttgtttcacttgcttatgaaggatgaaggtgactatttcactgttccgcagaacaagaaacagaagttaaaggtaagttcagtaacatgggctgagtatctatgtgacttcttggaaatgacaaaaaatgaagaactatccactaacattgcaacagtaagaaggggatattatggtcttattgacactaatataaagcttaagatccttcgggaactagtggaagaagctattgaaacctctgccataagggagatactaagtgatcgtgtggaccagaaacaagtccttaatgcaacaaaaagagagaacaccagaaaggacaaaaaagagcaaaatctgaacactgaaattgccatgaaaaatgaggagaatcagacagatgctgtgcaaggtggccatgaaggtgtagatgagctggttaggagaaaagaagaaaatgacaagagtaatatttctcggggtaggacagaagtgaaacgacacatggtacagcaccttgagacggagatcgagaaattatccatccgttccagccctcttggtaaagacagacagtacagtaggtactggtttttcaagcgtgaaggaagactttttgttgaaactgcagattccagagaatggggttactacagcactaaggaagagcttgatgcgctcatggactcattgaatgtcaaaggtataagggagagagctttgaaacggcaactagagaagttctatagtaagataagtaatgccctagagaaacgatcaaaagacatcgcaaacaagacgttacttgaagagggtgtgctgcgccgttccacacgtgtccgggcccagccaaaggacaatccgtccatggcattcctcaagtatgtcaacaagtggagggataactgaggtactctgagctatgtaggcttttgctcggttaggtcgttgcagtgactcgccatactcatggctggtttactgacacctcattagctagtgaaacctgtatcagaacctacttttcttctctctctttttttttttaaattttaacttagctttcatgtgtgttcacaaatgaacccctcccccccctccgtaattgaactatgctaggctttaccgtttttagaacagtggccaaattttttgcatggatgatgtaaacgtgacaaggccggtgtggagatgcttcgatctgcaagggtgggccgcgggccaatgttggggatttttgacttaatactactgccttgaattttttagcaccattttc

SEQ ID NO: 1460 - DNA, 1976 bp, Zea mays
cttctcccttcacaaccccaacctcgaaaacgaaggcgccaaaccattccccaaacgctctcgcgtccgcccgacagctcgcctgcctgcctctccgtcgtcgccgagtccctcgccggctctaccaggcggtggcgaaggcacttcggcggggacgctcaaccgccccgcgggcggcgtcgacggtcggttcccggcggcctcgcggaggttgcatcccgtgtcgaatcgaggtatttgtcggcaggatcctacgccaaatgcctctctttgataagaaacctttctccttgctggagccccctaaggacttggattcaaaggagaaggtgttccaaattcgattcacgaaggagatattccgagattatgaagaatacctgaagaggctaaacctttatcgtcaaagagtttggacatgtaatatatctggaaaatctaatttaacttttgaagaagctttggtatctgagcacaaagcgatggagaaggctcaaaatttgccaactgagctaatggctcaagttcttcggatgactcaatacagccctcttggtttatatgaacttgttgataagatatatgctagtctgctggaagaagtatttgagggaatagaattacatgctaataaggatggtaatgtggcaccttgcaagattttgaagattttagattctggtggcacaaagatgtgtgaagttggttggattcggaagggtaaggctataaccaacacatcagtaatcaaagctgcagatctgttttaccggagggcacctgttagcaggaatacgctgaagttttttattagagatgctacgtcacaaagtaatccatgggttatccatgagaatcttgccaaaaaatttggcataaccatcgagccccctgatagtgtaatgaagaaagggagaaaaagacaagagaatgaaactgttgaagatggaaggaaaaagctcaagacagatgaagaacatgcttatgtgctgattaagtatccaatagatgatctgctagtaaggcccaatgcagatgatccgtctttatttaagagacctcttctggctacagattttagagtaccaagatgttctgtgggagatctccttatggtatgggacttctgctcgtcttttgggagggctctgaatctgtccccatttccgctaacagatctggagaatgcaatttgccacaaagaaagcaatgttcttcttgtggaaatacatgcagctttgtttcacttgcttatgaaggatgaaggtgactatttcactgttccgcagaacaagaaacagaagttaaaggtaagttcagtaacatgggctgagtatctatgtgacttcttggaaatgacaaaaaatgaagaactatccactaacattgcaacagtaagaaggggatattatggtcttattgacactaatataaagcttaagatccttcgggaactagtggaagaagctattgaaacctctgccataagggagatactaagtgatcgtgtggaccagaaacaagtccttaatgcaacaaaaagagagaacaccagaaaggacaaaaaagagcaaaatctgaacactgaaattgccatgaaaaatgaggagaatcagacagatgctgtgcaaggtggccatgaaggtgtagatgagctggttaggagaaaagaagaaaatgacaagagtaatatttctcggggtaggacagaagtgaaacgacacatggtacagcaccttgagacggagatcgagaaattatccatccgttccagccctcttggtaaagacagacagtacagtaggtactggtttttcaagcgtgaaggaagactttttgttgaaactgcagattccagagaatggggttactacagcactaaggaagagcttgatgcgctcatggactcattgaatgtcaaaggtataagggagagagctttgaaacggcaactagagaagttctatagtaagata

SEQ ID NO: 1461 - DNA, 2827 bp, Zea mays
cttctcccttcacaaccccaacctcgaaaacgaaggcgccaaaccattccccaaacgctctcgcgtccgcccgacagctcgcctgcctgcctctccgtcgtcgccgagtccctcgccggctctaccaggcggtggcgaaggcacttcggcggggacgctcaaccgccccgcgggcggcgtcgacggtcggttcccggcggcctcgcggaggttgcatcccgtgtcgaatcgaggtatttgtcggcaggatcctacgccaaatgcctctctttgataagaaacctttctccttgctggagccccctaaggacttggattcaaaggagaaggtgttccaaattcgattcacgaaggagatattccgagattatgaagaatacctgaagaggctaaacctttatcgtcaaagagtttggacatgtaatatatctggaaaatctaatttaacttttgaagaagctttggtatctgagcacaaagcgatggagaaggctcaaaatttgccaactgagctaatggctcaagttcttcggatgactcaatacagccctcttggtttatatgaacttgttgataagatatatgctagtctgctggaagaagtatttgagggaatagaattacatgctaataaggatggtaatgtggcaccttgcaagattttgaagattttagattctggtggcacaaagatgtgtgaagttggttggattcggaagggtaaggctataaccaacacatcagtaatcaaagctgcagatctgttttaccggagggcacctgttagcaggaatacgctgaagttttttattagagatgctacgtcacaaagtaatccatgggttatccatgagaatcttgccaaaaaatttggcataaccatcgagccccctgatagtgtaatgaagaaagggagaaaaagacaagagaatgaaactgttgaagatggaaggaaaaagctcaagacagatgaagaacatgcttatgtgctgattaagtatccaatagatgatctgctagtaaggcccaatgcagatgatccgtctttatttaagagacctcttctggctacagattttagagtaccaagatgttctgtgggagatctccttatggtatgggacttctgctcgtcttttgggagggctctgaatctgtccccatttccgctaacagatctggagaatgcaatttgccacaaagaaagcaatgttcttcttgtggaaatacatgcagctttgtttcacttgcttatgaaggatgaaggtgactatttcactgttccgcagaacaagaaacagaagttaaaggtaagttcagtaacatgggctgagtatctatgtgacttcttggaaatgacaaaaaatgaagaactatccactaacattgcaacagtaagaaggggatattatggtcttattgacactaatataaagcttaagatccttcgggaactagtggaagaagctattgaaacctctgccataagggagatactaagtgatcgtgtggaccagaaacaagtccttaatgcaacaaaaagagagaacaccagaaaggacaaaaaagagcaaaatctgaacactgaaattgccatgaaaaatgaggagaatcagacagatgctgtgcaaggtggccatgaaggtgtagatgagctggttaggagaaaagaagaaaatgacaagagtaatatttctcggggtaggacagaagtgaaacgacacatggtacagcaccttgagacggagatcgagaaattatccatccgttccagccctcttggtaaagacagacagtacagtaggtactggtttttcaagcgtgaaggaagactttttgttgaaactgcagattccagagaatggggttactacagcactaaggaagagcttgatgcgctcatggactcattgaatgtcaaaggtataagggagagagctttgaaacggcaactagagaagttctatagtaagataagtaatgccctagagaaacgatcaaaagacatcgcaaacaagacgttacttgaagagggtgtgctgcgccgttccacacgtgtccgggcccagccaaaggacaatccgtccatggcattcctcaagtatgtcaacaagtggagggataactgaggtactctgagctatgtaggcttttgctcggttaggtcgttgcagtgactcgccatactcatggctggtttactgacacctcattagctagtgaaacctgtatcagaacctacttttcttctctctctttttttttttaaattttaacttagctttcatgtgtgttcacaaatgaacccctcccccccctccgtaattgaactatgctaggctttaccgtttttagaacagtggccaaattttttgcatggatgatgtaaacgtgacaaggccggtgtggagatgcttcgatctgcaagggtgggccgcgggccaatgttggggatttttgacttaatactactgccttgaattttttagcaccattttcgctagtcttgcatcgagacatactgcaccagtgatttttttgattgagtgatattccgttctaatatctgtgctttaagggtgcgtttgattgaggagtggaggagaatgtagcagttctattttagttttttttggatctttggttttcaacaaaagaggagcggagtggcacctggagtcttcatatagaaatttattataagtaaaatggtcggatgcgagtgctctcgagcgctttcctttctcttctctacactcatatagctctcaaccaaacaaagaacgaagcgtttttgttctattctactcttcaacaaaaaaaaata

SEQ ID NO: 1462 - DNA, 958 bp, Setaria italica
ccggctctatctaagagacctcctcttgctacagattttagagtgccaaggggttgtgtgggagatctccttatggtatgggacttctgctcatcttttgggagggttctgaatctgtccccatttccgctaacagatatggagaatgcaatttgccacaaagaaagcaatgttcttcttgtggaaatacatgcagctatgtttcacttgctcattaaggacaaaggtgactatttcagtgtcctgcagcacaagaaacggaagttaaaggtaagtttagtaacatgggctgaatatctatgtgatttcttggaaatgacaaaaattgaagaactatccagtaacattgcgacagtaagaaggggttattacggtctcattgacactgatatgaagcttaagatcctccgggaactagtggaagaagctattaaaacctctgccataagggagatactaattgagcgggtggaccagaaacaagcccttaatgcaacaaaaagagagagtaccagaaaggacaaagaagagcaaaacttgaacactgaaattgccatgaataatgaagagaaccagacagatgctgtgcaagatggcaatgagagtgtagaggagccggctagaggaaaagaagaaaaggataagagcaatgtttctcgaagcaagacagaaggcaaacgacatctggtatggcatcttgagacggagattgagaaactatccatccgttctagccctcttggtaaagacagacactacaataggtactggtttttcaggcgtgaaggaaggctttttgttgaaagtgcagattccagagaatggggttactacagcactaaggaagagcttgatgcactcatgggttcgttgaatgtgaaaggtataagggagagagctctgaaacggcagctagagaagtactataataagataagtaacaccctggagaagcgaa

SEQ ID NO: 1463 - DNA, 1817 bp, Pennisetum glaucum
ttgtaagattatgaagattcttattctgatggcacaaagatgtgtgaagtgggttggatgcgtcggacaagacttgatcaacacatcagttgtcaaagctgcagatctcttctaccggagggcgcctgttagcaggaacacactgaagatttttattagagattcaacaacacagactaccccatgggttatacatgagaatctcgccaaaaagtatggcatacctatggatccccctaaagatttagtgtttaagaagaaaggaagaaaaagaaaagaggatgaaactattgaagatgggaggaaaaagatgaagaaggaggaaggagatgcacatgtcccaattaagtatccaatagatgatctgttagtaagacccaatgcagatgatcctgctttgtttaagagacctcctctggctacggattttagagtgccaaggggttctgtgggagatctccttatggtatgggacttctgctcgtctttgggaggcttctgaatctgtccccatttccactaacagatatggagaatgcaatttgccacaaagaaagcaatgttcttcttgtggaaatacatgcagctatgtttcacttgctcattaaggacaaaggtgactatttcagtatcctgcagaacaagaaacggaagttaaaggtaagtctagtaacatgggctgaatatttatgtgatttcttggaaatgacaaaaattgaagaactatccagtaacattgcgacagtaagaaggggttattatggtctcattgacactgatatgaagcttaagatcctccgggaactagtggaagaagctattaaaaccactgccataagggagatactaggtgagcgggtggaccagaaacaagcccttaatgcaacaaaaagagagagtacaagaaaggacaaagaagagcaaaacttgaacactgaaattgccatgaataatgaagagaaccagacaggtgctgtgcaagatggcaatgagagtgtcgatgagccggctaggggaaaagaagaaaaggataagagcaatatttctcgcaaaacagaaggcaaacgacatctggtacgacatctagagacagagattgagaaactatccatccgttctagccctcttggtaaagacagacactacaataggtactggtttttcaggcgtgaaggaaggctttttgttgaaagtgcagatttcagagaatggggttactacagcactaaggaagagcttgatgcactcatgggttcgttgaatgtgaaaggtataagggagagagctctgaaacggcagctagagaagtactataataagataagtaacactctggagaagcgaacgaaagaaatggtgaacaagatgttacttgaagagggtgtgctgcgccgctccacgcgagtccgggctcaaccgaaggacaacccttccatggcgttcctcaagtatgtcaacaaatggaaggacaactgagctgcttcaagctgacatattctagctcaaaataagatgaatcttggtctttgggagaattgaccaacccaggtgataggggttggccgtactgccatagcaactagctagttactaagttatgtaggtttgcaattccccgtggctggtcaatcgagtcctcagtcctcactggatcagcgtttttctttttcttttccttttttaattattttggacgttggttctcaaagggaagcacctagtgtttgtctccttaactgaactgagagcatgccttagccaggttttacatgatgtgatgtaaacctgatgctggctctggctggagcttttgattg

SEQ ID NO: 1464 - DNA, 1814 bp, Pennisetum glaucum
ttgtaagattatgaagattcttattctgatggcacaaagatgtgtgaagtgggttggatgcgtcggacaagacttgatcaacacatcagttgtcaaagctgcagatctcttctaccggagggcgcctgttagcaggaacacactgaagatttttattagagattcaacaacacagactaccccatgggttatacatgagaatctcgccaaaaagtatggcatacctatggatccccctaaagatttagtgtttaagaagaaaggaagaaaaagaaaagaggatgaaactattgaagatgggaggaaaaagatgaagaaggaggaaggagatgcacatgtcccaattaagtatccaatagatgatctgttagtaagacccaatgcagatgatcctgctttgtttaagagacctcctctggctacggattttagagtgccaaggggttctgtgggagatctccttatggtatgggacttctgctcgtcttttgggaggcttctgaatctgtccccatttccactaacagatatggagaatgcaatttgccacaaagaaagcaatgttcttcttgtggaaatacatgcagctatgtttcacttgctcattaaggacaaaggtgactatttcagtatcctgcagaacaagaaacggaagttaaaggtaagtctagtaacatgggctgaatatttatgtgatttcttggaaatgacaaaaattgaagaactatccagtaacattgcgacagtaagaaggggttattatggtctcattgacactgatatgaagcttaagatcctccgggaactagtggaagaagctattaaaaccactgccataagggagatactaggtgagcgggtggaccagaaacaagcccttaatgcaacaaaaagagagagtacaagaaaggacaaagaagagcaaaacttgaacactgaaattgccatgaataatgaagagaaccagacaggtgctgtgcaagatggcaatgagagtgtcgatgagccggctaggggaaaagaagaaaaggataagagcaatatttctcgcaaaacagaaggcaaacgacatctggtacgacatctagagacagagattgagaaactatccatccgttctagccctcttggtaaagacagacactacaataggtactggtttttcaggcgtgaaggaaggctttttgttgaaagtgcagatttcagagaatggggttactacagcactaaggaagagcttgatgcactcatgggttcgttgaatgtgaaaggtataagggagagagctctgaaacggcagctagagaagtactataataagataagtaacactctggagaagcgaacgaaagaaatggtgaacaagatgttacttgaagagggtgtgctgcgccgctccacgcgagtccgggctcaaccgaaggacaacccttccatggcgttcctcaagtatgtcaacaaatggaaggacaactgagctgcttcaagctgacatattctagctcaaaataagatgaatcttggtctttgggagaattgaccaacccaggtgataggggttggccgtactgccatagcaactagctagttactaagttatgtaggtttgcaattccccgtggctggtcaatcgagtcctcagtcctcactggatcagcgtttttctttttcttttccttttttaattattttggacgttggttctcaaagggaagcacctagtgtttgtctccttaactgaactgagagcatgccttagccaggttttacatgatgtgatgtaaacctgatgctggctctggctggagcttttg

SEQ ID NO: 1465 - DNA, 774 bp, Zea mays
attctttcactcactctccagatccggtgcttgtgggagcctaacacgccccccgcctccctctccgccgtcgccgagtccctcgccggcttaccccgtcgctggcgaaggcactccggcgtggacgcctcgccgccccgcgggcggcgtcgacggtcggttttaggcctcccggaggctgcatcccgtgtcgattcgagatttggagaacacaatttgccacaaagaaagcaatgttcttcttgtggaaatacatgcagctatgaaggatgaaggtgactatttcactgttctgcagaacaagaaacggaagttaaaggtaagttcagtaacatgggctgagtatctatgtgatttcttggaaatgacaaaaaatgaagaacgttccacaaacattgcaacagtaataaggggttattatggtcttattgacactgatataaagcttaagatcctccgggaactagtggaagaagctattcaaacctctgccataaaggagatactaagtgaccgtgtggaccagaaacaagtcctcaatgcaacaaaaagagagaacaccagaaaggacaaacaagagaaaaatcttaacactgaaattgccatgaaaagtcaggagaatcagacagatgatgtgcaagttggtcatgggggtgtagatgagctggttaggagaaaagaagaaaatgacaagagcaatatttctcggagtagaacagaagggaaacgacacttggtacagcaccttgagacggagattgagaaattatccct

SEQ ID NO: 1466 - DNA, 1455 bp, Zea mays
ccgccggcccagcgagagcgagccagcgaggtgcccaggaccaggacggctggggaccctgtcatccaatcagtccgtcacacgaacacgacacgattcacacatttcaatcactcgcttcccatgaattcgctcgctttccctagctgcccgtcagcattgacgcccgcctccaccaccgcccccgcgtcctctccctttccctcgccgcgtataaagattcgctgcccgcgacaagaagatgcagctcattaccacctccgcctccgcgatcgaagctcctcacaaaccgttatcgtcgccatggcagccgccgcgcctgcaagctccgtgaaggaagtgctgccatctcccctgacctccgcctccgagccccctcccctcttcgatggcaccaccaggctgtacgttgcctatcattgcccgtacgcgcagcgcgcttggattgccaggaactacaagggtttgcaggacaagattaagatagtcgccatcgatcttgctgacaggccaacatggtacaaggagaaggtttatccagaaaacaaggtgccttctctggagcacaacaaccaggtgaaaggtgagagtttggatctggtcaagtacattgacagcaactttgaaggcccatcgttgctcccagaggatccttcaaaaaagcagttcgctgaggagctgcttgcatatactgatgcatttaacaaagcattatacttttgtatagtctccaaggaagatgtgtctgaggaagctgtcgctgctttggataaaatagaagacgccctcgggaaattcaacgagggtccattctcccttggtcagttcagtctggtggacattgcgtatgtaccattcatcgagaggtttcagatattctattccaacataaagaactatgatattacaaagggcagacccaaccttcagaagttcattgaggaagtggacaagattgatgcatacacacagactaaacaggacccacagtttttacttgagcagacaaagaagcggcttgggattgcttaaagcttgcggccgaggatgactctcgacagaaataccagcatagtagatcgacacttgtttagtcatttgtgtgcttgaataatgaatactacatatatggttttcaataagacatggtcctctatactgggttgtacttctgaaaacaaactagttgtcctgatattatagctttcgtggtgtgtttacgtcactgtatatgaaagggtggggagagagaatgatatgccatgtattctgtcaaatgtttttttataatgtcaagagctctgacttttaattaagaagaaaaaggattatatataagggccaaccaaacacatgatgctgccaaacaatatattcgaatggctaacccacctatgcaatacggcaaagcattatcatgaatcatggttgctactaaaaaaaggaaaaaaaaaa

SEQ ID NO: 1467 - DNA, 1236 bp, Zea mays
gacacgattcacacatttcaatcactcgcttcccatgaattcgctcgctttccctagctgcccgtcagcattgacgcccgcctccaccaccgcccccgcgtcctctccctttccctcgccgcgtataaagattcgctgcccgcgacaagaagatgcagctcattaccacctccgcctccgcgatcgaagctcctcacaaaccgttatcgtcgccatggcagccgccgcgcctgcaagctccgtgaaggaagtgctgccatctcccctgacctccgcctccgagccccctcccctcttcgatggcaccaccaggctgtacgttgcctatcattgcccgtacgcgcagcgcgcttggattgccaggaactacaagggtttgcaggacaagattaagatagtcgccatcgatcttgctgacaggccaacatggtacaaggagaaggtttatccagaaaacaaggtgccttctctggagcacaacaaccaggtgaaaggtgagagtttggatctggtcaagtacattgacagcaactttgaaggcccatcgttgctcccagaggatccttcaaaaaagcagttcgctgaggagctgcttgcatatactgatgcatttaacaaagcattatacttttgtatagtctccaaggaagatgtgtctgaggaagctgtcgctgctttggataaaatagaagacgccctcgggaaattcaacgagggtccattctcccttggtcagttcagtctggtggacattgcgtatgtaccattcatcgagaggtttcagatattctattccaacataaagaactatgatattacaaagggcagacccaaccttcagaagttcattgaggaagtggacaagattgatgcatacacacagactaaacaggacccacagtttttacttgagcagacaaagaagcggcttgggattgcttaaagcttgcggccgaggatgactctcgacagaaataccagcatagtagatcgacacttgtttagtcatttgtgtgcttgaataatgaatactacatatatggttttcaataagacatggtcctctatactgggttgtacttctgaaaacaaactagttgtcctgatattatagctttcgtggtgtgtttacgtcactgtatatgaaagggtggggagagagaatgatatgccatgtattctgtcaaatgtttttttataatgtcaagagctctgacttttaattaagaaaaaaaa

SEQ ID NO: 1468 - DNA, 786 bp, Triticum aestivum
gcacgaggccgcgctcgaagctccgcctcctcccgaacccgtaccgtcgccatggcatccggcttgcctgtaagctccaaggaagtgctgccgtctcccctgacctccgcctccgagccccctcccctcttcgatggcactaccaagttgtacgttgcctattattgcccgttcgcgcagcgcgcttggattgccaggaactacaagggtttgcaggataagattaagattgtcgccatcgatcttgctgacaggccagcatggtacaaggagaaggtttatccagaaaacaaggtgccttctctggaacacaacaaccaggtgaaaggagagagcttggatttggttaagtacattgacagcaacttcgaaggtccatcgttgctccctgaggatcctgcaaagaagcagttcgctgaggagctgcttgcatatactgatgcatttaacaaagcattatactcatctttactcagcaaggaagatgtgtctgaggaaactgttgctgctttggataaaatagaagacgccctggggaaatttaatgacggcccgttcttccttggtcagttcagtttggtggacattgcatatgtaccattcatcgagaggtttcagatattctattccaacataaaaaactatgatatcacaaagggcagacccaaccttcagaagttcattgaggaagtgaacaagatcgatgcatatacgcagactaaactggacccagattttttacttgagcagacaaagaagcggcttgggattgcttaaagcttgtga

SEQ ID NO: 1469 - DNA, 1202 bp, Sorghum bicolor
ggggaccctgtcatctaatcagtccgtcacacgattcacgaattgaccactcgcctgtcgcctcccatgaattcgctcgctttccctggctgcccgtcaccactgacgcccgcctccaccgcccccggcctccatcccatcccatcgccgcgtataaagattcgcttccagcgactagaagatgcagctcatcaccacctccgcgctcgaagctccgcctcctcccgaacccgtaccgtcgccatggcatccggcttgcctgtaagctccaaggaagtgctgccgtctcccctgacctccgcctccgagccccctcccctcttcgatggcactaccaagttgtacgttgcctattattgcccgttcgcgcagcgcgcttggattgccaggaactacaagggtttgcaggataagattaagattgtcgccatcgatcttgctgacaggccagcatggtacaaggagaaggtttatccagaaaacaaggtgccttctctggaacacaacaaccaggtgaaaggagagagcttggatttggttaagtacattgacagcaacttcgaaggtccatcgttgctccctgaggatcctgcaaagaagcagttcgctgaggagctgcttgcatatactgatgcatttaacaaagcattatactcatctttactcagcaaggaagatgtgtctgaggaaactgttgctgctttggataaaatagaagacgccctggggaaatttaatgacggcccgttcttccttggtcagttcagtttggtggacattgcatatgtaccattcatcgagaggtttcagatattctattccaacataaaaaactatgatatcacaaagggcagacccaaccttcagaagttcattgaggaagtgaacaagatcgatgcatatacgcagactaaactggacccagattttttacttgagcagacaaagaagcggcttgggattgcttaaagcttgtgaccaaggatgaatctctcgccagaagtacaagcatagtagattgagactagtttagtcgtttgtgtgcttgaataatgatgaatatcacagttatggttttcagtgaggcatggtcttctatattggttgtgcttctgaaataaattagttgtcactatataaaaggatcatttggtaatgtgttgatgtcactggttgtgcttctgaaaataaactagttgtca

SEQ ID NO: 1470 - DNA, 1372 bp, Setaria italica
gccagacggacagtgaccccgcctgaactgacgtgcccactccaccaatcagtgcctcgcacatccacacctcgccgcccatgaattcgctcgctttccctcgatgctgcccgtcaccgctgacgccggcctccacctcttcccccgtcacctcttacgctccatcatcggcgagtataaagattcgccgctcgcgccgcgccgctcaccgcatcgccgtgcagaagcccacccgaatcgtcgccatggcagccaccgcaccgccgagctccgtcaaggaagtgctcccgtctcccctcacctccgcctccgagcctcctcccctcttcgacggcacaaccaggttgtatgttgcgtaccactgcccatacgcgcaacgcgcttggattgccaggaactacaagggtttgcaggacaagatcaagatagtcgcgatcgatcttgctgataggccatcatggtataaggagaaggtttatccagagaacaaggtgccttccctggagcacaacaaccaggtgaaaggagagagcttggatttggttaagtacattgacagcaatttcgaaggcccatcattgcttcctgatgatcctgcaaagcagcaattcgctgaggagctgctcgcttataccgatgcatttaacaaagcactatactcatctatactctccaaggaagatgtgtccgaggaaactgttgctgctctggataaaatagaagaggccctggggaaattcaacgacggcccgttcttcctcggtcagttcagtctggtggacatagcatatgtaccatttattgagaggtttcagatattctattccaacatcaagaactatgatatcacgaagggcagacccaatcttcagaagttcattgaggaagtgaacaagatcgatgcatacacacagactaaacaggacccacagcttttgcttgagcacacgaagaagagacttgggattgcctagagcctgtgaccaaggatgaaactctcgctatggcattaccatcatagacttgaatagtagatccagactcatttgtatgcttgaatgttatatgcattgtttacaataagacatgtccttctatgctggtcgtgcttttgagaataaactatagttgtcagggattaagctttgtagtgcatcatcatcagtgtgctactcgacatgaaggagatgtaacgatgtgcagtgtgctgttaaatgttgctgatttcaatatatcagtgctcctctcatattaatattctccctgtggtattcttgtagtctagtaacgatggaaagtattgatcagcaaaggaaatcacaagtgagtggaaagaacaatctctgaaaatggatcattaacatacttgggc

SEQ ID NO: 1471 - DNA, 1227 bp, Panicum virgatum
ttcgcttgcctttcctcgcggctgcccgtcaccgctgacgctcgcctccacctccacctccgcccccgtcaccactaactccccgccggcgcgtataaagattcgccgcccgcgccgcgaagctcaccgcatcgccgcgcggaaaccctcccgaatcgtcgccatggcagccgccgcaccggcaagctccgtcaaggaagtgctcccgtttcccctgaccgccgcctccgagcccccgcccctcttcgacggcacaaccaggttgtatgttgcctaccattgcccgtacgcgcagcgcgcttggattgccaggaactacaagggtttacatgacaagatcaagatagttgcaatcgatcttgctgacaggccagcatggtacaaggagaaggtttatcccgagaacaaggtgccttccctagagcacaacaaccaggttaaaggggagagcttggatttggtcaagtacattgatagcaatttcgaaggcccatcattgcttcctgatgatcctgcaaagaagcagttcgctgaggagctgcttgcttttaccgatgcttttaacaaagcactgtactcatctataatctctaaggaagatgtgtccgaggaaactgttgctgctctggataaaatagaagaggccctggggaaatttaacgatggaccattcttcctcggtcagttcagtctggtggacatagcatatgtgccatttatcgaaaggtttcagatattttttgaaaacatcaagaactatgacatcacaaagggcagacccaaccttcagaagttcattgaggaagtgaacaagattgatgcgtacacacagactaagcaggacccacagtttttgcttgagcacacaaagaagcggcttgggattgcatgaagcttgtgaccaaggatgaaaatctcgccagtgggctgcttgcatagactgcattgtttgcaagaatggccttgtatgcactatgctggtcgtgcttttgaaataaactagttgtcctggattatagcttttgtagtgcatcgacgtcattatgttacttgacaggaagaggatgttataatgatgttcagggtgctctgttaaatgttgccgtgttcgataaatcagtgttcctctgctctcatagtctggtattcttgtactacgataactttgcggaagtgtgatcagacaagtaaatggaaagaacaatctccaaaatggaccattaacat

SEQ ID NO: 1472 - DNA, 1169 bp, Cenchrus ciliaris
caccaatcagtgcctgcctcctcgccgccattcccacgatgctgcccgtcaccgctgacgccggcctccacctcttcccccgtcacctcttatgccctatcggcgagtataaagatttgccgctcgcgccgcacctctcaccgcatcgccgtgctgaagccctcccgaatcgtcgccatggcagccgccgcaccgccaagctctgtcaaggaagtgctcccgtctcccctgacctccacctccgagcccccttctctcttcgacggcaccaccaggttgtatgttgcgtaccactgcccgtttgcgcagcgcgcttggattgccaggaactacaagggtttgcaggacaagatcaagatagtcgcgatcgatcttgctgacaggccgtcatggtacaaggagaaggtttatccagagaacaaggtgccttccctggagcacaacaaccaggtgaaaggagagagcttggatttggtcaagtacattgacagcaatttcgaaggcccatcattgcttcctgatgatcctgcaaagaagcaattcgctgaggagctacttgcttataccgatgcatttaacaaagcactatactcatctatactctccaaggaagatgtgtccgaggaaactgttgctgctctggataagatagaggaggccttggggaaattcaacgatggcccgttcttcctcggtcagttcagtctggtagacatagcatatgtaccatttattgagaggtttcagatattcttttccaacatcaagaactacgatatcacggagggcagacctaatcttcagaagttcattgaggaagtgaacaagatcgatgcatacacacagactaaacaggacccacagtttttgcttgagcacacaaagaagagacttgggattgcccaaagcctgtgaccaaggatgaaactctcgccatgggattaccgtcatagacttgtatagtagatgcagactcagttgtatgcttgaatgttatatgaattgtttacaataagacatgtccttctatgctggttgtgcttttgaaaataaactatatatagctgtcagggattcagctttgtagtgcatcatcatcagtgtgctacttgacatggagatgtgacgatgttcagtgtgctgttcaataaatgttactgatttcaata

SEQ ID NO: 1473 - DNA, 1100 bp, Panicum virgatum
cgccgcgaagctcaccgcatcgccgcgcagaaaccctcccgaatcgtcgccatggcagccgccgcaccggcaagcttcgtcaaggaagtgctcccgtctcccctgacctccgtctccgagcccccgcccctcttcgacggcacgaccaggttgtatgttgcgtaccactgcccatacgcgcagcgcgcttggattgccaggaactacaagggtttacaggacaagatcaagatagttgcaatcgatcttgctgacaggccagcatggtacaaggagaaggtttatccagagaacaaggtgccttccctagagcacaacaaccaggtgaaaggagagagcttggatttggttaagtacattgatagcaatttcgaaggcccgtcattgcttcctgatgatcctgcaaagaagcagttcgctgaggagctgcttgcttttaccgatgcttttaacagagcactgtactcatctatagtctctaaggaagatgtgtccgaggaaactgttgctgctctggataaaatagaagaggccctggggaaatttactgacggaccattcttcctcggccagttcagtctggtggacatagcatatgtgccatttatcgaaaggtttcagatattctttcaaaacatcaagaattacgacatcacaaagggcagacccgaccttcagaggttcattgaggaagtgaacaagattgatgcgtacacacagactaaacaggacccacagtttttgcttgagcacacaaagaagcggcttgggattgcatgaagcttgtgaccaaggatgaaaatctcaccagggggctacctgtataagactgcattgtttgcaagaatggccttctatgcgctatgctggtcgtgcttttgaaataaactagttatcctggattatagcttttgtagtgcatcgacgtcattatgtgcagggtgctctgttaaatgttgccgtgttagataaatcagtgttcctgtcctctcatagtctcatattaatattatccctgtggtattcttgtagtatggtacttttgcgaaagtgtgatcagacaaataaataagagcatatccaagagttttctgtttctg

SEQ ID NO: 1474 - DNA, 1282 bp, Oryza sativa
gcgtgcacccacaccacgttctcgtccaggtgctgagcggcttgacgaacctgaccttccgcgcccgaatcagctgctgacgtatcgcctccgccattaccacctcacactctctctccccatgaattcgctcgctttccctcgcggccgatgctccccgtcaccactgacgcgcccctccacctcccgtagttcttccgtcccatcgtcgcgcacaataaagattcgcccgagctcgcgaagcgtcgcccggtgcaacctccgcgacgccaagaatctctccccgtcccgcaccgtcgccatggctgccgcggccgccgcaccggcaagctctgagaaggaagtgctccccccttccctgacctcctcatcggagccccctcccctcttcgatggaaccaccaggttgtacgttgcgtaccactgcccttacgcgcagcgcgcgtggattgccaggaactacaagggtttgcaggataagatcaagattgtcgcgattgatcttgcagacaggcctgcttggtacaaggagaaggtttacccagagaacaaggtaccttcacttgagcacaacaatcaggtgaaaggagaaagcttggatttggtcaagtacattgacaccaatttcgaagggccagcattactccctgatgattctgagaagcagcagttcgctgaggagcttcttgcgtacactgatgcgttcaacaaagcatcgtactcatccatagtcgccaagggagatgtgtgcgatgaggctgttgctgctcttgacaaaatagaagctgctctgtcaaagttcaacgatggcccattcttccttggccagttcagcttggtggacattgcgtatgttccatttattgaaaggtttcagatattcttttctggtataaagaactacgatatcaccaagggccgacccaaccttcagaaattcatcgaggaagtgaacaagattcatgcctatacagaaaccaaacaggacccacagtttttgcttgaacacacaaagaagcgtcttgggattgcctgaagatgtgaccaaggatgaacccacaacaacctgcgatggagacagggagctggtgcagtatatagtagataaagactagtgtgcttcattttagcatatggtttatcttgaataagataatgcatgtcatgcagaccatgcttatggaacaaactattatgtatttttggtttggctgtgtacagctgttaatgtgaatttcccgtcatataattaattacaagcttcgcggggcgttgtctaata

SEQ ID NO: 1475 - DNA, 1041 bp, Avena sativa
tcgccgccaggacttccgcacgaaccgtcgccatggccgccgccgccgctgcaccggtcatctctccgaaagaagatctgccccctatcctgacctccacctccgagccccctccactcttcgacggcaccaccaggctgtatgtcgcatatcactgcccgtacgcgcagcgcgcctggattgccaggaactacaagggtgtgcaggacaagatcaagatagtcgcgatcgatctggcagacaggccggcttggtacaaggagaaggtttacccagggaacaaggtgccttctctggagcataacaaccaggtgaaaggagagagcttggatttggttaagtacatcgacagcaacttcgatggcccagcattgcttcctgatgattctgaaaagaagcagttcgctgaggagctgcttgcgtataccgatgagttcggtaaagcagcatactcatctatcatctccaagggagatgtgtcagaggaaactgttgctgcgctggacaaaatagaagctgcactcgggaaattcacagatggccctttcttccttggccagttcagtctggtggacattgcatatgtgccatttatcgaaaggtttcagatattcttttctggcatcaagaactacgatatcaccaagggcagacctaacattcagaaattcattgaggaggtgaacaagatcgatgcttatacacaaaccaaactggacccgcagtttctgcttgaacaaactaagaagcggctcgggattgagtgaagatgtgaccaaggatgaacaagaggtcggcaactactgcatcatcagcatggaagatgaaatctcagtcactcaggagtgtgcttgcttgctttatgctactatatatattgaataaaagatgcatgctattagggtcctggcgtcctgccttttgagtacagagttgtcattttgtgattatagtttgacggtgtgtccatgcttatgaaggaggacaatcgtatattgtgttgaatgtttatgaatttattaatgaatcgatcctcctacg

SEQ ID NO: 1476 - DNA, 907 bp, Eragrostis curvula
  misc_feature (907)..(907): n is a, c, g, or t
tattgcgcgagtcacgatctcggcaaagcctccgcatcgtcgcatggcagcggcgcgccggcaagctccgttaaggaagactcccgactcccctgacctccgcctccgagccgcctccccttttcgatggcactaccaggttgtacgtggcgtaccactgcccgttcgctcagcgtgcttggattgccaggaactacaagggtttgcatgacaaagttaagatagtcgcgatcgatctggcagacaggcctgcttggtacaaggagaaagtttatccagagaacaaggtgccttccctcgagcacaataaccaggtgaaaggagagagcttggatttggttaagtacattgacagcaattttgaaggcccatcgttgcttcctgatgatgctgcaaagaagcagtttgctgaggagttgcttgcatatactgatgagttcaacaaagcattatattcatccataatctccaaggaagatgtatccaaggaaactgttgctgctctggataaaatagaagctgccctgggacagttcagtgatggtcctttcttccttggtcagttcagcttggtggacattgcatacgtgccatttatcgaaaggtttcagattttctattccaacataaagaactatgatatcacggagtggcgttcccaaactttcagaagttcattgaggcagttaaccagatcgacgccttatcgcaaactaaacaggatccacatttcgtgcttgaacacacaaggaacggcttgggattgcctgaagactgcgcgcagaaatgacatctgtctgggagcgcccaattatcaatcgggatgggctgctgtcctattcccataactttggctcaaaaggctagttgaaaacatggtggtctaaacaaatggaacaggatgggn

SEQ ID NO: 1477 - DNA, 1419 bp, Hordeum vulgare
cggcacgaggccggccggccgaccccatccatggagcatcacccgaatcgacgtgtcgaatccacatttactgccgcaccaatgagttcgctcgctttcccctgccgctcgtcaccactgacgcccgcctccaattcccctcccgtcccgtcgccgtgtataaagatccgccgctcgcgacgagctgctccccatcgccacctcatcgccgccaggaattcgagctccccccggaccgtcgccatggccgccgcagccgctgccgcaccggtcatctccccgaaagaaaatctgcccccttcgctgacctccacctccgagcccccgccactcttcgacggcacgaccaggttgtatgttgcatatcactgcccgtacgcgcagcgcgcttggattgccaggaattacaagggtttgcaagacaagatcaagatagtcgcagtcgatcttgcagacaggcccgcctggtacaaggagaaggtttacccacagaacaaggtgccttcactggagcataataaccaagtgaaaggagagagcttggatttggtcaagtacattgacagcaatttcgatggccctgcattgcttcctgatgattctgcaaagaagcagttttccgaggagctgcttgtgtataccgatgagttcaataaagcactatactcatccataacctccaagggagatgttgcagaggaaactgttgctgcgctggataaaatagaagccgccctgggaaagtttagtgatggccctttcttccttggccagttcagtttggtggacattgcatatgtgccatttatcgaaaggtttcagatattcttttctggtataaaaaactatgatatcaccaaggacagacctaacattcagaaattcatcgaggaagtgaacaagatcgatgcatacacacaaacgaagctggacccacaatttctgcttcaacacacaaagaagcggcttgggattgagtgaagatatgaccaagcatgaacagaggccagggaactactgcagcatggaagatggagactagacaatcaggagcgttcttgcttgctactgtagtatataccatactatgaataaaaagatgcatgctactaaggtcctgccttttgagaataaattaagtggttgattgtgattatagtattttaagcacgttttgtgattgcggtttgacagtgtgccagtgcttatgaaggaacatcatcgtgtgttgtgtacttgttgaatgcttattttttgaacgggttagtctctgggtctctacatcttctgatgcacacaagcatagttttgtttagaaaggtgccaagcaataagaccagacgcttcatttcagctttaaaaacgagatcatcctttggcctcaactatttactgctgtaacctattttcaaagaatat

SEQ ID NO: 1478 - DNA, 980 bp, Pseudoroegneria spicata
catctccccgaaagaaaatctgcccccttcgctgacctccacctccgagccccctccactcttcgacggcacgaccaggttgtatgttgcatatcactgcccgtacgcgcagcgcgcttggattgccaggaactacaagggtttgcaagacaagatcaagatagtcgcgatcgatctcgcagacaggccggcttggtacaaggagaaggtttacccacagaacaaggtgccttcactggagcataacaaccaggtgaaaggagagagcttggatttggtcaagtacattgacagcaatttcgatggcccagcattgcttcccgatgattctgcaaagaagcagtttgccgaggagttgcttgtgtacaccgatgagttcaataaagcactatactcatccataacctccaagggagatgtggtagaagaaactgttgctgcgctggataaaatagaagctgccctgggaaagttcagtgatggtcctttcttccttggccagttcagtttggtggacattgcatatgtgccatttatcgaaaggttccagatattcttttctggtatcaaaaactatgatatgaccaaggacagacctaacattcagaaattcatcgaggaagtgaacaagatcgatgcatacacgcaaacgaagctggacccaaaatttctgcttgaacacacaaagaagcggcttgggattgagtgaagatgtgaccaagggtgacccagaggccagggaactactgcagcatggaagatgaagactcagacactcaggagtgtgcttgcttgcttgctagtatatacgtactgtactttgaataaaaagaagcatgctactaaggccctgcctctggagaataaattaagtggttgttttgtgattatagtctttttaggcgttttgtgattgtggtttgacagtgtacttgttgaatgcttatgagttgaatggactgatgcgccctctgttctca

SEQ ID NO: 1479 - DNA, 1179 bp, Leymus cinereus x Leymus triticoides
cgagttccccccgaaccgtcgccatggccgccacaccggtcatgtgagcaggccaagtcgcggcgcagaatctactgcgtttgattctcgattaaattattcaaatcgtttctctgttgtgtttttaacttggtgtttgtttctctactccaccgtgcgcagctccccgaaagaaaatctccccccttcgctgacctccacctccgagccccctccactcttcgacggcacgaccaggttgtatgttgcatatcactgcccgtacgcgcagcgcgcttggattgccaggaactacaagggtttgcaagacaagatcaagatagtcgcgatcgatctcgcagacaggccggcttggtacaaggagaaggtttacccacagaacaaggtgccttcactggagcataacaatcaggtgaaaggagagagcttggatttggtcaagtacatcgacagcaatttcgatggcccagcattgcttcctgatgattctgcaaagaagcagtttgccgaggagctgcttgtgtataccgatgaattcaataaagtactatactcatccataacctccaagggagatgtagcagaggaaactgttgctgcactggataaaatagaagctgccctgggaaagttcactgatggccctttcttccttggccagttcagtttggttgacattgcatatgtgccatttatcgaaaggtttcagatattcttttctggtatcaaaaattatgatatcaccaaggacagacctaacattcagaaattcatcgaggaagtgaacaagatcgatgcatacacacaaacgaagctggacccacaatttctgcttgatcacacaaagaagcggcttgggattgagtgaagatgtgaccaaggacgaccaagaggccagggaactactgcagcatggaagatgaagactcagacactcaggagtgtgcttgcttggtagtagtatatactatactttgaataaaaagatgcatgctactaaggtcctgccttttgagaataaattaagtggttgttttgtgattatagtctttttaggacgttttgtgattgtggtttgacagtgccccaatgcttatgaaggaacatcatcatatgttgtgtacttgttgaatgcttatgagttgaatatggactgatgcgccctctgttctaatgtta

SEQ ID NO: 1480 - DNA, 1322 bp, Brachypodium distachyon
atcgacgtgtcgaatccaatccaatcgacctttatgctgccgccatgaattcactcgctttcctttgccgcccgtcaccactgacgccttccgcctccccctccatctccctctccgtcccccagtcgtcctgtataaagctcccccgctcgcggccagcagctcaccgccaccgcaccgccgccgccgccaggatttcctcccgaaccgtcgccatggcaaccgctgctgcaccaccggtcatcttcccgaaagaaaatctccccccttccctgacctccacctcagaaccccctccgctcttcgatggcacgaccaggttgtatgttgcatatcactgcccgtacgcgcagcgcgcttggattaccaggaactgcaagggtttgcaggacaagattaagatagtagcgatcgatctggcagacaggccagtttggtacaaggaaaaggtttatccagagaacaaggtgccttcactggagcatgacaaccaagtgaaaggcgagagcttggatttggtcaagtacattgatagcaatttcgaaggcccagctttgcttcctgaagattctgcaaagaagcagtccgctgaggagctacttgcgtatacagatgagtttaacaaagcattatactcatccatactctccaagggagatgtgtcagaggaaactgttgccgcgctggataaaatagaagctgccctgggaaagttcaccgatggtcctttcttgcttggccagttcagttcggtggacattgcatatcttccatttattgaaaggtttcagatattctattctggtatcaagaactacgatatcaccaagggcagaccgaactttcagaaatacatcgaggaagcaaacaagatcgatgcgtatacacagaccaaactggaaccacaatttctgcttgatcaaacaaagaagcgtcttgggattgagtgaatatgtcaccaaggataaacaagaggcgcagcatggaatatgaagacttagtcactcgatcaggagtgtgcttgtttgttagatggtatttgaataaaaaagatgtatgctactatgctcctgccttttgagaataaggtggttgtgttgtgattatagtttgacggtatgccaatgtttatggatgagaataatcatatactccctcggtcccaagtgactcgaatttgtccaaatatggatgtatctatacccaaaaaacgtctagatacatgtagtatttcgtcacttaatatgggacggagggagtattttgttgaatgtttatgagtatagtgaaacgatgcttctatgatatcatgttaaccattt

SEQ ID NO: 1481 - DNA, 2752 bp, Sorghum bicolor
tgcccccagcccggacagagaccgcaccgcaccgcaccgcacaaggaggctcgctacagggccggccttgtgagaatctgagttgcgatacgcagcagcacacgacgccgaccccgaccgctcgcttgcggcgcggaacaaagcagccaccgccaccgccaccaccaccaccgccgccgccgcctcttcctcctccgctcccttattcgctctcgctcccacatccaccacctctaccgccgcacccctccttcttcttcttcttctcctcctcctcctcggcgaaggccggccggccgcacacagcgacgcggtggccgcagtggacgcccgagcctccaggtagagactagctagctcgctagctagctaatctactaccaggccggagcttgtccattgctggcacacaccatcatcagctgcctcgagcaagcgatcgaccggattcggatcatgaaccggatggaattggaaatgcggtgacgacaacgatcgatcgacctgctgtgcctagctcgatctctacctctaattaattaaggaaaagcaaaggagagagcagctagcgggccgcggtcggtgtcaagttctccgttctcggggggccgtatagatgacgcttggcgccgcggccgacgacatggaggccgccggcggtgagcgcatcagcgggaggcgcgcgcggttcacggaggactggtgctgctgcgcctgcgcggggctcttcctgggtcccaacccgatgatggcgcgctacatgtacgcgctcatcttcctcgtcaccaacctcctcgcctggaccctccgcgactacggcgactccgcgctcgccgagctccagcggctcaaggtgtgccagggcgcgcgctactgcctgggcgcggagggcgtgctgcgggtcagcctcggctgcttcctcttcttcttcgtcatgttcctgtccaccgtgaacacgcggaaggtgcacgagtgccgcaactcgtggcactccgagtggtggccggtcaagctcgtcctctggctcggcctcaccgtcgtcaccttcctcgcgccgtcgccgctcgtccagctctacgggaaagtggcgcatttcggagcaggggcgttcctggtgatccagctcatcagcgtcaccaggttcatcatgtggctcaacgactggtgccggtcagagatcagccagaagagatgccacttgcagattcaggtggtgtccatcgtcacgtacgtggggtcgctgctggggatcgtgctcatgtacgtgtggtacgcgcccagcctgtcctgcaagctcaacatcctcttcatcaccgtcacgctggtgctcgtgcagctcatgaccttcgtctccatgagctccaaggtgaaggcagggtacctggcgccggggctgatggggatctacgtcgtgttcctgtgctggtcagcgatcagaagtgagccgcacacggaggtttgcaacaagaaggcagaagttgccacgagcgcagactgggtgaacatcgcgagctttgtgatcgccgtcatcgtcatcgtggcggcgaccttctcgacgggaatcgactccaagtgcctccagttcaagcaggcggagggggagtcggaggaggacgacatcccctacggcttcggcttcttccacctggtgttcgccatgggcgccatgtacttcgccatgatcttcgtcggctggaacgcgagccacaccatggaaaggtggacgatcgacgtcggttgggcgagcacgtgggttcgtatcggcaacgagtggctggcagcactcgtatacatatggatgatgatcgcgcccgtaatctggaagacaaggcaggtgggatcgtcggcggagacggagacatgagcagatttcactgattctgacggcgtgatgacagccagcaatttatatatatatacaaacgcaaaacaaatgaaagggaaggggaaacggcaagaggtggtgcgtgctatgaattgcatgtatgcatcgccggcaaattcgcattcctggatgttcgttggtcaatgaggatgatgcactgctgctcgatcgggtagtttttgctaagccaagacaaggcaagaaggaagaggcaactagggagtactatatatgctaccactaatccaccgtgaagctcggttgaggaagctcatcatcgatctcgctgtactaaattaactatctgaaaagcatagagcttgtttgtttgggaacctgacaaagctgtctagtccgagcaataatgcaaatccgggctccttgaggtttgggattgctgctctgctcggctgcagctgtttggacaggtcaccatccgatcactcctataatctttttcgaaagggcagaacactcttatactcttttgcactctcataatcttttgcttgtcacttgtcattgtcactgactcactgatgctgcggggctaataaaagagcatgtttagatgctgcctgtcaggcagctgcccacccaagcagtgattagctagactccaggccaacgaaattgtgtgcctcgttggtgggggttgcttgtttgtgcatggcagattctcaaggtttgtaggcaaacataccgtaattgtgtggacacagaattactgatgccttgcaagactgagaggcgtttaccaaagaaggatagggaagttgctgaaaaatagtcttcagtcttacttaacgcaatgtaaaaacttgtaaaacgttgtaatgttttcaattcatctggattttggagcca

SEQ ID NO: 1482 - DNA, 1887 bp, Zea mays
gagcgttgtgtcatacatacgcagcagcacacgacgccgccggcccggcgccaccgcgcgcactcctagcctcgctcgatcgctctccgcagcgaggagccgaccacgacggtggccgccatggacgctcgcccgcgcctcctggtagactagctagctggcagaggcttgtccatccattgccgcgccggcggcacatcatcagaaacaggaagaagctaggaagaaggagcggcagctcgcggtggtagatgacgcttggtgctggtgctggtgccgccgtggccgacatggaggccggcagtagcggcgggtcgtcctccgacgagcggcgcgggcggcgggtcacggaggactggtgctgcgcctgcgcggaggggctcttcctggggccgcccaacccgatggtggcgcgctacctgtacgcgctcatcttcctcgtcaccaacctcctcgcctggaccctccgcgactacggcagctccgcgatcgccgggctccagcggctcaaggtctgccagggcgcgcgccgccactgcctgggcgcggagggcgtgctgcgggtcagcctcggctgcttcgtcttcttcgtcgtcatgttcctgtccaccgtgcacaccaggaagctgcacgactgccgcaactcgtggcactccgactggtggccggcgaagatcgtcctctggctcgcactcaccgccgtcgccttcctcgcgccgtcgccgctcgtccagctctacgggaaggtggcgcatttcggagcaggggcgttcctggtgatccagctcatcagcgtcaccaggttcatcatgtggctcaacgactggtgccggtcagagaccacccagaagagatgccacttgctgatccaggcggtgtccatcgccacgtacgtggggtcgctgctgggggtcgtgctcatgtacgtgtggtacgcgcccagcccggcctgcaggctcaacatcctcttcatcaccgtcacgctggtgctcgtgcagctcatgaccttcgtctccacgcgctccaaggtgaaggcagggtacctggcgcctgggctgatggggatctacgtcgtgttcctgtgctggtcggcgatcagaagcgagccgcacacggaggtctgcaacaggaaggcagaagtcgccacgagcgcagactgggtgaacatcgcgagctttgtgatcgccgtcgtcgtcatcgtggcggcgaccttctcgacggggatcgactccaagtgcctccagttcaagcaggcggagggggagtcggaggaggacgacatcccctacggcctgggcttcttccacctggtgttcgccatgggcgccatgtacttcgccatgatcttcgtcggctggaacgcgagccacaccatggagaggtggacgatcgacgtcgggtgggcgagcacgtgggtgcgcgtcggcaacgagtggctggcggcagtcgtgtacatatggatgatgatcgcgcccgtcatctggaagacgaggcaggtgggatcgtcggcagagacgtgatgacgactgagcagctttcactactgatatgctgacgaacactacccagaatttacatatacatatacagatcgacccgaaagcaaatgaaagggtaaaggacgacaacggggaagatgtgtggtgcgagcaaaatttataactgctatgcatcgccgacaaattaattcgcattcctggatgcacatgcactgctgctcgggtagttttttgctaaagccctgatcggaggagaacgctaatggctaatccgtcttgcatgcagtgaagccgctccactcggttgaggaagcgcatcgatctcgttgtactaaataaaccatctcatctcatctcatctcaaatacacatgcggggtttgtttgtt

SEQ ID NO: 1483 - DNA, 1225 bp, Panicum virgatum
  misc_feature (109)..(109): n is a, c, g, or t
  misc_feature (123)..(124): n is a, c, g, or t
  misc_feature (128)..(129): n is a, c, g, or t
  misc_feature (1064)..(1064): n is a, c, g, or t
  misc_feature (1145)..(1145): n is a, c, g, or t
  misc_feature (1176)..(1176): n is a, c, g, or t
gccgacgaggcgcggtgcggctggcggttcgtggaggactggtgctgcgcctgcgcggggctcctcgccgggcccaacccgatgatggcgcggtacctgtacgcgctcntcttcctcgtcacnnactnntcgcctggaccctccgcgactacggcaactccgccctcgacgagctccagcggctcaaggtctgccagggcgcgcgctactgcctgggagccgagggcgtgctgcgggtcagcctcggctgctttctcttcttcttcgtgatgttcatgtccaccgtgaacacgaggaaggtgcatgagtgccggaactcgtggcactcggagtggtggccggccaaggtcgtcctctggctgggtctcacagtcgtcaccttcctcgcgccgtcgccgctcgtccagctctacgggaaggtcgcgcatttcggagcaggggcgttcctggtgatccagctcatcagcgtgaccaggttcatcatgtggctcaacgactgctgccagtcggaggtcacccggaagagatgccacctgcagattcaggcggtgtccatcgtcacctacgtcgggtcgctgctggggatcgtgctcatgtacgtgtggtacgcgccgagcccggcctgcaagctcaacatcctcttcatcaccgtcacgctggtgctcgtgctgctcatgaccttcgtctccatgagctcaaaggtgaaggcagggtacctggcaccggggctgatgggcatctacgtcgtgttcctgtgctggtcggcaatcagaagtgagcctcacacggagatctgcaacaagaaggcagaagttgccacgagtgcggactgggtgaacatcgcgagctttgtgatcgcggtcatcgtcatcgtggcagcgaccttctcgaccggaatcgactccaagtgcctccagttcaagaaggcagagggggagtcggaggaggacgacatcccctacgggttcggcttcttccacctggtgttcgccatgggcgccatgtacttcgccatgatcttcgtcggctggaacgcgcaccagacaatggagaagtggacgatngacgtcgggtgggcgagcacgtgggtgcgcatcggcaacgagtggctggcggcgatcgtgtacatatggatgatgatcgcncccatcatctggaagacgcggcaggtgggancatcggcggagacatgagctgatgaacaatcaaccactaatgtgacatc

SEQ ID NO: 1484 - DNA, 2813 bp, Sorghum bicolor
atggcaacaaaacacagcgaaacgagcttgagaggtgagagcccacacgcaccaccacccgtcctcggtcctcctctctctctattcccccccctccccggagcgctcgtgcggaccacgacgacgaggaggaggaggaggaggaggagagagagagggagggagccctagccctgccctgcgcgccggcgtcgccagccagggttagggtctccccggggggggcccgccttccttgtccgccgtcttctcgctctggccgatccgcccgcccgacgcgcgggggcgcccagcggcgtgtctgccttcgttcgccctagacgcgagccaatgccgtgtgcctgaccgtcgcatcgctttgggattgattccactcggaggtggccagccagccagccaaccgagctcgctgtccttccttgccggctgctacggcgttttctgaggaggttccgtgcgagatccgggggccggcgagatgcagcacgatcaccgcaagaagagttcggtggaggcagagtttttcacagagtatggggatgcaagtcgatacaagattcaggaagtcattggtaaaggaagctacggggtggtgtgctccgctatagatgtccacactggagagaaagtagcgatcaagaagatacatgacatctttgagcacatatccgatgctgctcggattctccgtgagatcaagcttctgagactcctaagacatccagatattgttgagatcaaacatattatgttgcctccatcaagacgggacttcaaagatatttatgttgtttttgaacttatggagtctgatcttcaccaagttatcaaggctaatgatgacttgacaaaggaacactatcagttctttctctaccaactgctccgtgctctgaaatacatccatacagctaacgtttatcaccgggacctgaagccaaagaatatattagcaaattctaactgcaaactgaaaatttgtgattttggactagcacgagttgcattcaatgataccccaacaacaatcttctggacagattatgttgcaacaagatggtacagagctccagagctctgtggatccttcttttcaaagtatacaccggccattgacatttggagcattggatgcatctttgctgaggtgctaacagggaaacctttgtttcctggtaaaaatgttgtccatcagttagatttgatgactgaccttctaggcacgccatcaatggatacgatttctcgggtccggaatgagaaagcaaggaggtatctaagtagcatgagaaagaaagagacaatttcgttctcacagaagtttcccaatgcagatcctttagccttggatctcttgcaaaggcttttagcatttgatccgaaagaccgtccaactgcagaacaggcattggctcatccatactttaaagggctagccaaggttgagagagagccatcctgtcaaccaatcacaaagatcgagtttgagttcgaacggagaagagtgacaaaagaagacattagggagctgatattccgtgagatattggaatatcatccacaactgctcaaagactatatcaatggcaccgagaggacaacctttctgtacccaagtgctgtcgaccaatttaggaagcaatttgctcatcttgaagaaaatagtggaaacggacctgttattccaatggaaagaaaacatacttctcttcctaggtctactattgttcactcagctccaattccagtcaaggaacaaccccgtatcggcccatctagggaaaggccttcatctgatgagtcctacagaaatcctcgggagacagaaaaatattctggcaatctcccgagaacgtcacaggctccacaaagagtgccaacagcgagaccaggaagggttgttggtccagtaatgccttaccaaaatggagacaccaaagacccctatgacacacgaaggttggcaatgaactcaggatatcctccccaacaacaaatcccacaaacatttggttattatcagacacatggcaaaccagcttgctccgagccatcacaggctgaaaggtacacgctgcatcagcaggcctatgcctgtgcaaaccgtacagctgcatctgatgttgctctggacatgagagcacccccttttcatcatctatcggcagggcaaaaaggtgactcttctgataggctaacagccgagacaaacttgtacacgagatcactcaacggcattgctgctactgcagcaggagtggcagcaactactcacagaaaagtcggtgttgttccatttggcatgtcaagcatgtattagtgaccggatcatggccgagttatggtgaatcctacgtgcctttgttggagctatgctgccttcaggtggctaaacatcgataatgaagcggccaatcaaacctttggctggatgctgccaagtttagagtgcagagcaatacagggttttcctgcgtggtcaggaaaacaggaaccaccatcggcggcgtgaagcgtgtcaacatgtttgttctatttagggcaccagctagtatctgcctgtgcttgagaagtgtgcccttggttgcacactgaagggtactccagcggcttgtaatctgggcaaatttaggcgccaatttcttttctagagcgaggaggcagaagggaaaggaaggaacattaacgttttaaatattgtatagagatgtttctcatatatcaatcaacgtgctacaccagaattacttaagaaagatgcaagatatagcaaaaatttgcttggtatgaatgtttgcagatcgatcttgaac

SEQ ID NO: 1485 - DNA, 2574 bp, Saccharum officinarum
ctctctctattcccccctccccggagcgctcgtgcgaaccacgaggaggaggaggaggagagagagggagggtgccctagccctgccctgcgcgccggcgtcgccagccagggttagggtctcccgggggccccgccttccttgtccgccgtcttctcgctctggccgatccgcccgcccgacgcgcgggggcgcccagcggcgtgtctgcgttcgttcggcctcgacggcgcggcgcgaccgcgagccaatgccgtgtgcctgaccgttcgctttgggattgattccactcggaggtggccagccagctagagccagccgagctcgctgtccttccttgccggtacggcgttttctgaggaggttccgtgcgagatccggaggccggcgagatgcagcacgatcagcgcaagaagagttccgtggaggcagagtttttcacagagtatggggatgcaagtcgatacaagattcaggaagtcattggtaaaggaagctacggggtggtctgctccgctatagatgtccacactggagagaaagtagcgatcaagaagatacatgacatctttgagcacatatccgatgctgctcggattctccgtgaaatcaagcttctgagactcctaagacatccagatattgttgagatcaaacatattatgttgcctccatcaagacgagatttcaaagatatttatgttgtttttgaacttatggagtctgatcttcaccaagttatcaaggctaatgatgacttgacaaaggaacattatcagttctttctctaccaactgctccgtgctctgaaatacatccacacagctaacgtttatcaccgggacctgaagccaaagaatatattagcaaattctaactgcaaactgaaaatttgtgattttggactagcacgagttgcattcaatgataccccaacaacgatcttctggacagattatgttgcaacaagatggtacagagctccagagctctgtggatccttcttttcaaagtatacaccggccattgacatttggagcattggatgcatctttgctgaggtgctaacagggaaacctttgtttcctggtaaaaatgttgtccatcagttagatttgatgactgaccttctaggcacgccatctatggatacgatttctcgggtccggaatgagaaagcaaggaggtatctaagtagcatgagaaagaaagagacaatttcgttctcacagaagtttcccaatgcagatcctttagccttggatcttttgcaaaggcttttagcatttgatccaaaagatcgtccaactgcagaggaggcattggctcatccatactttaaagggctagccaaggttgagagagagccatcctgtcaaccaatcacaaagatggagtttgagttcgaacggagaagagtgacaaaagaagacattagggagctgatattccgtgagatattggaatatcatccacaactgctcaaagactatatcaatggcacggagaggacaacctttctgtacccaagtgctgtcgaccaatttaggaagcaatttgctcatcttgaagaaaatagtggaaacggacctgttattccaatggaaagaaaacatacttctcttccaaggtctactattgttcactcagctccaattcctgtcaaggaacaaccccgtattggcccatctagggaaaggccttcatctgatgagtcctacagaaatccttgggagacagaaaaatattccggcaatctcccgagaacgtcacaggctccacaaagagtgccaacagcgagaccaggaagggttgttggtccagtaatgccttaccagaatggagacaccaaagacccctatgacacacgaaggttggcaatgaactcaggatatcctccccaacaacaaatcccacaaacatttggttattatcagacacatggcaaaccagcttgctccgagccatcacaggctgaaaggtatacgctgcatcagcaggcctatgcctgcgcaaaccgtacagctgtgtctgatgttgctctggacatgagagcacccccttttcatcatctgtcggcagggcaaaaaggtgactcttctgataggctaacagccgagacaaacttgtacacgagatcactcaacggcattgctgctactgcagcaggagtggcagcaactactcacagaaaggtcggtgttgttccgtttggcatgtcaagcatgtattagtgactggatcatggccgagttatggtgaatcctacgtgcctttgctggagctatgctgccttcaggtggctaaacatcacatcgataatgaagcggccaatcaaacctttggctggatgctgccaaagttagagtgcagagcagtacagggttcctgtgtggtcaggaaaacaggaaccgctgtcgccggcatgaagcgtgtcaacatgtttgttctgttaaggcaccagcttgtatctgcctgtgcctgagaagtgcccttggtggcacactgaaagggtaagtcaagcggttgtaatctgggtaatttaagggccaatttttttctaaaacgaagagg

SEQ ID NO: 1486 - DNA, 2703 bp, Saccharum officinarum
  misc_feature (1793)..(1793): n is a, c, g, or t
  misc_feature (2537)..(2537): n is a, c, g, or t
  misc_feature (2572)..(2572): n is a, c, g, or t
  misc_feature (2597)..(2597): n is a, c, g, or t
  misc_feature (2603)..(2603): n is a, c, g, or t
  misc_feature (2698)..(2698): n is a, c, g, or t
accaccacccgtcctcggtcctcctctctctctattcccccctccccggagcgctcgtgcgaaccacgaggaggaggaggaggagagagagggagggtgccctagccctgccctgcgcgccggcgtcgccagccagggttagggtctcccgggggccccgccttccttgtccgccgtcttctcgctctggccgatccgcccgcccgacgcgcgggggcgcccagcggcgtgtctgcgttcgttcggcctcgacggcgcggcgcgaccgcgagccaatgccgtgtgcctgaccgttcgctttgggattgattccactcggaggtggccagccagctagagccagccgagctcgctgtccttccttgccggtacggcgttttctgaggaggttccgtgcgagatccggaggccggcgagatgcagcacgatcagcgcaagaagagttccgtggaggcagagtttttcacagagtatggggatgcaagtcgatacaagattcaggaagtcattggtaaaggaagctacggggtggtctgctccgctatagatgtccacactggagagaaagtagcgatcaagaagatacatgacatctttgagcacatatccgatgctgctcggattctccgtgaaatcaagcttctgagactcctaagacatccagatattgttgagatcaaacatattatgttgcctccatcaagacgagatttcaaagatatttatgttgtttttgaacttatggagtctgatcttcaccaagttatcaaggctaatgatgacttgacaaaggaacattatcagttctttctctaccaactgctccgtgctctgaaatacatccacacagctaacgtttatcaccgggacctgaagccaaagaatatattagcaaattctaactgcaaactgaaaatttgtgattttggactagcacgagttgcattcaatgataccccaacaacgatcttctggacagattatgttgcaacaagatggtacagagctccagagctctgtggatccttcttttcaaagtatacaccggccattgacatttggagcattggatgcatctttgctgaggtgctaacagggaaacctttgtttcctggtaaaaatgttgtccatcagttagatttgatgactgaccttctaggcacgccatctatggatacgatttctcgggtccggaatgagaaagcaaggaggtatctaagtagcatgagaaagaaagagacaatttcgttctcacagaagtttcccaatgcagatcctttagccttggatcttttgcaaaggcttttagcatttgatccaaaagatcgtccaactgcagaggaggcattggctcatccatactttaaagggctagccaaggttgagagagagccatcctgtcaaccaatcacaaagatggagtttgagttcgaacggagaagagtgacaaaagaagacattagggagctgatattccgtgagatattggaatatcatccacaactgctcaaagactatatcaatggcacggagaggacaacctttctgtacccaagtgctgtcgaccaatttaggaagcaatttgctcatcttgaagaaaatagtggaaacggacctgttattccaatggaaagaaaacatacttctcttccaaggtctactattgttcactcagctccaattcctgtcaaggaacaaccccgtattggcccatctagggaaaggccttcatctgatgagtcctacagaaatccttgggagacagaaaaatattccggcaatctcccgagaangtcacaggctccacaaagagtgccaacagcgagaccaggaagggttgttggtccagtaatgccttaccaaaatggagacaccaaagacccctatgacacacgaaggttggcaatgaactcaggatatcctccccaacaacaaatcccacaaacatttggttattatcagacacatggcaaaccagcttgctccgagccatcacaggctgaaaggtatacgctgcatcagcaggcctatgcctgcgcaaaccgtacagctgtgtctgatgttgctctggacatgagagcacccccttttcatcatctgtcggcagggcaaaaaggtgactcttctgataggctaacagccgagacaaacttgtacacgagatcactcaacggcattgctgctactgcagcaggagtggcagcaactactcacagaaaggtcggtgttgttccgtttggcatgtcaagcatgtattagtgactggatcatggccgagttatggtgaatcctacgtgcctttgctggagctatgctgccttcaggtggctaaacatcacatcgataatgaagcggccaatcaaacctttggctggatgctgccaagtttagagtgcagagcagtacagggttcctgtgtggtcaggaaaacaggaaccactgtcgccggcatgaagcgtgtcaacatgtttgttctatttagggcaccagcttgtatctgcctgtgcctgagaagtgcccttggtggcacactgaangggtagtccagcggcttgtaatctgggtaatttangcgccaatttcttttctagagcgangaggcngaagggaaaggaaggaacattaacgttttaaatgttgtatagagatgtttctcaaatatcaatgtgctacatcagaatcacttcagaaagatacnaagat

SEQ ID NO: 1487 - DNA, 2659 bp, Panicum virgatum
cttctctctcattccccctccccggaacgctcgcgcggacccacgaggaggaggaggaggaggaggaggaagaggagaagagggagagggagggagccctagccctgccctgcgcgccggcgtcgccagggttagggtctcccccgcgttccttgcgccaccccttcgccggctccccgctctggccgatcccgcccacccgagcgcccagcggtgcgcgcgccgacccggactccgcggcgcggcgcggcgccggccaatgccgcgtgcctgaccctctttttggggattccttccgttcggagctggcggcccgttaccgcctgtcacaggagctttgcggcgagatccggcggccggcgagatgcagcacgatcagcggaagaagagttctgcggaggctgaatttttcaccgagtatggggacgcgagtcgatacaagattcaggaagtcattggtaagggaagctacggggtagtatgctctgcaatagatgtgcacacaggagagaaagtagcgatcaagaagatacatgacatctttgagcacatatccgatgctgctcggattcttcgcgagatcaagcttctgagactcctaagacatccggacattgttgagatcaaacatattatgttgcctccatcaagaagggacttcaaagatatttatgttgttttcgaacttatggagtctgatcttcaccaagttatcaaggctaatgatgacttgacaaaggaacattatcagttcttcctctaccaattgctccgtgctctgaaatacattcacacagctaatgtttatcatcgggacttgaagccaaagaatatattagcaaattctaactgcaaactgaaaatttgtgattttggactagcacgagttgcatttaatgataccccaacaacgatcttctggacggattatgttgcaacgagatggtacagagctccggagctctgtggatccttctactcaaagtatacgacagccattgatgtttggagcattggttgcatctttgctgaggtgttaacaggaaagcctttgtttcctggtaaaaatgttgtccaccagttagatcttatgactgatcttctaggcacgccatcaatggatacaatttctcgggtccggaatgagaaagcaaggaggtatctaagcagcatgagaaagaaagatccaatcccattctcgcagaagtttcccaatgcagatcctttagcattggatcttttacaaaggcttttagcatttgatccaaaagaccgtccaactgcagaacaggcactggctcatccatactttaaagggctagccaaggttgagcgagaaccatcctgtcaaccaatcacaaagatggagtttgagtttgagcgtagaagagtgacaaaagaagacataagggagctgatattccgtgagatattggaatatcacccacaattgctcaaagactacatcaacggcacagagaggacaacctttctgtatccgagtgctgtcgaccaatttaggaagcaatttgctcatcttgaagaaaatagcggaagtggccccgtgattccaatggaaagaaaacatacttctcttcctaggtctactattgttcactctgctccaattcccgtcaaggaacaacctcgtatcggcccatctagggaaaaacattcatctgatgagtcttacaaaaatcctcgggagacagaaaaatattccggcaatgttcctagaacctcacaggctccacaaagagtgccaacagcgagaccaggaagggttgttggtccagtaatgccttacgagaatggtaacaccaaggatccatatgacgcacgaaggttggcaatgaactcaggataccctccgcaacaacatatcccacaaacatacggttattatcaggcacctggcaagccagcttgctctgagccgtcgcaggctgaaaggtacacgctgcatcagcaggcctacagcacaactgtgtctgatgttgctctggacatgagagcacccccttttcaccatctatcggcagggccgaaaagtgactcttctgataggctaacagcagaaacgaacttgtactcgagatcggtcaatgggatcgctgctactgctgctggagtggcagcaagtgctcacagaaaggttggcgttgttcctttcggcatgtcaaggatgtattagtggctgaatcatcgcgaatcctgcatgccttgatggaactctgctggcctatggtggcacgacactgagaatgaagtggcaagcaaaccttggctgggtgccatgaggtttagagtgcagagcgatccaaggttgactgatctgtaaggtcaggaaacaccatcggcggcatcgaagcatatcaaaatttctgtttaggccatcaacttgtacctgcctggcttgagtagtgtaccctttggttgcacacagaagaagtaaagaagcggggtagtccaacggcttgtaatctgggcaattaggcgccaatttgttttctagagcgaggagaaagaagggaaaggaaggaacgctaacgtttttatatgttgtatagagatgtttctcatatatcaatgtgctacatcagaatgacttcagaaagatacacgagatatagcgaaaatttgcttggtttagtagcta

SEQ ID NO: 1488 - DNA, 2798 bp, Oryza sativa
gagaaaagaaagcgcaccggccacctccaccctctctctctctctcctcccgtgcttctctctcttattcctctctctctctctctcttgagggctcgcgcagagcgaaggcgagaggaggaggaagaggaggagagggagccctagccctgcccccagccggcgcaggcggtcgctagggttagggtctccccccgcccgcgccttccttccttccggccttttcccgtcccctcacctgcggcgtgtgcgcttttctcggcctcgcggcggcgcggcgcggcgcgagccaatgccgtgtgtctgagtctgacccgttgattcttggcggattgatctggaggtgggcttgttggggttgctgtggtagccgggagggaggggaagcggcggcgtttgtttctgaggatatttttggtgcgagatccggcggggcggcgagatgcagcaggatcagcgcaagaagagttctacagaggcggattttttcacggagtatggcgatgcaagtcgatacaagattcaggaagttattggtaagggaagctatggggtggtgtgctcagcgatagatgtccacactggagagaaagtggcaatcaagaagatacacgatatctttgaacacatatctgatgctgcacggattctccgtgagatcaagcttctgaggctgctaagacatcctgacatagttgagatcaagcacattatgttgcctccatcgaggagggatttcaaagatatttatgtagtttttgagcttatggagtctgatcttcaccaagttataaaggctaatgatgacttgacgaaggagcattatcagttctttctttaccaactactccgggctctgaaatacattcacactgctaatgtttatcaccgggacctgaagccgaagaatatattagctaattccaactgcaaactgaaaatttgtgattttggactggcgcgagttgcattcaatgatactccgacaacaatcttttggacggattatgttgcaacaagatggtacagggctccagagctctgtggatccttcttttcaaagtatacaccagccattgacatttggagcattggatgcatctttgctgaggtgctgacaggaaagcctttatttcctggtaaaaatgttgtccatcaattagatttgatgactgatcttctgggcacgccatccatggatacaatttctcgggtccggaatgacaaagcaaggaggtatctgagtagcatgagaaagaaggagccaatcctattttcgcagaagtttcctagtgcagatcctttggcgttggatcttctacaaaaactattagcattcgatccaaaggaccgtccaactgccgaagaggcattggctcatccatacttcaaagggctcgcaaaagttgagagagaaccatcctgtcaacctatcacaaaaatggagtttgagtttgagcgtagaagagtgacaaaggaagatataagagagttgatattccgtgaaatactggaataccatccacaattgctcaaagactatatcaatggcaccgagagaacaacctttctatacccaagtgctgttgatcaatttagaaagcaatttgcccatcttgaagaaaatggtggaaatggcccggtaattccaatggatagaaagcacacttctcttcccaggtctactattgttcactcaactccaattcctgccaaggaacagccccgcattggcccatcaagggataaaccatctgatgaaccctatagcaatccccgggaatttgacagattttctggcaatgccccgaggacctcacaagctccacaaagagtgccaacagcaagaccaggaagagttgttggtccagtattgccttatgaaaatggtgccacaaaggattcctatgacgcacggagattggcaatgaactcagggtatcctccccagcaacaaatccctcaagcttatggttattatcagatacccggtaagtcagcttgttctgagctgtcgcaggccgaaaggtatacgctgcaccagcaggcctacacttgcgcaaacagtgccactgtgactgatgttgctctggacatgagagcacccccgttccatctatcaggagggccgaaaagcgattcgtccgaaaggttagcagcagagacaaacctatacacgagatctctcaatggcctcgctgctactgctgcgggagtggcagcaagtgcgcacagaaaggtcggtgttgttccctacggcatgtcgaggatgtattagtgcccaaccatggcacatcctgcatgcccaatgggagctctgatgctagcttgcggcgaagcattgggaacaaagtggcagttcaagctagtttgggcaccaagagcacagggcaatccaaggttgacgacgatgcctaagaagttgcattggtgccctgctgctcctgttcctgcttgatcaggaaccaccaccggaggtgtcaaaagcttttcaactctctattcgctttaggcaaatcagcttgtatctgcctgtgtgtgtgtaagaaaatgtgcccttcgttgcacacttgaagggggtagtccagtggcttgtaatctgagcatattttaggcgccaattgtatttctagggtgaggggacaaaagggaaaggaaggaccactaaccttttcctcttttttttttctttttccaatgttgtatagagatgtttctcatatcaaaagtgctacatcagaatgacttgagaaagatataaagcagacaattgcgcggtttaccgtagcttcatatta

(The sequence listing continues in the following parts.)

What is claimed is:

1. A method of increasing a trait in a plant as compared to a native plant, wherein the trait is selected from the group consisting of: seed weight, harvest index, biomass, rosette area, rosette diameter, root length, growth rate of leaf number, growth rate of rosette diameter and growth rate of leaf area, the method comprising:
   (a) expressing within the plant a heterologous polynucleotide comprising a nucleic acid sequence encoding the polypeptide set forth in SEQ ID NO: 660, and subsequently;
   (b) selecting the plant resultant from step (a) for an increased trait as compared to a native plant, said trait is selected from the group consisting of: seed weight, harvest index, biomass, rosette area, rosette diameter, root length, growth rate of leaf number, growth rate of rosette diameter and growth rate of leaf area,
   thereby increasing the trait in the plant.

2. The method of claim 1, wherein said heterologous polynucleotide comprising the nucleic acid sequence is selected from the group consisting of SEQ ID NOs: 456 and 180.

3. The method of claim 1, wherein said nucleic acid sequence is set forth in SEQ ID NO: 456.

4. The method of claim 1, further comprising growing the plant expressing said heterologous polynucleotide under nitrogen-limiting conditions.

* * * * *